United States Patent 7,750,207 (ZEA MAYS RIBULOSE BISPHOSPHATE CARBOXYLASE ACTIVASE PROMOTER) - sequence listing, part 2

SEQ ID NO: 1419 - DNA, 1168 bp, Zea mays
aaaaaaaacctttcgatccgtggtgtgttggatctgaacccaagctccgagtcgctttcggggtgggcattctcctcttcgtcttcggttgcaagaaagaaaaaggtcacccctctaacaccacgccgccgccgtttgctgctcggcgcctctcctcacaacccgtacgccaacgtctccaatctcgtatactttcgtgctcagcatcatggacggcttccccaagagcgtcggcggtggcggccctaacattccggcgggatcccaccccgcaggcgggagccaggcggcggcaggaggaggcgcgacgcagcggacgcagtatccgtatgtgactggtaattcagtcattgccttgaaatacaaggatggtgtgatcatggcatgtgacactggagcctcttatggatcaactttgagatacaagagtgtggaacgcattaaggcagttggcaagcatagcatcattggagcaagcggagagttcagtgacttccaggagattttgcgctatttggatgaactaactctgtctgatcatatgtgggatgatggaaactcgctgggccccaaagagatccacagctatttgacaagagtgatgtacaaccggcgcaacaagtttgatcctctctggaactcacttgtacttggtggggtgaaaaagggtccaaagggtgatgagaagtatcttgggatggttaacatgattggtacccacttcgaggaaaaccatgtcgctactggatttggaaatcatatggcaatcccgatactccgtgctgaatggcgcgaggatatgacttttgaagaagctgttaagctggttgagaagtgcttggtggtcttgctgtaccgagacagatcatctatcaacaaattccagattgccaagatcacaagtgaaggatcaaccatctacccaccatattccttgaagacctactggggcttcactcacttcgaaaacccagcccagggcgctgtgggatcatggtagatttatgctctgcatgccgcgtatcatgccatgaacttaggggagagcaatctgtgctgctgaaatcaaaacccttgtgaacgtttgttctgaacataactggaactctgcatttgcttgtatgacatgcgtatggttcaggaagtttaattccaatatttggtcact

SEQ ID NO: 1420 - DNA, 1304 bp, Zea mays
  misc_feature (1243)..(1254): n is a, c, g, or t
  misc_feature (1256)..(1261): n is a, c, g, or t
  misc_feature (1280)..(1281): n is a, c, g, or t
ttaatcggtcctaatcgatctggcacattgttagtactcctgctacgtactatgtttctagtagcccacaagatctagcccagtccaaacctttcgatccgtggtgtgttggatctgaacccaagctccgagtcgctttcggggtgggcattctcctcttcgtcttcggttgcaagaaagaaaaagcatcatggacggcttccccaagagcgtcggcggtggcggccctaacattccggcgggatcccaccccgcaggcgggagccaggcggcggcaggaggaggcgcgacgcagcggacgcagtatccgtatgtgactggtaattcagtcattgccttgaaatacaaggatggtgtgatcatggcatgtgacactggagcctcttatggatcaactttgagatacaagagtgtggaacgcattaaggcagttggcaagcatagcatcattggagcaagcggagagttcagtgacttccaggagattttgcgctatttggatgaactaactctgtctgatcatatgtgggatgatggaaactcgctgggccccaaagagatccacagctatttgacaagagtgatgtacaaccggcgcaacaagtttgatcctctctggaactcacttgtacttggtggggtgaaaaagggtccaaagggtgatgagaagtatcttgggatggttaacatgattggtacccacttcgaggaaaaccatgtcgctactggatttggaaatcatatggcaatcccgatactccgtgctgaatggcgcgatgatatgacttttgaagaagctgttaagctggttgagaagtgcttggtggtcttgctgtaccgagacagatcatctatcaacaaattccagattgccaagatcacaagtgaaggatcaaccatctacccaccatattccttgaagacctactggggcttcactcacttcgaaaacccagcccagggcgctgtgggatcatggtagatttatgctctgcatgccgcgtatcatgccatgaacttaggggagagcaatctgtgctgctgaaatcaaaacccttgtgaacgtttgttctgaacataactggaactctgcatttgcttgtatgacatgcgtatggttcaggaagtttaattccaatatttggtcactaaaaatggattgtgcggttgtgttctcggggcccggttctgtgttgattgtgctatgtggagaacttggaatgctaactctgttttttttttnnnnnnnnnnnntnnnnnnttttttttttttttttttnnttttttttttttttttttttttt

SEQ ID NO: 1421 - DNA, 1203 bp, Zea mays
gcacgaggcgctctcctcttcggcttcggttgcaagaaagaaaaaggtcacctcttaacaccaggccgccgccattgctgctccctttgttcgtttctcggcaccctcgatcccgagcgcggttaacccacgcatcgaccggcgaacgccaccgtctcccatcgagatctctcccatctagaatacctccgtgctcagcgtcatggacggcttctccaaaacgatcggcggcagtggccctaacgttccggcgggatcccaccccgcgggcgggagccaggcggcggcagggggaggcgcgacgcagcggacgcagtatccgtatgtgactggtacttcagtcattgccttgaaatacaaggatggtgtgatcatggcatgtgacactggagcatcctatggatcaactttgagatacaagagtgtggaacgcattaaggctgttggcaagcatagcatcattggagcaagcggagagttcagcgatttccaggagatcctgcgctatctggatgaactaactctttctgatcatatgtgggatgatggaaattctctgggccccaaagagatccacagttatttgacaagagtgatgtacaacagacgcaacaagtttgatcctctctggaactcacttgtacttggtggagtgaaaaagggtccaaagggtgatgagaagtatcttggcatggttaatatgattggtacccacttcgaggaaaaccatgtcgcaactggatttgcaaatcatctggcgatcccgatactccgtgctgaatggcgcgaggatatgacttttgaagaagctgttaagctggttgagaagtgcttgctggtcttgctgtaccgtgacaggtcatctatcaacaaattccagattgccaagatcacaactgaaggatcaaccatctacccaccatattccttgaagacctactggggcttctctcactttgaaaacccagcccagggcgctgtgggatcatggtagattaatgcgccgcgcacgccgcatatcatgccatgaacttagttgaggccaatctgtgctgctgaaatcaaacacttatgaacgtttgttctgaacatcactggaactctccatttgcttgtatgacatgcttatggttcagcgagtttaattccaacgtttgatcaaaaaaagtgaataaaaaacctggggcggcctcttgcgccctc

SEQ ID NO: 1422 - DNA, 3154 bp, Zea mays
cgctctattttggggagattttgcaacctctccctgactgcgccatttttttttctcgcctccaccaacgtcagctctccagtcaccagttggacaagcgggacgggacaacatcctcaccagccgcggccctccactcctccccgcagccctcgaccctcgtcagcctctccagttcacctcgccgtctccgtcatgccccgcgagggtttggggaattttggagcggaggaggaggcgagggatggtggacaggaaggtttggttacggaaatggatgtggaggaatcctcgccgtcttcgtcgccgatgtcgtctccggccgggtcgtcagattccatagacctcaacttcctgccgtttctcaagagggagcccaaatcggagccgtcgtcaccagagctcgggcccctgccgctgcctgtctccctcacccagacgccgccgcagcagcatgcagcggcggcggctccagcaactgaggcctcggtgcctccgcctccggcgactcctgacctctcgtccgcgtcgatgatgaccccgctgcagtcgctgccgcctaacccagacgaggactcgctccttcgggagtactaccgccttgcgagactatatctctcgtctgcggggtccggggcgatcgtcccgacaccggcaccggaggcggccgcaccggcggtggtacagtccggggccgggtccgtcgtgaaaaagcgccggccgcggtcatcggagctcgtgcgggtctcctcgctcggtgtgcaggatcagatctacttccgcgacctcgtgcgccgggcgcgcatcactttcgagtgcctccgcgggctgctactcagggacgacgagcgtgctgagtccctcggcctcgctggtgccgccgggtttggcgttgccagggaccggcgccgcgcccgcgcagacatgcgtgccgcagcgctcatggcagaccacgacctctggctcaatcgcgaccgccgcatcgtggggccgatgcctgggatctcggttggtgacgctttcttcttccgcatggagctctgcgtgcttggcctccatggccaggtacaggcaggaattgattatgtcagtgcagggaggtcggcctctggggagcctatagccacatctataattgtatctggtgggtatgaggatgatgacgatcatggcgacgtacttgtgtacactgggcatggcggccgggatcccaacctccacaagcattgcgtcgatcagaagctggagggtggcaatcttgccctcgagcgcagcatggcttatggtattgagattcgtgtaatccgtgccgtcaaatcaagacgaagccctattggtaaggtatacttctatgatggcctctacaaagttgttgactactggctcgaccgtgggaaatctgggtttggtgtttataagtataaaatgctgcgcattgagggccaagaacccatgggtactgtgaattatcgagcagctgaacaacttaaggtggatgtgtttgctgtaaggccaacaggttatttcagctttgatatctccatgggccgagagaccttgccagttgcactctataatgatgttgacgatgatcaggacccactcttatttgagtatctaacacggccaatttttcctacctctgctgtccaggggaaatttgctgagggtggtggtggtggtggttgtgattgtgctgagatttgctcaattggatgtaactgtgcaggaaggaatggtggcgagtttgcatataataagactggaaccctgctacgaggcaagccactagtatatgagtgtgggccatattgcaggtgcccacctagttgtcctaacagggttagtcagaaggggcttcaacataggcttgaggtattccggtcaagggagactgggtggggagttcgttctttggatctcattaaggctggcacattcatttgtgagttcagtgggattgtccttactcaccagcagtcagaggtcatggcagcgaatggtgattgcttggtgcgtccaaataggttccctccaaggtggttggattggggtgatatatctgatgtgtaccctgattatgtggcgccagaccatcctgttattcctgagttaaactttgcaattgacgtgtcaagggcaaggaatgtggcatgctatttcagccacagttgcagtccaaacgtgtttatccagtttgtgctgtttgatcattacaatgtgtcttacccccacctaatgatctttgccatggaaaacattccaccattgagggaactaagcatcgactatgggatggttgatgaatggactggacaattaaccatgtagctggagtaacctatttaaaaggcagtgttctctttctttcttttccctttatttttggaattctcataatgcttcacctggggatcatcaagccaactggactaaaattcctcagctgaaacttgcatgaggatgaccaagctacaactcattgtcatctacacttttacagtacatcagccatccattgtatatgttgcctgataacctaggtgcctcggccaattttctagatgaactcgcttttgaggtataacatgcaatgttgctgtaggaagcttgtttgatgtgtctggttaattttaaccttcgtgttatgagttgtcactgctggaactcattttgtacatatatctgcagattatctagctggaagcgtgtccacttttgttggaaaatgttgatccctatgttgtaaagttatttgcactccttgtgcaattgaagattcactctctggctgtgggtagaatctagctgtagaaagagtctaagtatcatgtgaattacgtgctgaggaagataaagttcagacggtttaggatttagacagtcatgtatttctactatcgcgatgacttgaccgattctgtgtctatgtttattttggatgatttttactaaagtaattctcatagaaatgggatgagaagttaggcgtttagtagtttgcaccaccttttggtagctagaagatgaaaaaagttaaaacaaacaaaaaaaaaaaaaaaaaaaaaaaaaaaaaaaaaaaaaaaaaaaaaaaaaataaaatacaatattaagggctgtccacgtatatgagtctcgggctcccgagaattaa

SEQ ID NO: 1423 - DNA, 1575 bp, Zea mays
  misc_feature (4)..(4): n is a, c, g, or t
tacntagaacatcctaatcaaaagaaccagcacgccggtcctcctgatggccgccgccggcgagggcgaggctgagcgtgtgtcagcgctgctgcggggaaataacgggggagggcgggttcgctttcgtcgcctcggcggataaggcgggggcgggggacctgcgcgcggcggaggcggcgcgggagatggcgtgggagcagctccactcgggcccctggagcgaggtcggcaccgcctggagggacgcctacgcgctcgcctgcctcaacgtcgcgcggctccgcacccacgcggccagcggcggagatagcgaccgctccgccgcgctccgggcactcgacatggggctcatcatgggaggcaacctactgcgcgccgacctcgaggcggcactggcgcgcatctccgcggaagcgtgtggcggaagcgaaggtggcgagggggtcgtggataaggaggaccagaggtggagggaagcgctcgacaggaaccgagacatcgctgatgcactgaaaattcttccagcgaactctttatcctgtaagaaagttgagaggcgatcatgcatttccttggaggagttcatatgtaattactttttgcgcgacacccccgtcataattagtggcaccatcgaccattggcctgcaaggacaaaatggaaggacattgagtacctcaagaaggttgctggagatcgtactgttcctgttgaagttggaaagaattacgtgtgtagtgagtggaagcaggagcttatcacattttctcagttcctggatagaatgtcgtcaactgtctgtccatcaaacttgacatatctggctcagcatccattgtttgagcagataaaagagctcagtgaagacataattgttcccgaatactgttacgctggtggaggtgaactccaatcacttaatgcttggtttggtccagagggtacagtgacaccattgcaccatgatccgcatcacaacatcttagctcaggtattgggcaggaagtatattagactctatcctgctttcatagctgaggacttgtatccacacacagagactatgttaagcaataccagtcaggtagatgttgacaatattgatttgaaggagtttccaagggttgaaaacctggaattcattgactgtatattggaggagggcgacctgctttacatccccccaaaatggtggcactacgtcagatctctctccaccagtttctcggttagcttttggtggcgtgcagcagttcaaccttcaggaggctcatagcgtcaatttcatgtttcccatattatcaaaaccagattgcagaaaaccaaagtaacctgacaggaccctttgtttcaggtgactccgcttttgaatggatgtacacacgtcatcaccaatgtccattgttagttttacttttaccacagtgattaaaatattgaaattgcttatatgccgaccatcatgctatcatgtgattcttgaaagcagaggttgaaggatgtcttcactgctacaatgtcaaattcttgaaattgtaaaggtggacttactagctccgagaatttaattt

SEQ ID NO: 1424 - DNA, 705 bp, Zea mays
gcacgagaccattacctagaacatcctaatcaaaatcattacaatgtgtcttacccccacctaatgatctttgccatggaaaacattccaccattgagggaactaagcatcgactatgggatggttgatgaatggactggacaattaaccatgtagctggagtaacctatttaaaaggcagtgttctctttctttcttttccctttatttttggaattctcataatgcttcacctggggatcatcaagccaactggactaaaattcctcagctgaaacttgcatgaggatgaccaagctacaactcattgtcatctacacttctacagtacatcagccatccattgtatatgttgcctgataacctaggtgcctcggccaattttctagatgaactcgcttttgagattatctagctggaagcgtgtccacttttgttggaaaatgttgatccatatgttgtaaagttatttgcactccttgtgcaattgaagattcactctctggctgtgggtagaatctggcatgtagaaagagtctaagtatcatgtgaattacgtgctgaggaagataaagttcagacggtttaggatttagacagtcatgtatttctactatcgcgatgacttgaccgattctgtgtctatgtttattttggatgatttttactaaagtaattctcataggaaaaaaaaaaaaaaaaaat

SEQ ID NO: 1425 - DNA, 3680 bp, Zea mays
  misc_feature (45)..(45): n is a, c, g, or t
tgcttttgtcaatatttgtctgagacttttgttaatattagaagngcagtacatgaattaaccaaaaccattgttttgtttattatgatctgaacaactcattttatatatggagctcgtggcaatggcagccccgcaaaaggatgatggaactcatggcgttgagtggtggcgtgcttaggctcgtgatcctctgcaacgaggcactgtttcccacgagcgttcccatcaccattgcagtcacgccacacgtcgctaggccttgagcggttggaggctcgtcaatttgtctttcgtcgcaacgcacgggtatatacctagtcactatataactattcgatatgacttgtttaattttttaatacatatatagacaaacaattgtcagtggattgtcgtgctagcaacttttaagccagatattagctgtagcgcattcaacgcaccgccgatgataatattcatatcagattaaccctgcacgggtcccgagctactactaatcataataaatgccgtttttatacggaataccagaccagttgtccgagggcctgcttgccaagttgtcagtaactgtggagagcacgagaaagtggggcatctactttttttagactactgctctcggcctcctctccgctccattttcgcaattccttcgagctccgctccggtgaagggcgctccattttggagatttcgcaacctctgcctcgttctgccatttttttttcttgcctgcaccaacgtcatctaaccagtcattagttggtgaaatcctccactcccctgcagaccacgtcagccttcaccttgccgtctccgttacgcgccgcgagcccgcgagcgtttggggagttttggagcggaggaggcaagggaggacggacagggaagtttggttgtggaaatggatgtggtggaatcctcgccgtcgtcgtcgccgatatcgtctccggccgggtcttcggagtccatagacctcaacttcctgccgttcctcaagagggagcccaagtcggagcccgcgtcaccagagctcgggcccctgccgctgcctgcgcccccaacccagacgccccagcagcagcatgcagcggctccggctcctgaggccacggcgcctctgtcgccagcgactcctgacctctcgtccgctccggtgatggcgccgctgcagtcgctgccgcctaacctggacgaggacgcgctccttcgggagtactaccgcctcgcgggcctctacctctcgtctgcgaggtccggggcgatcatcccagcgctagctccggaggcggccgcaccggcggtggtgcagtcggggtccgggtctgtcgtgaagaagcgccggccgcgttcgtcggacctcgtgcgggtctcctcgctcggcgtgcaggaccagatctacttccgcgacctcgtgcgcagggcgcgcatcactttcgaatgcctccgcgggcttctactcagggacgacgagcgcgccgagtccctcggccttgcggccgtcgccgggttcggcgttgccagggaccggcgccgcgtccgcgcggacctgcgtgccgcagcgctcatgggggaccacgacctctggctcaatcgcgaccgccgcatcgtcgggccgatgcccgggatctcggtgggtgacgctttcttcttccgcatggagctttgcgtgcttggactccatggccaggtgcaggccggaattgattatgtcagtgcagggaggtctgcatctggggagcctatagccacatctataattgtatctggtgggtatgaggatgatgatgatcacggcgatgtacttgcggctcgagggcatggcggccgtgatcccaacctccacaagcattgcgtcgatcagaagctggagggcggcaatcttgccctcgagcgcagcatggcttatggtattgagattcgtgtaatccgtgctgtcaagtcaagacgaagccctgttggtaaggtttacttctacgatggcctctacaaggttgttgactactggctcgaccgtgggaaatctgggtttggtgtttataagtatagactgctgcggattgagggccaagaacccatgggtagtgtgaattatcgagtagctgaacagcttaaggtggatgtgtttgctataaggccaacagggtatttgagctttgatatctccatgggccgtgataccttgtcagttgcactcttcaatgatgttgatgatgatcaggacccactcttattcgaatatctggcacgtccaatatttcctacctctgctgtccaggggaagtttgctgaaggtggtggtggtggttgtgattgtgctgagatttgctcaattggatgtaactgtgcagggaggaatggtggcgagtttgcatatgataggactggaaccctgctacgaggcaagccactggtatatgagtgtgggccatactgcagatgcccacctagttgccccaacagggttagtcagaaggggcttcaacataggcttgaggtattccggtcaagggagactgggtggggagttcggtctttggatctcattaaggctggcacattcatttgtgagttcagcgggattatccttactcaccagcagtcagaggttgtggcagcaaacggcgattgcttggtgcgtccaagtaggtttcctccaaggtggttggattggggtgatatatctgatgtctaccctgattatgtggcgccagaccatccttctattcctgagttaaaatttgcaattgatgtgtcaagggcaaggaatgtggcatgctatttcagccacagttgcagtccaaacgtgtttgtccagtttgtgctgtttgatcattacaatgtgtcttacccccacctcatgatctttgccatggaaaacattccaccgttgagggagctaagcattgactatgggatggttgacgaatggattggacagttaactatgtagctggagtatctatttagaaggcagtaatctccttcttttacctttatttttggagttttcattatgcttcactttgggaccatcaagccaactgctggctaaaattcctcagctggtaattgtccttattcttcatatgctattttttgggtacttcataggactttcttggcagtaggtgctcataattttccttaaaggttgctttgtgtatgtcactgagtttcatgtgtactttaaattttatattttgctatactgtatacttctgcgcagatctagactaattatactatctagctatcctcctaatttctctacctcattgctgattcagtgctttggttaaataaatctatactgtagttgcagaagaggttgtatgtcacccatttggtaaaccgtatagtgcacatgatcctcagctgtggcccatggcccttactagttatgtctatacactgcatcctaggaaaatctaaatagtcactttattctttttccagtaaggaagatgatgattttattgcataaccattaggtgaccatctctagtccatttccatgttggtcaacatctctgttttgtggtgaataggacagcagtagcagtggacagcagcagcagcagcaacagtcttttgactgctgtaggacagcagcagcagcagtcttttgactgcactttattatctagagaacaacacctgtgtgctgc

SEQ ID NO: 1426 - DNA, 2193 bp, Zea mays
tccgtcgtgaaaaagcgccggccgcggtcatcggagctcgtgcgggtctcctcgctcggtgtgcaggatcagatctacttccgcgacctcgtgcgccgggcgcgcatcactttcgagtgcccccgcgggctgctactcagggacgacgagcgtgctgagtccctcggcctcgcgggtgccgccgggttcggcgttgccagggaccggcgccgcgcccgcgcagacatgcgtgccgcagcgctcatggcagaccacgacctctggctcaatcgcgaccgccgcatcgtggggccgatgcctgggatctcggttggtgacgctttcttcttccgcatggagctctgcgtgcttggcctccatggccaggtacaggcaggaattgattatgtcagtgcagggaggtcggcctctggggagcctatagccacatctataattgtatctggtgggtatgaggatgatgacgatcatggcgacgtacttgtgtacactgggcatggcggccgtgatcccaacctccacaagcattgcgtcgatcaaaagctggagggtggcaatcttgccctcgagcgcagcatggcttatggtattgagattcgtgtaatccgtgccgtcaaatcaagacgaagccctattggtaaggtatacttctacgatggcctctacaaggttgttgactactggctcgaccgtgggaaatctgggtttggtgtttataagtatagactgctgcggattgagtgccaagaacccatgggtagtgtgaattatcgagtagctgaacagcttaaggtggatgtgtttgctataaggccaacagggtatttgagctttgatatctccatgggccgtgataccttgtcagttgcactcttcaatgatgttgatgatgatcaggacccactcttattcgaatatctggcacgtccaatatttcctacctctgctgtccaggggaagtttgctgaaggtggtggtggtggttgtgattgtgctgagatttgctcaattggatgtaactgtgcagggaggaatggtggcgagtttgcatatgataggactggaaccctgctacgaggcaagccactggtatatgagtgtgggccatactgcagatgcccacctagttgccccaacagggttagtcagaaggggcttcaacataggcttgaggtattccggtcaagggagactgggtggggagttcggtctttggatctcattaaggctggcacattcatttgtgagttcagcgggattatccttactcaccagcagtcagaggttgtggcagcaaacggcgattgcttggtgcgtccaagtaggtttcctccaaggtggttggattggggtgatatatctgatgtctaccctgattatgtggcgccagaccatccttctattcctgagttaaaatttgcaattgatgtgtcaagggcaaggaatgtggcatgctatttcagccacagttgcagtccaaacgtgtttgtccagtttgtgctgtttgatcattacaatgtgtcttacccccacctcatgatctttgccatgaaaaacattccaccgttgagggagctaagcattgactatgggatggttgacgaatggattggacagttaactatgtagctggagtatctatttagaaggcagtaatctccttcttttacctttatttttgaagttttcattatgcttcactttgggaccatcaagccaactgctggctaaaattcctcagctgtccagcagtggaggtttccaactagcataatgttcctctggcgttgaaagaggcttgcataaggtgaccaagctatcatcaacagaacatcagccgttcattgtatatgttgcctgataacctaggtgccttagccaattttctagatgatctcgcttttgaagtataatgtgtgctgctgtaggaagcttgtttggcgtggctggcgctgagtttcagccttaaccttcgtgttatgagttgtcgctgttggaactcattttctgtacatatatctgtaaattatctagctggaaatgtgcccgcttctgttgggaaatgttggtccatatgtggcaaagttatttggataccttgtggaattgaagattccgcggagccaggtttgtccgtaggtcattgcattaatgattttgtgaaattatttgtggttaaaaaaaaaaaaaaaa

SEQ ID NO: 1427 - DNA, 5653 bp, Zea mays
tccatttgaggtcgtttcgaaaatccaaattttaaatttttaaaattcagacatagttttcgttaataagatgacttcaaatcaaaaagttgtcaactacaaaattacataacttttcaagaactataaagtttattttggttgtttggttatttattcatctcacatgttggttctaacattattcacaaatcttatacatctctcttgtagtttcataaactatgaaagagatatattttttctaaacaaatttacttttattttaccatatgaataaatgaccaaaatataaattgtacatcttgatgaattgtataaatttttagttgaaaatcttttcatttgtattagtttactacttcaaaatacgatttttatattatctttgcctagtgttgaaaaaaacactcgacaaagaagctttttgcctagtgtaaaaaataaacagtcggcaaaaaaactctttgccgagtgtcataaaaaacactcggcaaaaaacctctttaccaagtggtgtttttttgttaagcactcgacaaagaactcatttaccaaaaaaaaaaaaacactccacagattatttgacactcgccatgtacgtgaggtgccatgtcggggcacgatccacttagctaactgtccatccatgcttgcatgtcaaacactcgacaccgccgcaaatatatgcataacagtaaatgctactacgactacatacttctgaatcagcgcgcggcggtcatgcatcctgatcgaattcattacgcatttgtggagacaggagacctgcacgtacaccggattgaacagggcactgttgatacgtacactctccttgccatgcctgccatggcaatggcaccataccatgcagagagcgagagggacagccagcatcgcccaaacgtcacgcacaaacgggcacaaaacctatctgcaggcagctgctgcctttatcttcgtctccattcgtccgtcatccagtccatgtgccaccagttccccgggcgtcgccatcgccggacgcgggtcacctcaacccccactacgcgcgccgtgccaggggccggagccagccgccactccctccctgcctcaccagtcaccactcgccagcctagtagcctacgcttcatgcccaccaatgaccaaaccaaccaagcaagcgctgctcgctcgcccgctactatatattctcacctgcaccgcttcttctcttctcgcgatccaagctgaacgagagccacctagcaagctagtttagcaggtcaggcatggccagcgcgacgacgactgagcagcgtgtcagcttcatcgtcgacggagaggctgatgagcagcagcagcagcggcagcatgacgacgaccttgttagccgcgccgccgtggtggcgagggaggtgagcaagcgggtgtctcgcctgtccgtcgaaggaggaggagacgctcagggcgtctacaaggtcggcagtgaaggcggcgttgccaggccaaggaacggacatcctcacgaggccgacgcgggggaggggacgccgcggttccggcgctcgtccggcggcgcgcgggcgctgccgccgccgcacgcgtggctggcgatcgaggacacgaggaagcttcaggaggagcaggggcatgacgacggcgacgacccgcatgcggagcaatgggcgcggctcttccgtggcggcgggacgacgcagcagcagcagcagcggctgaggctgcggcggagcagcttcagcatggtgcggcgcgagcgcgagcgcgcggcgcgggaggcgtggctggaccacgcatgggagatgaagcggagctggcaccagcgcaacggcggcgctcccgacgcgggcacccccgtggtggtggtggtggggacgtcgtcgtcgtcgtcgtcgcactcggaccatcaggccaccgcggcgggcggcggggtggccatggacgtggaggaggtccgcgcgtgccgggacctcgggctggagctgccctccgactgcaccgtggagatccagtgctacgggctgtccggcggcagcagccccacccacggcagcggcgctgattcaccctgcgccggctccagccgccctgttggtggtacgtatgatcgagtactagagctagcgtacctactgccatctttattgatcgtctactccaaaactgaaacgtgctaggaaataattcatgaatggctactaggatatactcctatatattttgctaaaacaatactataatgtccgtgtgtggtaagactattataatatccgtgcgttataatgacaccaaattattcggtaaatgttaggcacaacgattacataaaaacgaacaacatatacattattatcagcctcaatatctcacaaattcctaagcagcacgatgtcaatccccaaccaaacactagacacagtcacacacttatacatggcacccgctacagaaattactcagaccgccaagcgaagtagatagtctaagatgaatcggggaagaataacagacacatgatttcgggtgaagaaacctgcacctttagagtggccaatgaaccacatgctagtggcggcccagtcctcctcaatcccaagagacaacccccctccaccacgcaataactagacgtcaaatcagggacacccatcaatcaatcgcagatataccccaaggccaatccagggcaaaagcgacggcggtcggatctcccgcgggccattataccgagcgtcgatctatccagcttcctctctgccatcatggcctcgcgggatccaaaggagcgagcgagggagtgagctagggtttccggtggagggtagggagagaggcaaggcatcagtttccacgttgcgatcccagagaacgggcaagacggtggagggggagggaaactagagctagggttctatgagaaggagaggggaaccagagatagggttccgtgaaagagtgaggcggagccatggaggcagcgttgttgggatggagggacttgaaccgtggtttgattacaaagaaatatatgggtgtttttaagaatgttaggcacaacgacgatagaagccagtttccccacgttaaaatctaacagcaacaacattaattaatcgtgttcttgacgtcccttattaacgaaagcttctagtaccttgcatggcggtcatggcagcaggacgacgacgggttagcgtcagtcatgatgactactcgagttgattgctactgctagctagatagatagagtagtatatcaccgattcttgctctcttcctcccctgcggcgccgtggcaaatccaccacgacagggacggccactccatttgcacattcccccattccgatccactgcaggcacgcacggtcgccatccagcagctaatctagcgtcgtaaacaccacatgcacgccgccaccacccccattcacccatcatgcatctgacgatgctggatacagatagctatgcatactcgcgatggattggctagctgttcgtataggacggaatccatgcatattactccctccgttcgtttataaatatacgacatccttaatttttttaaaactttgatcattcattgtattaaaaatctcgagttatcgcttattttattgtgatttgttttatcaattaagattgtttgattataacttgaaattttatacttttgactaaatattttaaataatacgagtgatcaaaattttaaaaaatcaacggtgtcatatatatttgaacggaggttgtatatatcatactctctctgttctaattgaaaaaaagtcaaacaaataaaatgaaccggtcaaatttggtaaaaaaagtcaaacatattataaattggtacggagacagggaatattatatatactatagcgctattcatgtatcaccctcacgggtgatcactcatcctaaaataatttaaaaaatgatttacaaagatctatatatatatcactatctaatcaatgtcgttcgtttgtaaatgaatgaacgtttacagaaggagaaggagcggatccgatggacgtgaaggctcggctcaaggcgtgggcacatgcggtggccctcgcatccaccacccatctcaactctccgggtatggataaaatatatatatagtaatggtcctcgaatttggtatgccgtgttacttagattctcaaacttagaaaactaggaaaacatgtgctggaacttggtggcccattcaaagctgtccaatatcaaatttgcttgaaccagatgccaacatagtgtgccacgtttagagtcatttggatccctaaactcaacatgttgtgtcactttagatccccgaacttggcatgttgtgtcatttgggtccataaacctttattactgtgctccaacatggcacgttatatccgcgtccagtttaagcaaatccagttttaaacagttttgcacgggccgaccaagttacctaacctgtttttctgagctccagcgtgccaaattgaaaggactatatatatataagcaaacacctttttcttcttatatatatagccatgtttgtaaccaaatgtcctttttcctttcctttacatacgtatctaattaaatccccacgtgtaagtgtactgctaagtaagtagagtatacttactcttcgatttggaatgtaagcatccattatgtgtaagagatattatatataagtgtgtcgcgcgcgcacgcgcgtgcaagacctgtgtgaaaaaaaaaaaaaaaaagcggcccgtagggactaatgtttagtctcttcattttattccattttagtttataaattgccaaatatagaaactaaaatagatttttagttctatatttgtcaattttagaactaaaatagaatataatttagagactaaaaattagtccctagaaaccaaacaccctctaagttctacccttctaaacaaattaagcccagagcaaatatattttatatatactcacatatattgctgaatatagtacagggcaggtatcggccaaccaatcataatatcatataggtatatgtccgtacaatgctatgattttaatatataacatagtaaagaaattataactgcttatatgattttaatctacaatatttaacgatcaatcatcacacagttaaatccaacagatcttagaaagaacaaagttacatatacagatttttcagtgttttgtttgcattcaacaataattgttctgaatcttctcagagatgatgaggtgcacaaaagagaccaaaactaagaactgtaattggagaaaaaaaagaggacagctgacaagaagcccttcttgctgaataatgtctttaaggaagttgcgtctagtgtttcttcatgtagttcaccactggggttagcactatcaaaactgtagaatctatatcactcactacatttttagttttccattttaaacacacaaaacagggaggtgaaacataacaaatcaaaatgaaaaagaataaatatttgagggcaacacaactattctgttttacgataatacaaatcacgcaccatgtatcactggtattaaatagctgctcacttttcttcgtctctagttgaactgaaacatcaccatgttatatcattgatattgaatagctgct

SEQ ID NO: 1428 - DNA, 2473 bp, Zea mays
gtaccctcgggcgcacgagaccattacctagaacatcctactcgacaaactagccacagtaccacctcagcccaggtccccgtcgcctccgctcaactgccgccgcagggcccgctgcaggcttccatgtgtggtagggcccggtgtaccctcagcccggccgaggttgccagggccttcggcttccccaccacctccgccaacgcgggcggcggtggagacggccccgctgtgccgacgctccatcttaaccggttccggccgtcgtacaatgtgttgcctggggcgtacctgcctgtgggcgccatgcgggcactaccaggttgcgcccacggaggaggaggttcggatggggaggggccggtgatccagtgcatgaagtgggggctggtgcccagcttcaccggcaaggccgagaaacccgactatttcaggatgttcaatgccagatcagagtccgtaaaagaaaaggtttcattccgtcgactaattcaaaaaaataggtgccttgttgcagtagaagggttttatgagtggaaaaagaatggatcaaaaaaacagccatactacatacatttccaagatcataggcctcttgtctttgcagccttgtatgatgcatggacaaattcagaaggagagatcacccatacattcactattttgactacacatgcctcaacttctctaaattggcttcatgatagaatgcctgttatcttaggcagtaaggactatgttgatgcttggttaaatgatgtttctgtaaaacttgaagaaattactgcaccttacgaaggagctgatctggtttggtatccagtgacatccgcattgggtaaagcatcatttgatggacctgagtgcatcaaagaggtacatatcggagctactgataagcctatttcaaaattcttcaccaagaaatcgactgcctacgatctatcagggaagtatgagaatatgtcacgggagcttgctcatgcttacaaagcagcgaaagtggaatgcgatggatcagtagaaaatcaaggaggggacggcaaccaacaccagtcccgagagaagcaaactactaattgtactataaaggatgaacctgtcaccttggaaccacaagttttcgagacaccgtggagcatcgagcatgaagatactatgactctggctggtgccactttggaaacacaacgtgatttgggattcaagagaaagatcgaggacactcaagtcgaagctagcatgaagccctctcagcttaccaggaaggaaaaagctgtaaaagcagcttcggatgggcaggcatcgttgctttcatatttcgcaaggaagcagggtcgctcgatgaagtagtttgcggtagccgtgccatgtattcctgtgtaactcaaactttaccagtacctgtcctccgtgttcgggacaaactatttcggttttaattttgttttggctaccactaaaatgaaccagctagatttctgcggtcattaattttctgcggcccaacttagccgaggccaatgaaaaaagaactttatttccggtagtctggtccaatcactgaattaagaaccttgtttttggtggttatgttaagccgctgaacataagggtgacgataacgatcttgtttttggcaacttaagttaagccaccaaaaataaggtttttacttttttggcttaactaaccgacgcaaaataatgccctcatgggtctaggccctctctacgcttgctcgctgtcgcgcctgtgccttcccgctgctaggctaacctgccacctttgttggcaccgtgtgtggctgtgtgcccctgttgcctaatgttccatggttgttggccaacacccatcgttgcccttcttggttggtgcctgggctgcgggctgccctctttttggctagcacctagcatgctctaccctatccagccaacgtacctcaccttggtcggtgacctccactgtggtgcctccctggccttcgctcctccccggtcgacaccctccctgggctagccgtccatccttggctgacaccccttcattctagcacccatccatggttgacaccccaacctgagccagcaacctagtctctgttaccctgctcctcatatagcgttgcatacataatggtttggtaacaagggaattggagggggttgatgaagaggaaattagctgttattcaattctcaggattggtttggcagcgagtggaggaaatttccctggcacatttgggagtcaagggaactaaatacccctcttgagcaaaatacttcaaaaaattcagaaaaaatcaaagaaaaagagacatttagataaatcagaaacacaatgaaacatcactaaaaatccaaaaatctgcaccacatatgattcatgcaaagtttaatttgtataccatctaatctaattcatccaccatcacatcatataaggtcatcaccgttcacacgtacag

SEQ ID NO: 1429 - DNA, 807 bp, Zea mays
gtccctcacccccacgtcggcattcagcagtcagcaagtaacacgagagtgctagctcccttctccagctagccgtgtggctcgctcttcagatcgctgatctcaggcaagattagcctgcccgcccccaatggcttcttcctctgccgctttcgcaatcctcctcttcttcttcgccgtcgcggtgcagtccgctcgcggtggccatcagctggcgtgcgaggagctgccgccggacgcgtgcgcgttcgcggtgtcgtcgggcgggaggcggtgcgtgctggagcgcacgcccgagggcgcgcaccggtgccagacgtcggcggtggtgggcatgcagatgcagggcgggtgggtcgagactcgagaccgacgcgtgcgtgcgcgcctgcggggtcgaccgcgccgcgctgggcctccccgtcgccagcgccgcggccgaggaccgccgcgccttccgcgcgctctgctcgccggcgtgccgggacgggtgccccaacgtcgtcgacctctacgccacccttgccgcggctgaaggtgtgtcactgccggcgctgtgcgaggcggagaagaaggctgggaaccgccgcatgatgactgggaaggccccgctcggtgctcctgtcgccgctccggaggctgcgccagctccgtgtgaagaatgatgtaggctcgatttgtactgcagcttcagtagttgatgcacaccgtgtttgggatatgtgtaccacacccagatagtttgcattattttttatgaaataaagctgtacgggtattgtttgttgttcaaaaaaaaaaaaaaaa

SEQ ID NO: 1430 - DNA, 5044 bp, Zea mays
  misc_feature (4666)..(4666): n is a, c, g, or t
tcgtgtgcaggctgtggttggggacctggcgacacaaggcgagagagcccctgctttgctgagctggagggaccctcgggccaccgccatcttcattttcttatccctggtggtcgccgttgtgctgtacgtgacgccgttccaggttttgatggtcatagccatgctttacctgctgcgacatccccggttccgcagcaggatgccctcagtgcctttcaacttctacaggagactgcctgccaagtctgatatgctcctttaagatccagtatccaccataagagaaacaggtgcaagtcttacttatttatgtctgttccgctcggttccttctggttagcatcagatcagatgtgaatatacctgatgagttcatatattagaggtcattagtatccccggaataaggtgttggtttgatggtttatttccttggttatgccaaagaaagggaacaactggatcccttttgagttttgggaaatagtgggaggaggtttttggtgcagaattgtaatattaacttcaggttattagcatagaactaaaggcaggaacaatattatccccccgtgtattatgtttgtactatttgtgtcaattttgcttgtgtttcagtgatcttttgcctgcagctgggtcatgctgtttgtttttatgtgttcgaatccctcaccttgtttgggttcactggacatgcctgcttgctgcggttgtactccttgttaataggtggttttgctatcagggacagatccggccagcggtggggcgggcgaggctcgagcctcccctaccgcttcggatcctattccatggccgggtctcttcggatcctattccatgggcggtcgagcctccctgccgcttcggatcccattccatggagtctcactgtagacttccttaatctaaaatatagataatatagaagaatctttcgtcctgcagcagttagtttagtctcttctaaactttttttgggcccccaaccctgttgtttgttggccacgaatttttgcccgttgccagggttcgttgtgggctagtggcctgcaagattgttgccatggagtctctgacaggaaaagtagcagtgatttatgggttgtatgaaagctgaaaatccgtttggtttaacacgtatgacttgtttgcccttgtcagcgaacctgcactcgccgcccgagtggtggccagggtcgggagggcgttggaaaattggaatctttagttttaaaagtatattttaagttgctcaatttaccctctttgagacgccatagttcagtcatattgcaatgcgagaaagtggctaactccttgaataaatttgttcgaggaaaattctacttcttcgactgtgtacattttgctatttagatatgtatccgatacgattacgccgctccatctttggcatccaacaaagtttgtatttgtgtccacgttcttgtattatctgcttcaattcgaatccgacgaagggaaaatagagtaggacacgagagatacattctctgacctgatccttttttttcattcatataaagtacacatccacaaacatgcttcgctgcaaattaaagtacatatacagattctatcatttgctaaaatgaaaatgtctcatacggtcacccttgcaacatcgtggacatactaaaatgtattgttacattggtaagaggcgaaacttttggctgccacggggcgcttgcgtgcttcaattttgattgttttggtagcagcttccgcagaaaaaatgtggtggcgtgttcctgcctgcaagctcggtggtgtggtgtgcagcgagtggtggtgaagaaatgcttgaccgcgcgtccacactccacacggctgcgttggttttccaggcttcgcttcactaaaatagtgcaccctgatggaccgagtcttccgctaatataacctggcgaaacgaatgcgacgacacggcggtggcagattgcaaagcctctcgtccacgccggattttcattacgtgctatagccagtagacgtcgttttcccgtgaaacgatcgaagatacggtgaaccgcctgctctttgagagacaagggcgtactgccaagcgtctgagaaatctaggagactgcaggccagagagagagagatagccagggagggaacgggcacggcaggcagcgtgccgcgtcgtctcggctcgtcacgctcagaccctgagacctcctcgcgtgagtgtttgttacataaacgcacagacagctctctcctcgtccatcaccaactcatcagcgttcagcaaacaccaagcctccaactctccagctactctgcctcttggctcttcagatcgctggtctcagggcaccaatggcttcctccaccgctctcgccgccattctcctcgtcctcgccgtcgccgtgcaatccgcccgtggtaatagccctgccgccgtcgccgttgcgacgttaattatttccctttgttattcatgcacactctagtcattagtcacgggaaaccatggtcactggtcagtgtaagactttaagcgaatgcatggtgcgtgcatgcaggcgggcagctggcgtgcgaggagctgccgccggacgcgtgcgccttcgcggtgtcgtcgggcgggaggcggtgcgtgctggagcgcacgcccgagggcgcgcaccggtgccagacgtcggcggtgcgcggcgcgcggggcctggccgggtgggtcgagaccggcgcctgcgtgcgcgcctgcggcgtcgaccgcgccgcgctcggcctccccgtcgccagcgccgcggccgaggaccgccgctccttcggggcgctctgctcgccggcgtgccgcgacgcctgccccaacgtcgtcgacctctacgccaccctcgccgccgctgaaggtgtacatccatccatgcatgttgtcttgcattcattgattgattaacggtctatgatctctcttcctggcgtacgtggacggtttttgttttaacgtacgggaaactgatgatgatgatgagtgctttgcaggtatgtcgctgccggcgctgtgcgaggcgcagaacaaggctgggaaccgacgcatgatggctgggatggccccagtcgccgctcccgtggccgctccggtggctgctgcgccagctccatgtgaagactgatgtattcacgagtcacgattcttacaatcttactgcaccttcagtagttcatttacagtgttgggggatacccttgtgatgtgctagttggcattgttttcttgtacgtatgaaataaagttgtccgagcattaattgtttgttgttccatgagagatctgcatgcgatatgcgattggactataggttcagtgcactcggagcctcctgtttcctattgcaagtgttaaattgtttcttcgtctccaacaagaaaagaaaagaagcgttgctgcttctgcttctgcttctgcgcttctgacggaggttccccttgtgctctcggcccgtgtttctattgggctatagcctgtaaaaatcgggcggtccagaagacagtagtcaacgattgagactcctataggcccggtccggcccaactgcagcccgccagttcgccatcaacctttattcctcgtcaaaactccctgaacacaactccatctctagggttagtttaagccgcctccgctacgcgcaaggacgccgccgccgctcagcagagagcagaccgcactccgccccctcccaaattcccactcccacctctggttctcctccgcagctcggatcatctgctataatggcgtctgctgctggagacgcatcccgattcgtcggtaatccgcagctagatcgccccacttcgttccaatccgtcctgtcttttcttctcgttccgcccatgtttggcattgcgtgttttccggacagagccgtgttatttagacgcttagatatttctaggctttcgtacgtgttcgcactcgcacggcttccttgacaaaaccctaaaccctccgccgcgctgcagctccgacgtgcgccttaggttctagaacaaggcgagtagcacgcctttacctccccggctcgccttactacctaagcgtctcctaggcgacgcttgaatactatgtatatactttgtttcaatagttaacctggtagtttggatttttttttaaattctagctaacaatttgtttaatacatatgctgaactcttgttaaggtgccattaaactggaaggattagagacggcaaaagctagtggtgcatgccagcttgttgtgaagtatctgaaagaataatttgttggtgaatatacatacccctgcttgcgtgctggtgcaatttatgaaagaaagtatttgctggggacttcaatggctaggcctgttattgctaaggtaaagttgctctggtaattacatttttttacatataatgaccaaaaatgcatcctattttcttaaaagtagatactacttattttcttgagatctaatagacattatggcttacagtatgtttagtagtgtgcacatgcgcatgttggaacaaattattagtattataattacaacatcatcaaaatcactgatgtaactgatgtgacttttggaaaccattcagctcttctgtataatttcatgtctgtttcagtagaacatgatatgcttnctgatatgcatagacttatcatttttattaccttttatttcttatatttgctccaaaaaaatttcagctacatagagtacaaactcatggatgactgttttttgcttttgtcaattgatcttctagtcttgcagtttggtggcgcttatttatcattggaatgatctgttcagttaatctattgttaatcatgtgaacataatgcagtagagctattagcagaacaagcattattctgctggtagggcacgttatcacttgtaacacataagaaacagagggactcattttaatcaacaatccagtaaacttatgtttaattggctttgctcactaagtcactagtttgccatctgtggggatcactcaaggagccag

SEQ ID NO: 1431 - DNA, 1757 bp, Zea mays
aacacatattttgaacgaagccacataatacgtttattccaaatatctcctcgctgtctcctggctcaattttcccatgcccatcctcaaaacccaacccaaccaacttgagcgcgcgactcaaggcgccacaccggcaccggcatgcaccatgggtcctaccacagctcgcctccttcccctcctgcccttcgtcgccgtgttcctcctcgcctcccccgtggacgccgactccgccctggacgcggccacgcggtgcgcggccacgatcgtgtccatctcgccgtgcctgccgcacgtggcggccgtggcgccaccgctggctagctgcccgcctgccccaaccgacgcctgctgcgtcgccttcctccgcgctgtatccccgttggcagcgggaggcggagaggagggctgcctgtgccacctgctccgcaacccgcttctccttggctttcccatcgacgccgcccgcctcgccgcgctcctccctgcctgcgctgcgggaaatgccttcgccgccgccaacgtggaggccgccaccctcttcgctgacgcctgccgtgatctaaaggtgctgccgggattgcatttcatgccgcaatcaacaaccgggccagaaatttcaccagctgctgtccctgaattgatgtccaagccaaaggaggcggttccacttccaccagctggatcaatggttcgttcaggcactgaggtcaccagttcccgtggtattcctactgcagcattgatcctcgcggcagcaggagctgttatcacatagttcttgtgatgtttaagtgccacttgatactctcgtcggcctcgctcgatcttgatctgcgtttgtcgtgcctagctttgagcctttgacgattcagatgatctgcatttgccatgcctagcactttgcggtctccagtgttgtacgtggcagagttgtgtcacttcaatggaacctagtgatcagctgacgataccttcagttgattatcattcagaagcaggtcaaagatctactcagtcttgatgagatcgaagttgaaacccgccgatatatcaggagttgtgattcaggggcaagagacaggttgtgtgtcccctcgacaactgtgaacttggtttcatcagacgagtcgtcactttcctattagacatgcatatataagatatcgattttttaaaaaaaaaaaaaaaagtctcatgatgttgttgttcgaaagccgatgcccgtgccagcaattcttcgatgaactcaaagtttgtcatggtaactctgtcagggtcttctcggggaggcgaagtgagtaatatttgttctgtatgtctcggaacctctgaataaaatgacttgttgattcaccccactgttgttggaggacgatgaggtccaaaatcgtcatgtcgtgtttgagttggagaataaacgtgtgtgaaattgctgctccatctgcctccaagacatgatggaaccaagctagagtgatgtataccagccgaatgcaggtcttgatagcgatagagagagaagagccaaactttcatgtgttcagtcgtccctgctattccaagttgagctgtgtattggctcacatgcttgatggtgctagtgtcatcgctgccgttgaatttagaaattttgggcaccttgaactttggtggtggtggcatcgggttgaacttcttcgggtatggcttcacctagttgatcgccttgcatttagtagaatcccaaactaatctttcaagagctctatcag

SEQ ID NO: 1432 - DNA, 2140 bp, Zea mays
tgtctctactctctacacagttacctatacatattgttagggatataaacgatcggatacagacatatatttcttgtaccatatttgttttcatattgtttgttcagatacggatattatcgagttgtgtcgaataagacttaaatggatatcgacatcttaaatatacaactttaagtttacagatataaatcagatatggattggatacttagtacatagactcggatacagatcaaatcgtagtcctcttagacggattgattcgaatatggatggataatatctgcaccatttacatccatatatattgtgtattaaccatattaatgatttatgatctcagagtagtatcctacagtccctttggtgtcccttataattggaaaattgatttaaaggctgagggttatacatgtccaaagaaaatgaaaatgagtgccatctgtttcaacaattagtatgtaatttaaaaataatgacaagtgtcatccgataaaggatcatcgaatataaacagtagtttttccataaatgcgcgtatttgttggtgattctgcatgcacggtgcacccatggacgtacgccgtcaacgaacatgcttctggagttattagcagtccgtaggtagatatgcgcaacagacagaccaagtggtgatccacttggaacggcactaattaattcactaagtctgcaaagccggtgccagattttggtagctgcttgcggcacttaacttgcgccggatccgaatctatgcttcggttcggctccatggttcaccattcacctgtaatcgatcctatataaacccatgacggcccctccgatcctccatcagcatccatcaactgctaccgagttaagtatattcagagctcgtctgcagccaaaagcttccatttgcattgcgatgggggctctacctcgcggcctgctagctggcatctgcgccgtcttgttagcagcagtggttgcccatggtgcggaacaggaaacggcgtcaatggtggtcggcttggccaagtgcgccgactgcaccaggaagaacgtgaaagctgaggcggcattcaacggtgcgcgggctgctataaactatccaaccatttgcaatttgcattttgctgggcaaaccatttgcaatttaccggtctatctcttgtttttttgtcccttcaggccttcaagtggctgtcaagtgcaagaacgccgacggcgtcttcgagaccaaggccctcggtgaggttgacaagtccggcagcttcagcgttcccctcccggctgacctcctccgcgaggacggcgagctgaagcaagactgcttctcgcagctccacagcgcggccaacaagccatgccccggacaggagccgtcttggatcgtccggccaaccaccgacaacgacgacgacgacaagatgaagaataccttcgtcgcagtcgccggcaaggtgcactacccatcaaaggagtgcgcctctgctttcctcttctaccatttgttcaagaagcacctgttgcacaagaagcccatggtgatcatccctcacatccacaagaagcccatggtgccgatgtaccgccactcgcccgtgccggagtacaagccacctcacccgacgcccaccccgatctaccatgctgcagctgagcacaagacacagaaccccgagacggaccctgagaagttcaagaagctgctccccttcataaaaaataatcctttctttcccaagttccccaagtttcctcccggcaaggaggagaacaaggcgtaaaaatatgagggcgagagaccaagtgtacccctttcctctgcatccactcttacgtagtgtctgttgcatcttgcatggaccgtcattacctcctgtttcttgacagtgtttgtcacctctcaccggccagggctcccactaatagaaataaaacttttgttctaagcaaaaaaaaaaaaaaaaaggcccctaaattcttcatgctgggttagtcatgactcaagggatgttttgtttgggattgtaatctgctcagattatataatctaataaattttgaacgaagcgttagttccgaacagattataatcctgaacaaacacccctttatatggtctatatgtataatggtattagac

SEQ ID NO: 1433 - DNA, 1038 bp, Zea mays
attgggtaccgccggccgggccgggatcagcatccatcaactgctaccgagttaagtatattctgagctcgtctgcagccaaaagcttccatttgcattgcgatgggggctctacctcgtggcctgctagctggcatctgcgccgtcttgttagcagcagtggttgcccttgcccatggtgcggaacaggaaacagcgtcaatggtggtcggcttggccaagtgcgccgactgcaccaggaagaacatgaaagctgatgcggcattcaacggccttcaagtggctgtcaagtgcaagaacgccgacggcgtcttcgagaccaaggccctcggtgaggttgacaagtccggcagcttcagcgttcccctcccggctgacctcctccgcgaggacggcgagctgaagcaagactgcttcgcgcagctccacagcgcggccaacaagccatgccccggacaggagccgtcttggatcgtccggccaaccaccgacaacgacgacgacgacaagatgaagaataccttcgtcgcagtcgccggcaaggtgcactacccatcaaaggagtgcgcctctgctttcctcttctaccatttgttcaagaagcacctgttgcacaagaagcccatgttgatcatccctcacatccacaagaagcccatggtgccgatgtaccgccactcgcccgtgccggagtacaagccacctcacccgacgcccaccccgatctaccatgctgcagctgagcacaagacacagaaccccgagacggaccctgagaaagttcaagaagctgctccccttcataaaaaagaaccccttctttcccaagttccccaagtttcctcccggcaaggaggagaacaaggcgtaaaaatatgagggcgagataccaagtgtacccctttcctctgcatccactcttacgtagtgtctgttgcatcttgcatggaccgtcattacctcctgtttcttgacagtgtttgtaacctctcaccggccagggctcccactaatagaaataaaacttttgttctaagc

SEQ ID NO: 1434 - DNA, 7846 bp, Zea mays
attagacagaaaagttaggcaaagtgtggcaactgaggtagtgaaccaaacaaacagtcacgcgcgcagccactcgccgcggcgccacaagccacaactgatgaactgaaccatcactccaccaccaggatgagtgcagtgcaagcacctgtgacctgtggtcgcgctcacagagtcgtcgtcgagtcgagggctgctgggctggtgaccaccattcatccgttggatactgctttggctgcgaaatcttctggattgatgcgaaatgcagtgggcggggaggcgtgtgattagaacatgcatgtcgggcacggtatctgtctggagagcagtaatcgaaaccgaaacaaaccgaaacgcgtatggaatcagatctggacaccatcttcttatcatattttaatctagattcagtacaaatccttttgaatacgaattcaaaataaatatactggattcaggtttctattcgaatgttcacttaatttaactcagagaccagcgcgtgtattattgctaaatttaacatagataaatagaatttcatgactaagttcatcgataattaacatgaaataaaaatcaaaatagccttataatggtctctaacattgaaataaactaaattatattagatacggatatttaataaaacaatagataaactgaataaacttaaataaaataagctagttactcataaatatttaatatttagacataccaaataatcaattattatttgtgtaatatttaccattgaactaaaacaatattatattcccaaaaaatagactattaaaataattgacaacaacagatacgttaggttcaaattaaattagaaaaatactaaatttattttaaattcatgtatactaatagtatgaaatcaatattgaaagatatcgtaaatagtttcaatttattcttagtactatttaaatccttactaatatcaagtcggagtttcgtcatgcatcattcccctccgtaagcatttatcgcgcgtcagtgaatatatcaaaaaaaatgcagcagttaggatgcaaaccaccgtctcaattgcagcttatattgatttgcgttatacaaagaaaaccatatatcatatataaaaaccgtagtgatacatggacaactaaactagtcaaataattagtcactagttacgaaaagaaaaactttcaaataggtttattatatcttgttctcgagatgaatatcgactactttatatgtttatccaatacggttttggaccggctataaaaaacaaattctagtacatttatttagtacttatattagaaaaaaaatgaatacagatagctatattacaagttttagcggatcgaataattcgagttcccatccagacatctatttctatccctgcgcgcgagacgctggtatgtatgtgacacacgaaacggtgggtgactcgaccgaaggtgccctcatgtttcgtccacagcattttgatattccgtccggaagatggcgacctgcgatagatagcagcgcgatgacgaccaaggaaacgcgtcctttttgtagattttgtagatagagtagctgcacgatggatgcatggcctgctgcaatttctaatttcattactggaatataaaaaagggggttgtttttatctgaactgacgcaggcctcacctatccattggacgcaccgtcacataggcacatagtcaaatgttttctctagctcttgtcttcaataaatgttttctctatctcttcttcaattgatctagaaatcttctgtctatctctctatctaagaaaactgtcctccatctcttgctctaaaaagatgttttatatccctatcgtaaaaaaaatgttccctgtcgcctctaaaaaaaatattttttacagttcaacagacttaatcatgaggttaggttgggctggactgcaaccgcgatcagcacgcttcggcaatgcttgggacaacttgggctgcaagcgaatgatagaaggccttgtagatgattggactgatacgactgaggaggccatctggcccagttccactgcttcccttttccgttttattttataaaaatattcgaaatctgaattctataccccagaattaaaaactacacgaatagatgtctgccgccccatcaataagcgacagtgatctaattacatatattttttaaaaactctctccccataaaggcctcatgctccctcttctctctatatatcatcaaatttaaactataatatttttttagaatttttacgaggggactagaaacagtagttttgaaagtaggagtactcttagaggagctctacagggaagaaaaaaaaaagatgaggagatgatcccggcgaggctgaaaaaggcgaaatggagcgtcccataccagcagcagcactgcttccgacttccgtgcgtgactgtcgccattggcactgcacgattaatttggtcgctggtcgaaatgaagggcagttaagattagcatggcatcatgtccagtccaaactcggccggttgccgtcgatacaagtgtagtagtagcaggcgttggtggacactgccacactggataggcataaggcatacgtttggacagagcaggatggcgccatgagcccatgcccatgacaaatactgcatgtacgcagttgcaagaatgtcgccaatcgccatcaaggtacgtacacactctgtactgtacctgtagctccagggcagcactgggaaccctctttcccgtttactgctgacagctcgacgcacgaccgtaccccacgtgacaggtagcgagcgagagagagagagagacccactgacgcgccggtcccacgcacggcccaaaagcaaacgtgctcgacggcgcctgtcctgtacgcaggtgtggctgtggctggcccccacgcacacatcgtgagctccagtcgagtcgagctcgagcccatccaatccaatccagccgcaattaccggtcgcctttccacattaaaacccttggcatttaccggcggtcgtcccgttaaaacgtcgtggcacggtccaaggatccaccgctatttcgaggaagaaagaacacaggcggcggcgagtcgatcggcgacggcgacgccacgccacgccaccgatgcatcacagcgactcccgtaacagtcgatcggcgcggactggattggactggaaggattcggcgtcggcgcgcgctcgatcggcggcgagggagaggtcgctcccccgcgggccacggcacggctgtgccgccgcggacctggaggcgtggcgtggcgtggcgtggaccgggaaaaccgcgtggctcgctgctcggagctattatctgtcttaccgcttacgcataccacatatattcgcgagttttaaaatttaagtgaaacttgctaagaaggactttccgtaacagccagaagttctgtgcacattaacagagacagtataggaacccccacgtacgtcaaaaaggcggacctccacctcggtccctcggcggcctacccagtcgtcctgcaggtgattcaacctcttgcagcagatcgacatgtaggtctcacaaaacaaaactagaagcagctccatctgatccatgggattatatatctacccctaccctagctatttctgttctattgggaaaaaaaattatatatctgctaatctgcacccctagctagtgtaccccctactcagacgacatggacaagaatgatggtaccctagcctgcccctcggcgtcgcggtcgttgaaccggtccgcgcggtccactttggcgagtgcgacgtcacccacttggcagttggcacttcactttgccttgcccgtggccattgcccattgcactccctctttttcgtctttcctcgatcaatcaaatcacacgccacgctgcccgtttttttctttctttctgggcgcgagggtgacgggtccgattgctgctagtgtgacaatatgcatctaatcgaccagacattatttctatttatttttagataaaatttatttagttccctactatttttgtgaagaatcattagaatcacgattaattactacccctaattaaagaacaattccatcggtctctacgcaaattctggttgcaggttgcggagatacatgaacatgatacgtatgtgatcgcgctgctgttgtaccacaagagcacgtgtcgtcgttatcgcagctccagctagtctttagtcaacgggaccaaaaacaacaataacctcgccgaatacccactcgttttttcattattataaaaaagtagccgcactatgtggaataaacctggttccagtgagtggtgcgcccagcggcgaaccccacgtatcagatggtgatcgccacaaggcccaggggctcggcctcgcccaacgctcggcccagctaaaaaccgttctgggctccctggcctgcacacggcgctgtcagtggtcgctctcggtccacggcacggccccgtgcggtgtgtttcttaccgcacccagcaaaacgagaaaactgaagacaaccaaaccaacctccgctgcctgccaccatcgctcgctccctccctccaagtcgcactacagctacagaggatcaacttttttttttgtcgcttacctctcggaatggcatcttctcaccttcacgttgaagcagtcagcctgtgttgtgttgtgttgtagccgcagctgctgtcccagccggcggccgctcgttctgtccagtttcatggagaattttctccgcttctcgtttcggaagaatgactccagtagtaaagggtcagtgagtaataagtactgacgcggagccaagtaaccgcgccgtagttctgttctgtcgtgtcggagaagacgactggcatcgacaagcaggccggtcagcgccggcaccgcaatatacggaagaaaacgagcgcaagtcggggccattcacacccacgcacgcccaatcacaaagatctcttctgaattttctttaacaaaaaaaaggaggaacgaaaaacgaaaatcatatcctgcagaggatatatacaggagtaggagtaatcatgcatgtcatgggtcagcacgatgtcattgacccgatgagaggtcgaagaagggcggatcagcggatgcttcaagctttctctgctcggttaggttgctgtcactcgctctgaggcctcgacgcgctgctagctgagagccgaaagaaggaatcctcggccggcagcaggagaggagagccaccgtttgatcagcgaccgggcaaaagcaggccgcggccggccacccccgcccgtcgctgtccctccgaccccgcaccagcgactcgccgagcgcaggcacaagagggggggctccatccatgaggcagccatgctggtgctcatcaacaggtatttcaggagcaggaacagcagcccggccggaggaggcggcgaagagatggcgccggcggcggcttccagcgaccacctctgcctgccgggctgcgtgcccgtgcgcgccaagcgggcctccgcctccgcctccgccgccgcagcggccacggtcaccacggcgcgggcgtcgcggcacaacttcgtcagggccgcggcgtcgggcctgctggcgggggcgcacttcaccaaccacgagtcgctgccgccgcttcccgacgcgtacgccgagttcgtcgcggcgttcccgcagtacgcccacggcgcgctggcgcgggcggacgcgatccgtggcgaggagtaccagcacctggaccgccacgtctgcctggactacaccggcatcaacctcttctcgcacgcgcagatgagcgcctccctgccgtccacctcctccgcgccgcccgcctggcagccgcccttcttcgacatcgcgtacaagtccacgagcctgcgcgcgcaggtgcaatgcggggacaacgccgcgggcgcggaggcgggcgtcggcgccgccgtcacccggcgcatcatggcgtcgctcaagatccccggggacgagtacgccatggtgtgcacggccaacaggaccgcggcgttccgcctcctcgccgagtcctactcgttccagcccggcaagcagctgctccccgtgtacgactacgagagcgaggccgtgggcgccatggccgacagcgcgcgccgccggggcgccgaggtcgcctccgcgaccttcgcctggccgagcatgaggatccacggcgccgacctccgcaagaggctggccaggggccggcgccgcggcggcgggggacgcggcctcttcgtcttcccgctcgcgtcccgcatgacgggcgcccggtacccgtacctgtggatgagcgcggcgcaccagcaggggtggcacgtcgcgctggacgcctgcgcgctcggcaccaaggacctcgacacgctcggcctctccctcatccgccccgacttcatcgtctgcaacttcttcaaggtgttcggcgagaacccgtccggcttcgcgggcctcttcgtcaagaggtccagcggcctcgcggcgctcgagcgctccgtcatcgcgcgcagcatcggcatcgtcagcatcgtgcccgcccgccgctggtcgctgcacgacggctactccaccgagctggagcactcgcggagcttccccatgctcgccgccgacccggccctggacgacgccgacgtcgagaccacgagctccttctccggcccgctcagctccaccgccatcactcgcagcaggaccctgcagtcggacgcggcggagaacggcgacgcccacgcccacgccccggagatccgcgaggtcggcagcacggcagagaacggcttctactcggaggaacccagagcagaggaaacagagcggctggccaaggaggagcaagacggggaggggagagagagcgtgatggaggtggagtgccggggcctggaccacgcggacgcgctggggctcatcgccatcggcaaccggctgcgttgcatcagcaactggctggtggtggccctgcagaaactgcggcacccgcacgccgataacgggcacccgctggtgaggctgtacggcccgcgcgtcaagttcgaccggggcccctcgctggcgttcaacgtgttcgactggaagggcgagcgggtgtcgccgctgctggtgcagaagctcgccgaccgccacaacatctccctcacctgcggtttcctgtgcaacatctggttctcggacaagcacgaggccgagagggccgtcgtcctggagcacagggtcgccggcgatcccgtcgccgcgggcagcgccggagggaagaggaggaaggacgccggtggtggcgacgtggggatcctcgtggtgaacgcgtcgctcggattcctgagcaacttcgaggacgcctacaggctgtgggcgttcgtggccaagttcctggacgccgacttcgtggagaaggagaggtggaggtacaccgcgctgaaccagaagacggtcgaggtgtagacgaaacggagagcgctgcagtagcttcagctcagcttggcatattggtacggttcagttcactgtctgtaaagcaccattcttttaggatcagctctgccatcccctccagccattctttcagtgtaaactgtaaggtgtaaagtgtttccataatgatgatatcatttgatatatgaaataagtttcacttttcagcacaaatatgagaccatcttgtgtcttataagaagcttaattagagctccgacaatccgaccttccataggccagcctatctccaagagtgacaagacgcttgcttcataaatcatctagtgccttaaagatcaacaatttgatgcaatgcaatagagcactgtcaaactcactaaaa

SEQ ID NO: 1435 - DNA, 1195 bp, Zea mays
gccggccgggccggcgtcagcaatcctaatccaaaccgccgcggccacggccgcagccttccatagttctgtcagaaattccccttctcatccctgatccctccaactcccaccccaatacatcctgccgacgccatcagccggcgggacgcacacacgaggtcgaccttcgaaccctagtccttggccgagccgccttgcgggatcgtccccgccgcgcggcagctctgcctcgacccttttagtctccgtccgacaccgcttggatcagagatggaatcaccacccctcacagctgaagcaattgcttttaccgagaaaaagatggacatgactttggaggatataatcaagatgtcaaagaaaaagaatcctggaggcaagaacccccctaggcagccgatcaaaaagcgtccattccagaatgccaacactaataaagggaatggcaaggttcaacggtttatggaatctagatcaaccattagacaaggtgttcttgcacagagaaggtcaaatcttggtggaagtcagtttgctgctacaaagcaggctgcaaagaaggctgctgctatgccaatgcgcagcggggctgtctattggaagaagcctagtgcaagtaccttagtgcagaggaggtcagtaggtgatgcttttcaaaataccaaggtcaaggagtcgcagaaccatgcagcaccaaggacgatggatgcactctttgcacggatgaaggcgcaacgcatgaggaccgcaccacagcagcaggcaaatcctgcctctggacgtgatttcaaccagcagcgacgtgttcagcagcagcagaggcgaggtagagcatatggtggccgtgttgtcggcaaccaatgagcatatttggtgcatcgaagccccttctcttcactggtcttaaggaccttgagggctagtttgggaactctatgtttctctattttctcaagtgaaaatgagctaatttttcttgggaaaatgaggttttcaaactagccttgaatgaaaggacgccgggggaaaatctaacttgactttctttgttggatgaaaggatgtggacagaatatgaagcgaattttgtgtgactctagttgtctgcttctgttcagcatgtacactgacctacggaaattacttgcgagaaaaaaaaaaaaaatttaaaaaaaaaaaaaaaaaactcact

SEQ ID NO: 1436 - DNA, 1217 bp, Zea mays
gccggccgggttgcgagagaaggcaatccaaacctcaccgtccccgccgcggcccccagccacggccttccgtaatgtcataactccccttctcgagtccatctccaacctcatccctcccaccccaataatacatccagccggcgccatcaggcccggcaacgcgcaagcggggctgaccatcgaaccctagtccccggccgagccgccctccgccgagccttgcggccgctctgcgtcatccctcttagtctccctccgttcgacacggcttggatccgagatggaatcaccgcccctcacagctgaagcaattgcttatacagagaaaaagatggacatggctttggaggatataattaaaatgtcaaagaaaaagaatcctggaggcaagaaacccccgaggcagccgataaaaaagcatccattccagaatggcaactctaataaagggaatggcaaggttcaaagttttatggagtctagatcaaccattagacaaggtgttcttgcacagagaaggtcaaatcttggtggaaatcagttccctgctacaaagcaggctgcgaagaaggctgctgttatgccaatgcacaagggggctatccgttggaacaagccaagtgcaagtaccttagtgcagaggaggcctgtaggtggtgcttttcagaatgccaaggtcaaggagtccaaccaggcagcaccaaggacgatggatgcactctttgcacagatgaaggcgcaacgcttgaggacggtacctcaacagcaggcaaattcttccccctggagtcatttcaaccagcatcgacgtgttcagcagcagcagaggcgaggcagagggtatggtggccgtaatgttggcaaccaatgaatccaactagacatatctactgcatcggagccctttctcttcactggtcttttggaccttggaagaaaggacgcccctgggaaaatcaaacttggctttgtttattggaggggtgacaatgggctctaacttggctttgtttattggaggggtgacatcgggctctaaattttacactaagatttaaggatctgattaagatcaggccctatttctattcatttttaaactaaaatttatttactgccctactattttgtcaagagaaaaaaaaaaaatccattaccacctaacctttggacgtggacaggatatgaagcgaagtttgtttgagttttctagt

SEQ ID NO: 1437 - DNA, 2203 bp, Zea mays
  misc_feature (545)..(545): n is a, c, g, or t
  misc_feature (1628)..(1628): n is a, c, g, or t
  misc_feature (2070)..(2071): n is a, c, g, or t
tcaataagttgtgtcaacttgggacattgttgaaccatgtgcattgaaatttgggtggaactaaacagtctagactccaaaatgtgagggccttggaaaccaagaggatgcactagatattttcaatgaacactttattgtttctgtttcattttatttcaaaacatggtatgtactccctgacttcacttgagaagcgagaattgtatccttgttttgatgggggtatggtgagtttgctcagaaaacaatatggctcttggttctccgttgcttatgattcttggtactcgagcactcctgctcatgtgagatactaatgttttgattttgatacagtgcaagtaccttagtgcagaggaggcctgtaggtggtgcttttcagaatgccaaggtatggagtatggactttgtcaaatcttgaccttaatgctgagtaaataggacaaactggccgaaaaggtaaactgtttcctaatgtattgtatctgatgcataataatcaacttaagatgtaatgggtgatcttttggcctatcaatatnatgacatcttggaaaaccattgctattgtaattgatattttgtgttctttcttgatatgttttaatgcatagacagcatagttttctcacataatccatcttttttctggtatcctcgtgtcacttcataatcatctgtagtagtttcagagccgtgatcagtgctatactcgagtccccgtttatttttagaagttgcgtgatacatgaacttctatttgtttgattaatatattcgttgaattatcatgtcctgtagttttttttgtcgctgctgatcatacgcccgtaatctatttgtaggtcaaggagtccaaccaggcagcaccaaggacgatggatgcactctttgcacagatgaaggcgcaacgcttgaggacggtacctcaacagcaggcaaattcttccccctggagtcatttcaaccagcatcgacgtgttcagcagcagcagaggcgaggcagagggtatggtggccgtaatgttggcaaccaatgaatccaactagacatatctactgcatcggagccctttctcttcactggtcttttggaccttggaagaaaggacgccccttggaaaatcaaacttggctttgtttattggaggggtgacaatgggctctaacttggctttgtttattggaggggtgacatcgggctctaaattttacactaagatttaaggatctgattaagatcaggccctatttctattcatttttaaactaaaatttatttagtgtcctactattttgtgaagcgtttggatcgtgatccattaccacctcacctttggacgtggacaggatatgaagcgaagtttgtttgagttttctagttgtgtgcagtctgcttccgtttcagcatgtataatgacatggaaattatttggtcagagattatgatgtcttgtttcttggcttgattagcttcatccccaactaagagtaattcaccttacctagggatgacaacaggtcaggtttagatagggtagaataaatatccgtccgctataatatttgcgaagattatttatatctgtctatgactatactcgcggataacttgtaccggtatncgtagctattcgtttgattggttatctgtactatttcatcttaggtcaccacatgtgttgactttatttgagattatgtttggttacttatgtgagagtcacaacttgtacgagtggatgtaaaataagctattttgatactattaacttgcatccatttatacgctcaaaattattgtatctggctagtcagggtagtgtcagctcatggacgcgcagcaatccaatcaggctatagttttgtatctgcacgtaaacattttgggtggcctctggcgctagtggtggagcctagcgccgggcggtcggtagcttgcctaggggacagaggcgtgcaaccttgcttgaggtcgtcttgctgccttgttggatccgtgtggtggagcagtgaagctgttagctgtggaggggatggccagtcaggtcggatggggatcggatnntaccgccgaccaccttgtggtggttgttgcaaaacaacatgttacaaaacattgtgacaaatccaagaggctcgacgatttctcctcaagggacataccctttggggatgccattttcactgtatataaaca

SEQ ID NO: 1438 - DNA, 2238 bp, Zea mays
aacctggaatctctaaaattcaaccaacccttccggcagaaaacccccaagccacccaataaaagggggtcctttccaaagggggaactttaataaagggaatggcaaggttcaaagtttattggagtctaaatcaaccattaaacaaggtgttcttgcacaaaaaaggtcaaatcttggtggaaatcagttccctgctacaaagccggctgcgaagaaggctgctgttatgccaatgcacaagggggctatcccgtggaacaagccaaggtaaacaatgatgttcttttattgcttatgagaaagtttactgcattcaaggggttgttcaatttattgagtcatgcaccttggattatattggctgagaatgattgtgatgctggtgtttacatggaactgccttaacttctctggttatacacacacaagcttataaagcacgagaccattacctagaacatcctaatcgaaaagttttcttggttgaactgctacaaatatatggtgaatatagcatatgagccttgaagcttcattgaaagttatggccttctcctttatctgctgttgcctgacatttttctatgcagtttcatggtgtaatttatagctgctggatgagtgttattttggacaccagcattaactgtctgtgagggtttcattagtgttatttgtcaactattgttggaaggactgaaggagatgtgataatggttagcgtctcatgccactggtgacggatcatccatatacagggacgttacatgcctgagtttgaattggttttgactactggctccttggcagtgttcagtgtttatttgttgaatgatgaatgcagtgtaaatctagggtagtgctgctaattggacaattgttgtatgcctccaagggagtatattttgctactgcctcatattcaagttggctgtatccgtaacatcatgccagttttgagcatcctatcataatctgctatatgctccccttgttcactgcgtcccacagagataatgcttgcctgcatttctactggataagagtaaatcatggtatcttacgatttatctcagtatgctgggctgtatggatgctatcttttcaaggtcaactgttgggatttattttcatgattccttatgtgaccttgtttgttctggatcagtggtcactatttacatggcttgagttttatcagtttaatcaatcaataagttgtgtcaacttgggacattgttgaaccatgtgcattgaaatttgggtggaactaaacagtctagactccaaaatgtgagggccttggaaaccaagaggatgcactagatattttcaatgaacactttattgtttctgtttcattttatttcaaaacatggtatgtactccctgacttcacttgagaagcgagaattgtatccttgttttgatgggggtatggtgagtttgctcagaaaacaatatggctcttggttctccgttgcttatgattcttggtactcgagcactcctgctcatgtgagatactaatgttttgattttgatacagtgcaagtaccttagtgcagaggaggcctgtaggtggtgcttttcagaatgccaaggtcaaggagtccaaccaggcagcaccaaggacgatggatgcactctttgcacagatgaaggcgcaacgcttgaggacggtacctcaacagcaggcaaattcttccccctggagtcatttcaaccagcatcgacgtgttcagcagcagcagaggcgaggcagagggtatggtggccgtaatgttggcaaccaatgaatccaactagacatatctactgcatcggagccctttctcttcactggtcttttggaccttggaagaaaggacgccccttggaaaatcaaacttggctttgtttattggaggggtgacaatgggctctaacttggctttgtttattggaggggtgacatcgggctctaaattttacactaagatttaaggatctgattaagatcaggccctatttctattcatttttaaactaaaatttatttagtgtcctactattttgtgaagcgtttggatcgtgatccattaccacctcacctttggacgtggacaggatatgaagcgaagtttgtttgagttttctagttgtgtgcagtctgcttccgtttcagcatgtataatgacatggaaattatttggtcagagatcaaaaaaaaaaaaaaaatggcggacgcgtggg

SEQ ID NO: 1439 - DNA, 1751 bp, Zea mays
gccggccggggaaaaaaatacctccaggccgcccgccatagaccggacgcccttccactttccccttcccttcccttgcattcgcgcgttttccacctcccatcacgacctcttcctgacgtttccccaattcctccgcgctaagcagagcaacagcgatggcgacgaagtacgctgccgccgcggctgatctggtcacgggccgtccgcggaagcgggcgaggcttggctgggacgtggcgtcggctgccgaggctcagataggaacattttgtgggcaagaagttggtgatgtggccagcctgctattatcagcaaatccttccgaccatacttgttcgtctctgctcccgaagggtgtggctcgaaatgcttcccctccctggagagaagacgataaagatggccattatgtatttgctgttggagagaatttggcctctcgctacaagatatacagaaaaatgggtgaaggtacttttggtcaagtactggaatgctgggaccgagaaagcaaagagatggtggctattaaaattgttcgctctgtaaagaaatacagtgatgcagcaatgatagaaattgatgtcctgcagaagcttgcaaaaaatgatgctgcaggcaaacattgtgttcaaatacggaactggtttgactatcgtagccatatttgtattgtctgcgagaagcttggcccaagcttatatgattttctgcagaaaaccggcttccatccattcccaattgatctaattcgccggatcggacagcaacttttggaatctgttgcattcatgcatcgtcttcagctaattcatactgatctgaaaccagagaacatcctcctcgtttcttcagattatgtcaagttacctgatcccaaggacggatcattctcaaggaaactgccaaaatcaagtgccattaaattgattgactttggaagtgcagcataccatcaccaggatcgcagttacattgtatctaccagacactatcgcgcccctgaagttattttgggacatggatggagctatccatgtgatatctggagtgttggttgtatacttgttgagctttgctcgggtgagacactgtttcagactcacgataacttggaacaccttgcaatgatggatagagttctaggtcctcttccacggcacatgctggaaagagccgaccagcatgcggagaagtacgtcagaaaaggaggattgaactggccacaagcaataacaacagtagagagcgttagagctgttctcaaactgcctcgccttcagaacctggtgatgcagcatgtggatcactctgcgggggacttcattgaccttctgaagcgcctcttagcctatgagccctcgggaaggttgactgctcaagaagcgttgggccatgtcttctttaccagataccggcaataacaagtcgcctcgccatgacatcttcgatgattggctatggcacatttatctgacgaagaattaacaaaatctagagacagttggcgagttctgagtattcagaggcaagagatacagccttgagagaattcagatggtcgttgaacaaagagaacttggcgcgagtgcttgtagacatatctggtatatgtgtgtgtgcacgaagattgcggttggataccaatgtaaatgcaagtgtaactgaattaactgttacaaatttttctttataagctgcaagctcacacacgcagagttccgttgacaaaaaaaaaaaaaaaaaaa

SEQ ID NO: 1440 - DNA, 3594 bp, Zea mays
gtggtctcgtaaaaacgtaatttttacctttattttataaataagtttgcaacacaattcaaagttgttttcaaacgatcatacaagttccagaacagaacattttttatggaaaagtgtctcttatttgtgactgtagggattatctagatgtcttcgttgattaatactaccagtttacattaagatcatctatgggcaatcaaagctaaagaaagttgattagctaggacaacatatagattgacttatacttgtgacgagatgaccggaggaagtatttatacatgtgatttattatttatgatgaatttgaaacctgaagtcacgactcacgagaaaccctggcgcaaaaaaaaaatccaaaaggatataaaaggagtggggtggggttttgaatgtagattactgtccttgtaggctgcaaatgggctgatgtccacactttgggcccattgttaacaacagccagattgcatgtgaaaactgaagccacctacaatactggcatgccgcagtgttggagcatgatttttagttagtaacgcccaaaatttattttagacgcctttttagcgaacaagtggagatgctctaaatcacttaaccctgagtgaactgaacacggcagtttactcattcgttcccccacaaagttcggttggccgctacatccacaagctcatgcacagccctctcgagaggaatggaccagaggctctgcattcgccgcacgactctctctctctctctcagatgtgcggccatggtattggccgcagcgcatgagagagagagctgggagaggccaaaattggtctggtcgctccgtccgatctatatgtacaccacggagggcgctcgggtgtaaaaatagacagttgttgctgctgctcctccgatcttcttccctcttctcctttccttcctcccagccgcgcgtgcggagggaagaggaagaagagattagaagggcgcggaaaggagaagctacattcattagctaataactaggaaaaaaaacaaatttagcgtcggctgggcagacggtggcggcgcgcggggggagcgagcttccacgcgcccttctccctgccttcatctgctccatctgttcaagaacacgccagagaattcaagtgtcgcattgcacttgcactccgtcgagcggtcgagccccgatccatgcctgcgcctgcccctgccatcgccgtcgtcgtgccgccgccgccgtcgccatcgcttacaggttgcgacggctgctactgactgatcgctctggatgtagctataggtacctctcgattggcgtgctgttctgataacttctaacgagcctcgaacacaaaacaaaggtacgcgcgtcagtttaggatcgcattgctgctgtgaattgcgaatttctaatcgagtgactcggatgcatgttaagaagccgctctgccaccggctgccactggcgctggaggcaacgaccgctcgttagccaggatggcaatcgcggtcggccatttccacgacctcaagccccccgccgtgcgggaccggcactacagcctccactccgtcgcgctgctcgacagcctgctgctcgacagggatcatagggagcacggggatgccgccgccgcggccggagggggccacaccggcctgtccccgcggcgccggagccagtcctccccgtgcttcacgaccgtcgcgcctgccggctcggagcacgcggaccagtccgagaacaagatgccgcgcgtggagatcgtcgtgggccgccacgcccgcggcgtgcgcgagctcatcgcggaggccgcggtcgccatcgcgtccgggacgcggcttgtcccggcgcagagcggcctcggcggggcgctgctgctcaacggcagccgcgctggcgagcacgtcgctgtcatcaagccgctcgacgacactgcggccgcggggtcgtcgccggcgaacggcggcgggtacgcgagcaagaccgtgctgcgagaggtggccgccttcctcctcgaccacgacggtttcgccagcgtggagccgaccgcgttgatcaaaatctcgtcccccgcgatggcgacgaccgtggcatcgatccagcgcttcgtggcgcacgagtacgacgccggcgagctgggcccgtcgcggttctccgtggcttccgtgcaccgcgttggcatcatcgacgtccgcctcctcaacatcgaccgccacgccggcaacatcctggtcaagaacccgccaagctcccgccccgccgacagcagcccatccgcgccgccgcggctcgacctcgtgccgatcgaccacggcctctgcctgccggagcagctcgaggacccgtacttcgagtggctgcactggccgcagtcctccctccccttctccgacgacgagctggcgtacgtggcgtcgctggacccgttcaaggacgccgagacgctccgtgccgagctgccgtccctgaaggagcccgccatccggatactcaccgtctgcaccatcttcctgaagcgcgcggccgctgcggggctctgcctcgctgacatcggtgacatgatgacccgcgagttcacggctcagcaggatgtgctgagcacactcgaagcgctatgcaagcaagcgcgtgactccatcctcctcctcccacgcctgccctccttccgacacccctcgaccgacggcgacggcgtcgacgagggtacagccgtctccggcgggcggaagcacgtgtcgttcggcgacctgagcttcgcggagtgggcgtcgttcctggagaggttcgagcagctgctgccggcggcgctagaggccaagaagcgcgctgggctacggacgtcgtcgtcgttctgacttctgagtttctgaccgaagctgaccgtaccacgtactagtcaaccaccaccaccatcaccgtttgcatgcatgcgtgcgtgcgtgcgcgcttgcgtggacgcagtatttgtacacgtgtgcatgccagcttgacgggtaactgacgtgtatgtagctactagctcggatctggatgtcttttgtgtctacgtagggtacgacgaggagacgatactgtaaggtggcatgcatgctctagggagctgttctggaacacccttccaaagacgctgacgtgtcgagcaatgccatccgatactatggacagcaagtcagcaacgagccaacggctcctccagtcctcccccggcaggcgtgtatctgccattattatatacacaacataagtactcagaaaattgtaggtaacgtagttcgatcactgtggattttccgtaatgacggccacacaccggaaacaacacatggctatagaataaaaacccgtgctttttggcgggactatattagaaagcagatagaaatgtataaatattacctttggaaatacatgtggaggaagctgatgaaggtgtgtgatggcagaattttatttatgtttggttcttctgtctaaagtttacttcatgtcaattataaatattaaatacagatttaattaggtttaataaatttatctcatcttttagtctttgtctgtgattaaactatttaataacaggaaaaagtccaaattac

SEQ ID NO: 1441 - DNA, 2240 bp, Zea mays
cctctctctttctctttctcccctgcttccccttccattcccgacggacgacgcaacaacccgcctgccctgccctgccctgcctcacgctcgcacccgcggcggcgcggagggccggaacctaaaccctaaccctagcggcccgcccgcgatggggcagtgctacgggaaggcaggcggcgcgtcgtcgcggcgggcggaccacgacgacgcggtcgcgccgccgtccccgctgccggccaacggcgcgccgacgccgccgcagcagcccgccacgcccgggcgccgcaagtccggatcggccacgccggtgcaccaccaggcggcgacgaccgcctggcccagcccgtaccccgccggcggggccagcccgctccccgccggcgtgtcgccgtcgcccgccaggtccacgccccgcaggttcttcaagcggcccttcccgccgccctcgcccgccaagcacatcaaggccacgctcgccaagcgcctcggcgggggcaagcccaaggagggcaccataccggaggagggcggcgccggcgtcgccgccgactccgccgaggccgagcgcccgttggacaagacgttcggcttcgccaacaacttcggggccaagtacgacctcgggaaggaggtcgggaggggacactttggccacacctgctccgccctggtcaagaagggcgagtacaagggccatgccgtagccgtcaagatcatctccaaagctaagatgacgacagccatttccattgaagatgttcgtagggaagtcaagattttgaaagctctatcagggcacaataatctcgtcaaattctatgatgcatgtgaggacgccctcaatgtctacattgtcatggaattatgtgaaggtggagagttgctagatagaattttggctagaggcgggagatatacagaagtagatgccaaagctatcgttgtacagattttgagtgtagtgtccttctgtcatcttcagggagtagttcatcgtgatttgaagccagagaattttcttttcgcaacaagagatgaaagtgctcctatgaagttaattgactttggtctgtctgattttattagaccagatgaaaggctcaatgatattgttgggagcgcatattatgtcgctccagaggttctacacagatcgtacagtatggaagcagacatttggagtataggtgtcataacatacattctgctctgtggcagtcggccattttgggcaaggacagaatctgggatctttcggtccgtattaagggctgatcccaactttgacgattcaccatggccttcagtatcggctgaagctaaggattttgtgaagagatttctgaacaaggattaccgtaaaagaatgactgctgtccaagcactgactcacccttggttacgagatgaacaaaggcaaattccattggacatactcgttttcagattagttaagcaatatcttcgtgctactcctcttaaacgtttggcattaaaggcactatctaaggctttaagggaggatgaactgttgtatcttagattgcagtttaagctgctcgagcccagagacgggctcgtatcgctcgacaactttcggacggctctgacgagatacgtaactgatgctatgagagaatcaagggttcttgagtttttgcacgcgttggacccgcttgcgtacagaaagatggacttggaagaattctgtgcggcagcaatcagcccgtaccagctggaggctttggaaagctgggaagaaatcgctggaacggcttttcagcacttcgaacaggagggcaaccgagttatatctgtggaggagttggcgcaggaactaaacctcgccccgactcactactccatcgtgcaagactggatcagaaagtccgacggcaagcttaactttcttgggttcaccaaatttttgcacggtgtcacgatacggggctcaaacacgagacgacactaaaatggacgcgaactgtgtattcgcttctaatttaaagcctctctctcgtcgattatatatagatggccctgattttagtgttttgtgatgtcgcgcggctagctgttgttgtcatagctttttgtagagtacgtgtgaagatcatcgtgatggcgaaatcatatggtttgcccaaaaaatcaagtgtcatttgttcctcgccgattttgaatccatcatccgtgggacaaagaccttttgtcaacgtggcgctaaagttgacatc

SEQ ID NO: 1442 - DNA, 6356 bp, Zea mays
  misc_feature (713)..(713): n is a, c, g, or t
  misc_feature (756)..(756): n is a, c, g, or t
  misc_feature (2748)..(2748): n is a, c, g, or t
  misc_feature (2879)..(2879): n is a, c, g, or t
aatgcctattggtggtaatttcttcaattgtttttttggaacagattatgtgaaggtggagagttgctagacagaattttagcaaggtactttttgaatatagtatattcatctctagtagcttagtagaagtatctcttgttaatgcttaccaaggatgtaaacttgaactattgaagaggtgggagatatacagaagaagatgccaaagcgatcattgtacagattttgagcgtagtggccttctgtcatcttcagggagtagtgcatcgtgatttgaagccagaggtatgcttgaatcactttgtgtatagtttgtatatatgtacagtctagtatgtgtttgactggggttttacttctgccatcgtatttaactgtacttgtttttttatatttaagtgacagcaataatgcttgttttgaaagctaggctgccttttgtgacacaattgctatatttcattggcacagaattttctcttcacaacaagagatgaaagcgctcctatgaagttgattgactttggtctgtcagattttattagaccaggtaatgtactaatatttattttttttacatggcccattagtgtacagttatttctgttcttgtaattaaaagttattactttgttcaagggttcgttctagttttctaatatggaattagataagcatcatacatttctctgtaagcagcttaaatgacnacatttggaaaaaattagtctgaacattgattgttattaaaanctaagtttaggtgaacttcttgcaatagaaatccggcaacacagtgtttagtttcatttaggattttttgttgtgtgctcaggatcaaggatttcatcacatatgtatggaccggttttacattatgtttttgcttttccatacttttgttcatacttcatagtgtgtcccagttagctcttatgctgaacaaacagatgtttgccatttgctggatttatatggttggcaggtgcagattaatatggaaagtttgaaaaatctgaacacactaactaaccagcatctgcttgttagtcttgcattttagttgtttagcttgtgcatatgctaggatctttgtgtgtctaaattcacgataaatagtggatacatttgtatatgactatttgttctttgcatgtttctttacgtttggaagttggaatacactatcaacatttacagttaatattttttttcagttcactcattaactaaatcttatacttaattttgtgtgttctgcactatgcaatgcagatgaaaggctcaatgatattgttggaagtgcttattatgttgctccagaggttctacacagatcatacagtatggaagcagacatttggagtataggtgttataacatacattctgctctgtggcagtcggccattctgggcaaggacagaatctgggatcttccggtccgtattgagggctgatcccaattttgacgattcaccatggccttcagtatcggctgaggctaaggattttgtgaagagatttctgaacaaagattaccgcaaaagaatgactgctgtccaagcactgagtaagtcatcacatatgtttattttgtgttggcccgtgattttgatattacaatatctcactttggccttttgtactttacaccaccaccaacaaagtcttttagtcctaagcaagttggggtaatctagagttaaaacccaacagaaaccacaaaaagactagagttgggtagccttttattaacatctattataggaactgctatttatgatacgatgacgaaaaaaattgaatttattttccccttgtctgtttgcagctcacccttggttacgagatgaacaaaggcaaattccattggacatactcattttcagattagttaagcagtatctccgtgctactcctcttaaacgtttggcattaaaggtacagtacagactttcttttctgtatttgtaaacattctttctattcttcaccgatctttgttgatacagcaatatgcaactgataaatgtacatgtgctggatgattataatattgtagtaacacttaatatctttctgtgccacaggcactatctaaggctttaagcgaggatgaacttttgtatcttaggttgcagtttaagctgcttgaacccagagatgggttcgtgtcactcgacaactttcgggcggtgcgttatttgttgttgccgattgccctcatcattagttcattacgaagacatgtcaaaagcagaacacttgctcatgtctttttatgcacattatgttgattttctaatttctaaaatcccatggtgtaaccaggctctgacaagatactcaactgacgccatgagagaatcaagggttcttgagtttcagcatgcggtaaggattcatcattatgatcaaaagcaaaggattatgcagtgatgattatcatatctgtctgtatggaaattttcatagaattatctataattgtaacgttcaaacagtgccctacgcccaattttgagctgatgccatgatgtttcagacctgttaaatcctttccttttagaattagaactcctttttgcatcttgttatttttatctgccaatgcttattataattgatggttgaagttactgacgttgtgttcttatctcagttggaaccacttgcgtacagaaagatggactttgaagaattctgtgctgcagcaatcagcccgtaccagctggaagctttngaaaggtgggaagaaattgctggaacagcttttcagcactttgaacaagaggcaaccgagttatatcagttgaggagttagcacaggtatttggcattgggtcaacattttcagcattggcacttggagcnatgcgggagggcatccccgttatatcagttggggagtgagcacaggaactaaatctcgcgccgacacattactccattgtgcaagactggatcagaaaatcggatggcaagcttaactttcttgggttcaccaaatttttgcacggtgtcacgatacggggttcaaatacaagacgacactaaacagatgcaaactgtattcgcttctaatttgaagcctctcatcgattatatggccctgattgctgttacctcctgcctgccctgcccgagtctggtcaatgaccatccttgtttgtgatgcccctcccgctgttgccgtcgtagcttttgtagagtacatgtaaagatccttgtaatggcgaaatcatatggtttgctcaagaaatatatagtgtcatttgttctttttttttggctcgctaattttggatctttatccgtgggcagtcttttgttgacgttggcgctgaagttgataccgtcgcaggaacctgtaaggatgtaactttgtatgcacatacttgtatattattggcgtaaatttagttgtacactatcaacttataactgggttacaaagaaatgccagatatgtttgggatgaggatctcgctttattagtcatatgctccctccgttcttttttttatttgttgcctattagttcaaaaatgaacaagcgaacgataaacattaaagaacggaggtagtatcaaggattagtcaagaataaacaagcatctcgttgaatttgattgtattttcttttggcgcctggcctttcatatatattagctcttgttttttcttaatgtgatttagagggacctcgtcacggaggtgtccacagcagggagaacgtaacgcagaagaacaaaaatgcaaccaactggctgagcactcatgttattcgtcagtccagtgttccagatggttgcggaaaaacatttgaaattcaagtcactcgaggtaaacgatttgagagcgcttacacttatttttctttatttttttccatagggattttactcctggagtataggtcttatttgtttgggattttttttttcaacttttggctaccaaaagatgttgcggactgccaaacgtcctatcttttcagcttgtttctataacaactgctttggtaaaaaccgttcaaaaggcaacacaacacagaatcgatcgagtcgtcatgatagtaggaattcgttactttctagatcttaaaccctttggaccattccatcattctccgtacgtaatctctatgatactcagattttctctacagtcaaattctctttatagctagattgccagaaaagctagtaaaagaaaagttgaaacaaacagtcccctggtaggtggtaggccgctgaaccttcgacctggtactacttttctgctctctctctctctcatctgtttgtcactgcatgttatattggagccatcatgaatggaagggaagcaaggccactgaatccaatccatcatccatgcgatggggccatctgcatgtgagcagctagaggctcgagctggtcctggacattggacaagaacagccggccagaactgctccgggaataccagaagcagaaatgctgatggcaagcaaagcctgcaacaaggtctgaaacgggaacggctagctagctcatggagacatggaccaaccaaccaccaagacaagacaaaagcagtgggaggcagccaatatggtctgctactgctatatgtatctgtctgtctccttctaaagcgcccaagtcagcagcggaaaacaacatgcgtgcagcagatgcaaccgaaatacaacagaagcaagcttttacatgtaggctgctgggctctgtctgacgtggtgcgtgtgcgtaaacaaaccggattgtctagtctctgaattccgatgagaaacagagaaggtgacaggatcgtgcggaggccatcgacgtcccagtcacgcccacgtggtggtagggacgacagggagagaggaatatgtggagctacagtgaacagatcagcggtcacactcacacacacacacacaaaatggttgtctccatcgactgcaactgaacggagaagggcgcgatccgtagtagtgtatcttcctttttggatatggttgccggccgtgaactatcagtctttaataatgcttgttttttttgttcctcgactctttatttcacagatactctatctgctccaatttataacccgtctgatttttttacacccccgattcctcttatttaatatatatatataattattatttatttttactgtaatatggtttagcatataatgctctaataagtatgtattttgatttctattttttttaagaaaatgaataagacaagccagttaaatttcaagtacgaattataaattgaaacggagggagtatgtgctaatcgtaaacaatacttgttctcctataattaaattaatagatgtatctttctttataaaaaaacacaattctttgaaacatggaaaccatgcaaggtctttacacctgtattgaaaaacgtagtaccaaaagaaaaacggtagttcattgttgtataacagtatcagggtacgtaaaataccaaaaagatgaatttacgagagagcaagacatagaacgacgattatgttgaacctagacacaatttggaaccaacatgcaagctcatggaccttgggacctgcagagggctccaagcaacttagtgttagtgtatgttctaggggaacgacaaccccaaacacctgaatcatttagaagtgcttcgaggcacatgaggcctcagggacttcatctcatgagcgccctaggatacgaggggcccaagagacctatactatcctagccaagaatgtcctaggacactagggcctcaggccatagaatgccccaaggcttgcccatgtccctttatcaatccttatggaactttgtagttatttcttatgtgtgcccgatagcaagatacctaatgtcaagcccatgccctcgctggggcaaggggaggtccctagagcattgtcagagagcaaatcttcggccggatggcggagtgcacccgccctaaattctaagatgaggaggggcctaagcgttttgcttgttagttggaaaagtaggaagaacacaagaacacacaaggatttagagtggttcgggccgccggagcgtaacaccctactccactgtgtgatgtattgcttgagagcttgtatgaacttgtgagtgtctgagtgagcctaagcttggatgtccgcatgcctcccccttttatagctgaaggggggcatgtacaaaaggactctgaaccccgacacgtgggctcagagacataacagatgagataaccggagcaactaatgtcggtcaccttgcaccatcccctgtcccccgacatccgccactcgagtacagttggcgtgttgccgaaggttccttgg

SEQ ID NO: 1443 - DNA, 2527 bp, Zea mays
cgcgcccccctggcccctgcttcttctccttcccctttcattcccaacgaggcaacgacccgccctgccccgcctcgcgatccccacccgcggcggcgcggagggccggaacccaaaccctaaccctagcggcccgggcgccgcctccggtctcgcccgcccgccgcgccgggccgcgatggggcagtgctacgggaaggcgcgcggcgcgtcctcgcgggcggaccacgacgccgacccctcgggggcggggtcggtcgcgccgccatccccgctgccggccaacggcgcgccgctgcccgccacgcccaggcgccacaagtccggatccaccacgccggtgcaccaccaccaggcggcgacgcccggcgccgccgcctggcctagcccgtacccggccggcggcgccagcccgctccccgcgggcgtgtcgccgtcgccggcccggtccacgccccggaggttcttcaagcggcccttcccgccgccctcgcccgccaagcacatcaaggccacgctcgccaagcgcctcggcgggggcaagcccaaggagggcaccataccggaggagggcggcgcgggggccggggccggggccggggccggcgccggcgccggcgcggccgttggtgccgccgattccgccgaggccgaccgcccgttggacaaaacgttcggcttcgccaagaactttggggccaagtacgatctcgggaaggaggtcgggaggggccactttggccacacctgctccgccgtcgtcaagaagggcgagcacaagggccataccgtcgccgtcaagatcatctccaaagctaagatgacaacggccatttccattgaagatgttcgtagggaggtcaagattttgaaagccctatcagggcacgataatctcgtcagattctatgatgcatgtgaggacgccctcaatgtctacattgtcatggaattatgtgaaggtggagagttgctagacagaattttagcaagaggtgggagatatacagaagaagatgccaaagcgatcattgtacagattttgagcgtagtggccttctgtcatcttcagggagtagtgcatcgtgatttgaagccagagaattttctcttcacaacaagagatgaaagcgctcctatgaagttgattgactttggtctgtcagattttattagaccagatgaaaggctcaatgatattgttggaagtgcttattatgttgctccagaggttctacacagatcatacagtatggaagcagacatttggagtataggtgttataacatacattctgctctgtggcagtcggccattctgggcaaggacagaatctgggatcttccggtccgtattgagggctgatcccaattttgacgattcaccatggccttcagtatcggctgaggctaaggattttgtgaagagatttctgaacaaagattaccgcaaaagaatgactgctgtccaagcactgactcacccttggttacgagatgaacaaaggcaaattccattggacatactcattttcagattagttaagcagtatctccgtgctactcctcttaaacgtttggcattaaaggcactatctaaggctttaagcgaggatgaacttttgtatcttaggttgcagtttaagctgcttgaacccagagatgggttcgtgtcactcgacaactttcggacggctctgacaagatactcaactgacgccatgagagaatcaagggttcttgagtttcagcatgcgttggaaccacttgcgtacagaaagatggactttgaagaattctgtgctgcagcaatcagcccgtaccagctggaagctttggaaaggtgggaagaaattgctggaacagcttttcagcacttcgaacaagagggcaaccgagttatatcagttgaggagttagcacaggaactaaatctcgcgccgacacattactccattgtgcaagactggatcagaaaatcggacggcaagcttaactttcttgggttcaccaaatttttgcacggtgtcacgatacggggttcaaatacaagacgacactaaacagatgcaaactgtattcgcttctaatttgaagcctctcatcgattatatggccctgattgctgttacctcctgcctggcctgccctgcccctgagtctggtcaatgaccatccttgtttgtgatgcccctcccgctgttgccgtcgtagcttttgtagagtacatgtaaagatccttgtaatggcgaaatcatatgttttgctcaagaaatatatagtgtcatttgttcttttttttttggctcgctaattttggacctttatccgtggacagtcttttgttgacgttggcgctgaagttgataccgtcgcaggaacctgtaaggatgtaactttgtatgcacatacttgtatattattggcgtaaatttagttgtacactatcaacttataactgggttacaaagaaatgccagatatgtctgggatgaggatctcgcaaaaaagcggccctcgagctccag

SEQ ID NO: 1444 - DNA, 4680 bp, Zea mays
  misc_feature (370)..(370): n is a, c, g, or t
ctgcgacagccgccgatggcgtgtaatcagcgcctcatatttctcctgatctctccttaaattatactaaaaacgcataaagtgtgtgtgactatacatctttaaaagaaccattagatattggcaaagttggttcccgtaggccgtagcctagtgggcaacctagataggaatctcgtttcagtttaatacacgcatctaattaagcagacaatgcatgtccgagacatggtctgagcctgagctctggtgttgactgctgttttcttctctccctgacctataagagcagtcttaaccctccacggtatccaatttctataacattaatttaactgtgatataaactaaaagatgatgtggcaaacanttaaataaagaaagagtaagaaactgggtcttgtataagacttggtttcaacacgatatctaaatcacaacgaaaagaagtattaaattcagttaattaatattgatatttatattgaagaggtagtgtctagcagtagtttctaaatgatgtgtaggctatagaaactataagtagtgttttaggttcggactgctcgaatgcagcaggcagcagctctcgttaaactgtgcactagataataaaaggggtctggctacggattttctaattacttttttttaggagatgcccctagtgtagcagtaccactattactgaatgcgtcgcgctcgagcctttgaattgatgagggacgacggacggttaccgctttgcaaagggaaagcaaaacaaagcagatgggagacaagttaataatgccgtcgctttcatgcattattgtcccccaatctatctttgtcgcttactacacctttcatgaggcgggcgcgtacaacaactgtgcccccgcggtgatctacggtagtgaaaagttattaataacaacaacctatcctcccttttcttatataaccacccaaatacacacagtaacgtagcttacaactaccgcgcggttctcctgcgtgctgaattgctttgcagctatagcagaggttccaaacagtgcaggaagcgtgcgagttcgtcgagcctcgagcggaagcctcggtggggttcgattcgtcggcgcatgaccggaagccgcctcttgtacgtctccctctttttgtacccatgcctatatgcaatcacgcaaatgcgctccgcctgcatagagacagtagagagcgggcaggccccacaccagcgcggacgcgcataggcgcagcagaacccaccctccctccctcaccctgtgacacggcgcggggcacccaccccacccgtcggtcgatagcgcagtgcgcagcggcaacgacagaggagacagacacgagtgggtgtgcgagcattcaggcgaagccgatcaccctcgcccagcccaaagggtcggcgggcaggcgaaagcaacgccccaaccacctgatccctccaccccatcgcacgccataacaaagcagagcgccacgccaccaccaccccagctcactcgtgccgtgcactcgacccgtcccccctccctccactcgatccacccgccaagacctcccattgccgccgccgagccagccagggggggagaagagaggccagccgcgtcgcggcgggcggaggaggaggacgagcgggagagccgagccgagccggccgggcaggatgttcgggcgggacccctggggcgggccgctggagatctccaacgccgactcggcgacggacgacgaccggagccgcgacctggaccgggcggcgctgatgcggcagctggacgagacgcagcagagctggctcctggccgggcccggcgaccaggccggcaagaagaagaagcggtacgtcgacctcggctgcgtcgtcgtcgaccgtaaggtcttcatgtggaccgtcggcaccatcctcggcctcggcgtcttcatcggcttcgtcatcatgatcgtcaagctcgtcccgcacaagcgccccccgccgccgccgcccgaccagtacacgcaggcgctgcacaaggcgctcatgttcttcaacgcgcagcgatgtgagtcgtctgctctgaattctcaattctcctgtcagatccggccgggttttgcgtcagatacatgtctttgttgcttcagtactcctgtcatacatttttttgacaccaacagactccacatgggagattcgtaaaagcgattaaaattgacggagagaacgagtgctgtgctgcaccgacagaaattccccgttttcgcctgctcactcacgacgcgtcttctggaaatgtcagccggcccgctgccgaagcacaatggcgtgagctggaggggcaactcctgcatgaaggacggcctctccgacagcaccgtccgccggagcctggtcggaggcttctacgacgcgggggacgccatcaagttcaactaccccatggcatggtccatgaccatgctcagctggagcgtgatcgagtacagggccaagtacgaggccatcggcgagctcgaccatatcagggagctcatcaagtggggaacggactacatcctcaagaccttcaattcgtctgccgacacgatagacaggatcgtcgctcaggttggtagcaacaacaatagatcatcttggcggctgatttgctctgtcgtgcaaagcaactggtcatcagatccagtaccttggcatcctttctacagcacacatctgcggacagcagaccgctgactcccgtatcaacacttctcaatgcgtgcaggtgggtgtaggtgacacctctaaaggcagcagtcagcctaacgaccattactgctggatgaggccagaggacatcgactacaagaggccggtcaccgagtgccactcctgctcagatctagcgtcggaaatggctgccgccctggccgcagcttccatagtgttcaagaacagcaagacctactccgacaagctcgtcaagggcgccaaggccctgtacaagttcggcaggctgcagcgtgggcgatacagccccaacggatctgaccaggccatcttctacaactccaccagctactgggacgagttcgtgtggggcggtgcgtggatgtacttcgccacggggaacaactcgtacctcaccgtcgccacagccccgggaatggcgaagcacgctggagcatactggtttggaagtccaaactacggagtgtttacctgggatgacaaacttccaggagctcaggttagcatattccgtactcctgcactgaatctgatgataaaagtattcagcatgatcttaatggaaaatgaaaaaaacatggtcatctgcacatgtcagaaacactttgtataagctgaagatataaagaaaaactttgatctttaccaggctactactccgtctgttcttttttatttgtcaagtttttagtttaaaaatatattgacggcgacaaatattcgataacggaggtagtaatacactgtcaaggaaaatcagaaaaaggcttatcagtgtgataatgcagctttctaatgaatgaatatcgatcgccattaagacactttctactctatcccaggtcttctcagcaggttgcgactcttcctaagtccagggtacccttacgaagaaatactgaggacattccacaaccaaaccgacaacgtcatgtgctcgtatttacctgtattcaattcattcaacttcaccaaaggttggtgatggtgatgtccctctctgtttctctgcttcttgctccacagaacagagcttttagctaagcaatgggacattttttttcgcaggaggattaatacagctcaaccatggaaggcctcaaccgcttcagtacgctgtcaacgcagctttccttgcttctttatacagcgactatcttgaagcggctgacacgcctgggtggtactgtggaccgaacttctacaccatagaagtcctccgcaagtttgccaggtcacaggtaaatcgttgttcttaactctccttaggtgcccaacgttacattagcagagaaagtgggtcggtagttaaaacctgctcgatttgcagcttgactacatccttggaaagaacccattgaagatgagctacgttgtgggtttcggaaacaagtacccgaagcgccctcaccacagaggtgcgtcgatacctcataacggcgtcaagtatggatgcaaaggaggttacaaatggagggacacgaagaaggcaaaccctaacatccttgttggagcaatggtggctggccctgacaggcgtgacggctacaaagatgtccgcacgaactacaactacacagagcctacccttgcagcaaacgctggcctggttgcagcactgatttctatatctgatatcaaaaccggacggttcggcatcgacaagaacaccatcttctctgcgatccctccgatgtttccgacaccaccgccgccaccatcagcatggaaaccatagagagacagacctctgaatatccgcccccccccccccccccccaaataaaaaagcatcaacacagggaagtccagcaaacatatgatcagttgcttcaggaacggccaggaacagggaagcggtcagcataggctcatagagcttttatttctgtaccatcgcgacggatcagtatgaaagcctctgtcatacattgaccacaagttgtgtgcatggtgtataagct

SEQ ID NO: 1445 - DNA, 2468 bp, Zea mays
  misc_feature (2437)..(2437): n is a, c, g, or t
aacaaagcagagcgccacgccaccgccaccccagctcactcgtgccgtgcactcgtcccgtccccctccaccctccaagacctcgcattgccaccgccgccgccgagccaggggagaggagagaggccagccgcgtcgcggcgggcggaggaggaggacgagcgggagagcggagcgagccggccgggcaggatgttcgggcgggatccctggggcgggccgctggagatctccaacgccgactcggcgacggacgacgaccgcagccgcgacctggaccgggcggcgctgatgcggcagctggacgagacgcagcagagctggctcctggccgggcccggcgaccaggccggcaagaagaagaagcggtacgtcgacctcggctgcctcgtcgtcgaccgcaaggtcttcatgtggaccgtcggcaccgtcctcggcctcggcgtcttcatcggcttcgtcatcatgatcgtcaagctcgtcccgcacaagcgccccccgccgccgccgcccgaccagtacacgcaggcgctgcacaaggcgctcatgttcttcaacgcgcagcgatccggcccgctgccgaagcacaatggcgtgagctggaggggcaactcctgcatgaaggacggcctctccgacagcaccgtccgccggagcctggtcggaggcttctacgacgcgggggacgccatcaagttcaactaccccatggcatggtccatgaccatgctcagctggagcgtcatcgagtacagggccaagtacgaggccatcggcgagctcgaccatatcagggagctcatcaagtggggaacggactacatcctcaagaccttcaattcgtctgccgacacgatagacaggatcgtcgctcaggtgggtgtaggtgacacctctaaaggcagcagtcagcctaacgaccattactgctggatgaggccagaggacatcgactacaagaggccggtcaccgagtgccactcctgctcagatctagcgtcggaaatggctgccgccctggccgcagcttccatagtgttcaaggacagcaagacctactccgacaagctcgtcaagggcgccaaggccctgtacaagttcggcaggctgcagcgtgggcgatacagccccaacggatctgaccaggccatcttctacaactccaccagctactgggacgagttcgtgtggggcggtgcgtggatgtacttcgccacggggaacaactcgtacctcaccgtcgccacagccccgggaatggcgaagcacgctggagcatactggtttggaagtccaaactacggagtgtttacctgggatgacaaacttccaggagctcaggttcttctcagcaggctgcgactcttcctaagtccagggtacccttacgaagaaatactgaggacattccacaaccaaaccgacaacgtcatgtgctcgtatttacctgtattcaattcattcaacttcaccaaaggaggattaatacagctcaaccatggaaggcctcaaccgcttcagtacgctgtcaacgcagctttccttgcttctttatacagcgactatcttgaagcggctgacacgcctgggtggtactgtggaccgaacttctacaccatagaagtcctccgcaagtttgccaggtcacagcttgactacatccttggaaagaacccattgaagatgagctacgttgtgggtttcggaaacaagtacccgaagcgccctcaccacagaggtgcgtcgatacctcataacggcgtcaagtatggatgcaaaggaggttacaaatggagggacacgaagaaggcaaaccctaacatccttgttggagcaatggtggctggccctgacaggcgtgacggctacaaagatgtccgcacgaactacaactacacagagcctacccttgcggcaaacgctggcctggtggcagcgctcatttctatatctgatatcaaaaccggacggttcggcatcgacaagaacaccatcttctctgcgatccctccgatgtttccgacaccaccgccgccgccatcagcatggaaaccatagagagacagacctctgaatatattttccccccaaagcatcaacacagggaagtggagcaaacatatgatcagttggtacagcaaaggccaggaacaggaaagcggacagcataagcttatagagcttctatttctgtaccagtatgacagatcagtataaaatcctctgtcatacatagaccagaagttgtgtgcatcgcctgaaagctaatttttggggtcttgttgctgttggcattcctgctcatgtgtgaagttattttttgtagaaattgtacctttacaaattgttataggagtgacttttcatagtagtaaagcatttgtgtgacctgtaaacaaaaacaatacagaatacaatactactattacatgaaagngttgacctggttgaatacatataaataaaaa

SEQ ID NO: 1446 - DNA, 2246 bp, Zea mays
ctgcagtgcaacggaatgacgacgacaacatcgacaactctccaacaacaacaacaacaacaacaacaacaacaacgaaggtgtgtttctcagttcctcttagtagatcagatctactcgtcatcgagtttttactttcagttacggattggtattctagagacttaggaatcgatcctaggcggttctccagatgatatcgtttataaaacgccggtcactgaatgtcactcttgtccagatctagcatgccgccctgaccgcaacttccgtagtgttcaaggacagcaaagcatactctagcaagctcttcaaaggtgcaaaagccccgtacaaatttggcaatcttctacaattccaccagctactgggatgagtttgtgtggggtggtgcgtggatgtactttgccacagggaacaattcatacctcacggtcgccacagccccaggaatggcgaagcatgctggagcctactggtttggaagtccaaactatggagtatttacctgggatgacaaacttccaggagctcaggttagcacatttcatactccaatccaatgttgagtctgataaaagtattcagcgtggtcttaatgtaaaggaaaagaaaacatgatccttcgtacatgtcagaaacaggaaaatcagaaaaggcttatcagtgtaataatgcagcttccttatgaatattgatcatcactaacacagtccctacttcatcccaggttcttctcagcaggttgcgactcttcctaagtccagggtacccttacgaagaaatactgaggacattccacaaccaaaccgacaatgttatgtgctcatatctgcctctattcaattcattcaacttcactaaaggttggtgatgtccctccttgtttctaccttccttgctgcacagaataaagctaagagatgcaacattttgcaggaggactaatacaactcaaccatggaaggcctcagccacttcagtatgctgtcaacgcagctttccttgcttctctatacagcgactatcttgaagctgcagacacgcctgggtggtactgcggacctaacttctacaccacagaagtcctccgcaagtttgccaggtcacaggtaaaagcattgttcttaatgctctcaaagtgcccaacgtacggggaagtgaaattgatagttaaattaaatctgttaaatttgcagctcgactacatccttggcaagaacccattgaagatgagctacgttgtgggtttcggaaacaagtacccgaagcgccctcatcacagaggcgcgtcgatacctcacaacggcgtcaagtatgggtgcaaaggaggttacaagtggagggacacaaagaaggcaaaccctaacatccttgtcggagcaatggtggctggccccgacaggcgcgatggctacaaagatgtccgcacgaactacaactacacggagcctactctcgcagcgaatgctggtctggttgcagcgctgatctctatatccgatatcaaaaccggacggttcggcatcgataagaacaccatcttctctgcgattcctccgatgttcccaacacccccgccgccgccatcagcatggaaaccatagaggcaatacctctgaatgtttttccaaagcatcgaacagggaagtggagcaaacgtgtgatcatttggtacagcgaaggccagagacaggaaagctgacagcataagtttatagagcttctatttctgtaccaatatgacagatcagtataagatcctctgtcagacatagatcggaagctgtgtgcatcgcgtggagctaatttttgggggtcttgttgctattggcactccagctcatgtgtgaagttctttttgtagaaatggtacctttacaaattgttttataggagtgacttttcattattatagtaaagaatgcgtgtgatctctatgcttgcttcattttgatcctgttattttgtattcaaaaaatccctgtttgaggggaaatatgtttggtaacaagagatcacaggggatgggtggggtgggaaattagttcttgtcctcctcaatttcctccaattctcctgtggtcctctggttaccaaatcaaccctaagttctcggaaattacaatggaatgacaaaaggacaaacatgagtagtgcaattagtattctcgccgtttgtgttttgctcgtccatataagggcttgttcgtttagctctcaatccatgtggattgagtggaatt

SEQ ID NO: 1447 - DNA, 1401 bp, Zea mays
  misc_feature (1102)..(1102): n is a, c, g, or t
gagagagagagcagctccccccccccccccccccccccccccccaatgttatgtgctcatatctgcctctattcaattcattcaacttcactaaaggttggtgatgtccctcctcgtttctaccttccttgctgcacagaataaagctaagagatgcaacattttgcaggaggactaatacaactcaaccatggaaggcctcagccacttcagtatgctgtcaacgcagctttccttgcttctctatacagcgactatcttgaagctgcagacacgcctgggtggtactgcggacctaacttctacaccacagaagtcctccgcaagtttgccaggtcacagctcgactacatccttggcaagaacccattgaagatgagctacgttgtgggtttcggaaacaagtacccgaagcgccctcatcacagaggcgcgtcgatacctcacaacggcgtcaagtatgggtgcaaaggaggttacaagtggagggacacaaagaaggcaaaccctaacatccttgtcggagcaatggtggctggccccgacaggcgcgatggctacaaagatgtccgcacgaactacaactacacggagcctactctcgcagcgaatgctggtctggttgcagcgctgatctctatatccgatatcaaaaccggacggttcggcatcgataagaacaccatcttctctgcgattcctccgatgttcccaacacccccgccgccgccatcagcatggaaaccatagaggcaatacctctgaatgtttttccaaagcatcgaacagggaagtggagcaaacgtgtgatcatttggtacagcgaaggccagagacaggaaagctgacagcataagtttatagagcttctatttctgtaccaatatgacagatcagtataagatcctctgtcagacatagatcggaagctgtgtgcatcgcgtggagctaatttttgggggtcttgttgctattggcactccagctcatgtgtgaagttcttttttgtagaaatggtacctttacaaattgttttataggagtgacttttcattattatagtaaagaatgcgcgtgatctctatgcttgcttcgaagccgngatgaccggcgactggaggccctccgccaccgaccgcgccgcggagaggctccccggatacggcctgaccacgaacatcatcaacggtggtctagagtgcggcgaggaccgctccaccgacggcgccaaagccgccatggaccggcttcggctacgacaaaaggtactgcggtatgctcgtagtggcatacggtgactacatggcatgcgggagccccaagccttacgcaggatgatgacactagctactgatctatggttgctgccatgcaagccttcacgtgtgtctgcctctctac

SEQ ID NO: 1448 - DNA, 772 bp, Zea mays
  misc_feature (715)..(715): n is a, c, g, or t
ctggccgggacacgcagtgccgtgccgcaagaatctcccttaaactcactcgcctcgcctcgcctcgcccacccgcccgcctgtccctccccaaggccgcagctcactcgtgtcgtgcacccgtcccctcccacccgccaagaactagcattgccgccgccggtgccactgccaggggacggaggggaggccgcggcggcgagggagcggcaccaggcgcaagggggggaggagaagcaggagagccgccggcaggatgttcgggcgggacccctggggcgggccgctggagatctccaacgccgactcggcgacagatgacgaccggagccgggacctggaccgggcggcgctgatgcggcagctggacgagacgcagcagagctggctcctggccgggcccggcgaccaggcgggcaagaagaagaagaggtacgtcgacctgggctgcgtcgtcgtcgaccgcaagatcttcatgtggaccgtcggcaccatcctcggcctcggcgtcttcatcggcttcatcatgatgatcgtcaagctcgtcccgcacaagcgcccgccgccgccgccgcccgaccagtacacgcaggcgctgcacaaggcgctcatgttcttcaacgcgcagcgatccggtccgctgccgaagcacaacggcgtcagctggaggggccattcctgcatgaaggatggcctctccgacagcaccgtccgnccggagtttggtcggaggcttctacgatgcaggggacgccatcaagttcaactaccc

SEQ ID NO: 1449 - DNA, 3035 bp, Zea mays
ctgcagttgtattctataaacaaaccactttaagggctagttaaatagtccaaaaaccaaatgagattttagggactaaatttccattcttatttaaattagaataagactgagattttatctttctaactttcttctattttagactcccaaactaattctaaaagtagtaggaggcggttcaaattatagacaaacaattaagttggtcagcttcaaatcttgtgccgtacaaatcagtgcccccaagtgggcaacccaaccgtgacgcgcacaggctcagaccccacacggcgcggtgcactcacccgcccgtcggtcgataggcgatagcgcagcgcctgcggcgacgacacaggactacactacaggcgagacgagtgggtgtgcgagcgggcggacgatagcaacgccccaacaacctgatccctccccttcaccccatcgcacgccacaacaaagcagagcgcggcgctacacctacacacctccacccggaccacccccccacagtcccacaccacaccacgcagtgccgtgccgcactgctgtcctgcaatctcccataaactcactcgcctcgcctcgcctcgcctcgcccacccgcccgcctgtccctccccaaggccgcagctcactcgtgtcgtgcacccgtcccctcccacccgccaagaactagcattgccgccgccggtgccagggggcggaggagaggccgcggcggcgagggagcggcaccaggcgcagggggtcaggagagccgccggcaggatgttcgggcgggacccctggggcgggcctctggagatctccaacgccgactcggcgacagatgacgaccggagccgggacctggaccgggcggcgctgatgcggcagctggacgagacgcagcagagctggctcctggccgggcccggcgaccaggcgggcaagaagaagaagaggtacgtcgacctgggctgcgtcgtcgtcgaccgcaagatcttcatgtggaccgtcggcaccatcctcggcctcggcgtcttcatcggcttcatcatgatgatcgtcaagctcgtcccgcacaagcgcccgccgccgccgccgcccgaccagtacacgcaggcgctgcacaaggcgctcatgttcttcaacgcgcagcgatccggtccgctgccgaagcacaacggcgtcagctggaggggcaattcctgcatgaaggatggcctctccgacagcaccgtccgccggagcttggtcggaggcttctacgatgcgggggacgccatcaagttcaactaccccatggcctggtccatgaccatgctcagctggagtgtcatcgagtacagggcgaagtatgaggccatcggtgagctcgaccatatcaaggagctgatcaagtggggaacagactacatcctcaaaaccttcaattcatctgctgacacgatagacaggattgtcgctcaggtgggtgtaggtgacacctctaaaggcagcagtcagcctaatgaccattactgctggatgagaccagaggacatcgactacaaaaggccagtcaccgagtgtcactcttgctcagatctagcgtctgaaatggctgctgccctggctgcagcttccatagtgttcaaggacagcaaaacctactccgacaagctcgtcaaaggcgcaaaagccctgtacaagttcggaaggctgcagcgcgggcgatacagccccaatgggtctgaccaggcaatcttctacaattccaccagctactgggatgagtttgtgtggggtggtgcgtggatgtactttgccacagggaacaattcatacctcacggtcgccacagccccaggaatggcgaagcatgctggagcctactggtttggaagtccaaactatggagtatttacctgggatgacaaacttccaggagctcaggttcttctcagcaggttgcgactcttcctaagtccagggtacccttacgaagaaatactgaggacattccacaaccaaaccgacaatgttatgtgctcatatctgcctctattcaattcattcaacttcactaaaggaggactaatacaactcaaccatggaaggcctcagccacttcagtatgctgtcaacgcagctttccttgcttctctatacagcgactatcttgaagctgcagacacgcctgggtggtactgcggacctaacttctacaccacagaagtcctccgcaagtttgccaggtcacagctcgactacatccttggcaagaacccattgaagatgagctacgttgtgggtttcggaaacaagtacccgaagcgccctcatcacagaggcgcgtcgatacctcacaacggcgtcaagtatgggtgcaaaggaggttacaagtggagggacacaaagaaggcaaaccctaacatccttgtcggagcaatggtggctggccccgacaggcgcgatggctacaaagatgtccgcacgaactacaactacacggagcctactctcgcagcgaatgctggtctggttgcagcgctgatctctatatccgatatcaaaaccggacggttcggcatcgataagaacaccatcttctctgcgattcctccgatgttcccaacacccccgccgccgccatcagcatggaaaccatagagaagcaatacctctgaatgtttttccaaagcatcgaacggggaagtggagcaaacgtgtgatcatttggtacagcgaaggccagagacaggaaagctgacaacataagcttatagggcttctatttctgtaccaatatgacagatccgtataagatcctctgtcagacatagatcggaagctgtgtgcatcgcgtggagctaatttttgggggtcttgttgctattggcactccagctcatgtgtgaagttctttttgtagaaatggtacctttacaaattgttttataggagtgacttttcattattatagtaaagaatgcgtgtgatctctatgcttgcttcaaaaaaaaaaaaaaaaaaggcccctaaaaaaaaaaaaaaaaaaaaaaaaaaaa

SEQ ID NO: 1450 - DNA, 2483 bp, Zea mays
cattgggtacctcgaggtcggccgggaaagcagatcgccacgccaccaccaccccagctcactcgtgccgtgcactcgacccgtcccccctccctccactcgatccacccgccaagacctcccattgccgccgccgagccagccagggggggagaagagaggccagccgcgtcgcggcgggcggaggaggaggacgagcgggagagccgagccgagccggccgggcaggatgttcgggcgggacccctggggcgggccgctggagatctccaacgccgactcggcgacggacgacgaccgcagccgcgacctggaccgggcggcgctgatgcggcagctggacgagacgcagcagagctggctcctggccgggcccggcgaccaggccggcaagaagaagaagcggtacgtcgacctcggctgcctcgtcgtcgaccgcaaggtcttcatgtggaccgtcggcaccgtcctcggcctcggcgtcttcatcggcttcgtcatcatgatcgtcaagctcgtcccgcacaagcgccccccgccgccgccgcccgaccagtacacgcaggcgctgcacaaggcgctcatgttcttcaacgcgcagcgatccggcccgctgccgaagcacaatggcgtgagctggaggggcaactcctgcatgaaggacggcctctccgacagcaccgtccgccggagcctggtcggaggcttctacgacgcgggggacgccatcaagttcaactaccccatggcatggtccatgaccatgctcagctggagcgtgatcgagtacagggccaagtacgaggccatcggcgagctcgaccatatcagggagctcatcaagtggggaacggactacatcctcaagaccttcaattcgtctgccgacacgatagacaggatcgtcgctcaggtgggtgtaggtgacacctctaaaggcagcagtcagcctaacgaccattactgctggatgaggccagaggacatcgactacaagaggccggtcaccgagtgccactcctgctcagatctagcgtcggaaatggctgccgccctggccgcagcttccatagtgttcaaggacagcaagacctactccgacaagctcgtcaagggcgccaaggccctgtacaagttcggcaggctgcagcgtgggcgatacagccccaacggatctgaccaggccatcttctacaactccaccagctactgggacgagttcgtgtggggcggtgcgtggatgtacttcgccacggggaacaactcgtacctcaccgtcgccacagccccgggaatggcgaagcacgctggagcatactggtttggaagtccaaactacggagtgtttacctgggatgacaaacttccaggagctcaggttcttctcagcaggctgcgactcttcctaagtccagggtacccttacgaagaaatactgaggacattccacaaccaaaccgacaacgtcatgtgctcgtatttacctgtattcaattcattcaacttcaccaaaggaggattaatacagctcaaccatggaaggcctcaaccgcttcagtacgctgtcaacgcagctttccttgcttctttatacagcgactatcttgaagcggctgacacgcctgggtggtactgtggaccgaacttctacaccatagaagtcctccgcaagtttgccaggtcacagcttgactacatccttggaaagaacccattgaagatgagctacgttgtgggtttcggaaacaagtacccgaagcgccctcaccacagaggtgcgtcgatacctcataacggcgtcaagtatggatgcaaaggaggttacaaatggagggacacgaagaaggcaaaccctaacatccttgttggagcaatggtggctggccctgacaggcgtgacggctacaaagatgtccgcacgaactacaactacacagagcctacccttgcggcaaacgctggcctggttgcagcactgatttctatatctgatatcaaaaccggacggttcggcatcgacaagaacaccatcttctctgcgatccctccgatgtttccgacaccaccgccgccaccatcagcatggaaaccatagagagacagacctctgaatattccccccccccccccccccccaaaaaaaaagcatcaacacagggaagtggagcaaacatatgatcagttggtacagcaaaggccaggaacaggaaagcggacagcataagcttatagagcttctatttctgtaccagtgtgacagatcagtataaaatcctctgtcatacatagaccagaagttgtgtgcatcgcgtgaaagctaatttttggggtcttgttgctgtgggcattcctgctcatgtgtgaagttattttttgtagaaattgtacctttacaaattgttataggagtgacttttcatagtagtaaagcatttgtgtgacctgtaacaaaaaaaaaaaaagagatggtacagaaaaaaaaa

SEQ ID NO: 1451 - DNA, 1731 bp, Zea mays
aatcggtacctagctgtcctagcacgtgaaaattccttcggctccagttattacggaggattaggttggtgaactggtgactggagctggaatcgcatttcttgctctttggtctctccagaatcatcctccggccagccgttcttggaatcctcccgagattcgcttgcccgcccttttcttttcaagtggatctgaacttgggagggaaccccgatgcagccgcggtacggagaagcacgacaaccgctgccggggcggtacgcgctgtaccacttcggcaccagcggcgccgccgtcgccgccgccaccgccgtgacccatccgttcgatgttatcaaagtcaggcttcaaatgcagcttgctgggcaaagaggaaacttagttggaatgggaacaatatttacacaaatggttgaaagggaagggactcggtcactctacctgggacttgcaccagcgttggcgagagctgttgtctatggtggccttcggtttggactgtatgagccctgcaagcatgtctgcagttatgcatttggttcaacaaactttgcttttaaatttgcatctggagtcattgctgggggccttgcaactgctttaacaaatcccatggaagttttgaaggtgaggctgcagatgagtaaaagcagtaccagtacaataagagagatgagaaaagttatagcgcacgaagggtttaaagcactttggaaaggagtcggcccagcaatgacaagagcaggttgccttactgcatcacaaatggcgacttacgatgaggccaaacaggccttaatgaagtggacaccacttgaagaaggttttcagttacatctcatctggaacagctggtactcttgtgacctcacctgtagacatgatcaaaacacggttaatgctgcaacaggagtccaaaggcgccagagtatacaggaacggattccattgtgcttcccaggttgtggtgacagagggtgtgaaatcactttataaaggtggatttgccacattcgcgagagtaggccctcagacaacgattacctttatcgtgtgcgagaaactgcgcgaacttgcaggaatgactgccatctagtgccaccccaaattgcataatgtgtggggtccaacggttgaacagcatactctacccgagttttcacaccattctttattcactattcatgatgagaagggagaagataagcacccactgggatgtctaaggattgggaagcccagagctccttcagatttatcatacctcatttgaaatttcgaaatagcgtgattgttcttatgtttgctctaagacttactcatcatatctccaatctcatcttgtatttcaaactacactctacaaacaatacagtctgtagtgaaaaaaaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaaaggacccaagtttacttccccgggcttgcaacgtaaaagtttttttatggggcccccaaatttaaattcccgggccggggtttaacaacgtggggacgggaaaacccctggggttccccaattaaatgcccttgaagaaaatccccttttccccagttggggtaatagcaaaagggcccgccccgatcccctttccaaacatttgcccaccc

SEQ ID NO: 1452 - DNA, 2818 bp, Zea mays
agccgcgcctgcttgctgcttccccctctctttttctctcgtctccttccccgcgccgccaccaccagtccaccattccagcatcatcaccaccacccgagacaaaaaaataaaaaaaacccaacaacactgtaacgagaatatacggcaaaaccctagatctctctctcctctcggcattgctggctggggtgtgcggcggcccgcagtggtgagggacgcacggcgatggcctccgccgccgccgtcatcgcctcgccggcccccggcgccgccgcggccgagcccgccgcctggctcgtcgacgagcgcgacggcttcatcacctggctgcgcggcgagttcgccgccgccaacgccatcgtcgaccacctcatcttccacctccgctccatcagcgagccgggcgagtacgaccacgtcttctctctcgtccagcagcgccgccaccactggccgcacgtgatccacatgcagcagttcttccccgtcagcgacatcgccttcgcgctccagcaagccagctggcgccgccacgcgccgccggcccaggcgctcggggctggcgcgtcgccggccgcgctcccgccgccgcctcctcgccgcgcctcgttctcgcagtcccatcactcccaccagcaccatcgccacggcgcccactaccgccccgatccagcgcgcggcgccgccactgcggcgactggatccgagaaagatggacgtgaagttcataataacaaggaagggagggggctgaaagaagcggggaatgtcgtcgatactaaaagtttgcggttggattctcctataactgatgaaggtgaggaaaaatcaaagctgcaagctgtttctgaagaaagtagcaaaatggttgcaacccctgtagagtattcaaccaatgagatcattgatggcagcatggttaatactgttgaagggctcaaggtttatgaaggattactaaatgtaaccgaggcaaataagatcctttccttagtcaatgaaacaagagcctcttaccggcgaggggggcttgaagctagacagaaggttattattgctaaaagaccaatgaagggtcatggacgggaaattgttcagctgggtgttcctattattgatggccctcctgatgatgaaaatctaagagagacaagggtggaggcgattcctgggctgctgaatgatctgtttgatcgcttgtctcagcaggaaattatacccttcaagccagattattgtgtcattgacatcttcaatgagggagactattctcatcctcaccaatccccttcttggtatggtagacctctttgtaccctctgcttaacagattgtgatatggtgtttggccgttatatatcaggagaaaaaggcgatcatagaggtcctctgaagctctcgctcgcaactgggtcacttctactcatgcaagggagaagtattgactgtgcaaagcgagctattcctgctacacgcaagcagagagtcatactgaattttggaaagtccgtagcaagaaagcacatcccagctgaaagtgcctggtctactccattaacacctcctatgccctggggtcagtcatcaaggccagttaacggctcccgccatccccaaagtcctaaacactatgggtatgctccaatcagcggtgtacttccagcaccaccagttggagctcatcacgtcccaccgtctgatgggatgcagccactatttgtagcccctgctcctatttctgctgcagccatacctttcacgccaactgttcccttgcaaaatacatcagctgcttggatacaagaagttactccaaggcctgctccgccacgattccctggtcctggtacgggggtcttccttcctccgggatcaggccaccctctgcctcatcagatgatgccggcttctcatggccatggcgaacccaactctccacaaggttcatccgcttacctgcatagtaaggtcaatggcaaggagacatctaatggcaatctttctcctaagaactcgccgagaaagacatcttgcacagccgaggagaaaccagaatgcaatgggagcttaaatggtggtggcggctctgcggatgagaagtcaactgtaggtatggagcagcagaatggtgttcagaagaatgttgggagtagcaaggtccagccacatggacatgcaactgaatagagtgggacttatagtacatagacaacagaaaactgaagagacgaggagttgaattttgggccgtgaatttgcggtagtgcgcagagctcagcagaggtctttgctggcactctcttgtccctgacaagaatcatcgtgtcaagttctcgagacggaaaacatttgtcctaaactttgtagctgcactgttgcaaatctagattatcgacattgcctcgggttatcatctgctatcagagtcgtgggcagtgaaaaccatttctgatggtttatgttgcccaaatattatcgacctagtacatctgaaatgggaaaaaatgtggacgaaatttcttgcatcgaaaaaaaaaaaaatcgactcgcctttgatgcatctgtagcagactacttatggtagactgttacttgctgatagatggttctgctacaggtgtttgctgtggatgtcaattatatcctggactgtgagcttttcgaaacccacataacacaaaccacacaacctaaaggtcagagcacaaagaatggcgcaggacatccgatgtttcttgcttgtctgctaggaataaagcatgttgtgactattagacttattggttgtaatagactactcggttaagttcgggtt

SEQ ID NO: 1453 - DNA, 2362 bp, Zea mays
cgggcgcgtgggccttccacttcgcctcctcttctctctctcccccgtctcctgtctccacctgttccatcgcattctcctcccaccaccaccacaccacgcctcgcttatccccccccgagacccgacccctgctcgacgacgtgctggcaaaacctcctcctagtcctctcgcagaaggaggctgtgttctttccttcatcggtgcggcaacagcgaaagcttctcggtcgatctctcccaccgctgctccgccgtttgggtggttccgcgccttggccgcgcgggttggatccgagctccgtgcagcagctccgccgcgatacgtatcgcataggattccactggattcagctgctgagcagggtactggaaggtggatttgatactagctctgaacagccagtagaatttctcaaatactgtccaggatcatggcttctctctgtgatttctgtgggaaacaaaggtcaatgatctactgcagatcagatgcggcatcattgtgcttatcatgcgaccgtaatgttcattcagctaatgcactgtctcgacgtcatacaaggacccttctttgtgatcgttgtggttcacagcctgcatcagtccgatgtcttgaggacaacgcatcactttgccaaaactgtgactggaatgggcatgatgcagaatcaggggcttctgggcataaaaggcaagccataaactgctactcagggtgcccatcatctgcagagctttcgagaatctggtcatttattactgatatcccgactgtagcagctgagcccgactatgaggatggactaagcatgatgacaattgatggcagtgacgttactaatcgtcacgatacttcagatgataaaagattgttggaaatagctaacacaacactcatgagcgatccaccttcagccgacaagcttaaatctccgacaggctcttcttctggagatgggtttgatgttatgactctagccacagatcagcctgctggaccagtttcagcaacgcctaaggtacctaatgccagagatgatgataagttcaatgatggcatgtacgaagacttgtgtgtagatgatgctgaccttacattcgaggattatgaagagctttttggtacctctcacattcgaacagaggaactctttgatgacgctggaattgacggttacttcgaattgaaagagacaccacctttttatttcaacgagcagcccaaagctatgcagatagaatgtggcaacgtggtatcagctgattgtgcgatgtcaaacccaggggcaagggctgattccagcctttgtattcccgtcaggcaggtcagatctagtatatcccactccttatctggtctgactggtgagagcagcgctggagatcaccacgactgtggggtgtcaccaatgctcctcatgggtgagccaccctggcattctcctggtggtccagaaggctcagtcgctggaggcagcagagatagcgctctcacacggtacaaggagaagaagaagaggagaaagtttgacaagaagatcagatatgcttctcgcaaggccagggcggacgtgaggaagcgggtcaagggacggttcataaaggccggtgaagcgtacgactatgatccgctaagccagactagaagctactgagccttgggagtgtgactgttgttgtcgtccagtgtcagcctcgcagtctccagccgctcgtcggttgcaggctgcgctacagccaagatcactggagagcacaacgatcgcattgcatcagagcctgcatctgaaaaaacgttaagaagagataccaagtgttgggatgaatgaaaaaaaaaagacaaaaaagaaagatgcagacttgccggactcatatccattattcagtttctctgcggatgagtggcttggatcgcactgtgccatctgcgcgtcgaacagatgcagtgatggatgggcgctcgtcgtcctccagctgtaccgctgtgcgctaggacctgcgtcggctatatacggctgttcggcagtgagctgccaggttgtacagtctgggtaacagcctaacagggtatgcttatacctctcggttttcgttctgtaatacgtacgtattatttgcgcttgccaggagactgttcttcggccgtgtgtatgtttgtagatggttgcaacattggtaaaaaaaaaagtagccgtcgtgaatgtaaatttgtattcttgttaggtcgcatatagcgttggcgatgagcaggagaatcacacgtatctggacactgaacgtctgaacccttgtaactatttttgcgccagaataaccttcttgtgccttgtcgtttaaaaaaaaaaaaaaaaaagcggcc

SEQ ID NO: 1454 - DNA, 2515 bp, Zea mays
  misc_feature (1811)..(1811): n is a, c, g, or t
  misc_feature (2353)..(2353): n is a, c, g, or t
cggttatcgttgtattcttatctgatgctggttacatctctcaggtacctaatgccagagatgatgataagttcaatgatggcatgtacgaagacttgtgtgtagatgatgctgaccttacattcgaggattatgaagagctatttggtacctctcacattcgaacagaggaactctttgatgacgctggaattgacggttacttcgaattgaaagagacaccacctttttatttcaacgaggtatgtacttctcttgtatgactctgtaattctaaatatatgacatttaggacatgaacatagtctagaaagtgacaattcggcaaggaatttctatgaaaatatggtatttcaaacaaagataactaaatgttatgaaactacttcaggttatcttacactgtcaatgcacacgactgttatatctggatggccaaagcgtatattttcatttgaatttttcctgtggcaaagagagcttctgtgcttacttctagttagccagcgtcagtttattttctgtcctcagttgttatttatggtttctgttaatttcactcatcaagtctgagttgaggacaatttgtgtttattttccatccatagaatactctattttttttaaaaaaaactcggcgaatgctattatatacacaaaggggtcaagtgttcttgttttactaaacttttgggacttctttttaatgttttcagcagcccaaagctatgcagatagaatgtggcaacgtggtatcagctgattgtgcgatgtcaaacccaggggcaagggctgattccagcctttgtattcccgtcaggcaggtcagatctagtatatcccactccttatctggtctgactggtgagagcagcgctggagatcaccacgactgtggggtgtcaccgatgctcctcatgggtgagccaccctggcattctcctggtggtccagaaggctcagtcgctggaggccgcacacggtgcccccgcccccgccacgcggagaagaagaagaggagaaagtaagcacggctaaatgtctttttgtggttatttttctgcgcctaacattcatatagaccatggctatctttttaagcaaatgcctcccaccttctgggtctctcgtttctagttccaatactgtattgaccttttcttttcttttccacgaatttggccgacaggtttgacaagaagatcagatacgcttctcgcaaggctagggcggacgtgaggaagcgggtcaagggacggttcgcgtggtcgcggccgaggtacgactatgatccgctaagccagactagaagctactgagccttgggagtgtgactgttgttgtcgtccagtgtcagccggcctcgcaatctccagccgctcgtcggttgcaggctgcgctacaggcaagatcactggagagcacaacgatcgcattgcatcagagcctgcaactgaaaaacattaagaagagataccaagtgttgggatgaatgaaaaaaaaagacaaaaaagaaagatgcagacttgccggactcatatccattattcagtttctctgcggatgagtggcttggatcgcactgtgccgtctgcgcgtcgaacagatgcagtgatggatgggcgctcgtcgtcctccagctgtaccgccccgcgcggccccctccgtcggctatatacggctgttcggcagtgagctgccaggttgtacagtctgggtaacagcctaacagggtatgcttatacctctcggttttcgttctgtaatacgtacgtattatttgcgcttgccaggagactgttcttcggccntgtgtatgtttgtagatggttgcaacattggtaaaaaaaaaagtagccgtcgtgaatgtaaatttgtattcttgttaggtcgcatatagcgttggcgatgagcaggagaatcacacgtatctggacactgaacgtctgaacccttgtaactatttttgcgccagaataaccttcttgtgccttgtcgtttactcgtctgagatactacgatttatgctcctttccttgcgctgcgtctgcgtcgtgaactcatgattaactgagtaatgtcttataacacctcgttcaatccctgaaccggcggtatttattcctgacaactctctaagatcatatattgtctctatagatcaacacgcaatttttgtgcgcactttgtcctcactcgtgcgcacccgaaaaaactttccggtcgatcatccatcctaaattgctctaagccaagtacacttaacttgaaggttctttcgagatagactttcgaaaaagaagataccttattgatatgaatactatattaattctattaaactttgagttangatatctcatcccaggagttaggatatcacaatccacccctcttagaagaccaacgttctcgtcggtcaactcaatccagtaacttccactcttggccacgtctgtatgtctagtgtcgtcatacgtcatgccatgtgaccactccggacccacatacgtca

SEQ ID NO: 1455 - DNA, 2036 bp, Zea mays
ttgggtacctcgaggccggccgggtcgggtctgtccaccaccactcgagagaccgccgcgcgccccccccgcccccgcccccaaaacccaataaaaaaacgcacctttccttccttcccctcgctttccccctccttcctcccctcgatcccctcgccgggaaagatccgatcccatccacgtcgcggcgcaaccagagttccccgtcggcgaagcaggaaggcggaagcgaaaggaatgttgcacctttgaagcggcgcggcgacccggtgtttcttcctggccggcgatgggctgcttctcgtgcttcgactccccggcagatgagcagctcaaccccaaattcggtggcgactgtgggtacggcggcacctctgcggccgcggcgtatggagccggcttcggccggcacggggacagggggtacccggacctgcagcaggcgcccgtggcggcgccgcgcgtcgagaagctctccgcagcggctgagaaagcaagagtaaagagcaatgggctcaccaaagaggctttggtgccaaaggatgccaatggcaatgccatctcagcgcaaactttcaccttccgtgagcttgctaccgccaccaggaacttcaggcccgagtgcttcctgggagagggaggttttggacgtgtttacaagggccgccttgagagcacaggccaggttgttgctataaagcagcttaacagggatgggcttcaaggaaacagagaatttctagtagaagttctcatgctcagcttactacatcatcaaaacctggttaatttgattggttattgtgctgatggagaccagagacttcttgtttatgaatatatgccttctggatcacttgaagatcatttgcacgatatacctcttgataaagaggccttggactggaacaccaggatgaaaattgcagcaggtgctgccaaaggactggagtacctacacgacaaagctaatccaccagttatttatagggatttcaagtcgtcgaacattctgttggatgaaagtttccacccgaagctgtctgactttggacttgccaagttgggtccagttggcgacaaatcacatgtctcaacacgtgtaatgggtacatatggttattgtgcaccagaatatgctatgacagggcagctgacagtgaagtccgatgtgtatagctttggggtcgtcttgctagagttgataactggtcgtagggctatcgacagcaccagaccacatggagaacaaaatcttgtctcatgggcacgtcctcttttcaacgacagaaggaagctccccaagatggccgacccaaggctggaagggcggtaccccatgcgcgggctgtaccaagccctggcggtggcttccatgtgcactcagtcggaggccgcttcgcggccactgatcgcggacgtcgtgaccgctctgtcctacctggcgtcccagccgtatgaccccagcacagctttcgcttcaaggaggcttggtggaagcaagcctggcgagaatggcggcagggtggtttccaggaacgacgagaccggaacctcaaggtcgccggggaaggaccgggaggactcgcccagggacctcccggctatcctcctgaacaaggacctcgaacgcgagcgcatggtggcggaggccaagatgtggggcgaccgggagcgcatggtggcggaggccaagatgtggggcgaccgggagcgcatggtggccgaggccaagatgtggggcgagaattggcgcgacaagcggcgcgcagagaatgggcagggcagcctggactcgccgcctactaggaacagctaggggacaggggagagcctttcacacattccatccatgcttatcggttgtttatttccaggtcgattttcgtcgccgcggcggcgagcagggccatggggcatggagggttagatgtacatttctagggcagcgtcgtactggatagtgaatgcatttggttgtacttgtaaattctcagaaaaattttgtgagaatgaaaggacgcattttgagttcc

SEQ ID NO: 1456 - DNA, 910 bp, Zea mays
  misc_feature (907)..(907): n is a, c, g, or t
  misc_feature (909)..(909): n is a, c, g, or t
cattgggaccctcgaggccggccggggaacaaacttccctgaattcctgttcgctaccttcgcttccgctccaaaaaccaaataaaaaacgcacctttccttcccttctcctccccttcgctttcccccgtcctcccttccctcgatcccctcgccggaaaagatcccattccatccacctccacgtcccggcgcaatcagagtttccggcggcaaagcaggaaggcggaagcgaaaggaatgttgcacctttaagtagcgcggcgacctggtgtttcttcctggccggcgatgggctgcttcccgtgcttcgactccccggcagatgagcagcttaaccccaaattcggtggcgccggtgggtacggcggcacgtcctctgccgtcgcggcgtacggaaacggcacaggcgccggcgtcagcatcggccggcacggggacagggggtacccggacctgcagcaggcgcccatggcggctccgcgcgtcgagaagctctcagcagcggctgagaaagcaagagtaaagagcaatgggctcaccaaagaggctttggtgccaaaggatgccaatggcaatgccatctcagcgcaaactttcaccttccgtgagcttgctaccgccaccaggaacttcaggcccgagtgcttcctgggagagggaggttttggacgtgtttacaagggccgccttgagagcacaggccaggttgttgctataaagcagcttaacagggatgggcttcaaggaaacagagaatttctagtagaagttctcatgctcagcttactacatcatcaaaacctggttaatttgattggttattgtgctgatggagaccagagacttcttgtttatgaatatatgccttctggatcacttgaagatcatttgcgcgatctactgntnt

SEQ ID NO: 1457 - DNA, 1887 bp, Zea mays
ttttttttttttttttacaggtcagcgtgaacagtacgggggtactgttcatctattataggcacaggacgcggcctgtgagaaattacatacatgccctttacacttattattgacttatatacaattctataaggactagatagccttttcccctttaagtcggttcctttttccgccatttagccgaagctcccttgcgtgtagcttcggagcaattccaaccttcgtcacgatcatgttctttacatcgttcatgcttttagcccgagtccgaaggtacctttaagtagcgcggcgacctggtgtttcttcctggccggcgatgggctgcttcccgtgcttcgactccccggcagatgagcagcttaaccccaaattcggtggcgccggtgggtacggcggcacgtcctctgccgtcgcggcgtacggaaacggcacaggcgccggcgtcagcatcggccggcacggggacagggggtacccggacctgcagcaggcgcccatggcggctccgcgcgtcgagaagctctcagcaggtgcgcgacgtgctccgcgctgagctacgtgttccacggtttggggtgggtgggtggactggatcccggcaaggtggttgatctcccgcgtggtggttcaaccgcaccgggcctgcctgatctgatttagtagtgctccgtgtagcttgtggccatctttgcgtgttgaattagcgtcaggttctcgataggtaaagggaaaagaagtaggaactttctattgttagttattgcaaattaggttcatttactaccttaggcctcggagagatgtaaaggttgtggggtgataaactcgtggactgatgcaaccaggacatgctattttgaatagtgattctcttttgtctgagtcggactgctgatgagcttactgaatctacctcttgtacttgtctatgtgtgcagcggctgagaaagcaagagtaaagagcaatgggctcaccaaagaggctttggtgccaaaggatgccaatggcaatgccatctcagcgcaaactttcaccttccgtgagcttgctaccgccaccaggaacttcaggcccgagtgcttcctgggagagggaggttttggacgtgtttacaagggccgccttgagagcacaggccaggttgttgctataaagcagcttaacagggatgggcttcaaggaaacagagaatttctagtagaagttctcatgctcagcttactacatcatcaaaacctggttaatttgattggttattgtgctgatggagaccagagacttcttgtttatgaatatatgccttctggatcacttgaagatcatttgcacgatctacctcttgataaagaggccttggactggaacaccaggatgaaaattgcagcaggtgctgccaaaggactggagtaccttcatgacaaagctaatccaccagttatttatagggatttcaagtcatcgaacattctgttggatgaaagtttccacccgaagctgtctgattttggacttgctaagttgggtccagttggcgacaaatcacatgtctcaacacgtgtaatgggtacatatggttattgtgcaccagaatatgctatgacagggcagctgacagtgaagtctgacgtgtatagttttggggttgtcttgctagagttgattactggccgtagggctattgacagcaccagaccacatggagaacaaaatcttgtctcatgggtaagtgatgatctgtttacttgtaaatgatcgcgtgtttccctttttccaatatcttcacatcgttgtatgtctgttggcatcagacactaactacttgtagatgctgtagccttatagatcactttgttgctagaaacattggatcactggtt

SEQ ID NO: 1458 - DNA, 2705 bp, Zea mays
cgcttgggagtgccagtccttcttcttccgcatgtcgcgccgccgcggcgcctctcgacgcgagatcgtctcttccctcctcgcctcgtcccccactccgcagccgcaggtgttcgacctcctcatccgcacctacacccagtcgcggaagccccgggaggcctttgaggccttccgcctcctcctcgaccaccgcgtccccgtcccagcctctgcgtccaacgctctccttgccgtgctctcccgcgccgggtggcctcacctcgcccaggaggcctaccgcctcgtcctctcgtctgactcggaggtaaacgcctacacgcttaacatcatggtccacagctactgtaaaaccctagagttcgatggggctgacactgtcatctccgagatggagaagagatgcgtgttcccggatgtggttacacacaatgtgttgattgatgccagattccgtgctggagatgtggatgcagcgatcgcattggttgattccatggccaatagggggttgaagcctgggattgtgacatacaattcggttttgaaggggttgtgtaagcacagaaggtttgataaggcaaaggaggtgttcaggacaatggaccagtgcagtgttgcaccagatgttcggagtttcaatattttgatcggaggattttgtagggttggggaggttaaggaggcagtgaagttttacaaggagatgcaacatcgttatgttacaccagatgtggtcagctttagctgtttgattggattattctcgaggagaggggagatggaccatgcaggggcatacttgagggaaatgaaggggcttggattggtgcctgatggtgtgatttacacaatggtcataggtgggttttgtagggctggatcaatgtcagaggctctaagagttagggatgagatggttggctttggatgtctgccagatgtggtaacatacaataccctgttgaatgggctctgtaagcagcacaggttgcttgacgcggagaaacttttgaatgagatggaggagagaggggttacaccagatttatgcactttcacaactttgattcatgggtactgtaggcaaggtaacttcgagaatgcattgcaattgtttgacacactgttgcgccagcgtttgaggccagatgtcgtgacatacaatagtttgattgatgggatgtgcagaaaaggtgatctggccaaagctaatgagctatgggatgatatgcatgctcgagaaatcttacccaatcacattacctacagtatcctaatagacagccactgtgagaagggacaagttgaggatgcattcggttttctggatgaaatggtcaagaagggaaatttgcctaatatcaggacctataattccatcatcaagggttattgccgatcaggtaatgtaaaaaaggggcagcagtttttgcaaaagatgaggcaagataacgtattcccagatctgattactttcaacaccctgatccatggttatataaaagaagaaaacatgcatggagctttcaatgtgtttaatataatggagaaggaaatggtacggccagatgctgtcacgtataatatgatcataaatgggttttctgaacaaggcaatatgcaagatgctggtcgtgttttcaagggaatgggtgacagtggaattgaaccggatagatatacatacatgtcattgataaatggtcatgttacagctggcaactcgaagcaggcgttccaacttcatgacgagatgatccatagagggtttgctcccgatgacaaattttgaggcttgtcagttctgacctattggacataagcaagagaaatgcatgtgttgtgtgtttgacagtgtctttgaaaatcacacctccagaaatttgtgatttcgaagcgtcgaagggacaggtccagaaaaaaggggagattgttaaaattccattacttgggagtgaccgcacgaactatggtaatgttggcatgttgctccaactatgttctaaagattccatggcgtggctaagcaaaactgctgcacaaaaaggaaacagaatttgactggacgtctgaatatcttcccttcagtctgagctccagaccagagtgcaaaaagaaacattgaaccaatggaaaaatgaataaaagaacaatcagtaactacagtgcatgtctgaagattctcatgggcgtgggcatcttcctccaggattgttgggatcaaatgtgcagccagacgctccaggcatcgaggatgtcagggacaccgagcttccttcgttgtggcttgtgatttctctctcaggacacggaatgcagcgatggtagtgggcttgtgccgccagggccaggcagattatgagaaccagaggtagaaacttggttttctttggaccattcgtggtatcctgtgaacttcagtatcgagtgagatgcgaagctaggatttgaggctattatatattaagtttatggtctgcgtgtttgtttccttggcgatcacggtttttacgcgttctcccatgtggacgagtattcacaaggttgaccgcatgtatacagagtcgctcaactcgtcgtgaacaagttcacagaaggatctctgttgcacaagcaaaatgtatttcagaagtagaaataagatcattggttactgtgtcgcaatttcttccttaggaaaaaataatccacagcaataccac

SEQ ID NO: 1459 - DNA, 1144 bp, Zea mays
agcgacctcgagtttctgattgagttcggtaacagccgccggcggaaccgatacagacgttgttcaagccctcgcctgtgtcggcgccggcggcaggtcgattccgtcctggttgcaaacttgtaagctccttcggattcagatcccctttgggcggaggccgatggcctgatcaggcctcttaaagggcatgtgtggtaggtaatgagaaactatttatgattggtggacatgagggagactttatgactaaaccaggatcacctgtttttaaatgttggtggaactacagagaagcatgccatcaccaagaagctgattcttgttgatgaagtcttccgttttgatttggaagcattgacctggtcagtcattgggcgcatgcctttccgaatcaagacatccttatctaggtactgactactgagaggggggggggggctctgttttacttctgggcagcgagatcatgggcctgacaatccagctccaaagaaagttgttgggagtctgggactatgtggagaacgaggctgcacttgtgatggcagaagttgtgacagtttgtttcccctgaaaattgtagatttgcatctgatttcctgtccaacagctaggtccctttcagagaagagagttgcttgttttgattcccacatccggaatctgaagttcagagatgtctccaaacaaccagaagatatggacgtaagcaactaccaaagatcattcttattggagatattcagcgcaaaggccacccaccaaataatcctgatgttcttctttccctagctgttccagagaggtcggaactgtttggggctttcactagccaattaaaatattaagtagcaagctgagtaccatgtcagtattaaatctgtctctgtaattgcctccgaaattggtgtgcgtgtttctcatcttgttggtttcttagtatatgtaatctgcactcagaggtacaatataggtgcacaggggcaggacctgtacttaaatgttagaatacctgttcagggtttggagtttttcccgtgtaattactatttcacccctctgtaatgggcctggcccagtttactcgcatctattaatatatcacccaacccctgttagggttagggttttcaccggtcaa

SEQ ID NO: 1460 - DNA, 1487 bp, Zea mays
gttcgaacccgccatggccgcctccaagcccctgcggctacgcctcgcggtgccgctcgccctcgccctcctcctcgcgctcgccctcgtcaccaacttcctctgggcctcatcctcccgacgagtctccccgctgtcggccccgtcttcttccagaacggtgatggggaagcgcgccaaggcagtgtggcgcctcaacgccacgtacgcagacttgccggcgccgcactgggactgggaggagatgcccgcggcgcctgtgccacgcctcgacggggcgtcggtgcagattggggatctcctctacgtcttcgccgggtacgggaacatcgaccatgtccattctcatgttgatgtttataatttcacctctaacacatggacccaaaggtttcatatgcccaaggagatggcgcattctcatttaggaatggcctcagatggcagatacatctatgcagtttcaggacagtatggaccacagtgccgcgcctcgattaatcgcaactttgtttttgacactgagactagagagtggcatgggttgccccctttaccacttcctaggtatgcaccagctactcagctttggcgtgggcggctccatgtgatgggtggaggcaaagaggaccgccatgaacctggattggagcattggagccttgctgtcaaggatggcaaggcactggagaacgagtggcgagctgaagtacccataccacgtggtggacctcatagggcgtgtattgtagctaatgataaactatttgtgattggtggacaagagggagactttatggctaaaccaggatcacctatttttaaatgtgtacggaggcatgaggttgtgtatggcgatgtgtatatgctagatgatggagcgaagtggaaggaactgtctccaatgccaaagccagattcccacattgaatttgcatgggttgtcgttaacaactccatagtaattgttggtggaactacagagaagcatcctatcaccaaaaagatgattcttgttggtgaagtcttccgttttgatttggaagcactgacctggtcagtcattgggcgcatgcctttccgaatcaagacagccttagctgggtactgggaggggtggctctattttacttctgggcagcgggatcgtgggcctgataatccagctccaaagaaagttgttggaagtatgtggaggacgaggctacacttgtgacggtagaagtgaaagtttttctgaaaattgtagatttgcatctgatttctagtccaacagctaggtccctctcagagaattgcttttatcctgtattttgttgtttggaatgcatattatctatttttactagatattttaaatttaacatttaggctatcagcttgtaaattgcctgaatactaacagcaaaacaatgtaaatactgccaaaaaaaaaaaaaaaaaaaggcttatccgttcccgtcgtcctcgaggggggggccggtacg

SEQ ID NO: 1461 - DNA, 1287 bp, Zea mays
ttgggtctttcgtggcatcctgtaggctgatctactttggagtggaggcaatgatcacgctacaaagttctggtgtagaaacaggcctggtgatcttacccgtgatagatacaacagtggccaaatgcaaggttttggtgaccaacatgctgcttttggtgctcgtggtatgggtggattccagatgcctgaacctccaataacgcctggaccatttgctcctggattgtcacgcaatgaaggtacaatccctggcattggggttgcaatgaccttggcaggccagtcttttgatggatctgatggagagcagaggccatctattccgggtcttccacctgggcaacccccgttgccaccaggtcctcatccatcacttcttgggcagcaacaacagtatcaacagatacctcagcagcaacatccccagttttcgcagccaccacctccaaacatgccccaactgcaggcaccagctcacatgctttcacattcacaaggatctcggcctactcttccccagcttccaccaatgggtggaccatcagtgccatcacaagtgaacccaccgcttccgcctatgcctcacccaacggcaatgcatggttcacagagtcagatgatgccccaaatgccacagcacatgatgggcctaaatcagatgcatgctggttctgtgcctcctggtactgtacccccaatgggtgggttcccaagtgggatgggaaacatccaaggagcatcaggttcgtctggcgtacaaaattttcctatgggtggcatgtataatcggcctcagggacaaatggctccacaagggcaaatgacatccattcctggtctaagctcttaccagggaatgggcaatgttggccttacaccgccaccgccacagcacccgccgcctcgaggaggctcggcaacacagtgaccatccctggagcaaaacaaggattgtactgaacctaaattttctcgtgacactaaatttgtagcatgtaaatccatctcgagcaatatcagcgtgtctagactcccgcaaatcacgagggatttcttcacgattattgctcaggcagctaggatttttgctatctcgtgctgtggtttacaactgggggccttctgtcatgtgcctcatttgtactgtaattcgaatcgtgcctttacttgccggctgcttagatgttgaacatagagaattatttccctcagttttgagaagcgtgaacttcacttgtgccaaaaaaaaaaaaaaaaaaaactcgaggagggccccggtacccc

SEQ ID NO: 1462 - DNA, 1283 bp, Zea mays
ccggccgggaaaaccgtttcgcgatctccgctacccccagccaagtcgctcccggtggctccgttctccgcgccttcgttccccctcggttttcctgctgtttcgcctcggtcctgcttgctggtgctgcagatctgcgttcgccggccccttctccctgctatcgcatgccagccaggcgcccacgggcacggccagcccccaccccacaggcgtggcactgcccctgtccggctgttccttgcttttgcttgcctgtgcctgctcctgttgggcttcggcacctgcacagaggagacataggtatacagagccacgcagccaaggatttcgaattcgtgacttgttggagtttctgaatggccagcccaggggatgcggagggcatcaccatctccatgggggagctgagcgtagaagcagcgacttcgtcagctaacggcggtggtgatgttgccgctgtcgaccaggatgatgtgtgggaagatgtttcagattctcatgggcacgcgtctaccttagacagagaatggatccacaggcagaaccagtttcaaaagatgggctatcgggacggaataacacaagggcagaaggactctgcccaggaaggcttcaatgctgggttcaggcaatctgtaaacgctggctacaagtggggccttgttcgcggggttgccagtgcgctagccagtcttcctggcagtttgaaagaggaactggtgccggacgtccagtgcagagggaaactacaggatctgcacagctccgtgcgagaaatatcagcagatgacgctctccagatgttccacgagagtatccgccagagtaaccctccgtcagaggggtcaggatcatatgtagtagcatcagccaccgatggagctacggaaccaaacaggatgaaaagcctaccgaaggatctcgtgttgttgctgcgtgaatgctcggatatcaaagtcagcaaggagttggcgtgggattcatgaacaaggcgactcagaaattccaaccactacaagtgtggcagaatcacactgagttcccagattactgaacgcctacctgggctgatggatgaatgtgattcggggattttgttttggaagtgactgagatactcgaaaggttcagggacctcgaatcgaatgtgtctgtagtaatgcagatttttattccatatttccctttttttgctgcaacatgtaactagaattgtaactataaatttgcagttcttaaacaattgtaatgttttttttccctcaaaaaaaaaaaaaaaa

SEQ ID NO: 1463 - DNA, 1705 bp, Zea mays
ttgggtccctcgaggccggccgggacccgaaaaccccaaacccaaaggcatctcccagtcggagtcgccccatggccccacccacctattctccctgccggcggcagccttaaccctaatctcatcgcctcctcttccttctccagttcctcgaaggcccagcagacaacagcccctctttcttctcagccatgtcggaggacgaagcgaacgctgctgctgcgccggcagagggaaagaactggcggcggaaggggaagcacgacaagcccaagccgtgggacgaggaccccaacatcgaccgctggaagatcgacaagttcgaccctgcctggaacgagggcggcatgctcgaagtcagctccttctccaccctctttccccagtaccgagagaagtacctacaggaggcgtggccggtcgtgaagggcgcattgaaggagtacgggatctcgtgcgagctcaatttggtggagggatccatgactgtgtcgacgaccagaaagacaagggatcccttcgctattatcaaggccagggaactaattaagcttttgtccaggagcgtccctgcacctcaggcaatcaaaattcttgatgatgagatgaactgcgatattattaagattggtggtcttgtgagaaataaggagcggtttgttaaaaggagggaacggcttttaggccctaacttgtctacactcaaggctattgagattttgactggctgctacatcttagtgcagggaaatactgttgcagccatgggcaactataggggaaggggactgaaacaagtgagaaggattgtagaggattgcatgaagaatgtaaagcatccagtgtaccacatcaaggaactactaatcaaacgtgagctagcaaaaaatcctgctctagccaatgaaaattgggacagatttctcccgaagttcaagaagaagaatgtcaagcagaagaagcctcaaactaaggagaagaaaccgtacacaccctttccaccgcctcaacagcctagcaagattgatcttgaacttgagaacggtgagtatttcatgagtgacaaaaagaaatcagcaaagaaatggcaagagaagctggacaagcaatctgggagagctgaagaaaataaaagaaaaagagaggctgcatttgttcctccaaaggagaacactgcaggtccatccaaatctgacaagaatgccagtgacaacagtgagatagccgatatagcgaagtcattaaagagaaaggcgaaggaatttagaaagaacgaggcccaggagagtgtcatagctgaatcatatatcgcaagtaatgatgaattgcggcaaaaaaagaaaaagaaatcaactaagtccaagtagccctaatcctcatgcataatgacactggcaattgagaaggattgcatgagccatccctataattatgtcattcatgctgtgatcgtattagatgatgaaacaaaattcgaaccttccgctggtctgttgttgcaacagttcatatgcaataggtttttaatgggtaactgccatgataaccaaggaacagaaagagccctcaagcttatcattctccaaagatatatattttcatcctataggttgtgttggttggtagagcctggctggtctaggcctgttgtatcatagtacgttatatgcaggcctcggaaaaaaaaaaaaactcgagctcgtgc

SEQ ID NO: 1464 - DNA, 1212 bp, Zea mays
  misc_feature (56)..(56): n is a, c, g, or t
cttctttttccccacctgggaaagggggatttctcaagcggataagttggtaacgncagggtttttccagtcacgacgtgtaaaagacggccagggaattgtaaataccgactcccctataggcgaatgggtaccgggccccccctcgagttttttttttttttttttttcttttttttttttttttttttagttaaccagtggccatcatcagaactgaaatatagcatccgtctcatttggacgatgcgtggcgaatgcaataaataacaaatacagaactacttgtaccaaaatttctctgctctcataaaccagtggtgtgaaaccttttgcccatgggtcatgcgccgaagcgggaactttcataaagggaagaatcactgcacacacctggagccatgcatgtgcaaattcggcgggggcaacaaaattcggatgagctctcctttgtccaaatgaagccattgacgagaagatgactgtctcgtcactttctcttttgtgaagttacgctttttccttgtttggcaaaggctttctttgcattccggtttggggttgctctctgaatgacacgttgtttcatcgagcttctcatggggattaacctcctcgtattgtattggtttaatgataacaccaggcttcttaacaatcgcaggtcgattgagagcagaaactgatatcgctgggttgaaatcaggcccaataggcattcgaatgctctgctcatacacatctttcgaagtgtaagggaaaggcagtttccttaccaaatacttttcagtcttcttatctacatgttcagaaataatgacatgcttaagcttcgagtctttccatcgaaggcttctctgggcattccggtcgtctcctgaagtattcttatctgcttctcctcatcatcaccgtcgtcattgtcatcttcgtccatatcctcgccttcctccgaaggcacatcctcatccgcatcggaggcgtcgcggggggggggggggggaactagggaacttctcctcttccccggaggccggggggaccattatttttaaaggggcggccccccgggggaactccagttttggtccctttaagggggtaattctcaggttggggaaaccgggcaaaaggggttccgggggaaattgttttcctccaaattccccaaaattaaggccgaaaaataaagggaaacccgggggcccaaga

SEQ ID NO: 1465 - DNA, 645 bp, Zea mays
gagcaggcttttcaggttcaggattctcatcatttatagcatccattttgtctttcgcaaattcagcttcaacatcatcaccagcaaaagcctgacgtatgagatcagcttgcgatggaagttcatagctctcctttctgtcagggatggtcaagttgccttcaaccatctcttcctcagaatctgaatcggaattgtgatcctgttgcttaggctgtgggtctacaatagaaggaaccggtattttggatttattggtaatgtcattggcattgctctggtcctttcctttgtcgctcttgaccttcttccatgaatcaccagctaacattccaacttcgaaagttgtcttaggaccaggattttttatgatatcagtaaagtttctgtatatatcattctgtggttcatcatccagtagtgcactcccaaattgggtatcatcatgtttcatagttacttcattattgctcaaaggctgggctggctcagaatcatactcgctatcactgctgttttcagtatcttgtaattttttcctcttcactaactcttcgtgcgtatttttggtaggcccaaacgttcttttacctgacaccttaactttgtctgtcgttttgttcagtgttattgtcctctaatttc

SEQ ID NO: 1466 - DNA, 1175 bp, Zea mays
ccggccgggtcctcctttggtttggcatctcagtaccccttgtcttcgttgggagttatcttgggttcaagaaacctgccatggaacctccagtcaagacagacaagattccacgtcagatccctgagcaggcttggtacatgaatccgcttttcaccattctgattggcggtgtccttccatttggagcagttttcattgaactcttcttcatcctcacctccatctggctgcaccagttctactacatatttggcttcctcttccttgtgtttgtgatcctgatcatcacctgcgccgagatcacaatcgtgctctgctatttccagctctgcagtgaggactacatgtggtggtggaggtcttaccttacctcaggatcctccgccctgtatctcttcctgtacgctggtttctacttcttcacgaaactgcagatcactaagctggtgtctggcatcttgtacttcggctacatgcttctcgcctcatatgccttcttcgtgctgactggcacaattggtttctgcgcctgcttctggttcactaggttgatttactcttcagtgaagatcgattaggtgccaagatgacagaacagcacatgtttcaatggagtcaagataattgtatgattaatgtggattggggaattacccctccccctcctttttttgaaggttttcaggaaaattttactgtttaggatttagtttacagatggtttatgttttgttattgtcaggttatacactttagtgatttggaactgaaaaaatataagggtaaacatattatgatgaggctgtacctcggccccgacctcgctagtggggctctatataaattaaattcattgtgccaggtatatgcttgtaccgggcggccactgtagggctccaagaccagtatgaaatccaccgtttggatcctggaattgaatagtaaatttagatatagattaattaagctaatatggttttatgcagaatatatttgtatattattgttggtcacatgggataaatatttatgtacttcagttatactatagaggagtgagccgagttgtaagttaccgagtaaaaaaatgtagattagtgatacataaaatcaatctccctagatttatctctaaactttggaaagtggtagaaatgccaaattctaaactt

SEQ ID NO: 1467 - DNA, 2257 bp, Zea mays
accgaaacttccgcctcgcagcgcgcccgcgcgtcgccgttgcctctagcggtctagccctctactactcacccgaccgccccccccgcgccgcccgtgcgagccataccgccacccaccgcctcgccgcgcagatctctggggcttatccctacccccgggctgtgattctcccgcctcctcaccgatgcggacgccggcgatgctccggtgggccgcggcgctcgcggtcctgctcgccgtcgccgcgccggccgccgggttctacctccccggcgtcgccccgaccgacttcgccaagggtggtccgcttccagtgaaggtgaataagttgacatctatcaagactcaactcccgtatacatattactcccttccattctgcaagccagatgccatagttgacagtgccgaaaatctcggggaggttcttcgtggcgatcgcattgagaactctccttatgtgttcaaaatgcgagagcccaagatgtgtcagattgtctgcaaagcaaagatcactgagaaagaagccaaggagctgaaggaaaagatagaggaagaataccgagtgaacatgatcctggacaacctcccgctagttgttcctgttaataggcaagataagaacagtattgcttatcaaggtggatatcatgttggtctcaaaggcgtgtattctggaactaagaatgagaaatacttcatccacaaccatttgtcatttacggtgaagtatcacagggatgataattcagaactttccagaatagtgggatttgaggtcaacccactcagtgtcaagcatcagattgatgataaatggaatggtgtagacactcgcttgagcacttgtgatcctcatgcaagcaaatttgtcataaactctgattctcctcaggaagttgaagctgacaaggaaatcatattcacatatgatgttcattttgaggagagtgagatcaagtgggcatcacgttgggacacctacctgttgatgactgatgatcagattcattggttttctattgtgaactctctcatgatcgtgctttttctatctggcatggttgccatgataatgcttcgcactctctacagagacatctctagatacaatcagcttgaaactcaagaagaagcgcaagaggaaacaggctggaagcttgttcatggggacgtattccgtcctccaacccactctgacttgctctgtgtttgtgttggcactggcgtccaattctttggcatgctcctagttacaatgatcttcgctgtgttgggtttcctttctccatcaaaccggggaggactgatgactgcaatgcttcttgtctgggtcttgatggggctgcttgctggctattcttcttcacgcctctacaagatgttgaaaggttcagagtggaagaagatcaccctgcaaacggctttcctgtttccaggggttgcatttgttattttcttcatcttgaatgctcttatatggggggagaagtcatctggtgctgtccctttcaccacaatgtttgcactggtcctcctctggtttggcatctcggtacccctcgtctttgttgggagttatcttgggttcaagaaacctgccatggaacctccagtcaagacaagcaagattccacggcagatccccgagcaggcttggtacatgaatccgcttttcactattctgattggtggcgtccttccatttggagcagttttcattgagcttttcttcatcctcacctccatctggctgcaccagttctactacatcttcggcttcctcttcctcgtgtttgtgatccttgtcatcacctgcgccgagatcgcagtcgtgctctgctatttccagctctgcagcgaggactacatgtggtggtggaggtcctaccttacctcaggatcctccgcgctgtacctcttcctgtacgctgctttctacttcttcacgaaactgcagatcactaagctggtgtctggcatcttgtacttcggctacatgtttctcgcctcctatgccttctttgtgctgactggcacaattggcttctgcgcctgcttctggttcactaggttgatttactcgtcagtgaagatcgattaggtgccaatatatgacagaatagcaacgtgtttcagtgatggagacaagagaactgtaccattgatgtggattggggaattaccccccttcttttagggttttcagggaaaaaagtttcttcttaggatttagtttatgaattattatggt

SEQ ID NO: 1468 - DNA, 2753 bp, Zea mays
atcaataaaaaccctagcagatccacccgtcacccgaagcttcctcctcgcagcgcgccgcgcgtcgtcgcctctacccaccggacttcgcgcgccacgacgagcctgcgagccatcagcccatcacccacccacccccccgccacgcagatctagggagcttaccctcccaccgggcggtcattcttccgtcccatcaccgatgcggacgccggcgatgctccggtgggccgcggcgctcgcggtcctgctcgctgtcgccgcgccggccgccgggttctacctccccggcgttgccccgagcgatttcgcgaagggtgatccgcttccagtgaaggtgaataagttgacatctatcaagactcaactcccgtatacatattattcccttccgttctgcaagccagataccatagtcgacagtgccgaaaatcttggggaggtacttcgtggcgatcgcattgagaactctccttatgtgttcaaaatgggagagcccaagatgtgtcagattgtctgcagagcaccgatcactgagaaagaagccaaggagctcaaggaaaagatagaggacgaataccgagtgaacatgatccttgacaacctcccgctagttgttcctgttacaaggcaagataaaaacagtattgcttatcaaggtggatatcatgttggtgccaaaggcctgtattctggaacaaaggatgagaaatacttcatacacaaccatttgtcatttacggtgaagtatcacaaggacgataatttggaacattctagaatagtgggatttgaggtcaacccacacagtgtcaagcaccaggttgacgataaatggaatggtgtagacacccgcttgagcacttgtgatcctcatgcgagcaaatttgtaataaactctgattctcctcaggaagttgaagttggcaaggaaatcatattcacatatgatgttcgctttgaggagagtgagatcaagtgggcgtcacgctgggacacctacctgttgatgaccgatgatcagattcactggttttctattgtgaactctctcatgatcgtgcttttcctatcaggcatggttgccatgataatgcttcgcactctctacagagacatttctagatacaatcagcttgaaactcaagaagaagcacaagaggaaacaggctggaagcttgttcatggggatgtgttccgtcctccaacctactctgacttgctctgtgtttatgttggcactggcgtccaattctttggcatgctcgtagttacaatgatctttgctgtgttgggtttcctttctccatcaaaccggggaggactcatgactgcaatgcttctagtctgggttttgatgggtctgcttgctggctactcttcttcccgcctctacaagatgttcaaaggttcagagtggaagaagataaccctgcaaacggctttcctatttccaggggttgcatttgttattttcttcatcttgaatgctcttatatggggggagaagtcatctggtgctgttcctttcaccacaatgtttgccttggtcctcctttggtttggcatctcagtaccccttgtcttcgttgggagttaccttgggttcaagaaacctgccatggaacctccagtcaagacaaacaagattccacggcagatccctgagcaggcttggtacatgaatccacttttcaccattctgattggcggtgtccttccatttggagcagttttcattgaactcttcttcatcctcacctccatctggctgcaccagttctactacatctttggcttcctcttccttgtgtttgtgatcctgatcatcacctgcgccgagatcacaatcgtgctctgctatttccagctctgcagtgaggactatatgtggtggtggaggtcttaccttacctcaggatcctccgccctgtatctcttcctgtacgctggtttctacttcttcacgaaactgcagatcactaagctggtgtctggcatcttgtacttcggctacatgcttctcgcctcatatgccttcttcgtgctgactggcacaattggtttctgcgcctgcttctggttcactaggttgatttactcttcagtgaagatcgattaggtgccaagatgacagaacaacacatgtttcaatgatggagtcaagataattgtatgattaatgtggattggggaattacccccctcctttttttgaaggttttcaggaaaaatttactgtttaggatttagtttacggatggtttatgttttgttattgtcaggttatacactttagtgatctggaactgaaaaaatataagggtaaacatattatgatgaggctgtaccttgtgacaatttttttttgtggggctctatataaattcaattcattgtgacaggtatatgcttgtaccggtgaattactgtagggctccaagaccagtatgaaatccaccgtttggatcctggaattgaatagtaaatttagatatagattaattaagctaatatggttttatgcagaatatatttgtatattattgttggtcatatgggataaatatttatgtacttcagttatactatagaggagtgagccgagttgtaagttaccgagtaaaaaaatgtagattagtgatacataaaatcaatctccctagatttatatttaaattttggaaagtggtagaatgccaaattctaaactaaatgacctatattattaagtaaaatccaattcaatagca

SEQ ID NO: 1469 - DNA, 7325 bp, Zea mays
  misc_feature (554)..(554): n is a, c, g, or t
  misc_feature (7230)..(7230): n is a, c, g, or t
gaaataaacaaaaactatatttgtagtctagacgtcgctccccacgctctcccgcctcgtggcaacgcacgggcacaacctagtatttataaaatgaagaataatgaaaatagaacgaaaagaaaaacattagcaaaaaatatctacaataacatttttagcttatatagatatataagtgaaagtaattttacctccgtctacaaacttaagcatgtttattctctaaaatctgtcaacacaagtaaatatttcttatatacgccccactttttcaattattaattaatttaccatttatggtagcgactaggcactagactagttgaacatatgtagattatcttcggttcatgcatataatcacccaaaacattgttttgtactataaactacaccgtttatatagtagaatttgaaatagttaatgtgaatcggtaatctgctagagataatcttatgttgtatcaccgtaatctttgagcttcagtgaggaggaacccattgcttccccaatagttttttatgaaaaaagtctaaattactgactccangtatgaacaatgtttatataaacttttaaaactatttttttatttacccctccactatttcgattggttcaatctactccttaacaaaattttactttttattttatgtataaattaagtttttagtttaaaatttattgatcagtagctaatgtcataacttaggctagaaaaatatattatgattctttatatttattttgatagtttaaagatcagataagataataaatttaatgatacaaaactaaatgtaaaataataataattcttaatatatttttctcacataaattattataacctcaacaaaatatgtatttaaaattcaacttttacgtggagaaacaaaaaagacaaatcttattagagaagatttgtcttttgcttctctacgtataagttgaatttcaaggcaaccttggacatcataacttatgttagaaaaaatatgttataattatttatcattgtttcacatttagttttgtattaataaagttattatattatctaatctttaagctatcaaaataatttttaaaactataatttatttttctaaatactatggtttataacgttatatttaaacaataatttttaaaattatagtatctttaaagctgaccaaaactataaggttgtcatgacgactacatcgagaaatattgttacaaaacatatcctcgatgttgcacttatacaaccgcaacttggttggaagagagcaaaatagaatccgcatattatacgatcatctctaaacaaaagatgattagcggcggagtttctcgtccgggtttcacatcccaccatcaccaccaaaaggacgcccttttttcttagtcatttgacttgcagccaccaagttgtcgcatttcttcccactccggttctcatctgctgctccacgccgatccaactcggagtccccactccctcgaggcgcccctgctgcagcggagcaccagggtcttgcctcgatttgcggcgaaagcacgccgtttttctggtggtttgtagcgccgagcggttcttgattccggcgctggttttggtgctattgaggaggaggtgggggttttctttcgattggaggggtaaaagttgccgcctttcttgcattccactctgttcttggaccggatttcttctccctgcacgaactcgagctcgagctcggctcgggcttctccaacctccaacgcgtagtcccgtctagttttcttacatacaggttattaagctttttttttgtaagccttggtaatttcacttcaagccgtccctagtttcagagaagttcaagtaaatctgagtatatatggtcatatgttctcgcaggtggcattttagtgcttgcttctttcaagaactgcagcgtcttgattactgctttacctctttgcggatggatggatgcgattgtattgagccactttggcaggccgatgatctcttaatgaagtaccagtacatatctgacttctttatcgcacttgcatacttctcgatccctttggagctgatatactttgttcagaagtcagctttcttcccctaccgatgggtactcatacagtttggtgcgttcatcgttctgtgtggggcaacccaccttataaacatgtggactttcactacgcataccaagaccatagctgtggtgctgacagtggcaaaagtggcgacagccgttgtgtcatgcataacagctctgatgcttgttcatataatccctgatctgctgagcgtgaaattgagggagaggttcctgaaagcgaaggccgaggagcttgatagggagatggggataataaggacacaagaggagacgggaagacatgtgcacatgctcacgcacgagataagaagcacacttgacaggcatactattctgagaactacacttgttgaaatgagaagaactcttggtttagcagagtgtgctgtgtggatgccatcacgctctggaacaacccttcagctctcacatgcactccataccaatgctccgcttggatcagttgttcctatcaatcttccgattgtagctaccatttttaatagtaatcgtgctgagagaataccacatacttccccattagcttcagtaaaggctcagaaaagcaagtacgtcccaccagaggttgttgctgtccgtgttccgctgctgcagcttacaaattttcaaataaatggttggcccgagctatctgcaaaagcctttgcagtgttggttttgatgcttcctccagacagtgcacgaaaatggcgaccccatgaactggagcttgttggagttgttgctgaccaggtagttatcaattctatttctgtcttaaactgcattcttatatgcattccatttatatctggtatggttgtctagtacactcttgcattagtactagtgtgccttaccactataaatcatatggtctaaagaaacataaatccacataagagaacatcagtcgaaggttggagcttaattctggttcgccctctatggaaaggaaaaagattggagttcaaaactctagctcttgaaccattttagttctgtgccaattttttttaaaattatttattttgtatcttaattagatatttttagaacattttttatatccccagatgctctttaatagcctttcagcacttttcagtttgcagtggagtgtgaattgtgtatgacttcagttgctaacttgctttaaacgacgttattttattgtgattaaagaagtatttcttgcataatcagctaactgctgtcataaactgtgttaagatgattaactctatttggggatgtaacatgtctcctattggttttacaagtatttaccttggtgggccttctagaaatgaatgctctcttttttctcattttgtttgtgtgcatgtcctctctttattttttggggaaaatccatagacaagaaatttgccaggcatgtattaatagtgaagaagcaatttaaacaccacacattaagaaaaatgatcaccctcacaatggaagcatgtcctctctctgcacttacaatgagcaattcttgctgatactgagcttgtctgtcctcacatagcacatagatgagacttcccatgaagtattttgcactgtttgtgttgtcttatatccttaattcatcataaatatcattgctaaacgagcccattctctcatttaggtggcagttgcactgtcccatgctgccattttggaagagtccatgcaagcccgtgatctgctattggagcagaatattgctctggacgcagcacgccgagaggcagaaatggctatatgtgctcggaatgattttcttgctgtcatgaatcatgaaatgcggactcctatgcgggcaatcatttctttatcatccctcctgttagaaacaaaacttactgcagaacagcgggtgatgattgagactatactgaagagtagcgatcttctagaaactctttcaaatgatgttttggatatatccaagcttggagacggcagccttgagctggaaattgcaccttttaatctacatgccacctttacagatgtaagtgcacttttatgctttactattcactattatgttatccacaaccacaagggaaattggtttgacttattcatcttgtaggtggttgatttaattaaaccagtagctgcattaaaaaggctatcggtaatggttcatttggctccagaattgcccacctgcgcaattggtgatcggaagaggttgatgcagataatactaaatgttgctgggaactccgttaagtttacaaaggagggtcatatttcagtttcagcatctatcgctaggccggattctctgagggacccatacgctcttgacttgcatccagttctctccgatgggtctttttacttggctgtgcaggttagttaatgagcactcactgcattgccacattggtttaattccttaatcttctaaagtagactgagctgcctatcaatgtgtgtgctcataggttgaagtaatcgccagtagatttataactactgtttgttatgcccagatagctagtgcagtactgcagtggtcgaatgcctatattacagccttgttagttgtgttccatgtcgtacaaattagccgtctattatccataatgtgcaacgcagtaccttgaattaaaaaaaggagcctatttggagttgattggtagtccttgatattatattataggtttaggtatgcttgtccaggcatgtagccatactataattttcatatttgaggaggaactggccgttcatctagatggacagttttatttagaaaggaagaccttaacttatgagagattttccagatgagtttaggttgccgtcttcgtttcaaaaaaaagaagggttattatttgctagtctgcaggaattccattggctaagcacaccacaacattgatctgcctattatatatacattgcacaatatctacagcaaatctgatgccaaataatgctgcaggtaaaagacaccggctgtggaatcagcccacaagatatgcctcacaccttcacaagatttgcacaccagcaaaatgctacaaacaaattgcgtagtggcaacggattgggtctggccctttccagaaggtataccagtaaagtttttttttcctgaatgaattttgtctcgagagaatttcatcttggacgctaatgtagagtgtgcatatatgctctctcagatttgttgcccttatgcaagggaacatctggctggaaagcgaaggcgtagggaagggctgtaccgcaacgttctttgtgaagctaggactatctgatgcaaatctccggaggatggtgcctcctgtccagccaaaacatggaaatgcagatccagatgtatcatcaataatcaacggcgacatggcgattcttccgcgttgttaccagtcgatgatatgacaaggaactgcaggaggagcctgatcttgtgatatcatgatttgaaggtggattcacggggttaaggatgctgtgtgtagagattgctctccccgttttttttttttttttttttttgcagagccgtcgcgctctaggcaagcaggtgcgagtgcgatcgggcgaatccaaaatagcgggacgcctctactagggaattaacagcgcagggagagcggtgcggtgttttaagaaattataagttgtgagatgagtggcgtgtttgttagacgtcatttagggttttctagtgttgtactagtatagtcttggtagagagaagcagaaagaagctgatctgtacacgaggcaaatgaaatgctgatgactacttataaggcttctactgtttgtacagtattttttttgtctacataaattgcaacagtatagtatttttgtctctatgaattgaattgcaggtgtaacagttctttaatttaattcgaaacgaacaacccgtaaaacatgaaaacattggtgtggtttcatgacagatgacatgatttcattttggaagaatgtaagcaaagcgtgaattttaactgtagttgtatttgcaacagtttatatatttgaatgtagttggatttgcatcaatctatatatgttaataaattttcccacaatttatcttacgggacgtttggattccttcattttagatcctttcattttagaggaattgaaattcacttaataaagtaacttatttagtttggaatttaatattccaccactttccaaagttcagatattagtctatctcaaattcatggactaggggatgggaaatgattttatacagtagtagaatttgtttctactctgtaatttacgtgacacccttcgtcttacttcttctctatagtaaaattatagcatcttgctaataataatatataaatatattttgtataaaactgaattagcttaattgatatatgtctaaattattattattagaatggaattcaatttcaatgatccaaacggtgatattatccaaacgggccgtaataaaatttaaattcaatttcgacccgatccatgccactaaattttacacccaacccacctgccttgtttggctgcatagaattttaactatgggatttaatccactcaaaatgccttttctagctgacaattgcgcaggaatggacgattgcaagcagagctaccacaaaaatgatacatggaacgtcgggaaccgtcttaaatcatgtaggagtatcacaaaacaatcttcgtgctcaaccagtaacgagtagataataaggagacgacatcaaatatcttccaaaattcaaaccaggacaacaaattgtgctactaatctcggtacagagtgatgactaattactgtcgactgatcaaacacaacggttgcactatgctgatggcaacacggagggccacaatttgttttaaaccttgaatccacggctgttcctcctgccacgagccttctcgaacttccttcccttggagcgcacatacggcttggtgtggctgtgcggcactccaggagccttgccaaagtgcctcactgcctcacgggcattcttggggcccctcaagaggacctgcaatacgtagcaacatagccagaacattagttcaagtttaaggaaacctacaatactgcagaacagggtttattatttnacatggaataatgacaacggcctttctaaagtctcaactaatatctgggattttatacaggtgctgattaagggggtgttggttgctcaagcgtt

SEQ ID NO: 1470 - DNA, 2077 bp, Zea mays
actagcctcgtgccgaattcggcacgaggcctcactatgacgagcaccataggggacgactcatcgcagaagggcaggtgttgcccgttctgcggtccaggacccatgacaggtttctagacgcgcggtcccgccccaggtacactcctctccttgagagggctggcttggacgtcgtatcgttccaggttcgccgcgggttgcccacaatcaacactgcggcgatcacagctttggtcgacaggtggcggccggagactcacactttccatcttccttgcggcgagatgaccgtgacactgcgagacagccagaagcagcttggtctcagtattcgtgggcgtccagtgaccggtcaggcagcacccggtggctggagacagagagtcgaggcctttcttggaagggaggttcccacagacacaccaggtagccacacatctggggtttctctcgcctggcttaggcagtcgttcggggagtgtccagctgcagcagatgaccagacggttagctactactgccgagcttgggtcctgcacttgtttggctccgtcctttttccagacgcgacgggtgatagcgcgtcctggatgttccttccttgcctcactgattgggacatggcaggaggctacagctgggcttctgcagtgctatccttcctgtacagacaactttgtgaggcttgtcgtcggacggcaaagaacgcgagtttaggcggttgcgtgtacctactccagttgtggatgtggtcgcacctaccggttggtcgccctattgagtttgctcctcgaccttggttcgacgtcgtcggcttgcgactacgaccgacggcggcttaccgttgggaccaggtccaggctccgttcgcacgtcaccaacgcgcctacgtcgagtactcaaacgagctggacgcacttacaccgtcgatggttagctggcaaccatacgatcagccaccgtcgccacacattcagttgagctccgcgtgcacggcagatgaagacatttatttattaaggtgtccactgatttgcttctatgccgttgagtaccacttgcctcatagagtagcacgccagttcggtctacgtcaggagttccctgtggagcccttctcaacatcgatagaactccacaagttcgaccgccaaaagcagaagaagatcactgactttgaggcacaccaccaagtgtacattgacgaatgggaccaaatgcatgacctcctctaccagaacgatcagccccacaccaactacaacttccgcgagtacatctcttggtatgtcagtgcaactcggtgcaagttgaagggccagtggacatcagcggactacgccgaactagagtcttcagatgacgaagacacgtcctatgacctagttactcggcatgggacacacgtggaggctgcaccgatcctagatagagtgggcaactccatgatgcagtctgtggttgacatcgagcatttctctaagaccacttctgacagcaggacacttgcctttctctcaaggctatcacgtcgcctacgttgtgctgctgctcgttgtggttgcaggactagcgtcggagttaacatacaacatactctgcagcaccatggtgacacctcgctaggacttggagctatcatcgttgcacagggctcgtcacgttcgacacgagatgcgtttgcgagccgcaaggaggacgaggatgacattaagattcctctcgacaagattggaccataggatgctcctaagacaaccttcacagcctataccacgcagacgatggcgacgatcgcgcaaccctaacaccccaggcatcaacgctcttggggccaagggcaacggtaactagaaggatgcgagggaaacatgatggtgcatgtcttctgctttggcttttttgtgctatggactatggatgacgatatagactttctgcgttgtacactttggttgatgatatagattatctgtggtatgcactttgtttgatctagttgtgtgatgcgctatttagagatatatatgctcatatcatattagttttttttataattgtggatgttactaaa

SEQ ID NO: 1471 - DNA, 2394 bp, Zea mays
tttttttttttttttttaatttttttttttttttttaattaatctatttccatttatcttatttgtacaaacaatattaaattacaaatgtaccttcggcttgaaggagtgaaaatacaagtatggcgccaaaagcaaatgccgagtcagcgtgaacagtacgggagtactgttcatctatttataggcgcgggtcgcagcccatgcaagattacattaatgccctttacgtttataaataactctatagtaattcttcgaggtctaatctggtttttcatctttaagtcggtttccctttccgccgttatgtcgaagctcttctgtgcatagcttcgtaatgatcttttccttcgtcacaatcaccttccgtcccactcaagcttcgtcttggccttaatcttatatactcgtaatccaattccgaagatacctgctcacacatttcacttggaaaacattgttaaatcatgtttttgaggaccttcggaagccgaaggccgccaacaaatattaatgttgaagattgtgaggtagagtagaggatttgctgactagaataaaatataatataaaaattcatgagtggacagcctaatatcgctgcaacggcggcgccgccgataaaacggccagccgggcagcggagacgcggagtggggcgcgacggcgcgtaacctgtggggtttcaggttttgtccctgcgtggcagcgacccagccccatcgagcatcgaggcatggaaccgggagccaaatcggaagcaaagcaaggtgaggcaggatctggcgcgggggaaagcggcagcggcaaggtgtatcatgagaggcagaggctgcaattctgtctcctccatgctctcaacaaccttatgcaggaaaaggaatgtttcacccgtgctgagttggacggcatcgctggaaatcttgttctcaatgatccaaacaagggccagtggactcctctaccattcatttttaaacctcaccacaatgttataactgggaactatgatgtgaatgttctcatcacagcattagaagctagaaacaagaaggtggtttggcatgatcgtcgtaaaggggcatcatcggttgatctgaatgcagaaacattggtaggcctggtgatcaatgtacctatcaggaggttcagggggctttggactggcaggcattgggtggcaattcgacgcattgatggcatctggtttaatttggacagtgatctttctgaacccaagcagtttaaggaccaagaaaacgtgattgggttccttgacagtgtgctcagccaaggtggagaactcatggttgtgctgcaaggtgaataaccctattgccccgaatctcaaatggctaccgaatagcctcttctatgcgacttgcccatgcttttgagttgtcatctgaatgagatcacatgcacctactgcagaaatttcctaaaccttacggtttaatcgctgatcataatggacagattggtaaatcgaaggtccagtatgcaacatatacacttggtttattcatatactggtttattggtaaatcgaaggtccagtatgcagacacctgctaacccttggtttgatttattgctgtgcccgtctctatcatatactggattgccaagcaggtgtctgcagtaggtagaacattagcttgctaaatgatgaaaatagcgaacttcaatcctcagcaagaattaatgttgctgcggaattgtacagaactaatagggaggttgcttgtgttgtagttatatgctttggagaaacgaagttatcccatgctcctagaatttgtcagttcgtttgtaagtaccattggatatcagggaacgtaacattatctgtagactgtactagttgatacccctggagtaatcagagcgatgtcccatggtctttcaaatattacaaagcataaaatatatgtagctgtaagatcattcttgtttaatgcaaaaatatcgagttaggaaggtgatgatgttgagctcgcgagggggggcctgtggcgatttaattactttctctccttgcccgtgcacgcactcatgcaatttggtttcagttggggaagcaaaataaccaaagggaaaaatatgtagtttgcctactgtgttctcccgaatttcaacttcggactcagaaacgtcagaggaaacaagaaaagtaagatttgtctgtaccctttccttccaaaaccgccttacaaaactaccaaagaggttattcagaaattcagtttttgttactctttcaataaaaaaaacttgaactgtagcttcaaaacatcgcacttctccctttgtccgagtggtacagtgcgtcatttctcatcttccgagaaatcaaacatttacaactttaatcaaatatataaaaat

SEQ ID NO: 1472 - DNA, 1713 bp, Zea mays
tcacgtagcataatggaggcgctgagttcgattgaagctttaagaaccgaggaaagcagtacatggacaacagtttttgttgctatcgtcacaaaacccctctttttttgcacgtgcgacatcaagtcgcgctgatgaattagttgagataatgctttgcagctttggtgtattcgagtagagtacatgcacggtgttttttgtactgctagtcctagtcggtacggacctcttcttttctttttcacacgttactagtagcaacaagtttagagtttgtcgtgtccttattgcgtcctagctggatcactctgccctgtgggccaagcgagcaatctcctcgatttacaatgaaccattttcccgttgggcccatggaaaatccaaaagataagaatgtcatacgctgcaagcctgcaagcatctatataaacactggcaatgccagctcccgtcgatgccaccacaacagcacacagacgtgtggcccctctgcagcaaaaaccagaggccgcggcaggcacggacgcttcacgcgcaggccgcggactagcgccatggcgacgtgccggtgccccgagccggcgcaatgccatcacaggccgctcctctcgacggccaagggctaccctaagctgcacgaccgcccgaggccggcgcccggcagcgtcctcgccgaggtggccgccatcctctgcctcaccgggccaatggccggcgcggggatcctgttctacatgcgctccctcgtgtccatggtgttcctcggccgcctcggccagctgcccctcgccggcggctccctcgcgctcggcttcgccaacatcaccggctattccgtcctctccggcctcgccggcgggatggacccggtctgcggccaggcgttcggcgcggggcggacggacctcctccgcaccgcgctccggcgcaccgttctgctgctcctggccgcgtccgtgcccatcgccatgctctgggtggccatgcaccgggtcctcgtctccgcggggcaggaccctgacattgcggccacggcgtacgcctacatcctctgctgcctccccgacctcgtgctgcagtgcttcctccacccgatccgtatctacctgcgcgcgcagtccgtcacgctgccgctcacctacggcgccgccgccgcgctgctcctccacgtgcccatcaacttcctcctcgtcagcgtcctcggcctcggcgtccgtggcgtcgcgctcggcggggtctggaccaacctcaacttcttgctgttcctcgtggcgtacgtctacctccgcggaatgtacggcacccatgacgatgacggcgccaagaagggcgcgtccgtggcggcgccaccagccgaggaggtggagcaggagcccgcccaggagtcggggagcctcggggggctgtgcgcgcacagctgcatgtccgtctgcttggagtggtggtggtacgagatcatggtgctcctctgtggcgtgctcatcgaccccaaggccgcggtggcttccatgggggtgctcatacagaccacgtcgctgatatacatcttcccgcactcgctcggctgcgccgtgtccacgcgagtcgggcacgagctgggcgcccggaggccggagcgcgcgcgcctcgtcgcgcgcgtcgggctcggcctgggcgccgcgctcggcctcgtggcctgcgcattcgccgtgtccgtgcggggcgtctggg

SEQ ID NO: 1473 - DNA, 564 bp, Zea mays
  misc_feature (549)..(550): n is a, c, g, or t
  misc_feature (558)..(562): n is a, c, g, or t
tagccgctcgtcgtcttctcccgcacgacattcttccagcttctagaggaaaatccagccaccgtacctgactgcgtgatattttttggccgccgctcaccgccggtgaagattccgccaccgttctcccctgacgctcggccttatctcttcccctctgctcactagcgcagttacgctgctcctccctcctcttcttcttccccgtgcacccagccattccggtgtccggtccagctcgctcgctcatcctcgagtccggccgggttctcgcgcacgctccttctgctcgccggccgtgagctcgtccatggcagctcccatcgtcgcgttgtcagcacccagcctgacagggagcacagggactcttccacggcagcgggatacacctccgctgggagctccggtgttgggccggcgacggaagaagcccaatgtaagatacacgggtccagagtgggtgtgagtatttaagacacgaatttgtaaggaatattcaggctgtaagaaatacgctactgctatagtatcgtatcgtatcgtctcctnnaaaaaaannnnnaa

SEQ ID NO: 1474 - DNA, 1344 bp, Zea mays
  misc_feature (1337)..(1338): n is a, c, g, or t
agagcatttctcgctgcttctttctcttcaagaaaacgtcaaaaaaacgtcagcaccaggctcctccctctaataaatagcggcgggcctctgtcagctcacagctcagtcctcttcaaccccgtttcgccgcccctagcccaaatcccccacctactcgccgccggcgccgtctcagcctcatccttctccgctagccatggccgccgcgggtcccgggctctactccgagatcgggaagaaggccagagatctcctatataaggactaccacacggaccagaagttcacgctcaccacctacgccgccaacggagctgccattactgctgcaagcacgaggaaagatgaagctatctttaatgaaatccagagccagctgaagcacaacaatgtgactgtggatgtgaaagcaacttcagaatcaaatgtgataactacaatcacagttcatgagctgggcacaccaggcttgaaggcaattttatgcgttcctttcccgtaccagaaatctgcaaaggctgaactccagtatttgcaccaccatgctggtgttgctgcaagtgttggcctaaatgcaaaccctgttgttaacctttctggtgtattcggaactaaagctattgctgttggcgctgatgctgcatttgatacttcttctggggacttaaccaaatacaatgctggactgagctacacgacgcctgactttgttgctgcagcgactttgaacaacaaaggagacaacattgccgcttcctactaccactcggtgagtccaaccacagccgtcggaggagaactgagccacagcttctcgaccaacgggaacaccatcacctttgggacgcagcatgccctggaccctctgaccactgtgaaggcacgcttcaacaactacggcatggcaagtgcactgatccaacacgagtggaggcccaagtcactggtcaccatctccacggaggtggacaccaaggccatcgagaagagctctaaggttgggctctccctggtcctcaagccctgaggtcaccagcttctgcttttgggatgttaggtttatttttatttttatcagcagctgaagtccagtaaacaagcttggactaaacttgtcaactttggtgcccatcccataaactcaattcgttgtctgttaccatatcctaaactacctgagaggtttatgttacaatttacgtcgtgcttctgattcttttcgctgtctaatattgggtgttgtttggctcaccccttaaatttggagaaactccaaaaaaaaaaaaaaaaacccagattttaactatttgatcaaaaaaaaaaaaaaaaaaaannggggcg

SEQ ID NO: 1475 - DNA, 6425 bp, Zea mays
tcatttgaatttttttttcacgagctaaactgatattttaacttggttcgttaaccaaacaagctatcacatttcaacaaagagaagctatacacatatcgtatacgtaacaatcgatgaacatgttggtgtttatgtcctacgagataaactagttattgatgagccgtgtcttggtctatgcgaatataactgcgggttaaactgatgaacctgtgtgtattgtaaattgatgagtgacgagctgtgttaatttcatgtatctggtctgtgaaactatgagtataattattatttttatattattaaattagtttaaaattaactataaattaattattctttatatatttttttttctaccctgactctcgagctaaatgagtcagctcaagataactatttagcttgttagcttaacgagtcgagtcagacctagctcgaactcagactagtcgaggttataagctggctcgatactctccctctctgttcttgcaccgtagagatccatactgccctgagagcgaacgggggatcgctgtgcctgtcgttacgttatacaggtggtccgccggtgcagcatgggatgggatggaagccgacggcgtgccggaacaatccacatccactggtgaaacgggtgtgcaaatgcaggaccaactactatgatttggatgcacccatgcttctgacgcaagattccatctgctctgtctttccctcagaccccgccggtcccgaaaagcatatatgcgccagctttccgagaagcaaaaggtcttttcttttactttaaccttatgtaaaccggaaaatgttaatgtttgtaatgtgtaataaatgtcgttagaatagtcatgtagtatactttttattgtaaaccgacctgcagatctgactatacgtaacagtacctttatctttttataaattattggaattgtaaagattcttaaaaactagattttcttctataaaacagcttttataaactgaagatagaaactagatttttaaaaactagacttaaactttgttgtttttttttaaatttccgacttgtttgtaagcacatcaaaatctcgtggcttgttttgcggttgactacactcggacgacagaggttggagctttcttttattagaaaagtagactccgtttggttctttagtccagtgactaaagtttagttagaagactaaattttagtcacaatcatatttggttataggaactaaaagtattcaaaaaaatattaaataaatcataaaattactaaaatatctcttagcattctttctctattagcgtaactgaaataaaggtggataaaaactgggatttatatggtttagtcttttttagtcgtccctggaaagacttgagactaaaacaatttagtctctattttaatcctacagttcgacaatttagagactaaatatgactaaaatagatggaataatctttagttcctcaaaccaaacgagaccttattattgtgacaataaaatcaataaggaaacaatctgtttcttcatctgtcgggaacatttacaaagttatccattttacttatattcttttttaatacaaataaaaatttatttttaattttttttgatagaccgagacaacaagatctattttctctttatcagatagtttcatattaaatttgtcagaataaaataagcgggttataaggggaaaaaactcttaactggaggcggcgataaatccctctctccaagctttttaaccaccttttgttctcttgaagctatcaacaatcctttgcaaacaaacaattgcattgctggaacccattattagtttatgacatgaagcaaactgcactggatcccggatcctggttgtaaacacgtaccaacccagaaaggcaactttcataaacaaattctaaatcacacctgtcccatccgaaaaaaaagtaaagaatgttacagaaaaacctaccaaatcaaccaacaaaagacaagtgctcggtgctcctactcaaaagaacagttttttttctaagaaaaagaaggaaaagacaagtttctcaaaagaacaccttttcctctctagaaaatccaaccaggaatcacatgcttttttttatagccgctctagcggcctactgagtaggtgtgtcagtgtgtgttgcttcatccaagaacgaccagtcagcctatcataaagctctctccttttctcgcgggccgcggcctcactcccttgtctccactctcccgacggagacggagcctcgaacgaacccaatgccaatgcgcctcctcctcctcctcctcctcaccttcctcgccaccgccgccgcggtggcgggtgctgccggtggcgcggccgcggctggctcggatgcggacgcgctgctggcggcgaaggcggtgctgtcggacccggccggcgcgctcgcgtcctggacgaacgccaccagcaccggcgcctgcgcgtggtccggcgtgacgtgcaacgcgcgcgccgcggtcatcggcctcgacctctccggccgcaacctctcgggcccggtgcccacggcgctgtcccgcctcgcgcacctcgcgcgcctcgacctcgccgcgaacgcgctctgcggccccatcccggcgccgctgtcccggctccagtccctcacccacctcaacctctccaacaacgtgctcaacggcaccttcccgccgccgctcgcgcgcctgcgggcgctccgcgtgctcgacctctacaacaacaacctcaccggcccgctcccgctcgcggtcgtgggcctgccggtgctccgccacctccacctcggcggcaacttcttctccggcgagatcccgcccgagtacggccgctggcggaggctgcagtacctcgccgtctccgggaacgagctgtcggggaggattcctccggagctcggcggcctcaccaccctcagggagctctacattggctactacaacagctactccagcggcctacccccggagctcggcaacatgacggatctcgtccgcctcgacgccgccaactgcgggctctccggcgagattccgccggagctcgggaacctcgccaacctcgacacgctcttcctgcaggtgaacgggctcgccggcgccatcccgccggagctgggccggctcaagagcctcagctcgctcgacctgtccaacaacgcgctcaccggcgagatcccagcgagcttcgcggcgctcaggaacctcactttgctcaacctcttccgcaacaagctgagaggcagcataccggagctcgtcggcgacctgcccagcctcgaggtgctgcagctctgggagaacaacttcaccggcggcatcccgcgccggctcggccgcaatggacggctccagctggtcgacctctcgtccaacaggctcaccggcaccctcccgccggagctatgcgccggtggcaagctggagaccctcatcgcgctcggcaacttcctctttggctcaatccctgaaccactggggaaatgcgaggcactctcccgcatccgcctcggcgagaactacctgaacggttccatcccggatggtctctttgagctgccgaatctgacgcaggttgagctgcaggacaacctcctgtccggcggcttcccggcggtttccggcaccggtgcgccgaatctgggggcgatcactctctccaacaaccagctcaccggcgcactgccggcgtccatcgggaagttctcaggtttgcaaaaactgcttctcgaccagaatgcattcaccggcgcagtacccccggaggtcggccggctgcagcagttgtctaaggctgacctgagcggcaacacgcttgacggcggtgtgccgccagagatcgggaagtgccggttgctcacctacctggacctcagccggaacaacctgtccggggagataccgccggccatctccggcatgcgaatcctcaactacctgaacctgtcccggaaccacctcggtggagagataccggcaaccattgctgcgatgcagagcctcacggccgtggacttctcctacaacaacctgtccgggctcgtgccggcgactgggcagttcagctacttcaatgccacatccttcgtcggcaacccggggttgtgtgggccgtaccttggaccctgccattctggcggcgccggcacgggccatgatgcacacacctatggcggcatgtccaataccttcaagctgctaatcgtcctcggcttacttgtctgctccattgcgtttgctgccatggcgatcttgaaggcccggtcactgaagaaagccagcgaggcacgcgcttggaggctcactgcgttccagcgcctcgagttcacctgcgacgacgtgctagacagtctgaaggaggagaacatcatcggcaaaggtggagccgggatcgtgtacaaggggacgatgccggacggtgagcatgtcgcagtgaagcggctttcgtcgatgagccgtggctcgtcacacgaccacgggttctctgcagagatacaaaccctcgggaggatccgacaccgctacatcgtgaggttgctcggcttctgctcgaacaacgagacgaatctcctggtgtacgagttcatgcccaacgggagcctgggggagctgctccatggcaagaaaggtggccatctccactgggacactcgctacaagatcgccgtcgaggccgccaaggggctcagctacctgcaccacgattgctcgccgccgatcctgcaccgcgatgttaaatcgaacaacatcctgcttgattccgatttcgaagcacacgttgctgatttcgggctcgccaagttcttgcaggactctggcgcatcacagtgtatgtctgccattgctggctcctatggctatattgccccaggtaaaatttctatccttattacagttcacagttgtctacagattaattctgaatacagttgatgcttgtttatctcatatagtggtaaacatgttgctgtctgttactacttggccccctttagctaatgaaacatagcatccctttatttatggctcgctaaagtttgtttccttgttctgatatgtcagaaatatacaacttataatctgaaaatcaactaatccttcatcggatcgctaccttgtggatgtacagagtacgcatacaccctcaaggtggacgagaagagcgacgtgtacagcttcggcgtggtgctcctggagctggtaacgggaaagaagccggtaggcgagttcggggacggcgtggacatcgtccactgggtcaggtcgacgacggcgggcgcgagcaaggagcaggtggtcaaggtcatggaccccaggctgtcgagcgtgccggtgcacgaggtggcgcacgtgttctgcgtcgcgctcctctgcgtggaggagcagagcgtgcagcgccccacgatgcgggaggtggtgcagatgctcggcgagctccccaagccagccgctgccgctgcagctgcagggcaaggagacgaggttcccggcagcggcgacggcgacgaatgttccgccgcgccgtcgggtgctccggcagctgatgaatctgttgaagcgccgcatggcgaagccaccaaagaaccgagctcacagtcttcgccgaccactgatctcatcagcatctgagagctgtgtcgagcttgtttttttttcttctcgttgctatgtttccttccttctccttgcgaagttcagatgtttggatgtttctagattattagggtttggtgttttaggtctcccctgcacttagggtggtctctgagattcagacatcttgtgttcatccatcttcatttaggtaggccccgggattcagacatcttgtgttcatccatcttgtgttcatgcatcttagcctcacttaggacactgctgtgtacagtagtacatatcaagctccctaaatctccattttgctgtcagaactgaaggaccatttagggggggattaaggagcctaggattatggagcagtcaaggtcgttaatgttgctgtttgtacttgtgttaataaggtgggcattgatatgttgctgtactgcacttcgccttcaagcaatcaagcaagcctcagtcaatgcaatgcaacacctttcctttggctctcactgtactggaacaggatgattctccagaacagctcttgaatcttgattatcaattatcgtagggtgaggtcgcaacaacatactagcataacctcgcatttagtgaagatgatcgttatgaaagcatagggcgcgaatgcttccaacgtagtattgcaaggagtgagtgacaggcccatgccatgcatgacggtatgtctggtggagcgacggttggctgcagaatcagggttggtggatcggcggcagcaggagactggagaccagctgccagcac

SEQ ID NO: 1476 - DNA, 1305 bp, Zea mays
aaccgcgtctcctctccagcgcccgccgtcgccgccgccctcctcttggtcccgccgtccgtcgaggtcatcatggtgagggtcagtgtgctcaacgatgcgctcaagtccatgtacaatgcagagaagaggggcaagaggcaggtcatgatcaggccgtcgtccaaggtgatcatcaagttcctgacggtcatgcagcgtcatggatacattggcgagttcgagtacgtggatgaccacagagctgggaagattgtggtcatccacgtactcgggctcgccaagttcttgcaggactctggcgcatcacagtgtatgtctgccattgcaggctcctatggctatattgccccagagtacgcatacaccctcaaggtggacgagaagagcgacgtgtacagcttcggcgtggtgctcctggagctggtcacgggaaagaagccggtaggcgagttcggggacggcgtggacatcgtccactgggtcaggtcgacgacggcgggcgcgagcaaggagcaggtggtcaaggtcatggaccccaggctgtcgagcgtgccggtgcacgaggtggcgcacgtgttctgcgtcgcgctcctctgcgtggaggagcagagcgtgcagcgccccacgatgcgggaggtggtgcagatgctcggcgagctccccaagccagccgctgccgctgccgctgcagctgcagggcaaggagacgaggttcccggcggcggcggcggcgacgacgaatgttccgccgcaccgtcgggtgctccggcagcggatggatctgttgaagcggcgcatggcgaagccaccaaagaaccgagctcgcagtcttcgccgaccactgatctcatcagcatctgagagctgtgtcgagcttgttttttttttccttcttcttctcgttgctatgtttccttccttctccttgcgaagttcagatgtttggatgtttctagattattagggtttggtgttttaggtctcacctgcacttagggtggtctctgagattcagacatcttgtgttcatccatcttcatttaggtaggccccgggatctgtggtgtgctgcatcttagcctcacttaggacactgctgtgtacagtagtacatatcaagctccctaaatctccattttgctgccagaactgaaggaccatttagggggggattaaggagcctaggattatggagcagtcaaggtcgttaatgttgctgtttgtacttgtgttaataaggtgggcattgatatgttgctgtaaaaaaaagaaaaaaaaaactagagggggggcccggtaccc

SEQ ID NO: 1477 - DNA, 1110 bp, Zea mays
ttcttttgcagcccatgccggcccagctcagcggattacgagaacccgccgccgcgccgccccatagataggttttgtttgggatctcaacgtttcttcctcgtctccgtctcgacacggcggcgccgccgccgccagctgctgccaggagccaagcccaagcctgagcttaaaccatgccgattggttctcttttcgtgtcgaggctggccaggtctagccatgccctccccgctgccgccgccgcggccatctctcaggcgcccaggccccagcacatcgcatctcctatattctccggccttggagcagcggctcgtgatttcagctcaagggctctatggaagggagcattcgtcgatgccttcctggctagaataaagaagaacagagaaaacatgaatgggaagaagatttggtctcgtaggtcttctattttgccggaatttgttggttccactgtgctcatttacaatgggaaaagtcatgtccggtgcaagatcactgaagggaaggttggccataaatttggagagtttgcttttacacggagacgaaggccccatcgaacaataacaggaaagggaaatcaaggaaagggcagaaagtaaaagtagaaatgtgcatgaaaggtgggtttaaggacagcttgatgacggcgtagctgacgaacagcacttgaatcaccagaattcatgatctggactgttttttcttagaccaataacagcaggaaaatgttagcttatcttacttagggctagtttgttaactccatttttccaagacattcttatttttctaagggaaaattaactaattttccttgggaaaatggaattcccttagaaaaacgaggttgccaaactagcccttaaagatttgcctatggattatttcctgcttgctatcggtgcgatcggtataccttaaactgattgtaagtttatgctttagagtgattgtttttgaacaaaactagctacatttctgactgctggaagcaaacttgagtgcctcaagtagctggcaggtagaaaatcctttgctttgaaaaaaaaaaaaaaaatttgccctgcacatttgctgaagcgaacaagttttaatgtg

SEQ ID NO: 1478 - DNA, 1119 bp, Zea mays
  misc_feature (897)..(897): n is a, c, g, or t
  misc_feature (902)..(902): n is a, c, g, or t
  misc_feature (907)..(907): n is a, c, g, or t
  misc_feature (965)..(966): n is a, c, g, or t
  misc_feature (971)..(971): n is a, c, g, or t
  misc_feature (977)..(977): n is a, c, g, or t
  misc_feature (981)..(981): n is a, c, g, or t
  misc_feature (986)..(986): n is a, c, g, or t
  misc_feature (988)..(988): n is a, c, g, or t
  misc_feature (1001)..(1001): n is a, c, g, or t
  misc_feature (1003)..(1003): n is a, c, g, or t
  misc_feature (1006)..(1006): n is a, c, g, or t
  misc_feature (1013)..(1013): n is a, c, g, or t
  misc_feature (1016)..(1016): n is a, c, g, or t
  misc_feature (1018)..(1019): n is a, c, g, or t
  misc_feature (1023)..(1023): n is a, c, g, or t
  misc_feature (1025)..(1025): n is a, c, g, or t
  misc_feature (1030)..(1030): n is a, c, g, or t
  misc_feature (1034)..(1034): n is a, c, g, or t
  misc_feature (1045)..(1045): n is a, c, g, or t
  misc_feature (1048)..(1048): n is a, c, g, or t
  misc_feature (1069)..(1069): n is a, c, g, or t
  misc_feature (1099)..(1099): n is a, c, g, or t
  misc_feature (1110)..(1110): n is a, c, g, or t
cccgccggggccgacgacacgctcctgcaggagccggcacgccatggcgggcttctgcactcctgctgccactgcagctgcccatgccgccctaacccctctgacgagctcaaggaagcacatcgccatgtgcctgtcccccaggccaagcggcggcggcggcatcggcggcggccagagggcgcggcttgcgagtacaggcgcagctcctcaggttcgcgcgctggcgccgacgaccgcggcagaagaagcagcgggtccctcccccgcccctctcaacgtggagtacctggccgctgagttcgccggccacggcgtcagcttcgagcccgtgggcgtcagctgcgccgtcaagatgtcgctgcgcaacggcagcgtggcgcacgtgctgctccccagcgggctcgtcacgtcttacaagcccgccatgtggcacggcacggtcacggaggttctccacacgaacgtcgccgaggtcccaggcgggcgggccgtcatccgcggcggcgtgttcgtggacctccgttgcgatggctgcgacggcgtatggtcgccgagcgcgagcggggcgtggtcgctccgcgacgtccggggaagcccagccacctccatagaggtcgagctcgcgtcagcggcgccggggaacgcggccgccgcgaggtgcgtggtgacgctgcacccggaagcgctggccacggagctcacggtgacgaacaatgcgtcggcggcctcgtcgccgccgatggctctgacgtgctccgtgcccagtcacctgcgcgtgagcaccccggacgccacctacgctctggggctccagggctccgactaccgcagcgtggagcccgcgctgtccggagttcagcattatccctccccgccgcggccgcgcgccggacnaacanggacncagcccgaaaccatggcaaacaaagcttggaatgatccttcggcggcaacaagacctnncgccnggacancccnacggnanaggacacactcancnatncgacccnttncnntgtnanaaccnccangattccatttnacngggcagaagaatcgttgttgnaagaaggtcaagattacttttaccgttccntcatgtcgganttctcggtt

SEQ ID NO: 1479 - DNA, 2076 bp, Zea mays
ccctttgtcggaggctatgatcagatttgtcccggagcgcggcggtgtcggtggccgtcgtcgtcttgggcgggctgttgctgtcgtcgcaaactggaagaaggctcgagtcgtcgaaaggtacaactggttcttcacatgtcttttccccaaccatagtggggtggtcatcctatctctgccacaccatccaacccgatccactgttgtcggtcggaaggtatggtccctgatgaatccggggcaccaacggctaggcctcaccgccgagggatatcttccacctgtgtgcgcgcggctacttctcctgtggcagcgggaagcgcggcaaggcgctgtccgccgcggactagctgctccgccccgccgtcatcaaatggcttcgctcacgcgtgctcctcgaccacgtactcgcccgcgaagagaaccgcgtcaccgccgcattccgttgtgtgtgccttgggaaggacccctccacccacttcctctcaccgtcaatctctaggtgcactgcacccccacctccaggccccgacccctggtcgtgccatgccgcatctagattccaccagggcacatacaaggaggcgcgtgatgctatttcttttctttcttttgatcccataggtatcgggtcggccagatgcgtacaacgtcgcgttctacttggtggtggaagcgcccatcccagccgacggactcgctgctgggctgcttcatccacgactacggcgcgtcgtcgacgggccgtggctcgtctgtgccaccgtagcagctacgtgtgcggcttgcctgcttgggcatgcgcccacgtgccgctaccacagggatgatggctacctcgagatcgacgtggacatcggccgcttggcgatcgccaagccgttctgcacctcgcgctcggcgccatcatgtcggtcaccatcgacatgggtcgccaagccgttctgcacctcgcgctcggcgccatcatgtcgatcaccatcgacatggggttccttgtcgagtcccaacctgaggaggagctgcccgagaggctgttcggcgccatgcgtatcgcgtagatggagatgggcgcaaccaggtacgtgaagctgcctctgatgtggccatgccggagacggccgcagggctaaggccagtttcagggtaagcttagcgaagctggtcaactatagccgctagcaagaccatgccggtggcaaggtgggcaggtcaatgagttgcccggagcgatagcgagcaggtgagcgctgaatttcctaggaaatcgtctccgtattatttccattaatccgcattaactatatccaaagctatttattcttatttcaatgaagggcctcataatcattccacattttgacactggagtatgtccattttttctactattgttgaagtcttaggtacatttgcgggcaattgtccttcctaattttagtgacattacattctctttgaaacaatatcctgaaaatttgatttcatatttcatacgtgaggtgttttaactattgtagcattgatttcccccagtgcacctgataggctatcatcattggccttagagatatcttcaattagatgtgaagaagggcatgaccaaaacggcaacaaagataactgttggggaccttcggcttccgaaggtcctcaaaaacataatttaacaatgtttctgtagtataatacatgagcaggtaccttcgaacttggaccttccggacttgagtcaaaatcacagtgtgaagaagcacaagggatacgaaggatggaatgaagccgaagctgtgcgcaagggagcttcggcgtgataacagaaaaggaaaccgacttaaaggggaaaaggctatctagaccccgatgaattactatagaattattagcaaatgtaaagggcatgagtgtaattttacatgggctgcgtcatgtgtctataaatagatgaacagtgctccagtactgttcacgctgacttggcattttgcttttgcgtcacgcttgtaccctttaccttccctcaagctgaaggtacacttgtaacatggtatcatttctatttcttcatagtaa

SEQ ID NO: 1480 - DNA, 1282 bp, Zea mays
ttgggaccctcgagggccggcgggaccccgggcccggccggacgaacccatcgtttgaccgaccaactgcccaacaaacgatggccggcgtgtcagcaagcatcccgtgcgtggtgctcaacacgggccacgcgatgcccgtgctgggcttcgggaccggctcctccagcacgccggaggatctgccggcgaccatcctccacgccgtccgccttggctaccgccacatcgacacggcctccatgtacggcacggagggggcggtcggagccgccgtctccgacgccgtcgctgcgggggccgtcacctcccgcgctgacctcttcatcacctccaagctcgtgatgaaggacgcgcatccggaccgcgtgctccccgcgatccgggagtcgctggcccgcctaggcctggactacctcgacctcttcctcgtccactggcccgtcgccgccgacgagaacaacaagcccgtgccgttcgacatggaaggcgtctggcacgccatggaggagtgccaccgcatcggccttgctaggtccgtcggcgtcagcaacttctctgcggccaagatgtcccggctgctcgccttcgccgccgtaccgccggctgtgaaccaggtggaggtgaacgtcggctggcgtcaagagaaggtcagggaggcctgcgccaagaacggcgtcgtcgtcaccgccttctcgccgctgggcgcgatcggcacggcgtggggatccaacgccgtcatggaaagcggcgcgctggaggacatcgccgccaggagaggcaagaccattgctcaggtagcgttgaggtggcttcacgagcaaggggtgtgctttgtggcgaggagctttaacaaggagaggttgaagcaaaacatggagcttttcgattgggagttgagcgtcgatgacaaggagaagatcatggggattccacagaggagagcatgccgtgcagagttctttttgtcaccagacgggccgtacaagaccttggaggagctatgggacggggagatatgagataccatgtagctgttgtatctattgtttgtcgacatcgttgttgcttgctgctgtggggaaatatcttcggaatactctctgaatgaatgtggactaacagttggtcctggacaattgccttgcatgtcagtatacattttgttgcattctagctaggttgggtgtggtagtactgctagtgattaagattattagggcttttcttagatcatgtacaacctttagtttgccaaataataacttgattttgtgtcatt

SEQ ID NO: 1481 - DNA, 1258 bp, Zea mays
gattagaaaaaacatgagcatcttttatgtctgcaatctggacaagcggttgagcgtaaggaaaaacaattattgaacaaaactatggccgtatagtccgttcaagctccagatagttctaacatcagaattctatattattcgcgatgacgctgtcaagctctgcccaaagcatccacccgtatacatgcgagaagattctgtaccttccaaagaataatccatctctcacactgtacagatctaaaatgcacgaaatctggtggagatgggcatctgcgtatgtggtcgttcttgcttagcttatatccatggcttcaccatcaagttttaagttgtactccagtccacattggcatttgacaggatccaaaatccccttcatcccattaattgtttcatcaagagactggaagtactcaacttcccccgatttatcaccttgcagagctttgtattcctcctccaatgacttcatatccatctgctgtagtgcagcgggaaaaccaggaattatgtttttctcttgctccagaatctgcttgattctgctgatttctaaaagaagcgctgatctttgtgatttgatgtcttggatcttgagctgagctgacaccagttgtgtgtagagtttcccgggcttgttaaacttatccaggctcccttctgagttaaatatgacatgtttctccccttcaatgaagttttgcttgctctgagatttggcaacatgtggctcctgtctagtaatcttattcttcatactaaaccattcctgttgctcctgtagtttgacagtcaaggtttctgttctctttgtgtagaacaatcttttctcacagagtttcacaaatgtactttgcagtttcctgacggaggagctccaaggtctgcttcagtgtggcgcactcgatgtccagcgtggcaatccttccctgcttctcggccatctgcatgcctaccttagccctcgctgtggccagccgctcggcctcctcgctcgcctgctttgcttgcgccatcactagcgcgacatcgctgtcgtgagcgtcgatggctgtacgctgctgctgctcctcgacagaccgcttcgcggcgtcgtcctccagatcgttcatgtaggagcggagagatttcatgctctccaggtactcctccatgtcttaccggatggagcggcggggcgacggcggcaaggtcggtggagaagacgatgcagctagttgttgaattacgcggacgctgggcggacgctggg

SEQ ID NO: 1482 - DNA, 2357 bp, Zea mays
cccggcctcttgtcttccacacatcgccacgccactgattggctcgcgattatgtgattcgtgaaccttcttgccatggggatgtctgcagcgtctcatctctgtgcttcttcgtccctgcgagctttaaccgtgttgtttgtgttggcagctcttgtttcagatgtagaggggcgacatcatcgtcatgtctgtcctccttatttctcctgcggtggtttaagcaatatatcgtatccatttcgtcggcaaggtgatccatctgggtgcggtgtccaatcgtatgagctggtttgcacggatacagatgctacaattcgcatcggcagtggaacatacaaggtgcttagcatcaactccacatattcttacttctgggttgttgatgccgacctggacatccagagcagttgcccccttccccggtgggattaccatgctaggaggaccagtcgtaatcgtaacttacattggaggattgagttcagccatgatttttccaattctaatccgacgatgtgggtttacgcttacgcttaccctgattggaccagtagaaactcatatcgtcagagggttgagttcagccatgatacccctttttcttcttcttatatggattattcggggtgggctatctttgtgaattgttctcagccaatagagaacggtgtgtatagaccggtgtcttgcttgagcaattcttctttcatctacttggtaactggttactggtatgagtatgatggctatgtttttgctttgggtctggagccttcatgcggttacctagccatgactcctttgggtggtccaggcatgccggtgcccatgaatacaagctatccagatgttgttaagttcatgaggagtggatttgcccttcggtttcctctttcgtatggtgacaacatcagagaatgtctcgcagagaatacgcgtgctttccatgaagaaccaagaaatagtacaggcatcagggaacagatcttggacattcttacattcgagacattatggttttgtgttattgatcaacttggatcaagtaataatgttgtcaaatctgttctcatcaacatcatcgtcagaataataccatttgttctgtggggtctaaaatctgcacatgttatttgcaggttcgtattgatgccgctggcagtatttgtcttcctagcctataaatactggaaaacacggataacaatagatgcagtcgagaagttcctgcgaatgcagcatatgctcgttccgatgagatatgcatacacaaacatcattgcaatcaccagccatttcagagacaagctcggacaaggaggctacggtactgtatacaagggggtgctacagccaggtgaagttcatgttgctattaagatgctaggcaactccaactgtaacggagacgagttcatcagtgaggtcgccaccattggaaagatccaccatgtcaatgttgtgcgcctcattgggttttgctccgaggaaaatatcagggcacttatctatgagttcatgccccgtggatctctcgataagtacatcttctcgtcggagaagacattctcatgggacaaactcaacgagatcgctctgggcattgctagaggtcttaactacctgcatcacgggtgtgatatgcagatagtacactttgacatcaagccacacaacatccttcttgatagcaactttgttccaaaagttgctgattttgggctagccaaactgttcccaaaagatgacaatttcgtgccactgagcgctatgcggggaacgattggctatatagctccagagatggtatctcgaagctttggtgtcatctctagcaaatccgatgtgtacagctttgggatgctactattggagatgacgggcgggcgaagaaacgcagatcctcatgcaggaagctccagtcaagcatactacccatccttggtgtacaagcagctgagccagggtgatgcaaacatgatcaatgaaggtgttgatatgcacgagttagagaagaagttatgtatcattgggctttgctgcatccagatgaagccgcaagatcgaccgacgatgagcgaggtcatagagatgcttgaagctggtgtcgatggcatccaaatgcctccaaggccatacttttgtgatgaagagggtgacagttcttactctataatctctgaactggatacaatagaagagtagtagtagtaaaatgcacttgtgtctatgtgctcttaatgtatcagactattaagattgcaaggttgccataagctaaggtactggttgtatacttttattgagagtgtgataatgtgatatcatataaaatacctccatgaagttttttc

SEQ ID NO: 1483 - DNA, 2717 bp, Zea mays
tgcagcgagatgtatatatggacgtgcaaagtactatttacggagaatgtagtttgagatatggaatcagatagactctggactatggatatgaagtctgctggagatagcctaacactgacttatctaggatgccgcttcaaggtttgcatttgaaaataacactccagatattggttactgcattgaaaaaccttttttcaattacattttaaccctatccaagtatatactggttgctgtgttaaaattctctctttatctccggtcccatccccatcaaaggccatttgcaagccagaaaaagacgcaaaagaaagactaccaagtccgcggccgggttcacagtggaacagtcatgtgcgattttctttctcaaaaacagtgaagatgctcaggctgtctgtgactctgggtgactcttgtcttccacacatcgccacgccactgattggctcgcgattatgtgattcttgaaccttcttgccatggggatgtctgcagcgtctcatctctgtgcttcttcgtccctgcgagctttaaccgtgttgtttgtgttggcagctcttgtttcagatgtagaggggcgtcatcgtcgtcatgtctggcctccttatttctcctgcggtggtttaagcaatatatcgtatccatttcgtcggcaaggtgatccatctgggtgcggtgtccaatcgtatgagctggtttgcacggatacagatgctacaattcgcatcggcagtggaacatacaaggtgcttagcatcaactccacatattcttacttctgggttgttgatgccgacctggacatccagagcagttgcccccttccccggtgggattaccctgctcgttggatcaatcgcaactcacatcgttggaggattgagttcagccattattatctctattcttctttttatactgtttcgaggtgggctatctttgtgaattgttctcagccaatagagaacaatgatatatgtaataatatatatgatgacgatgtgtatgggccggtgtcttgcttgagcaattcttctttcatctacttgctggtaactgacaactgggatgttatttctgctggggatctggagccttcatgcggttacctagccaagactcctttgggtggtccaggcatgacggtgccctcgaatacaagctatccagatgttgttaagttcatgaggaatggatttgcccttggatttcctttttcgattagatcttaccccaccatcagagaatgtctcgcagagaatatgcgtactttccataaagaaccaagaaatagtacaggcatcaggcaacagatcttggacattcttacgttcgagacattatggttttgtgttattgaacaacttggatcaagtaataatggtgtcaaatctgttctcatcgacatcatccaacaaataccatatgttctttccagtctgaaatctgcacatgttatttgcaggttcgtattgatgccgctggcagtatttgtcttcctagcctataaatactggaaaacacggataacaatagatgcagttgagaagttcctgcgaatgcagaatatgctcgttccgatgagatatgcatacacaaacatcattgctatcaccggccatttcagagacaagctcggacaaggaggctacggtactgtatacaagggagtgctactgccaggtgaaattcatgttgctgtcaagatgctaggcaactccaactgtaacggagaagagttcatcagtgaggtcgccaccattggcaagatccaccatgtcaatgttgtgcgcctcattgggttttgctccgaggaaaatattagggcacttatctatgagttcatgccccgtggatctctcgataagtacatcttctcgtcggagaagacattctcatgggacaaactcaacgagatcgctctgggcattgctagaggtcttaactacttgcatcacgggtgtgatatgcagattgtacactttgacatcaagccacacaacatccttcttgatagcaactttgttccaaaagttgctgattttgggctagccaaactgttcccaagagatgacagtttcgtgccactgagcgctatgcggggaacgataggttatatagctccagagatggtatctcgaagctttggtatcatctctagcaaatccgatgtgtacagctttgggatgctactattggagatgacgggcgggcgaagaaacgcagatcctcatgcaggaagctccagtcaagcatactacccatccttggtgtacaggcagctgagccaaggtgatgcgaataggatcagtgaaggtgttgatatgcacgagttagagaagaagctatgtatcattgggctttggtgcatccagatgaagccgcaagatcggccgacgatgagcgaagtcatagagatgcttgaagctggtgtcgatggcatccaaatgcctccaaggccatacttttgtgatgaagagggtgacagttcttactctacaatctctgaactcgatacaatagaagagtagtagtggtagtaaaatgcacttgtgtctatgtgctcttaatgtatcagactattaagattgcaaggttgccataagctaaggtactggttgtatacttttattgagagtgtgataatgtgatatcatataaaatacctccatgaagtttttttacaaagaactcctcaaaaagcggcc

SEQ ID NO: 1484 - DNA, 2412 bp, Zea mays
aacccaaaaagagagacacaaaagaagaaagactcaagtcagtggcatcacaatcatgaagatactcaggctgtgactcttgtttctactcactccacgccactgactggcaggcgattatgtgattcatgaaccttcttgccatggcgacgatgtctgcagcgtgcttcttgccatggcgacgatctcatcgctgctgtgcttcttccctgcgagcttcaaccgtgttatttgtgttggcagttcttgtttcagatgtaggcgggcgacatcatcgtcatatttgccctccttatttctcctgtggtggtttgagcgatatatcatatccattccgtcggcaaggcgatccatctgggtgcggtgtcgaatcgtatgagctggtttgcacggatacagacgctaccattcgcatcggcagtggaacatacaccgtgcttagcatcaactccacgtattcttacttctgggtcgttgatgccgacctggacatccagagcagttgcccccttccacggtgggattaccatttgtttcctttcattttgaggattgacaactcacatcgtcggaggattgaattcagccatgatacccctttttcttcttatatggattcggtgtgggctatctttgtgaattgttctcagccattagagaacaatgatactgataaatatcatagatatgagccggtgtcttgcttgagcaattcttctttcatctacttggcaactggctaccggtatgatggctatgtttctgctggggatctgaaaccttcatgcggttacctagccatgactcctttgggtggtccaggcatgccggtgccctggaatacaagctatccagatgttgttaagttcatgaggagtggatttgcccttcgatttcccttttcgtatggtgataacatcagagaatgtctcgcaaacaatatgcgtactttccttaaggatccaagaagtagtacaggcatcaaggaactgattgtggacattcttacggtcgtcgacatattctgggcttgtgttatctatcaacttcaatcaactaataataatggtgtcacaactgttctcatcggcatcattgaaacgatacaatatgttagcggggtcctgaaatatacagctgttgtttgcaggttcgtattaatgccgctggcagtattcgtcttcctagtctataaatactggaaaacaaggataacagtagatgcagtcgagaagttcttgcgaatgcagcagatgctcgttccgatgagatatgcatacacaaacatcattgctatcaccggccatttcagagacaagctcggacaaggtggttacggttctgtatacaagggggtgctacagccaggtgaagttcatgttgctatcaagatgttgggcaactccaactgtaacggagacgagttcatcagtgaggtcgccaccattggcaagatccaccatgtcaatattgtgcgcctcatcgggttttgctccgaggaaaatagcagggcacttatctacgagttcatgccccatggatctctcgataagtacatcttctcatcggagaagagtttatcatgggacaaactcaatgagatcgctctgggcattgctagaggtctcaactacttgcatcatgggtgtgatatgcagattgtacacttcgacatcaagccacacaacatccttctcgacaacaactttgttccaaaagttgctgattttgggcttgccaagctgttcccaaaagatgacaatttcgtgccactgagcgctatgcggggaacgattggctatatagctccagagatggtatctcgaagctttggtgttatctctagcaaatccgatgtgtacagctttgggatgctactattggagatgacgggcgggcgaaggaacgcagatcctcatgcaggaagctccagtcaagcatactacccatccttggtgtacagccagctgagccaaggagatgcgaacgagatcagtgaaggtgttgatatgcatgagttagagaagaagctatgtatcattgggctttggtgcatacagatgaagccgcaagatcggccgatgatgagcgaggtcatagagatgcttgaagttggtgtcgatggcatccaaatgcctccaaggccattcttttgtgatgacgagggtgatagttcttactctgtaatctctgaactggatacaatagaagagtagtaattgtagtaaaatacacttgtgtctatgtgatcttaatgtattagactactaataatgcaaggttgtcataagctaaggtactggttgtatacttttattgagagtgtggtaatgtgttttgatataaatacctccatgaaccattttttacaaaaaccccaaaaaaaaaaaaaaaaaaaaaaaaaaaattatt

SEQ ID NO: 1485 - DNA, 1862 bp, Zea mays
  misc_feature (1858)..(1858): n is a, c, g, or t
ttgggaccctcgggccggccggggtccgcagcgtctcatggctctgcttcttccttgagagctttaaccgtgttgtttgtgttggcagcttttgtttcagatgtagaggggcgacatcgtcgtcatgtctgtcctcatttctcctgcggtggtttaagcaatatatcgtatccatttcgtcggcaaggtgatccatctgggtgcggtgtccaatcgtatgagctggtttgcacggatacagacgcgacaattcgcatcggcagtggaacatacaaggcatgccggtgcccatgaatacaagctatccagatgttgttaagttcatgaggagtggatttgcccttcggtttcctctttcgtatggtgacaacatcagagaatgtctcgcagagaatacgcgtgctttccatgaagaaccaagaaatagtacaggcatcagggaacagatcttggacattcttacgttcgagacattatggttttgtgttcttgatcaacttggatcaactaataatgatgtcaaatctgttctcatcgacatcatcgtcggaataataccatttgttctgtggggtctaaaatctgcacatgttatttgcaggttcgtattgatgccgctagcagtatttgtcttcctagcctataagtactggaaaacacggataacaatagatgcagttgagaagttcctgcgaatgcagcatatgcttgttccgatgagatatgcatacacaaacatcattgctatcaccgcccatttcagagacaagctcggacaaggaggctacggtactgtatacaagggggtgctacagccaggtgaagttcatgttgctgtcaagatgctggccacctcaaactgtaacggagaagagttcatcagtgaggtggccaccattggaaagatccaccatgtcaatgttgtgcgcctcattgggttttgctccgaggaaaatatcagggcacttatctatgagttcatgccccgtggatctctcgataagtacatcttctcgtcggagaagacattctcatgggacaaactcaacgagatcgctctgggcattgctagaggtcttaactacctgcatcatgggtgtgatatgcagataatacactttgacatcaagccacacaacatccttcttgatagcaactttgttccaaaagttgctgattttgggctagccaaactgttcccaagagatgacagtttcgtgccactgagcgctatgcgaggaacgataggctatatagctccagagatggtatctcgaagctttggtgtcatctctagcaaatccgatgtgtacagctttgggatgctactattggagatgacgggcgggcgaagaaacgcagatcctcatgcaggaagctccagtcaagcatactacccatccttggtgtacaggcagctgagccagggtgatgcgaacaggatcagtgaaggtgttgatatgcacgagttagagaagaagctatgtataattgggctttggtgcatccagatgaagccgcaagatcggccgacgatgagcgaggtcatagagatgcttgaagctggtgtcgatggcatccaaatgcctccaaggccatacttttgtgatgaagagggtgacagttcttactctataatctctgaactggatacaatagaagagtagtagtagtagtaaaatgcacttgtgtctatgtgctcttaatgtatcagactattaagattgcaaggtggccataggctaaggtactggttgtatgcttttattgagtgtgtggtaatgtgttttgatataaaatacctccatgaaccttttttttacaaagaactcaagaacattttgtttgcctacaagcnaaaa

SEQ ID NO: 1486 - DNA, 3914 bp, Zea mays
  misc_feature (2510)..(2510): n is a, c, g, or t
  misc_feature (3370)..(3370): n is a, c, g, or t
cttgcatgcctgcagggtaattccaatggagggagaaacaaaggaaggttcatggacgggaacaaaaaaaagagaaaaagatatggaggtcaagcacagggaaatagaggcccattagatggtagctgtgaagaacccatgcctctcccaaatccaatggttggatttaatttgccggaccattggacaagaccagtagacagatcgctgcctacacaagctattggaccaccatacttctactacgagaatgttgctcttgctccaaagggtgtctggactaccatatctagattcttgtacgatattcagccggagtttgtggactccaagtacttctgcgctgctgccaggaaaagaggctacatacacaatctaccacttgagagaaggtcgcctctcctccccttacctccgaagacaatatttgaagcatttcctcgtaccaagaggtggtggccttcatgggacccaaggcggcagttcaattgcctccagacttgtacgtctagcgcaaaactgttagagaggattcgtgtaacccttgcaaacagttcggatccaccacctccattagttcagaagtttgtgttggaggagtgtaggaaatggaatctggcttgggttggcctaaacaaggttgctcctctagagcctgatgagatggagttcctgcttggctttcccaaggatcacaccagaggtatcagcaggacagagaggtaccgatctcttggaaactcgtttcaggttgacactgttgcttaccatctctcagtcctcaaggataggtacccacaaggcatgaacgtgttgtctctattcactggcatcggaggagccgaggtggctctccataggctcggcatacgcatgaacacagtcatttcagtagagaagtctgaggtgaacaggacaattttgaagagctggtgggatcagacgcagaccggtaccttgattgagatcaatgatgtgcagacgctgacagctgataggatcgaggcatatattagacgaattggcggctttgatctcgtgatcggtggaagcccatgcaacaatctcgctgggagcaaccgccaccacagagatggcttggagggcgaacattcttccttgttctaccattattttaggatcttggactccgtcaagtccatcatggagcgcctgtagtttttagaaacttttgatgttctggttcgtagaattgtagccgtctttccctgtgatcaaacttgtgaatgatttgaaggtcgactggtgtaatattcatgtcactctaatttaggctactttcgttaaaaaaaaaaaaagaaaaatgcaaattgaaaggcagggttcatttcttaagtttgtatttctcaatgcgagatctagtatctttgtcgaaaaaaaaaacctaaaactgtggagctatgaaaaggacagtgctattagctccgatcacccactgatggcgaggacagaagatgtccttccacagcccaaaagattctgctttcgctcatggttaccacaacttcacccagaatcataaaaaaaaaatatccagtgtggcaactgaaccatcaggatgtctgtgccagcgttagcccaggtgcctgttggaagctggtttgggctgcatcaactgtccgcgcagaatttggaccgatgtgagttctcgatctcagctttgggcttgtcttcgaagtgcatgcatgttggatacagattcccaactcccttgtgtctgtgtagatcgcagatggcgggggactggaaagaagatggttccttccgctgctcgtggtgtgcttgaatccagtagtggtacacattctggtggctttatgatgaaaaggtgagtggtttctaagtgctgcattaccagatcacttcaaaactgtaagttctgatttggtgacaagggaattggagagtacatatggaaggaaatagctggctattcaattttgtatagcgagagatttactgccccatggatcttctacaattctcttgttatccaatcggttttaaggacttgtttggaagaagggggttgatgaagggctaaaattctttactattgaggggtattagggtggattaaggcctagtttgagtactctagtaatgagaggaattgaattggattgagatgtattatgagagtttttgatttattgggatttaaacactcttcaatctctccaaatcatttcaatccaaaagtatccaatctccagtaggtcatgtaaacggccgtgtgaagtattgttttgcactatagattatacagagtttgaaatagaaagtgaaatagggagtctgttgaagatagtctagcccactaacgtgatggcaaaacggattactgcatcatgactgtatccgttatccggatgatccaaacaggaaacagcagcctgatgccaaaaaccaaaaggtcaatatggccgctactaacggtatgcagaatttagaacactcacggtaaatatgaggtactttcggtgtcnatttctgggcggcaatccttctactttggaaacctcgaatccccttcaggattggagaagattaagatgaaaataaactaatttcttttttaatcctcttcaatttcaaaggtaatttgagttttcaagcccatcctactcaagtcagaacctctcttggagccgcggttggttactcgatttattgactcatgcggtcatgcagttgacgacttcaggctgttcagggagagcatggagtacaatgatgtaaaagaactctactctactctactcacatggatttcatatttttgagtttcctgcatgccacatttcactaaaccaagtaaattgaaactagtagggaaaaatacaagacagtagagatttacatacagaatgaagggttggattccagctctgaactgaagcaggatagcaaaagtacagggcatttgcctgaatctacgctccacaagtatataactcgtatgtttgggctgtgagttgcagatgtggtcatccaagttccacccgatcgtggagagatccctccgcctgcacttcaccgttgaccccgatcaatgactaccattctgctctgagtttgctactttgctacgtggtcggtgttcttggagccgctgcagcctgcaagcctccatggaatctccaagctggacaagaaacaaacaaaaaaataacataccaatgccgataatcttgctgggagttgtgtttcagattactttgttgccccacatcgactaactgtgcctgttgacagagaactgagaatggatggatgaatgaatgaatctttgcaggccaagtgcttgactgagattgggagatgctcctgatgatccgagtttaanagatgtcaacaggcatgtgatcaggaatctcaactgcatctcttgttaacagatgtcatcaggcatgtgatgcacatgctcgcctgcaaagagtacagctcactcgtgctcctctttgattttctcatgtttgcgcggtataagttctacactttttgatcgatggtgctactactaattgttgggttgatctcatacgtactcggcgagagaacaaagccaaacctctcgcgtcctgaccaaaggtgcaataaccactttggttgtggcctaccttcacgagtgaaataaatacaaacacgaaccaacgttcgttgtacttccttgacacacaaatcttttttttttgaaagacgcggcaagagaattgccacgtccaaactttattaagaggaaaaaaaagaacacacttacagacacttatctagccaaacagcccccgaaaaagccactcaagtactctagaaagaaaaaaggataaaagaatgctatgcagagaccctagcaaccaaagtcaaaaaaaaaatagcaactctttgctgcc

SEQ ID NO: 1487 - DNA, 1474 bp, Zea mays
gcagatttgggtggttttaatgggggggctgatcatgacgacaacgtggaactagagaaaagcaatgtgctgttaatgggacctactggctctggtaaaactttacttgcaaagacattagctcgttttgtgaatgtaccatttgtaattgctgatgcaacaacattgacccaggcagggtatgtaggagaagatgtagaatctatattatacaagttactcacggtggcagattttaatgtgcaagcagcacaacaagggatggtgtacatagatgaagttgataagatcacaaaaaaggctgaaagtcttaacattagcagagacgtatctggtgaaggtgttcagcaggcattgctgaaaatgctggaaggcacgatagtcaacgttcctgagaaaggagcaaggaagcatcctcgtggtgataatatacagatagataccaaagatattctttttatatgtggtggtgctttcgtggatttggaaaaaactatatcagagagacggcaggattcatctattggtttcggcgccccagttcgtgcaaacatgagggctggtggcatttcaagtgctcaagtgacatcatccttgttggaatctgttgagagtggtgatctaatagcttatggacttatcccagaatttattggacgcttccctatccttgtgagcctggccgctctaaatgaggaccagcttgttcaggttctgattgagccaaagaatgccctgggcaaacaattcaagaaattgtttagcatgaataatgttaagcttcactttacagatggtgcacttagaataattgccaaaaaggcaatgtcaaaaaatacaggtgcacggggtttaagaactatccttgagaatattctcatggattctatgtatgagatcccagatgcaaaatctggggagaagcgaatcgatgcagtggttgtagatgaagatgcagtaggatcagtggaccaacctggctgcggagctaagattctttacggtgatggtgctttggatcaatatctatcccagataaaggtgtcaggagacggagtggggagcgaaatggatggggaagctgagctttcgtcatcgagagccattggcatgtgattcctggttctgaccgcaccagtgtaacctgtaaaaatctaatcccagttatatcaatgtaagtagtagtagccttgtaaatgaaacgatatgtgcagcgtccattgttcttctgaagccctggcacacgttgccccgcccgcgctcacgcattgcatgatttgcagcaggattttaatgagtgtagtcgagcaggttcgtgtagataccagtcgcttataaatggcgcaatgccatgaattgtaatagctgccggatctatgttaaaacttgaaacaaagaaatggatcaagagggcatggagttgcaaatttgtgaaaaaaaaaaaaatcgcaaactcgaggggggggcccggtac

SEQ ID NO: 1488 - DNA, 2244 bp, Zea mays
gagcatcctcgtggtgataatatacaggtaaagctagcttatttatgacgttctacatttctactccacaagaaatggtaaaaggaaaaagtgaccaaaaatagattgtccagttgttttctctgccattgaattgtctaactgtctattgctagaaaatcaacataatcttaagtgtagtatggtaattaacctattgatgtgttgatgcaactgacatgcatataatttaattaattatttgtcaacaattgtcaactttgactttccagaacaaaatatgacttgcattgatcgatgttgggactgggagtatatattggtgcatcttttgtttgtacactaaatacgtatataatttgactaactgtttttttcagaacttacaaaatttgactttccctgccaaagtttgccttacattgatggacacaaggtgtatgttaactccattgtcccattgagaagatcaagagttctgtaataaaaaaagtattggatccctgtgttaatgctgcataaaattctaaaagttaccaactagttgtagtacaccttttaacaggagcatgctgttatggcattggtgagggggtaatggtggttcaggtgatgatgatccttggctacgcaagtgtagctgcgggtatagttgagcgaggtttcacccctttagctccctattttattggagggaagagaaataggaagatcattcattgcttgattatgctccaagggccattcagcttacataggcatcaggctgccaatcagtcctcaaatctctctcaattattaagtttctaaattagcaccagctaatgtccgcttcccattgacagcagatcagccactttcctggctaggtgttcctgccttcttagtcctgcggctaaactgctttccccacatgacacatgcacgatccaatgctattgatcaggttcttgggacttctttgacaatattttccttatattttatgcctcatatgtctgtgcatatgggtgggcatgaacttctataagaaacagcggtagtagtcattctttgttattgtaaaagcaataaacactaaatgtattttttcatcagtaagctgcttattcagaaacatgccaaacagctctctgctgtaaatgtctggcctaatgtacgctgtacccccctccccaaaaaaaggaaagaaaattccacgatgcctattgagtcttgacctgtgttttggccttttatcacaaacattggttaattacttaattatggcattcatgtacatgcagatagataccaaagatattctttttatatgtggtggcgctttcgtggatttggagaaaactatatcggagagacggcaggattcttctattggcttcggcgcaccagttcgtgcaaacatgagggtcggtggcacttcaagtgctcaagtgacatcgtccttgttggaatcggttgagagtggtgatctaatagcttatggacttatcccagaatttattggacgtttccctatccttgtgagcctcaccgctctaaatgaggaccagcttgttcaggttctcactgagccaaagaatgccctgggtaagcaattcaagaaattgtttagcatgaatgatgttaagcttcactttacagatggtgcacttagaataattgccgaaaaggcgatgtcaaaaaatactggtgcacggggtttaagaaccatccttgagaatattctcatggattctatgtatgagattccagatgcaaaatctggggagaagcgaattgatgcagtggttgtagatgaagatgcagtaggatcagtggaccaacctggctatggagccaagattctttatggtgacggtgctttggatcaatatctatcccatataaaggtggcgggagatggagtcgcaagcgaaatggatggagaagctgagctttcaccatcccgagccattggcatgtgatttctggctctgaccgcactagtgtaacctgtaaaatctaatcccagttgtattcatgtaagtagcagccttgtaaatgaaataaatatgtgcagcgtccattgttcttttgacacccggcacacgttgcctggcagcgctcgcgccttgcatgatttgaagcaggattcagaagagtgtattcgagcaggttcatgtatgtaccgtcacttatgaaatttcctataagtcccagtcactaccggtaatcaaaaaaaaaaaaaaaattcaatcttgg

SEQ ID NO: 1489 - DNA, 2254 bp, Zea mays
ggcgacgatcatgagaggcaaggtatgcatgcatgcatgaacgaccatgacatgtactagctagctcgctctagcagttgttgcgatcctctcatctcatgcatgaacgaaatagggacggcgtggacggcgacgtcgcacatcgtggcggcggtggtgggctccggcgtgctggcgctggcgtggacggtggcgcagctggggtgggtggtgggtcccctcgtgctggtgggcttctcttgcgtgacctactacacgtcggcgctgctcgcagactgctaccgctacccggaccccgtccacggcgccgtcaaccgcgagtacatcgacgccgtccgatgctacctgggtatattatatttctagatatatatcttgatgcatttgttctgaaatcgatctgaccgtcacatgcatagaccggaagaacgtggtgctgtgcgggtgcgcccagtacgtgaacctgtggggcactctcgtcggctacaccatcaccgccagcgcaagcatgatgtaagaacattcttttttatttgtaatgtatttgataatacattacacgttacgagcctttccgtgagtagtagccgtttgtgtcgtagctagctagcttgctctgctgggtgcgtacgctttgcctgacgccagccgaaaccaagcgacagcggaaaggtggcgggatacgtggcttttcacccgaaaccaggagaatccgttgcaacgacccacgccagtctccatgctctatctgggctgttttgtttgccgacgcggcacgcatgaatgaacaccccagcttctccctactggccgggcacgtatccggcgtgagtgtagttcactctactccagttgatgtatgtattgttcgtctttttacagcgcgattaagcgcgtcaactgcttccaccgggacggctacggcgccgccggctgcaacccgtcggggagcacgtacatggtggtgttcgggctcttccagctcctgctgtcgcagctgcccagcctccacaacatcgcctggctgtccgtggtggccgtggccacctccctgggctactccttcatcagcctgggcctgtgctccgccaagtgggcctcgcacggcggccacgtgcgcggcacgctggcgggcgccgccgccgtggccggccgggccgacgacgacaagcaggcggccttcaacgtgctcctcgcgctcggcaacatcgccttctcctacaccttcgccgacgtgctcatcgagatccaggacacgctgcgctcgccgcccgccgaaaaccgcaccatgaagcgggcctccgcctacggcctcgccatcaccaccgtcttctacctcgcgctcggctgcaccggctacgccgccttcggcgaccacgcgccggggaacatcctcacgggcttcgccttctacgagcccttctggctcgtcgacgccgccaacgtctgcgtcgtcctgcacctcgtcggcgcctaccaggtcttcgcgcagcccatcttcgcgaggctcgagtcctgcgtcgcctgccgctggcccgacgccaagctcatcaacgccacctactacgtgcgcgtgccgccatgcctcctcctcctccgcacgtcgtcgtcctcgtcgccgccgcccaccctcgccgtcgcgccgctcaagctcgtcctgcgcaccatcgtcatcatgttcacaacgctcgtcgccatgctggtgcccttcttcaacgccgtgctgggcctcatcggcgcgctcggcttctggccgctctccgtctacttccccgtcagcatgcacatggcaaggctcaacatccgacgcggagagatccgctggtggatgctgcaggccatgagcttcgtctgcctcctcatctccgtcgcagccagcatcggatccgtgcacgacatcgtgcacaacctcaaggccgccgcgccattcaacactgcaaactgattaataaacatgcatttactagtatatatacggatcggatcggaggagtgatgggttaattagtttcttaattagctttggctactatatctatcagtatcagagtcagaggagcagagggccggccacatgcatggcctttttgtgtttcttgattatatatctggcaaatttgatctgtcgagcagattttcatgcatgcatgcatgctgctaattcggacgtacgttgaactagtaataatattatatatttgtaatgtaaccccagcaatgccatgcaatgcaagaagcaacaataatatttgcc

SEQ ID NO: 1490 - DNA, 959 bp, Zea mays
gctctgccctactcagtaggcagttgtcgccgcgcataatcatactagtgacacaatcacagctagccacctccccgtccccagcatcgccaaaggtcacatcggtcggccacgggcgcggggcaagaaggaccaggtgacggacgagcaggagggaggaataatggcgggcgcgggcgcgggcgggtggaagaagcgggtgggccgctacgaggtgggccggaccatcggccggggcaccttcgccaaggttaagttcgccgtcgacgccgacaccggcgcggctttcgccattaaggtgctcgacaaggagaccatcttcacccaccgcatgctccaccagatcaaaagggaaatatctatcatgaagatcgtaagacatcccaacatagttaggcttaatgaggtgttggccggcaggacaaagatatacatagtcttggaacttgtcactggaggtgaactgtttgatagaatagtccgccatgggaagctacgtgagaatgaagccaggaagtatttccaacagcttattgatgccattgattattgccacagcaaaggagtttatcatagagatttgaagcctcaaaacttgcttcttgactcacgtggaaacttaaaactttctgattttggacttagcacactgtctcaaaatgccttgtacacacgacatgtggaacgccaaattatgttgctcctgaggtgctaagtagcaatggatatgacggatgtgcagcagacatttggtcatgtggtgtcattctctatgttttaatggctggttaccttccctttgaggagaacgaccttccacatttgtatgaaaaggagccaagtcattgatccagagaatacttgatccaaatccaagaactcctatagtgtgtgtgaaactctcaacacgtacttcgtcatatatttctttatattgatgtgcaaaaaaaaaaaaaaaa

SEQ ID NO: 1491 - DNA, 1866 bp, Zea mays
  misc_feature (1154)..(1154): n is a, c, g, or t
gctctgccctactcagtaggcagttgtcgccgcgcataatcatactagtgacacaatcacagctagccacctccccgtccccagcatcgccaaaggtcacatcggtcggccacgggcgcggggcaagaaggaccaggtgacggacgagcaggagggaggaataatggcgggcgcgggcgcgggcgggtggaagaagcgggtgggccgctacgaggtgggccggaccatcggccggggcaccttcgccaaggttaagttcgccgtcgacgccgacaccggcgcggctttcgccattaaggtgctcgacaaggagaccatcttcacccaccgcatgctccaccagatcaaaagggaaatatctatcatgaagatcgtaagacatcccaacatagttaggcttaatgaggtgttggccggcaagacaaagatatacatagtcttggaacttgtcactggaggtgaactgtttgatagaatagtccgccatgggaagctacgtgagaatgaagccaggaagtatttccagcagcttattgatgccattgattattgccacaacaaaggagtttatcatagagatttgaagcctcaaaacttgcttcttgactctcgtggaaacttaaaactttctgattttggacttagcacactgtctcagaatggagtaggccttcttcacacgacatgtggaacaccaaattatgttgctcctgaggtgctaggtagcaatggatatgacggatctgcagcagacatttggtcatgtggtgtcattctctatgttttaatggctggttaccttccctttgaggagaatgaccttccaagtttgtatgaaaagataactgcagctcagtactcatgcccatattggttctctccaggagccaagtcattgatccagagaatacttgatccaaatccaagaactcgtatcactattgaagaaataagagaagacccatggtttaagaagaactatgtaactattagatgtggtgaagatgaaaatgtcagcctggacgatgttcaagctatttttgacaatattgaggacaagtatgtatcagacgaagtaactcacaaggatggtggtcctcttatgatgaatgcctttgagatgattgcactattctcaaggtttggatctctcnagcattgtttgataggcaacaggagtttgtcaagcgccaaacacgtttcgtctcaagaaagccagccaagactgtagtagctacaattgaggttgttgctgagtcaatgggtctcaaggtccactcccggaactacaaggtgaggcttgaaggtccagcgtcaaacagagcgagccaatttgctgttgttctagaggtctttgaagttgctccttctctgttcatggtcgatgttcgaaaggttgccggtgacactccggaataccacaggttttacgagaacctatgcagcaaactttgcagcataatctggaggccaaccgaagtttctgccaaatctacgccgctgaggacgaccacctgctagccgcctagcccagcactgagctactgtagtggcatcaccaagagacgtgattcgtagccgtcagaaagggagagcttctgttgaatctagcattgctcgtggagctgggattcatgttgaccaccaggtgtttgtatattgtagtaacgctattgtagatagtctgtatagctccatttgtgcagttgtacgtagcaggaatatgttaaaaaacaacttttaatgtcaggtataatcggtttgcatccaggaagcatctccaacagtgtcttaaatcagtactctattttcaaatatagggttcaacttataaaaacagttttaacaatgccctattttatattt

SEQ ID NO: 1492 - DNA, 1042 bp, Zea mays
ctttgaaaagaaaacccaccccaccgccgcccgcgaccccgcccgcgagcaggaatggcgtacgcggcggggcggaagaagcgggtgggccgctacgaggtgggccggaccatcggccagggcaccttcgccaaggtcaagttcgccgtcgacgccgacaccggcgcgcccgtcgccatgaaggtgctcgacaaggagaccatcttcgcccaccgcatgctccaccagatcaaaagggaaatatcaatcatgaagatcgtaagacatcccaacatagtcaggcttaatgaggtgttggcagggaagacgaagatatacataatcttggaacttgtcaatggaggcgaactgtttgataaaatagcccgatatgggaagctacgtgagaatgaagccaggaagtatttccagcagcttattgatgccattgattattgccacagcaaaggagtttatcatagggatttgaagcctgaaaatatgcttcttgactcacgtggaaacttaaaagtttctgattttggacttagtacactgtctcagaatggagcaggacttcttcacacaacatgtggaacaccaaattatgttgctcctgaggtgctaggtagcgatgggatatgacggacctgcagcagacatttggtcatgtggtgtcattctctatgttttaatggctggttaccttccctttgaggagaatgaccttccaagtttgtatgaaaagataactgcagctaagtactcatgcccatactggttctctccaggagccaagtcattgatccagagattacttgatccaaatccaagaactcgtatcactattggagaaataagagcagacccatggtttgagaagaactatgtagctattagacgcggtgaagatgagaatgttagcctggatgatgttcaagctgtttttgacaatattgaggacaagtacgtatctgaggaattaactcacaaggatggtggtcctcttatgatgaatgcctctgagatgattacgctatcttaaggtttggatctctcaacg

SEQ ID NO: 1493 - DNA, 2908 bp, Zea mays
  misc_feature (2716)..(2716): n is a, c, g, or t
ccgtcctcctcctcgtcctcctggctgcccatgtcgtctccacctccgcccatgccgagcctcctcttccgagcccttacaacacctccgcccatggcgagcctcctcttccgagcacttacaacccatccatgtgctcggaatcgttccggtgtggcggcgtcgagatccgctacccgttctatcttgccaacgcaaccgccgactacagcgggaactactactcctgcggctacaccgacttgagcgtttcctgcgaactcgaggtcgaggggccgtcgacgacctggacccctaccatccgtctcggcggcgacaactacaccgtcaagaacatctactatgactatcataccatctcactggcggacagagatgtgctcggaggcggcggctgcccgtcgtccgccacaacgtcagcttcgacgagacgtggctgcacaacgccagcgccttcgacaacctcaccttcttcttcggatgccactgggggccacgcgatacactgcctgaatttgccggcaacaacatcagctgcgccgggttcagtactccaactgtcagtggaggctccttcgtgttcaagcctgaagatcttgacgaacaagaggagcaggagttggcttcacactgcgacgaggttttctccgtgccagtgggaagcgatgctctgcgggcgaccgacaccttcagcctcacagggtacgggtacggcgacctgcttaggcaggggttcgagttggaatggaatcggacatcggaggatcagtgtggccagtgcgagggatcgggctcgggctcgggctcgggctcgggcggatggtgcgcctacagccagaagagagaattcctgggctgcttgtgcagcggagggaaggtgggcaacccgttctgcaaaccatcgaagtcaaaaaggaaagcaagaattcttgctggtgccctgggtggtggtgctgctgcgctgcttgttggtgctgccatatttttgttcgtcatcatgcgcaagaggaagcagaagaagaaagtgatcaactcgtcttcgaagctcctcaagtacagcggctctggtgggaccccgcgttcgcgggttggtgacatggagtccggcagcatcgaggacccgccaacgcaccacttcacctacgaggagctcgaggaggcgaccaaccgcttcgacgaaagcagagaactcggcgatggcggcttcggcaccgtctacaaagggtacctcagggacgggcgcgtggtggcggtgaagcggctgtacaacaacgggtaccggcgcgtggagcagttccagaacgaggcggccatcctgtcggggctgcgccaccccaacctcgtcatgttctacggctgcacgtccagccacagccgcgagctccttctggtgtacgagttcgtggccaacggcacggtcgccgaccacctgcacgggcagcgggcccccgagcgcgccctctcgtggccgctccgcctcagcgtcgccgtggagtccgccgcggcgctcacctacctgcacgccatcgagccgcccgtcgtgcaccgcgacgtcaagaccaccaacatcctcctggacgccgactaccacgtcaaggtcgccgacttcggcctctcccgcctcttccccctcgacgtcacgcacgtctccaccgctccgcagggcacgccagggtatgttgatccagagtaccaccagtgctaccagctgacggacaagagcgacgtgtacagcttcggggtggtcctggtggagctcatctcgtccaagccggccgtcgacatcacccggcaccgcagcgagatcaacctggccagcatggccatcagcaagatccagaagtgccagctggaggagctcgtcgacctcggcctgggctacgacaccgacccggccaccaggaagatgatgacgatggtcgcggagctggccttccgctgcctgcagcagaacggcgagatgcgcccgccgatcaaggaggtgctcgaggtgctcaggaacatccagggcgagtgtctgacgtcggggaaggatggggacaagagcaaggacgggcccttctctcccaccacggttcacgctccgtgggacagcaggtccacgacgcccaacaccagcagggactaggatagttagtgcttgaggactgagaccggccgaggtttaattcgtgtctgtattgctgctgtgtgactgctaggcatgccatctgttttcaggcttcgtagttagttcctggtgatgtaaatatttgttttgttggtgctgtcaggacagagggaatgcacatacatgtgtaagagtggcgaatggtattatacatatatatacacgggtacttactgaataaatagatagatgtcgcttgtgcctaaaaaaaaaaaaaaaaaaaaaaaaaaggttagtccttgaggactgagaccggccgaggtttaattcgtgtttgtgttgctgctgtgtgactgcgaggcatgccatctattttcaggcttcgtagttagttcctggtgatgtaaatatttgttttgttggtgctgtcaggacagagggaatgcacatacatatgtaagagtggcgaatggtaagatacatatatacacgggtacatactgaataaatagatagatgtcgcttgtgactaaaaaaaaaaaaaaaaagcggacctaaggttagcccttgaggactgagaccggccgaggtttaattcgcgtttgngttgctgctgtgtgactgcgaggcatgccatctattttcaggcttcgtagttagttcctggtgatgtaaatatttgttttgttggtgctgtcaggacagagggaatgcacatacatatgtaagagtggcgaatggtaagatacatatatacacgggtacatactggataaatagatagatgtcgtttgtgac

SEQ ID NO: 1494 - DNA, 1843 bp, Zea mays
  misc_feature (10)..(11): n is a, c, g, or t
ttaaccctcnntaaagggaacaaaagctggagctccaccgcggtggcggccgctctagaactagtggatcccccgggctgcaggaattcgcacgagaccattacctagaacatcctaatcgaaaaaagacaccaaacacccatgcacacgcaacctatcaagatgaaaagaggcctcctggtactttggtccttgttctacttcagtgttgcaaacgctgacactagaaaccaggccaagcagcctcttgagttcaatcaattgagagtatcaaggaaatatgttcaaggaaaacaagattcaactcccaagaacggaaccagtccatcagtgcatagaggctcaacaagcaatcaacgggagcaggataagatcatatgtatgcctgggcaaacaggggtagcagagtttgaccaatatgcaggatatgtgactgtggatgccaaggctggaagggctttgttctactactttgttgaggctcctcaagatccttcaaacaaacctcttgtcctatggctgaatggagggcctggctgttcatcctttggatctggggccatggttgaacttggacctttctctgttcatagtgacaacaagacactgtacaagaaaaggcatgcatggaacagaatggccaacatgttgttcattgagatcccagctggtgttggatactcatattcaaacactacatcagattactataacactggtgaccaaagaacaacagatgatgcatatacctttcttattacttggctagagaaatttcctgaatatcaggaccgtgatttcttcataactggtgagagctatgcaggtcactatataccagaacttgcaaatctgattctctctaagaatagagccaccaatgtaactagtatcaagcttaaaggtgttgcgattggaaatgcagacttggatgataatttgactctaagagcatcatatgactactattggatgcatgctatgatttcgggaaaagcttataaagccgtcaaggataagtgcggctttaatgggacatacactgaagactgccaaaatgccatggacttagccacccaagaaaaaggaaatattgatgactatgacatctatgcaccaatatgccaagatgcctcaaacccttctaaatcaagtgactcgttagtgtttggtgatccatgcacaaaccactacgtctcctcttacctaaatcgtcctgaggtccaaagggcactccatgcaaacacaacagggttaggctacccatggatggactgtagtcagcagatatttgataattggaaagattcaccagagacaatgctgccatcaatcaagaaactcatttcaagtggcacgagaatatggctgtacagtggtgatatggatgcagtgtgctcattcatttcaacacaatatgtgctggacaatcttgggcttcctatagaagcagcttggcgtccatggcacgtcgacaatgaggttgctggctacgtcattgggtataaagggctggtcttcgcgacggtcagaggagctgggcacatggtgccatactaccagcctcgcagggcattggcattattctcgtcattcctcgaaggggagctccctccacgctgatcgattaagctagcagggtttgtgaatgccatttactcattttccacagcctatggaatcataggcggtacatgaggcctagtgtttttactatacttgtagctggcctttattttttatataaatatataaaacaaaccaagcagggagctgacgattatattaataaaaaatgagatggagaaaaaaaaaaaaaaagcttatcgataccgtcgaccgt

SEQ ID NO: 1495 - DNA, 1802 bp, Zea mays
acgggcacgaccatctcctacacccgcgggcaaaagttccctgtcccccgtacacattccaccccaaaatggcactcgcgccatcacccccagcgctgccgcccaacccggcgctccctttgccgtggtgggggcgggccggccgcggtgcgctcgtccgcgcccgcgcccgcgccgtccgcgcggcgctacggcccccgagccagtggtccgtcgggagctggcggggccgcccggcgcagcagcagcccgagtacccggacaaggcggacctggaagacgtgctgcggacggtgggaacgttcccgcccatcgtcttcgccggcgaggcgcgcaccctcgaggagcgcctcgcggaggccgccgtcggccgggccttcctcctccagggcggcgactgcgccgagagcttcaaggagttcaacgccaacaacatcagggacaccttccgcgtcctcctgcaaatgtccgttgtgctcatgttcggaggccagatgcctgtcgtcaaggtgggaagaatggcaggtcagtttgcgaagccaaggtcagatggttttgaggagcgggatggattgaagttgccaagctatagaggggacaatatcaatggggatgcattcaatggggagtcaaggttgccagatccacaccgcatgataagggcgtactcacagtctgcagcaacactgaatctgctgcgtgcattcgcaactggaggttatgctgcaatgcagagggtagcacaatggaaccttgatttcacagagaacagcgaacaaggtgataggtacatggagttggctcaccgagttgacgaagctttggggttcatgtcagctgctgggctccctttagatcaccctataatgacaacagcagaattctggacgtcacatgagtgccttcttctaccttatgagcaagcgctcactcgtgaggattccaccacgggcctctattatgactgctctgcccacttcctatgggtcggagagcgcactcgccagcttgatggtgctcacgttgagttccttcgaggcattgccaaccctcttggtatcaaggttagtgacaagatggacccagcagaacttgtgcggttgattgatatattgaatcccgaaaacagggctgggagaataaccatcatcacaagaatgggacctgaaaacatgagggtgaaacttccacacctgatacgcgctgtccgtggggccggtcagatagtaacatgggttactgacccaatgcatgggaacactatgaaggccccttgcggactcaaaacccgctcgttcgataggattttgggtgaggtgcgtgcgttctttgatgtccacgaacaagaagggagccaccctggaggagtgcatctagagatgactggacaaaatgttacagagtgcatcggcgggtcacgtacggtgaccttcgatgatctggggtcacgctaccacacgcactgcgacccaaggctcaatgcctcacagtctctggagatggcatttatcatcgccgagcgccttaggaaaaggaggatggcctcgtcgcctttgtacacgaaccagctgggttccattccatcaatgggtctgtgaacaacactaggttcactgtcaaggactagtccttgggttttgtttcagctgctgtgtcaaactttgctggcatgcactggtaaactagatagcctgctgtactgctcattcccggcactgggtctgccctcaaagtataatagatactcatcactttttgaccaaaaaaaaaaaattgttcgttggcccccgaatgttttcccg

SEQ ID NO: 1496 - DNA, 2061 bp, Zea mays
tgatagctagggcctcttttcctgcttcggcttctcatgtttcttgccggtcgtagtggaatccctacatgacagttagtaataacaacatatatctgtaaggtactctgtttttttggttgatgaggtaaactcaaccctttgctttgatgataataataagagtcatattttgcaggattttttttatttagggattatctccgattcctctttacaccactttttttcatttcagtgcaatatcaggtagtggaagtgctgggaggagaaaaaatcttgtcttgcatctgattcggtcttgtagagaaacagaaatgaaatttcttgtcagaacactggttcgtaacttgcgtattggggctatgatgaagacgattttacctgcgcttgcacatgctgttgtttttgatagaaactgtgcagcagatcctgcggtgtcattggaaggcataaaatcacaactacagagtctttcaactgaagttgccgaggcatacaatgtcactcctaatctagatttgctcattccttctcttctgagagaaggcactgcattttcagcttcatccttggcaatggtgcctggcacacctattccacctatgcttgcaagaattactaacgggttgactcagtcgttgaaagctttccatggcagatcatttacttgtgagtacaagtatgatggtcagcgtgcccagattcacaaagcacttgatggatccgtgcgaatattttcaaggcaaatgaaagaatcaacttccagatttcctgatcttgtgaatatgattaaggagttgtgcaagcccgaagtgtcaagctttatactggatgccgaggtggtaggaattaacaggaagaaaggaaatgagttgatgtcgttccaagagctatcttcaagagaaagagggaataagcattcctcaatttcaatagagaacataaaggttgacatttgtgtgtttgtttttgacatcatgttccatgatggagagagactactggattgccctcttcggcaaagaagaaagtacattcatgacttgttccatgagaagccaggatattttgagttagctcagcagctaaatatagaagcctgcgaagcttcaccagacaattctagcactttggctaggatggacacgtttttcagaaatgcatgccagtcttcttgtgagggtataatgttaaagactttggatgtcgatgctggatactctgcttccaaacgctgtgattcatggttaaaggtcaagcgtgactatgtgcaaggcttaggtgatagccttgacttggttccgattggtgcatggtatggaaacggacgtaaagctgggtggtacagcccttttctcatggcatgctacaaccctgaaactgaagagttccaaagtgtatgtcgtgttatgtctggtttctcggatgagttctataaagagatgaaggagttctattcgggggaaaggatactgcccaagaagcctgtttactacaaaacagacgagcaaccagagctgtggttcaccgcagaacaaatctgggagatccgaggtgcagacctgacgttgtcccctgtccaccatgcggccattgggcttgtccatccatcgcgcggcatctcggtgaggatgccccggtacatccgttcagttccagaccggagcccagaggactgcggcacggccgccgatattgctagcatgttcaaagcccagacccggaagatggatgtcagcagcgagggccaggagtagtaggcaatgcaaagctcagcccatttcctcgtcctagctttgcttatgttcaccagttctgtatatacacagaacgaaccagggtgaagtgaaccaccctactgatcaaatggtgaaaactgaagcgtaggacaggcagcactgatcccactggctttcaatttttctttgtacagaaactgaatgcagttggaacgcggaaggaagcccacgagttgcacgttcggggggaaaaaaacgatgcataagtacatcaggcaaaaaaaaaaaaaaaaaaaactcgagggggggcccggtaccc

SEQ ID NO: 1497 - DNA, 3208 bp, Zea mays
tgtggattagactttgtacactgctgcccaggtctccagctaaactgaaaggttcacctgtacttgagtacttctgttggctggactttctaagatatagtgaaaccaagactcgagctttgttctttcttttttttttttttttcaccaggttcaaaattttgaacaagagaagaagctgctgtttgactcagcccgactactttagaacacatcattacatttggactaaacctaccagttctgatagccagattgtgccattctaggaatacgtctgatggtgcaccgagactttggagtacattcaacaagaggcccaacgaaacacttttgaaggctcaatctatagcctcatcagactatatacagacaatgcaaaaccacaaaactaataacagcgacacgggcaatgttaggtgcaaagaagtggcggcagaaacgtgaattgtgagaggaaacaaacaattgtcgacagatggatcgacagtagttatcaaacctaggccattgaagtagcaactatcctcactctgatcatgctgctggtagtagttgttgaacgcgtatgacacattgccaggccaggcaagacctgagcaggagccaccaggtaacagagaagtgcagtcgccattggcgcaagctgacgagaaactagaagaaacattggacaaatccttgttgttgtctaccacacaccattttgatggaaggtaattgacatcaggggcattcttgagcgatttaggaccttgacctatgttggcatagtactttgcctggccatcaaaggtaaaaatgccatggtgcctttcatagcctccactagctatactccgttgatcttcatctaaaaggctgaagagatacatctcaactggagggacttttgggcgaagtggagtcccagactttttggccaggtggttgactaggccagtcatgaatgattgagcaatagcaggagttgcgttcatggctccatctgttggccatcctgctctcccaacaatgatgtccatgtcactgaagccagctttggttagagaagtaaccagagcatctatgcttgcatcaacgtagttgtcatacttgttttcgccatcttttacaggatgagacattagttggaaaagaaaatagtccaatgacaaatttctgttgtgttgaaagctcaagaatggatccagctcgaccataaatggagaactgctgttagcaagaaatgagaggagatctgccatggtcttgttaacatcaggtctgaagctagctttcgtgggcagagtagatgcattctggaatgtgtcagcactgcaaggtactaccaccttcatcttgccagacaattttgcatggactaatgcttgttgaacattttctgctgctcgaactacaaaaggatgaaaattttgtccatgacgtagaagaaagggctcatccccaacaacaatatacctgcaaagtcaatttgtttgtcaattttaaaatattattaaagatgcaaattaaaacagacttgcaacatatatgcacatacagatagaacacaaaataatggcattatttaatgcatgattcacttcatctatgcagtgggacatacaatgtcctcatgatacttgctctataacacactgcaaaatgattttttgcagaaatgaagcataatcatctgccacaaaagatatacagtactaaaggcccaactatgtactcttttcagctatttagggtataggcgttgacatagcagtggacgtaaaatacatactctattactctgctacttttgaacctgatatactaaatggagaatatcaaaagaaaacctaaatgtcctcccaggttcaaagttgtaacctaggaggattacattcacattctacccattgaagttctctgaaatggtaaattacacctcgaattgttgacttggtatagataaaagtcatttgtaacatcccttaatagaatcaccaatcaggaacctgccactaccagcatatcagcagtggcattttgtgggttttcatagtttaatttcacagaagaggttctacctagatataagaaaattccagtgaactactccaaggtagaagcaccaagttgtcaactgaagccaactaatacattcagtaaagaaatggttcccttcttcaattcggattgtatccaatctgattatagaaataaggtaacaaaggcacaggcggcacatcccaccttcccgtgggatccagccatacacagtagaaccgcaatgactaatgtaactcgttgtgagtaggaaaactgcagtcatatactcacattgattaatcgagtcaattggaactgtgcccagttggccgttttctgtagacatgagaattagatcaactaaaactatgacccgtgcgtgattcgtttgctctcagaacattcgactagcaaaagaacccataatcccagttagtaatctgatgaagaggcgcctacaaatcgtgcattggaagggagctcttactcgaaccgcacgctggaggagtaacgggtgatgttgtcgtggacccacgcggcggctgccttggtggaggaggcgaggggccggagcagcgcgtcggggatcccgacgctgacggcgatgccggtgccttcgagcgccgtgagcgcgtcggaggaggcggcggcgaggcggacgcggggaacagagttggggaggaggaggccccgtacgacctgcgccgccggaagcgagtgggaggacgcgaagccccagttcacacccaccgcggaagccggcggtggcggcgccatggcgaggagtaacaggaggaggccaggtacgagcgggcgcggcgagctgcggcgacgggacagcattgcctcgtgttccgtgcgcgctggaggccaccgggtcttgtcagtacaggcactagtgctgctatgctctgcggctgtctgttgtctcggccctctttcttcccgtggtgccgtgggcagccggctactcttacatgtgttgaaaccatgtccgtacaggcactagtgctgctatactcttagggcttgtttggttattcccaatacacatggattggatgggattggaaaaaattgggaaaaagtttgacttgtttgggattcaaacccatccaatcccactcaatccacatggattgagagctaaccgaacaagcccttacatgttttccctacc

SEQ ID NO: 1498 - DNA, 897 bp, Zea mays
caagaagacaaggccggcgacgagaggacgacagcgtgcaagaagagaaggcccatgttaggcgcaactatagggctcaaggtcaatcagttgtggtcacacttttccatttttacgttcagctaaactgaccccctgtctcatggtgcaactgtgcaaggataggcaacaagtgttcaacaatatgtctgtggatcaattgacctgcatttcagcttttagttgaggatcaaaatctcgtgtcgttcagggccctcggtagagagacattaatgtgtcggcaccgtggatcgtcgcagttgtgggtcactgtaacggcactggtcacaggcaccatctgcctctgttcgtcctcctctattggcctcctcagcacctacagggtccagatggaaaagtttctataatacatatgtaacaaatacatactccttgttcaagagatcgtaagcaagattgtaaacggtatccaacgcagaagcacctaatatggttacagagtattactgatgggcttacctgcagactgcatgctactactcaaggatgttgttgcaaatgagttgtggagaaccgtagatgcaaatggttggagagcatcttctgcaccacacatctattggcctcacataccagctgaatctgagagcaatgggtacttgtgtgtccggtgcaacggcggcttgaccttacaaatcagtgttgtatgactaatataaaactctctctctctaaagtagcatagttcaccatgcaagttttgtgtattcatggcaacatatctgaaagatttaagattacttctaccttgattttgtagatatgaaatgttgttgtcattgcacgaatcattaatgacttgattttgctctctatatgctatcttagaagtttcag

SEQ ID NO: 1499 - DNA, 2550 bp, Zea mays
gcacgagaccattacctagaacatcctaatcgaaaaggatttgggagaggaatggtgggagatagcgccgtaccccgtggtcagccgccagtgtttcgcactttgctattcagcttcgttcttcaccggttcaccctagccgccaccccaacccccagcgacagggaccttcgccgccaggccgcccccaatccctagcgactgcgagcaccgtcgccaggcgccgtgcagcgagcgtcgccgcctggcgaagtcgcgcgactcgtgccctgcagcgagcgccgctgtcccgcacccaccgtcgaacggctgccgatgcccaacgccctgcagcgagttgcgccgtcgtccgcttcctctcgctggtaacctcgtgtttcgatttggacagattgctcgtgacttggtgttgcgccgccgaccgagcctccttcccctaagtccctaaccgcctaccctagtccaccacctgccgcagctctcgcctccgtcaagatccgaacccctcgcacgcggcacgaccaaatcctagacacctgatcccaatgcgcagggccctcggcagagagacgttactgcgccggcaccgtggatcggcactgctgtggctagctgtaacggcactggtcacaggcaccatctgcctctggtcgtccttctccgttggcctcctcagcacctacagggtccaggatgttgttgcaaatgagttgtggagaaccgtagattcaaatggttggagagcatcttctgcaccacgcatctgttggcctcccccaccagctgaatctgagagcaatgggtacttgcgtgtctggtgcaacggcggcttgacccaacaacgcagtgcaatatgtaatgctgttgtcgtagcacgaatcatgaatgctacactagtgctgccagagttagacacaaattcattttggcacgatgagagtggttttgtagatatatatgatgttccccacttcatcaacacattgaaatatgatgttcgaattgtcatgagcattccaaaaatcactgcacaaggaaagaccaagaagctcaaagcatataagattttacctcctagagatgcacccgttacttggtacagaacaactgctttggagagactaaggaagtatggtgcaatatatttaactccattttcacaccgtttggcagaaaaaattgatgatccagagttccagagattgagatgcagggtgaattatcacgcactacgatttaagccaagtatcatgaaaacaagtagtgatatagcgaataagctccattcagaaggccatttcatgtcaattcatcttcggtttgagctggatgtgcttgcatatgctgggtgcttcgacatattcacacctgaagaacaggaaatcctgttgaggcatcggaacaaatattttccattgctgttgaggtattggggcaaatattttccaggaaacacacctgactacagggaaagaaggctcattggaaagtgccctttaactccagaagaggtaggtcttattctacgtgctacgggatttgataactcaacatggatttaccttgctcctggcaagctctttggtgggaaacacttcatgaagccattcaaggctatgtttccacgtcttaaaaaccatagtatgatcagaagtggaaagctggaagaaaatatccgagggctagcagggtcagcagttgattacatggtctgtctcctgtcggacatttttatatatgatggtccgagcaacttcgcagacaatctcatgggtcatcgtctatactatggtttccgaaccacgatcacaccaaacaagaaggcccttgctcggatattcatggacagggaggaagggcacacatctgcatttgaggagagggtcaggcaggtcatgctcacccattttggcgccccccacaagcgcatccatccagagtctttctacacaaacccatggccagagtgcttctgccagacgaaagctaggaatcatgctgaccggtgcccacacaacagtgtaaatgatgtccttgaaagttggttccataataaagaagatgtagaagtggaagctactaatcaaactgactccaccagctaaaccgagagttggctggtggaactgagttatcaaaggtttattgattgagaacagattgtttgtcacagacctgcgaatgacatcattggaggaaggattgatggctccagatctctgtaggcgattatgttcgactcaagatttagttgttgagattcttagtctgggagggtcagaaccagattttggataggtttacattgtcatgtagagttctgtggaagaaaaatcatacgaacgtcatgaactatgtggctactacaattggagatctttaccccatatgctatagctgagtgtttggtggcttcagttctgttggagttatttgctgttcctcactatacatatctggttgaattcatgcgttcctggtcctggaactggaacttccccagttttgatttttgcaattcaccgtaatgctaaaaagtcgactatctcc

SEQ ID NO: 1500 - DNA, 1258 bp, Zea mays
  misc_feature (1194)..(1194): n is a, c, g, or t
aagggacccaagtgatgcatatgcaaaagttcaaggatccagctgacatagcatgataagttcagggacccaattccaacatgacacacaacgttaatattcggtgttaatattcggtttgagcaaactcagttttagataaaccaccaagtccgctcaaactcggttttagatagaccaccaagtcccaacactcgttttcctactcttctggcttcgggacccaaataacacatgttaattccaacgcctcctgatacattttactctttggtatacattcagaaaaggacagagaacacgttttcttattgtttatatatattcccggcgataacataacaattcaactacaacaaagtacaaagtttctttaaacaccagaccctctcctataactggaatatgcgaagagctacagaatgtgttgtgcaaaaactctactcaaggagaagcgctttgtctttttgatgtggatacccggctcagtcaaattttcagactgccgtatcatcttcaggctcattaaactgctcttcgtacccgtcctcctcggccccatcctcaatgctgctgtcaacactgtcatcatcgacgtcttcatcattgtggttggcgctatcggtatcctcttcatcaatcgagctcaactctttccaatcaccattttcgtttacaccaaggatgctgtctttggacatcccagcattctccaaatcatctgtgctaatattgcttcctatttcaatctgattcatcttaacactaggaaactgtaaaggcctgtcaggccagtccttaaagaaattgttcaaggtcatgaatctgaacacgtgaataagtctacgtttatccctcttgatatcagagctaagaagcttctgcaggagggttggttctctgctcttgaccatcccgtgatcagcgtgaggagtacggttccataccttagatcttttagactgaaaacctccacgctcataccttgatcttttgttattattgaaacgatttccaaaatgagaatccctgaattgagttttcctattatttttattttcaatgcattgatccccaatttctgatagatagccaggcggtagctcaggtgggtcaaaacccagctcttgttgctttgctatgacttccttcagttcctgccgtcgcaatcactgtagcatctaagagccagancaacatacatttccagactgaaataatagaatcatatcatcagcatttatgtgcccactacttg

SEQ ID NO: 1501 - DNA, 1963 bp, Zea mays
ctctcgcttctgttcccctatcgtcggcctccacaagcgccacgtctcgcgccctcgtccgctccccgccgatgagctgccgcgcggcgccgtggagtcgcccgtcgcacattgctggtccgcgtgtgcccaccccggcgcggccgcgcttcgcacttggaagtaggaatctgtggaagaactcatggaaaattggtgctggtgtttcaaatatgtttgcgctgccatcaacactgtttaggtgcatggcttcaagtggctctggtgatggtgattttgctcagtctacattgactgacgaagcagcagcaccatttccattatactcttggccagataagcagagaccacgagtgtgcattttaggtggtgggtttggtggcctgtacaccgctttaagacttgaatctcttgtgtggcccaatgataagaggcctcaggttcttctggttgatcaatctgataaatttgtatttaaacccatgttgtacgagctattgtcaggagaagtggatgtctgggagatagctccatcttttacagagttgctgaaaaacactagtgttcaatttgtgagagacagtgtaaagcttctgcgcccttctgatcacttaagaagaaaacctggggaaccatgcactggtggagttgttcatctggaaagtggcactgtcattgaatatgattggctcgttctagctttaggggctgaagctaaaattgatgttgttcccggttctgctgaatatgcgcttcctttcacgacattagaggatgccttgagggttgaaagcaagttgaaaatgctagagaggaaaaggtttggtaagagttcccctactattgaggtggcaattgtgggattgggctattccggtgttgaattagctgcgactatatctgagagattaaaaaacactgggactgtaaaggcaataaatgttcaaacaaccgtatgtcccactgctccacaaggaaatcgtgacgctgctctgaaggttcttgagtctcggaatattcagcttttattgggatattttgtgagctgcatcaaagaggctcctacatctgatgattcaagtagcacagttacatactctgaagttgacggtgatcataggaaactaattttggaccttcaacctgctgaaagaggcctcaaagggcagaccctcgatgccgatttggtgctgtggacagtgggttcaacatctcagattccacggttacagcctcctgatgctccctatgttattcctctgaatggtcggggacaggtggagacagaggaaacccttcaagtaaaaggccatccccggacatttgcgattggcgattcagcagctctaagggatccatcaggcaaactcctcccggccactgcacaggttgccttccaacaagcagattttgctggatggaatctctgggcggcaataaatgaccggcctctcctgccgttcaggttccagaacctcggcgagatgatgacgctcggtagaaatgatgccgcggtaacagcaagtttcattgaagggctgaccttggaaggacctctcggacatgccgctcggaagctcgtgtactgcctcagaatgcccacggatgagcaccgggtgaaggttgggatcagctggttcacaaaggctgcgatcgattcgcttgcctccgtgcaaaacgcggtaagtaacacgctcacaggctcatcatgactgtacgggttcttaggtgtatattgcctgcctgaacggaatgaaatggaggacaaatcgatgtccatcttatgtacgtaatcgaggttcttctcgactagtgtgtaccatactttttaatcatgctgctatgttcctacggtacaagagcagtgatgatttatataaaaacacgtgtggctatgccaaaaaaaaaaaaaaaaggcttctagttgggttggttacgtgttttaaaaaacaaaatactattt

SEQ ID NO: 1502 - DNA, 3278 bp, Zea mays
cctttgcggcctattagagcagcgacaggacacgtgctaccaactcatccttggttaggttcagactagctaaggctctgccattgttgttgccatcgagatcatgccgttcttccaccactttgagcttctcgatcaactccacagatagtgtattgagatcgagaaggatttcgattgccatcacactatgtgagtgccttggtggagtgtcttgtaggaatttgaatatgatttttggctcctagtaccccgacattgaggacctccagttggttggccaagtcgcgaacagattcactgtccttgaacctgagcgagtcgaactcatgtcgtagcgtgttcgccttcgcttggcacactcagtccacgttgaggtgtgttttcttgagtgcgtcccacgcgatcttggcggacgccttgctcgcaatcgcctcttgcatctttggaggtacctcgagtgtgatggcctccaaagcattgtgatcgtcgatgtagtcggtggtgctgatgttcactgccatccacagccgtctcacctgcagcttcaacttcatgagcatcacccatgagtagttggtcttggtcaacaacgggtactacctactgtcactactccccctcacaactcgacggatcactaggccacaatcgccattgctagagccgctccttgtcttctggtggcgacacagtggtgaggtagtttatccgtactgcatgactgcaagcacaaccctgacagcgatagcggttctgataccaattaggttgtgtccagtagatcgtgcatgtagtcgtgtaaaatatttttttgtactgtagatgacactgtttgtagagtgaagtttgaaataggaggtaggatatggaatgttgtgataggagagctgttggagatagccttatagccttctactcaatggtgtgtattgccggagacgaagatctcaggatcactcaaacgctcacaaaactcaatacgaacaccgaaaaacacactgaggttttttggagctgccaaactgcaccactgcaataggtgtattctgttgatctgtttattacaaaagctcatatccataaatcacgacacaaatcagcaatcaattagctaagaaagaaactatccaatcaactatcaattagctatgaaaagaaactaatcattcagctatcaattggctaagaaagaaaactaatcaatcaactaagaaggaaacgaataaaccaagctggatcatgcaacaattaatgtccttacatatggttttttccatttgatttttgcttacctagtagccttggtatgttaattggtgcttatctgattgccatggaacgttatcttgttgcagaaaaactggaaccttttcagtgttaacgttgcaatggcgggtacaggcctgtatcagctttcacggaagattaggtttgtcccaaagccaagccagcaagtgtcatgttattgttgacatgtcgagtgaagttgatatgatttacgtgtcgatctcctttacaggcaagattacttgtctggtgagaaggatgctgctccacaactgcaagaatagataatgacaacacacaaagaataactgattgagaagtctgcggcctagggatcttactcttgatttttctgggcaggcaaggatatgtctcgatccaggacgggtcatgtttgttttcttgttcttctgaaatcatgagcaggtcaatgtgaaaatctcctgccaaaaaaagaagcccatgaagtaatattttgtgcatttttgtgggaaaaaagtcatgccaggacatgattcgtatattgtccttttgttcactctatctcgtatttgtgaactctaaattgtttgccaatttgattgatcatagcccagtgttcagagatgtcagtgcccttcaccgtcctcattttgttatgatcgtggtgaagctgaattgttatccctggagaatgagggcattcaataaggagtgtttggtttaagaaaatcactccctccaagatagagtggtgtatgtctatcccttcacggagtgtttggtttgagaaatcatttcatgcaaaatgagttggtatatcataagtttattccctaaatttggttggatttggttgaatgactctatttcccatgttaatactaactaattaactataattaatgaggtggtaatgaatcaatttattacattccacaaaccaaacaaaaaatatgaggagtgagaagatgatggactagcttattcctcgaacaaaatactctataatagtatgtttggattgaggagtaagtattgcatcatcttctcactgctcacttttttttgtttggtttgttgaatataaggagtttattcttcatcatttcagtgaggagtgagaaaatggactagcttatttctcaaaccaaacgccctataatagtatgtttggtttgaagaatgagatattgcataatattttcactcacttttttgtttagtttacggaatgtaatgagttgatttatcatcattttattccccataaactaataattagtaataacatgagaaatgtgtttattccactaattttataggatgagcttatgatgtatcgcattatctagaatggattgattcttcaaaccaaacaccctataattttggtgggatgacctcattcaccatgttagtactagctaactaaatacgaggaatgagacggtgatgaatcaactcattttaatctaaaaaccaaataaaaaagaaatgagaagactgaactaacttattcctcgtaccaaacacctgtaagtgaagaaccatttggagccattttgataattatcagccggtcatttcaattgcagtggatatatgtttagcaaaccgtccggagaagggacggggcttggcttgatcacaagcagaaaacttgccagcataaagctcacgaattgtacatagatccgagccatctggaaacgtgaactacataaggacagatacacagctgttcggtcttcagtctacacttcgaatgaactacaaaacgacgacactgctggttggtctacactcccaatgtgctctaagttggattgaacctaaattccgctgcaatgcttacactaggaagtaaggatgtaaatggggtggatattatccatccatattagaattcaatctgtctaagaagactgagattcgatctgtacccgagtttaggtattcactatctcatgtatatctgatctttattcgtattaatatattcaaag

SEQ ID NO: 1503 - DNA, 1894 bp, Zea mays
tctctgttttgtcgtgccatccgtcactttactctcgagtgcttgggcccactgttcccgtccccaccactctcctaccagcttgtgatgccttcgctattggtaggtatagatccgtatacttattcggatgttaaattttagaccccctttattcgcttgtgaataaataacatatataatttgctttgtaaatttgtattcttgttttgaacattgagcctattaatattcataaaaagtaaacctcaaattcattctatgtctttttaaataactgatataaaattcagatgttttttcattttttgttgtagggagaaaataatgcataaaaagctatacaaaattttattctcgtacttcgtaatatttgtaataacataaaataaaaattaacacaaaattctatacatatctaagctaaaatattaatataattcagatgttgaaacattcctaaggtctactttgggaagcacaaatcgtcttcgggattggaggggttgagatagaaataaacaaattttctctttaattatattcaatcccagaaatttgactatctgtcaataaaaaattagcatcattttccattactgacagccactgccctggtcctgtggtcaattcaaaagccaaacgaacttctctgttcacttgcatgtaaaagggaggtttcacaggtgggccccactgtctcaccctcaacaaccccacctccccccccgccggcggatcgattcccgagacacgagcgccagcggatcgatcattcgatccccaccactgcccgaggccccctcctcgctgacttggctcctccgccgtggccggaggcgaagcaagtgtaaaccagcccaccctcctccccgtctcctctccctccccatgcgctgttttgttctgtattgggttgtgcgcgggggacaggacgcctcctgcgccgaccgttccgttcgtgtttgtgcctgcctgtgccttcggttgttcctctgagcgacggcgagtcggcgaccgaggtggggttccgagcgccccagcccgtggtggaattcgtttggtctggttgttgcgggggaccacagaagcattagctgggtgaactctttcaaaaggggcaggtgcgctagtttgaatggctgctacaaagcttcaggccttttggaaccaccctgctggccccaaaaccattcatttctgggcgccaacattcaaatggggtatcagcattgccaacatagccgactttgcaaagccgcctgaaaagatatcttaccctcagcaagttgctgttgcatgcactggaatcatttggtcaaggtacagcttggttatcacaccgaaaaactggaaccttttcagtgttaacgttgcaatggcgggtacaggcctgtatcagctttcacggaagattaggcaagattacttgtctggtgagaaggatgctgctccacaactgcaagaatagataatgacaacacacaaagaataactgattgagaagtctgcggcctagggatcttactcttgatttttctgggcaggcaaggatatgtctcgatccaggacgggtcatgtttgttttcttgttcttctgaaatcatgagcaggtcaatgtgaaaatctcctgccaaaaaaagaagcccatgaagtaatattttgtgcatttttgtgggaaaaaagtcatgccaggacatgattcgtatattgtccttttgttcactctatctcgtatttgtgaactctaaattgtttgccaatttgattgatcatagcccagtgttcagagatgtcagtgcccttcaccgtcctcattttgttatgatcgtggtgaagctgaattgttatccctggagaatgagggcattcaataagaagtgtttggtttaag

SEQ ID NO: 1504 - DNA, 900 bp, Zea mays
cattgggtacctcgaggccggccgggattttccattactgacagccccaccatccccagcgccagcggatcgattcccgagacacgagcgccagcggatcgatcattcgatccccaccactgcccgaggccccctcctcgctgacttggctcctccgccgtggccggaggcgaagcaagtggggaccacagacgcattagctgggtgaactctttcaaaaggggcaggtgcgctagtttgaatggctgctacaaagcttcaggccttttggaaccaccctgctggccccaaaaccattcatttctgggcgccaacattcaaatggggtatcagcattgccaacatagccgactttgcaaagccgcctgaaaagatatcttaccctcagcaagttgctgttgcatgcactggaatcatttggtcaaggtacagcttggttatcacaccgaaaaactggaaccttttcagtgttaacgttgcaatggcgggtacaggcctgtatcagctttcacggaagattaggcaagattacttgtctggtgagaaggatgctgctccacaactgcaagaatagataatgacaacacacaaagaataactgattgagaagtctgcggcctagggatcttactcttgatttttctgggcaggcaaggatatgtctcgatccaggacgggtcatgtttgttttcttgttcttctgaaatcatgagcaggttaatgtgaaaatctcctgccaaaaaaagaagcccatgaagtaatattttgtgcatttttgtgggaaaaaagtcatgccaggacatgattcgtatattgtccttttgttcactctatctcgtatttgtgaactctaaattgtttgccaatttgattgatcgtagcccagtgttcaaaggccct

SEQ ID NO: 1505 - DNA, 1013 bp, Zea mays
aaaactgttccgtcacatacccgccgccgccgggatccatctctcgtccgtccttcaccccatccaacggctgatgcgtaaggaggagtcaccaacacgcaacacgccagggaaaaaaaaaggaaaagattcagacggacggggcaccactgcctgtcgccctcaagaacccccaccatccccaccgccagcagatcgattcgcgaaagagacgaccgccgccgcatcggaccgtgcccgagccccccttctcctcgctgactcggctcccctcctccgccgtcgccggaggcgaagcaagtggggaccacagaagcattagctgggtgaacccactcaaagggggcagggaattgtgtgctagtttgaatggctgctacaaagcttcaggccctttggaaccacccggctggccccaaaaccattcatttctgggcgccaacattcaaatggggcatcagcattgccaacatagccgactttgctaaaccacctgaaaagatatcttaccctcagcaagttgctgttgcatgcactggactcatttggtcaaggtacagcttggttatcacaccgagaaactggaaccttttcagtgttaacgttgcaatggcgggtacaggcctgtatcagctttcacggaagatcaggcaagattacttatccgatgagaaagatgctgcttcacaactggaagcatagataatgacaacaggcaaagaataacggattggaaagcctgcatcctaggagtctactcttgattttttttttctgggcaagcaaagaataacggatgggtcatgtttgttttcctgttattctgaaatcgtgagcaggctaatgtgaaaatcttccgccaaaaaagaaaaccaatgaagtgatgttttgagcattttttttgtgggaacaagtcatgaaagtacatggtttatctgttgaacaaaaaaactacaacccttgtgcggccatattaaaaaaaaaaaaaaaggccctagggccgcggccgctct

SEQ ID NO: 1506 - DNA, 2327 bp, Zea mays
cattgggtacctcgaggccggccgggaaaatccctcggggccctcgcggcccgccgcgctcctctttctttccctgtcccgacagagttcgaggaagctggggtgggcctgatgcttctccttctcttgaaacgtgatgatggattcagtaagcatgaagctgttagcttttgtgttcctcctgttgcgatgccagcgggcatcgcttgctcttgctgtcgacttccaagtcgaagcattggttgaaatgaggacgcaacttggtgacaaacgtggtgtccttagtgattggaaggataatcaaatgagcccctgctactgggccaatgttaattgccaagacaacaaagtcacaacaataattttgagctcgtcagggttaacaggatccttatcacccagcattgcaaagctaacaactttacagcagctgatactggataacaacaacattactggagggattcctccggagtttggaaacctgtcaagtttgacaattctaaaccttggaagaaataatttaaatggttcaataccggactcccttggacaactttctaaactccaaaatctggatctaagccataattatttgaccgggaatatcccaagctctttctcaaatcttctgtcattgagtgatattaatctggcatataataatataagaggtgcaatcccacaacatctacttcaggtggctcaatacaactatgcaggcaaccacttgaattgtggccaaaatttatctgcatgtgaacgaggcagcacattgacaggtggatcaaaaaattccaagctaaaggtggttattggaagcattgctggagcagtcacactttctgtaactatagttctagttttgctatggtggcaaagaatgcgttaccggcctgaaatcttcattgacgtgtcaggtcagaatgaccatatgcttgagtttgggcaaataaagcggttctcatggcgggagcttcagattgcaaccagcaatttcagtgaacagaatgttcttggcaagggtggttttggtaaggtgtataaaggagttcttccaggtccaaacagtataaagattgcagtgaaacgactactgaacgtggacagtcgtgatggggaaatggctttcctcagagaagttgaattgataagcattgctgtacacaagaacatattaaggttgataggattctgtacaacaccaacagagaggcttttggtataccctttcatggagaatcttagtgttgcttcgcccggccgagatataaaactaaacgaaccagcattagattggtctacaagaatgcgaattgctcttggcgctgcctgtggtttggagtaccttcatgagcactgcaatcccaagatcatccaccgtgatgtcaaggctgcaaatgtcctgcttgatgggaactttgaagcagtggtaggagattttgggctggcgaagatggtagacatagggaggaatacagtaacaacaggggttcgtggaactatgggccacgtagctcctgagtacataaagacaggaaggccatcagtgaagacagatatctttggttatggtgtcatgctgttagagattgtgacaggagagcgtgcaattgcattccatcctgaccgtatagaagaagcaggcgagatcctgctcactgatcaggtcaagctatggatggaagaagggcgactactcgacctagtggatcgcaatctaggtggcgtctacaaccttgaagagctggagaaggttacccagatagcacttctctgcactcacatggatcctgaacaacgccctacaatgtctgaggtggtgcagatgctggaaggagagattgtcccagcagagcggtgggaggagtggcagctggctgagctccaacgacgacaacagcatgagatgaggcaacagggcaaactattcaacttcagtgaagagtctcaaaacatccaggaagccattgagttgtcagctggcagatgagctgtcataagaaagtgacatgattttcacttgttccttaaatagaaaggctataagagaaatattgactattaggaatagtctataaggtcctggactcctggtgtaatatcttgcacaagtaactccgtccatatgctgttaatacaacgataggaccacacctagctcagaccatgtgtatatcaagaatagactgttctacattttaattgcattctgtattactggataactctgaaattctctgttgtgtgtgtgtagaacttgaagccttgaattccagctttagcataaaagccaaaaatttcggcagtaataggatcataacttt

SEQ ID NO: 1507 - DNA, 775 bp, Zea mays
gagagagagagagacagctcactagccccccccccccccccctcagtctctcagtgctgatacttctctccactctcctctttctttccctgtcccgacagagttcgaggaagctggggtgggcctgatgcttctccttctcttgcagtctagcgtccattccacttcgcaagggcttttctttctgttttaagtaaaacggatccagcaacgcaccagttcctgaaacagaaacgtgatgatggattcagtaagcatgaagctgttagcttttgtgttccttctgttgcgatgccagcgggcatcgcttgctcttgctgtcgacttccaagtcgaagcattggttgaaatgaggacgcaacttggtgacaaacgtggtgtccttagtgattggaaggataatcaaatgagcccctgctactgggccaatgttaattgccaagataacaaagtcacaacaataattttgagctcgtcagggttaacaggatccttatcacccaagcattgcaaagctaacaactttacagcagctgatactggataacaacaacattactggagggattcctccggagtttggaaacctatcaggtttgacaattctaaaccttggaagaaataatttaaatgggtcaataccggactcccttggacaactttctaaactccaaaatctggatctaagccataattatttgaccggaaatatcccaagctctttctcaaatcttctgtcattgagtgatattaatctggcatataataatataag

SEQ ID NO: 1508 - DNA, 1691 bp, Zea mays
cattacattaatggcaattgtgaaaaatatatattaaatctctgtcaaactattatattctctggagtatgttataaacattcttagaacccatgtagaatggaaattattcacactctgaaaattgttatacttttttccttgagtatgttataatcactcttaaaatctatgaaatttcttaaaagttcacgttcagaaagttacatgggttatcaattcttgctatataatgaaaaatgttcttcactgttctaggcatctagtaacaataatttcagggaatgtaactataatttgagttaatgaaaaggatcatattatgctttcagagggaactaaacgagttagtactggtgttgtacaaatgtagtctctgtgtggtccaatagaccaatatatacttgcattcccaaaatatctcaccattgttactgatcaaaacaactacatcgaggaaactaagaggttacagccacatatacttgaaatccatgtaacatgaaacataattgcaactgtacctattaagttttcaatcccctagctacctgtagtttttgaagcgtttcttttctgtttctgcaatatttgactcctgagccctggcatgccgtccttgcagtttatgatgtcacaatagcatacaagcatcgactcccagattttctggacaatgtgtatggcgttgatccttctgaagtccacatccacgtcagaatggttcagctccatcacatccccacaacagaagacaagataacagaatggatggtagagaggtttaggcagaaggaccagctcctggcagatttcttcatgaaggggcactttcctgatgaaggaactgaaggagatctgtcgacgccgaagtgcctggcaaacttcttaacagtagtatgcttgacggccatctgtttgtacctaactcttttctcatttgtgtggttcaaggtctatgttgtagcaagctgcgcttacctctcatttgttacctattactccatactaccaccccaactgataggttcaccagagggtgatgtcaaggccaaaaaggttgtgtagatgttgatgtaacttgccatgaaaactgtacatccgcaaacgatttttactgctggagtttctgccttgtgacatttaaggttccctttctgcagtaggaggtatgaatgtatgatagtgcgtatgtaggaattttctgtgattcatcagcgtgccagggccctatctgaaggcagtaaactgattttagatatatgttcttaacatttttataaacaaaactagaccacatttgttacaaatattgaagatttatttatttattttatttgatctttgttctgatgcaaacaatcaaacattagctatatccaacttgaatatattaatacaaacaaccaaacaaaaacaaccaaacaaacgtcaccgcatgtacctagcaaggacataaggagtttgactctttacatactggccaagctgaaccaatctgctaccataccacaaccaatcacataaatagtgaaccagtgatgtccgttctgaaaaggtagagtcgttagtattctggcatgtcacgcgagtgatgtccgttctgaaaaggtagagtcgttagtattctggcatgtcacgcggacgacaccggcgatgacgccttttaagattgctttagttgtttttcg

SEQ ID NO: 1509 - DNA, 1706 bp, Zea mays
ccggccgggccgggatagcgcgtgcgcaggagtataagggctccccccggccccccgggcccgcggcctcgggctgccgctggttccgaacgcgtggtgcgacccgggattccctcgcgcttctctgtgtccccttcctccggcctgaggggaggaccccgcagatcccatcgaaattcacggccggcctaacccaagccggtcctccccgactcccggcgacgaccaatttctccttgttctcgcccctccaacccttcatgatgcttagataatatacagtgctgggttttagcactgttttgagtttttaaattgagctaaggcttcagtgttagtcttgaaagatgaacggttcaagtggttcccaagggcatcatgtcagtggagagaagaagcaagtgtgtcatgttagccggcccattcttaacaatggaccaaagcaccgtccattgacccccatgaggcgatgccgtggtgtagcatgtgtagtgattatactgtcaacagcattcctgttggtagtttacttggctcctattactacttttgctgtgcggctgttcagtgtgcattacagccgaaaggcgacttcctttctatttggaatgtggttatctttatggccgttcttgtttgagaagataaacaaaaccaaggttgtcttctccggtgaaaatgtgcctccaaaacgacgtgtattgttatttgctaaccacaggaccgaggttgactggatgtacttgtgggatcttgcactgaggaaaggccatttaggatatatcaagtacatacttaagagcagcttgatgaagttgcctatttttagctgggcatttcacatttttgagtttatcccggtagaacggaaatgggagattgatgaagcaattattcagaacaagctatcaaaatttaagaacccgagagatcctatctggttggcggtttttcctgaaggcacggattatactgagaagaaatgcatcatgagtcaagagtatgcttcagaacatggcttgcctatgctagaacatgtcctccttccaaagacaaagggcttcatttgttgtttgcaagagctgaggagttccttagatgcagtttatgatgtcacaatagcatacaagcatcgactcccagattttctggacaatgtgtatggcgttgatccttctgaagtccacatccacgtcagaatggttcagctccatcacatccccacaacagaagacaagataacagaatggatggtagagaggtttaggcagaaggaccagctcctggcagatttcttcatgaaggggcactttcctgatgaaggaactgaaggagatctgtcgacgccgaagtgcctggcaaacttcttaacagtagtatgcttgacggccatctgtttgttacctattactccatactaccaccccaactgataggttcaccagagggtgatgtcaaggccaaaaaggttgtgtagatgttgatgtaacttgccatgaaaactgtacatccgcaaacgatttttactgctggagtttctgccttgtgacatttaaggttccctttctgcagtaggaggtatgaatgtatgatagtgcgtatgtaggaattttctgtgattcatcagtgtgtgagggccctatctgaaggcagtaaactgattttagatatatgttcttaacatttttataaaaaaaaaaaaaaaa

SEQ ID NO: 1510 - DNA, 1545 bp, Zea mays
attcgtttacctctctctttctctctctgtgtgtgtgtgtgtgcaggaaaaagaagggagctgtgctaaaatttcttggaggggagggggtagatgacgtttggtagcgccgacatggaggccggcggcggcgagcaccgccacgcacaacaggaggaacagtcatcatccgacgagcggcgcgcgcggttcgcggaggactggggctgctgcgcctgcgcctgcgcggggttattcctggggcccaacccgatggtggcgcgctacctgtacgcgctcatcttcctcgtcaccaacctcctcgcctggacgctccgcgactacggcgactccgcgctcgccgagctgcagcggctgaaggtctgccagggcgcgcgctactgcctgggcgcggagggcgtgctgcgggtcagcctcggctgcttcgtcttcttcttcgtcatgttcctgtccaccgtgaacgccaggaaggtgcacgactgccgcaactcgtggcactccgagtggtggccggccaagctcgcgctctggctcggcctcaccgccgtcaccttcctcgcgccgtcgccgctcgtccagctctacgggaaggtggcgcatttcggagcaggggctttcctggtgatccagctgatcagcgtcaccaggttcatcatgtggctcaacgactggtgccgcgcagagatgacccagaagagataccacttgcagattcaggcggtgtccatcgtcacgtacgtggggtcgctcctggggatcgtgctcatgtacgtgtggtacgcgcccagcccggcctgcaagctcaacatcctcttcatcaccgtcacgctggcgctcgtgcagctcatgaccttcgtctccatgagctccaaggtgaaggcagggtacgtggcgccggggctgatggggatctacgtcgtgttcctgtgctggtcggcgatcagaagcgagccgcacacggaggtttgcaacaggaaggcagaagtcgccacgagcgcagactgggtgaacatcgcgagctttgtgatcgccgtcgtcgtcatcgtggcggcgaccttctcgacggggatcgactccaagtgcctccagttcaagcaggcggagggggagtcggagtcggaggaggaggacgacatcccctacggcctcggcttcttccacctggtgttctccatgggcgccatgtacttcgccatgatcttcgtcggctggaacgcgaacgcgagccacaccatggagaggtggacgatcgacgtcggctgggcgagcacgtgggtgcgcgtcggcaacgagtggctggcggcaatcgtgtacatatggatgatgatcgcgcccgtcatctggaagacgaggcaggtgggatcggcggcggagacgtgagcagtttttttccactgattctgacagccggaatctatatatacatacaaacacaagagcaaatgaaaggccaagggacgggaaacgggaagaggtggtgcgtgctaactcctatgcatcgcattcctggatgttcattggtcaatgacgatgctgcactgctgc

SEQ ID NO: 1511 - DNA, 1305 bp, Zea mays
ggtacccccgagttcggccgggaaggagtggtgggaggcacaagaacgaggagatcaagttgcctctgtgcttgatgttggagaagttggtccccgagcagcatgtcgttgccaggtcgttagaagtgttggcccatggtcagcaggaacaactcaaatcgaaggaagcatccataatgcctatttttctcttattggaaaggcagaacattttgtttacatcgagaatcagtttttcatttcaggtctttcaggggatgacacaattaagaatcgtgtattagaagcactatataggcgcatacttagagcagaaaaagagaaaaggcgcttccgggttattattgtcataccacttttacctggttttcagggtggcattgatgatggtggagctgcgtctgtgagggcaattatgcattggcaataccgaactatttgtagaggacctaattctattcttaaaaatctgtatgatgtggttggctcgaaggcggatgattatatctcattttatgggcttagagcacatggaagatcagatgatgggggtcctctggtcaccaatcagatatatgtgcacagtaaattgatgattattgatgatcgcatggcattgattggctcagccaacataaatgatagaagcttgctgggatctagggattctgagattggtataattattgaagataaagaggttctcagttctataatggatggaagaccttgggaagctggaaagttctccctcagcctacgactttctctatgggcagaacaccttggtcttcttccaggagaggttagttgcattatggatcctgtggatgattcagcgtacaaaaacatctggatggccacggctaaggagaataccgtgatctaccatcaagtattctcatgtgttcccaacgatcacatccattctaggtaccaatttcgccaaagttttgctcatcgtaaggagaaaattggccacacaaccatagacttgggtgttgccttagaaaacctggaaacgcaacagcagggagacctggcatgtgccaatccaatggaacggttgcaggacgttcggggtcatattgtttgcttccctttggagttcatgtgccaagaggacttgagacctttcttcagtgagagcgagtattatacatctccacaagttttccattagggcttgttcgattatttcaattccatgtgacgtggtgtgtattagaatgagttgggatgaattttgacttgctatggctttaaaccgactcaataccatctaatccacatggattaatgttg

SEQ ID NO: 1512 - DNA, 983 bp, Zea mays
gcggccgttccgggggacgcattcccgccaccagatttgtggacgacgtatcgccttcctccgccccgcacggacccatggcgagtcagacaactcttcgtctttctttcttcttcttctcttctccactgcacatcctcctttcttcttctcctcctcgatcggcaagaagctaaggaggcaccattgcttatcgtctgatccccgcggggcgcgtgtcgctgcacaagatgacgacggcaacagccggtggcagcgtcgccgaccgcatcatgccgcacctcctcaacatatatggatcgtccgcgacggcacgggacttcgagatttacgcgccaaatgcgacgtttgaggacccgctcatgcgagctcacggggttaagcagatcaaatcagcgttctacacgctgccaaaggtgtttggggaatccaagatcaccgagtacaccgtacaagagaatcccatggggccgggcaaaaccgaggtggtgatccagaacaagcagcactacaaggtgctgggcaagccggtggatctgacgtcgctcatcaggctgcagctccaggacggcaaggtggtcaagcacgaggactggtggcacgggaagcctctcaagaacagggacacggtgggcgtgccgctggtgggccgactcgcagaggccagccgccggggcgccatgctgctcacccacgcactcatgggcttcggcaaagacccaacccagcctcctcctcctccgacactttgaattcgtcagactcggtagtctgatcaatccaaccaatcatatatgtttgtatatctatctgtctgtctgcttcgcaatgctactctcacgcataacacctgctggacattcttttgttgcgtgcacaaaacttagaacacctagtttgggaactcaggccccctccagttttgagttaattttcaaattagctctaatttcttctgcataaagaacctatatcatcgatta

SEQ ID NO: 1513 - DNA, 966 bp, Zea mays
cctcgaggccggccggggacccatggcgagccagacaactcttcgtctttctttcttcttcttctcttctccactgcacatcctcctttcttcttctcctcgtcgatcggcaagctaaggaggcaccattgcttgtcgtctgatccccgccgggcgcgtgtcgctgcacaagatgacgacggcaacagccgttggcagcgtcgccgaccgcatcatgccgcacctcctcaacatatatggatcgtctgcgacggcacgggacttcgagatttacgcgccaaatgcgacgtttgaggacccgctcatgcgagctcacggggttaagcagatcaaatcagcgttctacacgctgccaaaggtgtttggggaatccaagatcaccgaatacaccgtacaagagaatcccatggggccgggcaagaccgaggtggtgatccagaacaagcagcactacaaggtgctgggcaagccggtggatctgacgtcgctcatcaggctgcagctccaggacggcaaggtggtcaagcacgaggactggtggcacgggaagcctctcaagaacagggacacggtgggcgtgccgctggtgggccgactcgcagaggccagccgccggggcgccatgctgctcacccacgcactcatgggcttcggcaaagacccaacccagcctcctcctcctcctccgacacattgaattcgtcagactcgtagtctgatcaatccaacgaatcatatacgtttgtatatctatctgtctgtctatcttcgcattgttactctcacgcataacacctggacattattttcttttgttgtgtgcacaaagcttagaacctagtttggaaacccatgtcactccagaatttgagtaaaagtctttctaaagctcacgttataagtccttatttagagagccgtctgcggccagaacatatcatcgattacatgcactaattttattct

SEQ ID NO: 1514 - DNA, 2127 bp, Zea mays
  misc_feature (10)..(10): n is a, c, g, or t
cccacgcgtncagccacgcgtccgcccacgcgttttcccacgcgtccgcccacgcgtccgcggacgcgtgggttctacatcacaacccttcgttgagtcctatcaacctttcattgctcaggtagctggcttttttattgttgaggaccgtgtctgccggcctgcagatggacttctatctgagagccaggttgatactatgttggaaacagccatttctaaacttactctgatcttagaggaacagttctctcgcattcatgctgccaaccacctcctcctcataaaaggttatgtcagcctttttggtgcaaccctgaagaagtatgggtaccgatccatgtcgctggctgaaatccttgataaaactagggacaagtatcttgaacttcttctttctgactgccggaagcagctcaacgaggccttctctagggactcatatgagaggatggttataaagaaacaaaatgaatacgacgcaaacatagcggcattccaacttgaccccattgatggagtaccaaatttgccatacgtcgctccattttcctcctctgttcccaatgcttgtcgtattgtgcgttctttcatcgaggagttggtcagctacttgtcactcagcggtggcgtaaacgtctatgatgtggtgaaaagctacttagacaagttcttgattgagacgttgaatgatggttttctgaagctgatacatggtggatccctggaatttccacaggtggtgcagatcgcaggaaatatcgccgttctcgagcggtcctgcgacatgttcctttggcacgccgctcgactttgtggtgtccctaggtgcctcctcgagaagccccattctggattgagtgccagagctgtgctcaaagcctcccagaatgcagcatacaacggatcggttactttggtgaattccaagatcgacgagttcatgctgcagctgactagcatcaactggaccccggacgaagctccagagcacgccaacgactacatgaacgaggtcatcatctaccttcacgaggtggtgtcttccgggcagcaggccgtgccaagggacgcgctgttcaaggttgtatctggcgcgctgagccacatctcggactctatgacgacggtccttctcagtgaccgggtgaaaaggttcaacgcgaacgccgttgctagcatcgacgtcgatctgagggcgctggaggggttcgctgacgacacgtaccgcacggccgggtttctggacctgagaaagggaaccagtttcagagagtgtctagccgaagtaaggcagctcacaaaccttctgctgagcagccagcctgagagcttcgcgaaccctgcaaccagggagcagagctacggagccttagaccacaagaaggtggcgataatttgtgacaagttcaaggatgcccccgacagcctgttcgggagcctctcaggccggggcacggtgcagagcgcccggaagaagtccctggatgtgctgaagagaaggctaaaggattttagctagctggtgagctagatcatttagacaagctagtagcatagtacccctgttttagtgccagtcgtatccatttaaaatttcttttccgtctttctttattccctctttaatcgacttcccgtttcatgcgccgaagagaaggctgaaggattttagctggggttagctggtgagctagatcgttaaataagctagtgctctgtttagggaagaagacaagtggttcggtgtgtaaagccatttcaaatttctttccatccttatttttactcccttaatttgcttcctacacaacaaaaaaaaaaatgtaggttttgacatcgagcgcgaaggcacctacgaccgagaacaagacggcgacagcggcgctgagcgacttcacagcgcccgaattttttgtattttagcctttaaacagaagtaaattcacgtttagacctaaaaaaattttaaatgcagttttggtcccttagctcggcgccacagcctgtggcgccgaggtaacacagctcggcgccacagcctgtggcgccgagctgtgacgtggccgcaacggctagctacgtccagggctgacctggcgctgacgtggtggcggcgcggccgcg

SEQ ID NO: 1515 - DNA, 516 bp, Zea mays
  misc_feature (481)..(481): n is a, c, g, or t
  misc_feature (483)..(483): n is a, c, g, or t
acccggggtccggtggcgagccggcaacagtacgagttgtccgggcgcgcgtatgtgctcgccgggctgagctcgcacgcccaccagcgcgccacgtcgcggcaggtgatgtccggtggcgtggcagaagcgactcggggcggcgaatcggcgcaggtgcgcagtggggcgttggagacgtcgggcatcacgatgtcgtacatgacgccggcgatgctggacatgctgggccggtcgcggaggtcgcgtgagctgctgcagcaacgccaacaacagacggagctgagaagaacgttttgaccgtgtgattatgtggcgtaggaggtactaggcagtcctcccgaaaaaccgttcgtgtgatcaagtgtatggttatccattgatattttgactaaacggtagttcaatttggttcattcttcttattcaaactgtactttaccctcaaaccaaatataatgtagtattagattaccccgangnaaaaaaaaaagggcggggcgctcttgggggatc

SEQ ID NO: 1516 - DNA, 1858 bp, Zea mays
attttgaaaaccttagatcagcgatttcaagttgcaccctctcatgagctcaaaagttttagctgcttgtatgggcttgggcttcgggggattcctagcacgccttcttgatggcgatggtccctttatcctgatagtaggtctggcggtctccggcttggcggtgagccggtgacgatgatacgacctggttggaggttggaggtggagcaggagagtttgcaggagcagttggcatgggcgctggcactcgtccactcgcgtcagccatccgacgccaccaaggtgtcggctctgacgtggcaccttgcgcttgcgcacggactccgtcgctgattcgtttgtctcttccccagtcgcgcaccgcgggccgcggttcgcctggtggctgcgacgtgagtgggcctatatcagcgcggcactcacggggaggcggtgccaacccatatccatcacggcgaagagacctcgggagtgagtgggccgctgggagagcagacaacactgcaacggggtgcgcgcccgcccgtgccgttctccgtcgtcaccgttcgcccgccgccgatccatggggtgggcgctggctctgcacggcggcgccggggacgtgccgcgcacgctgccgcccgagagcagggagccgcgcctcgccacactccgccgctgcctcgacatcggcaccgccgcgctccgggagggccgcaccgcgctcgacgttgtcgagctcgtcgtgagggagctggaggactgcccgcacttcaacgccggccggggctccgtgctcacctccgccggcaccgtcgagatggaggcctgcgtcatggagggcgccaccctgcactgcggcgcggtctccgggctctccaccgttgccaacgccgtctccctcgccagactcgtcatggagaagacgccgcacatctacctcgccttcgacggcgccgaggccttcgccagggaacagggggtggagactaaggatccaagccactttatcacggacaacaatatcgagcgtctgaggcaggccaaagaggccaacagggtgcagatcgactacacccagccagcagcaggccaaagccaaaaggcccaggccgtggtggacgacaactgccagacgggcacggtagggtgcgtggccgtggacgcggcgggcaacctcgcgacggcgacgtccacgggcgggctggtgaacaagatgcccggcaggatcggcgacacgcctctggtgggcgccggaacgtacgccaacgcgctgtgcgcggtgtccgccacgggcaagggcgaggagatcatccgccgcacggtggcgcgcgacgtcgcggcgctgatggagcgcggggacgcgctcccgctgcgcgacgccgcggcgcgcgtcgtggcgggggcggcccgcggcgccgtggggctggtggccgtgtcgcgccagggggaggtctgtatggcgcacaacaccaccgccatgttcagggcgtgcgccaccgaggccggccacaccgaagtcggcatctggacggacgccgccgacgcaggcacgggcgcggacggagagactgtcagcgtcgcgctctagctctaggcatttcatccccgtgtggcgtattctatcgttcgcgtcccattattgccacctgtccgatagacaacttgttctcgatccggtaatttcaccgtgcttcagctgcgtgtgtttggaaaaattgattcggtttcgggtattgttaagagatcgatgggagaagtgaaacattgttgggcgttcagtatgcttttgtaataccttttgttttcttaaataaagtcctaaggagtgttgggaaaaaaaaaaaaaaaaaaataaaaaaaaaaaaaaaac

SEQ ID NO: 1517 - DNA, 1855 bp, Zea mays
aatagcaggtaagccccactgttaggatttccttaaagcaaaaggaatcaactgtacaacagaaacaggtagcctgaggcaagctgggccaaactgtctacaaagctctagccatgatttgtgatcccataggaatcaggttgttgccgtgacctactgcccacaactgacctggcctggcttttcgtgaacttggcatgttatattagctgtctaacagctgtgggatgacaagcatgtttggagatttaactgcaatggtttgtttagctccaaatctgcctacaaagcttttttttgaaacgcaaatggcagtagctctgcctttcattaaagagggaaaagagttatagaacaaagatcatggatcacagatcacacacactaggagcacatcttgtgcttgaaaagacccaccgggaaaactaaaagaacatcaggggcccaaaaccactaggttaggctgctagagagcaacaacactcctgaaaagcgtaaggcctcttttattttccccgccacctgcaacgccgacagtgagctatggtcgaaaattcttctattacactctttccaaatgttccacatggtgtagattgtgattccgttgaagtctcttcttcggtcttttgcgatgagagaggctgtcagaacccaccactcactgatgctgtcaaaatttgatgggtccccttgctgcggtaagatgctgtcaacatttatctgcctacaaagtttttttcatcggagctaaatattttgagccttggaagttggaaaagaatattgaagagctgggcagccccctttttttttcttgaacggctgaacgcgcaggagagctgcacatcaatgtattaagagaaagaaaagtccaaaatggaccaaatacaatgcccaaacaaggcaaaaaacagacaaagaaagaaaactggaccatgacagcaaccagaaatataactctttcctcttcagaagctgccaacaagagtaaaagagagcggccagcccaatctaccacagccctaatcactaggattatccctgaccaaattaaaagcagcaggaagaccaagcctttgcagatgctttgcaccagccctactccagcactccacttcatccataaacactatttggattatgctcatggaaggatttattccatcaaagacggctgttccgatgaagccataatcaccaagttcccaggattatgacactatggactatggacaccttttctcaatcttttgtgcacctttatatgcgcattgctccaccacgcagcaaaggaggtctcatcactatcaggcgtgagatgtcccaacatcaaaggcgaaaggatgatatgccaaaactgtctagcaaaactgcacgtacacaataggtgctggacggtttcaaactcctggtcacataactgacataccactgggtgcggtagtccttttctttgaagcctatcagcagtccagcacttactgccaaccaaaggaaaaaattgcatttagggggagcccatgacttccacaaccttttccatggttcaaaggagatggatcccataaaaaacgccttataacaagacctggaagagaactgtccagaggttgtatgtacccacacatgtctatcatcttcctgggtaagcaccacccttctaaagagcatcccataactacaagaactgctgcagtctccaatcagggagagcggatgcacaatgtcagaaacccactgccaattagccagcacctgggcaacagttctgggacgtgatggtcctgctgcccaccatacatataacctcgggcgcaagatcttgtactgtcttcccatttaaccatctgtc

SEQ ID NO: 1518 - DNA, 1917 bp, Zea mays
  misc_feature (6)..(6): n is a, c, g, or t
  misc_feature (17)..(18): n is a, c, g, or t
  misc_feature (1836)..(1836): n is a, c, g, or t
  misc_feature (1839)..(1839): n is a, c, g, or t
ccgggngccatttatanntttgttattaagccgccgaaaccgctgggagggaaatttgagcggcggagtagctgctggattcacacgtacacgggtgagggttgaggaagagacggggaggaggagcttggggggcaggacaagtcaaaggacaaaggctcgcactcccccggcgccttctcgtcagcttctcccccttcgtcgtcttcgtctgctccgcccgcctaccacgcacgttttcgcttcccctcttttaacaacgcccagcaccgccgcctccgcagtcgagcagagcgcccctccctcttcctccctccccctctttctcgctcgcctcccacttgcgggcgtctcgctgaactggttgcgccgtaccagctgcgctccgtctccacagaaactgcttccaagtctctagctctctgctggtgcatctgcggttgtatttgtaaagatgggttgctgctttatgttcggaaagaaagctaagcaggccgttgaaggcgatgaagatctacatagcgtcaaggtgttttcttacaacgacttgaggaaggctacacaaggtttcagtgacgcaaacaagattggcgagggcggtttcggttctgtcttccggggagtgcttaaagatgggacactagtggcagtgaaagttctatctgctacttcaaggcaaggcgtccgcgagtttctgactgaacttacagcaatatctgatatcaagcatgcaaatctggtcactcttatcggttgctgcgctgaaggctctcacagaatcctggtttacaattacctcgagaacaacagccttgcgcagacattgctaggatccagatacagtaacattcggttcaattggcgggctcgtgtcaaaattgcagttggcattgcctgtggacttgcgtttctccatgaggaaatccgtcctcacattatccatagggacataaaggcaagcaacatccttcttgacaaggacctgaccccgaaaatttcggatttcgggttggcaaggctcctaccacccaacgcgacgcatgtgagcacccgagtagcaggcacattaggatacttggctcctgaatacgcaatccgtggtcaagtgacaaagaaatccgatatctatagttatggtgttcttcttttagaaattgttagtgggagatgcaacaccaacacaagattacctagtgaagatcaattcctccttgagaggacatgggcactctatgaggaagggcgtttagaagacatcatagatattgacatcggcgatgacctggatgttgatgaggcatgcaggttcatgaagattggcctgctatgcacacaagatgcaatggcgcgtcgtcccagcatgaccaatgtcgttcggatgctctcaggggagaagagaatcaacgtagaccacatcactaggcctgccatgatcactgattttgctgatctcaagatcagcaacaaggagcaaagaccaggcgagacacgctctcccacgacaactcctacgacgaaatcattcaccaccaccgaaccattctcgtcgtcagagacgcccacgcagtcatccatgtgaaagtgtgggcgtaagcagcagttttttttttgttgttttcagtttgtatagtgtgtgaatgtggtagatgggccaggttacatgaattttttgaagagtttattgtttgttttgttatgaggaaacatctcataggtctcttattgcatctttgttgctgtaaatatttgaaaatgaagatggtcaagataagctttgcacgattcacatatttttttttgggtttttttttttttttttttttttttttttttttnctnttcttttttttttttttttttcttctttttttttttttccccttcctttttttttcttttttttcctcgtttttgttt

SEQ ID NO: 1519 - DNA, 5493 bp, Zea mays
ggaatggccggctggataggaaaccccccgtatccacgaatccgtcggccgttcttcgccggcgtcaaacggccgtatgggtatgcgataccacgccacgccacaccacgccgttgtactcctccacgcaggagtgttatcgtaccgcaggtggtcagatcaagtgccgtcacatcggcaaacagagaacatgccgtcgtcctcgccgtggaagacagcgggccccacggccatggcggacgtggatggagtcgggtgacgagacgatgcacgctcagcttgaccggtggccgggccgggccgggtcgtggtttcctcccgcgttgctgcggagcggaccggaccttaccttccccgccgcagcacggcgtgcacgcggatgggggggaaaagaacaggccgtccggccgtcgccgccacggctcccacaacccaacaccgccatttctttttttaaaaccagtcgcctcgccagtcgccccacccgccatttatatttgttaagccgccgaaaccgccaaggaacggacggaaaacaaaccgaggcgagaacgagagctgggagggaaatttgtgcggcggagtagctgctggattcacacgggtgagggttgagcaagagacggggaggaggagcttgggggcgaggacaagtcaaaggacaaaggctcgcactcccccggcgccttctcgtcagcttctcccccttcgtcgtcttcgtctgctccgcccgcctaccacgcacgttttcgcttcccctcttttaacaacgcccagcaccgccgcctccgcagtcgagcagagcgcccctccctcttcctccctccccctctttctcgctcgcctcccacttgcgggcgtctcgctgaactggttgcgccgtaccagctgcgctccgtctccacaggtgattcttggctcttgcgctctgtgatgtgtgtgtagtagcttctgtccttggattgttagtgctgctggggtttcttctcgagcggtttggcttcactggcaccctgtctgcacacatagccatagattgaagactactcgttcattctgcactcctctgcatgtggattaggagggttgggtctgcgcaaagcaagcgcttgtgagcgtgatggcgtgcagaccgagaaaatttcgtgttccagtttgtacttgtgtcgttcagttcttccctgcgtcttccaagtctaaacagctctgcctcgcgtcggcgagttctttggcttgttgggatcggctggctccagagtgaattcccgtcctcgttcctttcctgttctgatttggatttgggaattgggacatactatcccctccgggatttggattcccgggtaaggaaaagagaaggggcccctttgccatcatgccatgtcctgtcttagatacgatttgattttggctaaacacctgctcgttttccctgggggttgccggttacctgactgcctcgcgagggaaatcgaaaaacgggccacaatgggtgggtctgtcgagagagagagagagagagagagagagagagagaaaacagagttcaccatgaatcgggatgcaatttgcattcgttccatcgtcgtcggacggttatcgcaagcaagcaagcaaccaggaggaggagttcgtcatcgccatctactatagttagctgttttccacactccaacggacatgattggcccgcctgtcgcgatacctttcggagtcgccagtagatgtgacagtccctgcttcatttcttcaagttgggtgggcaaattcagggctgactttgcccttgacctcacaatttttttgcagctgaaaccggagatgtctcagcttggtggtctcacatgttttttttttgtcatcttactatcttgtagcacccgtagatgactttactgtagcgatctggaatgcggtaactaaacaacttacttccgtgtgtcgcgacaatgccagcgttttttttttgctctcaagtggtccaatatgtcagttttgaacacgcaaattgttgtttacgccacaatttgccatgtggatccagtggctacttgccaaatgctagctgtagccgtacttttctttcttttaattaagattcatttactatgccagtggatctattgaactgaacccttgtctgataacctggtcgacatgtctttgtttttcagaaactgcttacttttctttcttttaaggtccatttactatgccagtggatctattgaatcgaacccttgtctgacgatagtctggccgacatataattgtttttttttcagaaactgcttccaagtctctagctctctgcgggtgcatctgcggttgtatttgtaaagatgggttgctgctttatgttcggaaagaaagctaagcaggccgttgaaggcgatgaaggttggctacttctgctcatattagcatggcttctttgtgtctgcaaccagtttcctattcttacaaacggttgcttttcttattccagatctacatagcgtcaaggtgttttcttacaacgacttgaggaaggctacacaagatttcagtgacgcaaacaagattggcgagggcggtttcggttctgtcttccgggtaaatataacattttccagcacctcatcggcgtcttgtgcagacagaatgaagaatcctttgggcttacactttaatcttggttattaaacagggagtgcttaaagatgggacactagtggcagtgaaagttctatctgctacttcaaggcaaggcgtccgcgagtttctgactgaacttacagcaatatctgatatcaagcatgcaaatctcgtcactcttatcggttgctgcgctgaaggctctcacagaatcctggtttacaattacctcgagaacaacagccttgcgcagacattgctaggtgacacattgctctgcttaatgcctcaacacgttgtctatatcttcatggttttcgtacttacagatgtttcggctatgccaacgcaggatccagatacagtaacattcggttcaattggcgggctcgtgtcaaaattgcagttggcattgcctgtggacttgcgtttctccatgaggaaatccgtcctcacattatccatagggacataaaggcaagcaacattcttcttgacaaggacctgaccccgaaaatttcggatttcgggttggcaaggctcctaccacccaacgcgacgcatgtgagcacccgagtcgcacgcgcggggtaagcatgccccccctaattcctgtttgtgaggcctttctcatgattgatggtagctctgacttttctattctattttatgtccagaggatacttggctcctgaatacgcaatccgtggtcaagtgacaaagaaatccgatatctatagttatggtgttcttcttttagaaattgttagtgggagatgcaacaccaacacaagattacctagtgaagatcaattcctccttgagagggtaagcccttgttatcacatatatcctgcaaaaaaacaagcctggacaattttgtctaaattcgcacggatcagtgcggccgggaactaaaaaaatataagaaactactgaccatattaacacacattcttctcttgcagacatgggcactctatgaggaagggcgtttagaagacatcatagatattgacatcggcgatgacctggatgttgatgaggcatgcaggttcatgaagattggcctgctatgcacacaagatgcaatggcgcgtcgtcccagcatgaccaatgtcgttcggatgctctcaggggagaagagaatcaacgtagaccagatcactaggcctgccatgatcactgattttgctgatctcaagatcagcaacaaggagcaaagaccaggcgagacacgctctcccacgacaactcctacgacgaaatcattcaccaccaccgaaccattctcgtcgtcagagacgcccacgcagtcatccatgtgaaagtgtgggcgtaagaagcagttttttttttgttgttttcagtttgtatagtgtgtgaatgtggtagatgggccaggttacatgaattttttgaagagtttattgtttgttttgttatgaggaaacatctcataggtctcttattgcatctttgttgctgtaaatatttgaaaatgaagatggtcaagataagctttgcacgattcacattcttgaactcctgctcctgccgtgattatttggatcagttcaccttgtatctgacttttgtcccagagaatacgaaggagagctgcttatcttttgcgctgttacgtgctaacaagttttgacatctctaatctcaccctgaagccagataaaaagagcacccacatttagcacaggttagcttcattattgaaggtgaggaaaaaaaagatactctcatgcagtcccacacagtgcccataaatgtgaggtgaagatgtaaaaagttattatttttcgttttagtacactttacttctacgtgagagcatgatttaaaaaactttagtataggctaatgttttcaaaagatccgtttgacaaaaagaacagcacgtgaagtgccacacaggaggtgtacctgacgttgacagcacgtcatgccgatgtcggcagaaaagatgtccttgttgaaaaaacttgttacctaatttaaaagcgtttctagtaaatattgtaacagtgtttccagtcacatcattttgaataaaattgtataaatcatcttcttttattcttcatatattatttaaaagttggaaaaaaattagcagactcaaacctcagcatctatatagattttcgcttagggccctaattgtcaggacagtccctggtttccacacatctcaacagcacagctgcacagggacggtcaagtgcctccgagttttcgcagagatgcagacagttgaggaagaaccaagaaccgatcaaacctgaagtccccctcacagcaatgcacgagatttcggacaacaaacgcgtcgccgtcgtcatcaggtagctcgtatactgtcgcgagacttgcctggagtcaacatgccaactatatacgtacatatggtgtcggaatcgatgccccttcaactctttttaaaagtgagattgacccccatgcattgcattattcagagatcacacattcacgttcacatcagcttgtgcttttgtttagcagagttccagttcaacgcctgtcgctggcaagtgtaccctccctgctgccagccagtgaggagcttgttctgcagagggagcaaaaccaccagcgaagtaaacgaagctgacaaactgaacctttttttttcctactatagaacaccggtcaaactcttgcatttaaaaagttgggcgtgggcagaaaactcaacgtatagaatattatgaaagtatgggtaatatgcatttcataataatctggaatatttatacaaaacaatgttctgacttctgactgccttgctgaactgtttgagctgactacaagatttctgaa

SEQ ID NO: 1520 - DNA, 727 bp, Zea mays
attgtgttggggaagcacagatgggatacccttgaagacatatggaatggcttatgtgctaaagtagtctgcgacagcttgggatatggtgtgaagaccggactgccttatgtgatgagaagtgatgcagaagcaggtaaagctctggagagcttgaaagagtgggaaggggtaaaagtcatggatgatgttctcccattcttccagtcgctcaagctatcgaggactgcagttactgttgacgattgtgttaaggagcttgctggagttgtccgtgagaagctaggacctaagaatgcaatcttcaccaaagcagccgatgccatggtggaatggaacaatctctggaaagtgcatggtgctcagaatgcatagtttgggaatttgcatgtttcctacagagcatctaatagttgtttggagtgcgcgttttacagttctaaattttccctgtggaactcatgaagctgaaataaacaacagtcctttatgccgtgaatttggcatgaatagctgagcatctcattgtatacgcttaagaattatgtaatgtaatgcatcaaaagaacatgtgatgttttcttgcatcttgtcttgttaaacggaatctgctaagaggttggataccagctcagctcagcagaacctctgggcaggcgctgtcaaaatctatgaaagcatttgctgtataccagatatgttttcgtaagaacatcccaccacaccc

SEQ ID NO: 1521 - DNA, 1755 bp, Zea mays
  misc_feature (22)..(22): n is a, c, g, or t
accggtaacaaaacatcccggngtcgacccacgcccgcccccccccccgcccgccctcaccctcgacgccgcgctcctccgcatcgccaatatcgccgacctctcccacctcccagaccacctcctcatcgatctcttccgtgtgaaatcatatcacagtcacagccacacaggagtgtgcgggctgatgtcctcttatgcttatgctgcagaggattcaacattagaacacattttgtaatgtgctcttgcatttttattgcagagaaccctcagtgctggtaagctgacagagaaagttctcaagttgtttctagcaaccggctgtgaggatatcatattggctgttcggttgctcaacattaagcagccactcgtaccagtccttcccacaaggtgctctgagagattctagacctgctgccgttcacattgttttgattacctgagaagatgcctttggaaattcaagatagtgaggttgacattgtgattgcggcactccggcccaacctgaccactttctttgaggcatggcgaccatttttctcccgtttccacatcattgtcgtcaaagatccagacatggcagaggatcttcaaatccctgcaggttttgatctcaaggtttacaccaagtcagatattaatgggttgcttggtgcctcctcatccataaacttatctggtcactcatgccgttactttgggtatcttgtctcacgcaagaagtatgtgatttcaattgatgacaattgcctcccagcgaaggacactgctgggtcgactgttgatgttgttgcacagcacatggccaatctgaaaacacctgctacacctttctttttcaacacactctatgatccatacaggaaaggtgctgactttgtccgtggttacccattcagcctgcgtgagggggttgagtgcatgctctcgtgtggtttgtggcttcataatgctgactacgacccgatgactcatgttgtgaagagaaatcaacggaacacaacatatgtggatgctgtgatgacggttccgcttggtgccatgctgcctgtgagcgggataaatgttgcattcaaccgcgatgtgctggggcctgctatgttcccaggcctgcgtctacgaaacgaagggaagcacagatgggatacccttgaagacatatggaatggcttatgtgctaaagtagtctgcgacagcttgggatatggtgtgaagaccggactgccttatgtgatgagaagtgatgcagaagcaggtaaagctctggagagcttgaaagagtgggaaggggtaaaagtcatggatgatgttctcccattcttccagtcgctcaagctatcgaggactgcagttactgttgacgattgtgttaaggagcttgctggagttgtccgtgagaagctaggacctaagaatgcaatcttcaccaaagcagccgatgccatggtggaatggaacaatctctggaaagtgcatggtgctcagaatgcatagtttgggagtttgcatgtttcctacagagcatctaatagttgtttggagtgcgcgttttacagttctaaattttccctgtggaactcatgaagctgaaataaacaacagtcctttatgccgtgaatttggcatgaatagctgagcatctcattgtatacgcttaagaattatgtaatgtaatgcatcaaaagaacatgtgatgttttcttgcaaaaaaaaaaaaaaaaaaaaacccgcgggggcccggtaccc

SEQ ID NO: 1522 - DNA, 920 bp, Zea mays
ggtaccctcgggctcattgggtacctcgaggccggccgggatgcgaccgccctcgctgctctccctcaccctcgacgccgcgctcctccgcatcgccaatatcgccgacctctcccacctcccagaccacctcctcatcgacctcttccgtagaaccctcagtgctggtaagctgacagagaaagttctcaagttgtttctagcaaccgactgtgaggatatcatattggctgttcggttgctcaacattaagcagccactcgtaccagtccttcccacaaggtgctctgagagattctagatctgctgccgctcacatcgttttgattacctgagaagatgcctttggaaattcaagatagtgaggttgacattgtgattgcggcactccagcccaacctgaccactttctttgaggcatggcgaccatttttctcccgtttccacatcattgtcgtcaaagatccagacatggcagaggatcttcaaatccctgcaggttttgatctcaaggtttacaccaagtcagatattaatgggttgcttggtgcctcctcatccataaacttatctggtcactcatgccgttactttgggtatcttgtctcacgcaagaagtatgtgatttcaattgatgacaattgcctcccagcgaaggacactgctgggtcgactgttgatgttgttgcacagcacatggccaatctgaaaacacctgctacacctttctttttcaacacactctatgatccatacaggaaaggtgctgactttgtccgtggttacccattcagcctgcgcgagggggttgagtgcatgctctcgtgtggtttgtggcttcataatgctgactacgacccgatgactcatgggtgtgagagagaaatcacggaacacaacatatgtggatgctgtgatga

SEQ ID NO: 1523 - DNA, 1121 bp, Zea mays
acgaaggcaacgcgtgctgagggctgaggcagaaaaacgcggggaaacaagagggaaacgccgtgagaggtcgccgataggtgcgcgggtcgcggtcgtcgcctcctctgcctccctggcacttcggctcggctcggcaaacgcaacaacacggagcgggcgtggggagcggagcggagcggtgagcgaggatcgagggcaacgtggcgaggcactcccgagggggagaggcgactttgcttccagttccaggaaagagtgggctataaaaaggcgctcgagatccagatctgggccgatgcgaccgccctcgctgctctccctcaccctcgacgccgcgctcctccgcatcgccaatatcgccgacctctcccacctcccagaccacctcctcatcgacctcttccgtagaaccctcagtgctggtaagctgacagagaaagttctcaagttgtttctagcaaccggctgtgaggatatcatattggctgttcggttgctcaacattaagcagccactcgtaccagtccttcccacaaggtgctctgagagattctagacctgctgccgctcacatcgttttgattacctgagaagatgcctttggaaattcaagatagtgaggttgacattgtgattgcggcactccagcccaacctgaccactttctttgaggcatggcgaccatttttctcccgtttccacatcattgtcgtcaaagatccagacatggcagaggatcttcaaatccctgcaggttttgatctcaaggtttacaccaagtcagatattaatgggttgcttggtgcctcctcatccataaacttatctggtcactcatgccgttactttgggtatcttgtctcacgcaagaagtatgtgatttcaattgatgacaattgcctcccagcgaaggacactgctgggtcgactgttgatgttgttgcacagcacatggccaatctgaaaacacctgctacacctttcttttcacacactctatgatccatacaggaaaggtgctgactttgtccgtggttacccattcagccctgcgcgagggggttgagtgcatgctctcgtgtgtttggtgcttcatatgctgactacgaccgatgact

SEQ ID NO: 1524 - DNA, 1856 bp, Zea mays
  misc_feature (82)..(82): n is a, c, g, or t
cctgtttagattagaatgggctaaaagtagctaaaaaaaactgctaaagtttatctcgcgagattggaacagaccttaaacnttagttcttagaaaccaaacacctccttaatcatgcaaaagtagcatttgtggatgcgacataccatacgtgcctgcttttttttttctcatgacgtgtgggcttgactgactgtcagtgaggtagagaaacatcgaatttgtataaaatattttgttaaaatgtttatggtaaaatcgctttactgtagatcttggtgtacggtgtacctaaaattcataattcatagttacatttttttattagcggaggtctaccaaacactcacagcgtgaggagttcgaaagaaagggagaaaatgttatgcttgcttgccttgagggaagcgtcgccgtctgcccacacccgcaccgcacccaaccgcagcggagccgggagccgaaggccgagggtattcttccttcgccgctaagcacgcctcctctccacaggcagccgacccaggggaagcgtcgccgtctgcccccaccccgaatctgatgcttcatcgattggttctaatcctcactacctccatattcatgcacgagattgcgggtgattaggagcagggaccaatcatattgaactcagatttggagcggagcaggaggggagccattgcccgtgttctgattgctgctagaggtcgagggatggtaggggtgctgtcgaatcgcgtggatcgggacgacctcaaggccggggatcacatctacacttggcgggccgcctacatctacgcccaccacggaatatatgctggagatggcatggttatccattttacaagggcagctggacatgagattggaacaggaacattcttggactggttcctttatagctcctctccggcagcaactgagggtcctccctgccagaaatgtgggcacctagtcaagtccgatggggtcatcacctcttgcctcgattgcttcttagatgggggcagcctgtacctctttgactacgctgtgtcgcctgctttcttcctcgccaaagcacggggaggaacgtgcaccctggctgcctctgaccccagtgacgttgtgatccaccgtgcacggtacctcctggacaatgggtttggcatgtactccctgttcaagaacaactgcgaggacttcgccatatactgcaagactgggctgcttgtggagaccgctttcagtgttggccgtagcgggcaacttgcgtctctgactgctgccttcagcgccgtggcctcgtcccccttgcgtttcctgacaaccagtgctggtggcctggcaattgtgaccagcggcatgtactgtgtcgggcggtatgtgtcggatattggtgtccggcgtgatgttgtcaaggtccctgtcgaaaggcttgtggagcagaatgttacttggattcctcagtgtgtggctacagagacagatatcgcggcaggagcaccgcagcagcagttggaggttccttgtgcggttgccgaggaagcatccgttatacagcccgcggcaccgtgatccattgctgaaatgtcatcatgtaccaggtgttggcatgagacaggacaactggaactacgtacttgtgtggaagtacatgtaatgatgtatctggtggtgttatgcaatccattgctgctgctgctgctaatggtgcaagcaatgatgatgatgatggatgtggttccatgaccactattaattattacagaattgagaagacctgtatttgcccttgatgattaatgatttctgttataccgttgcttatggatgcatctgatgtgaaaaaaaaaaaaaaaaaagcggcc

SEQ ID NO: 1525 - DNA, 1451 bp, Zea mays
cattgggtacctcgaggccggcgagaaaatgttatgcttgcgtgcggtgagtccttttcgtttgccgatcccccgcacccgcacccaaccgcagcggagccgggggtattcttccttcgccgctaagcacgcctcctccacaggcagccgacccagggaagcgtcgccgtctgcccccaccccgaatctgatgcttcatcgattggttctaatcctcactacctccatattcatgcacgagattgcgcgtgattaggagcagggaccaatcatattgaactcagatctggagcggagcaggaggggagccattgccggtgttctgattgctgttggaggtcgagggatggtaggggtgctgtcgaatcgcgtggatcgggacgacctcaaggccggggatcacatctacacttggcgggccgcctacatctacgcccaccacggaatatatgctggagatggcatggttatccattttacaagggcagctggacatgagattggaacaggaacattcttggactggttcctttatagctcctctccggcagcaactgagggtcctccctgccagaaatgtgggcacctagtcaagtccgatggggtcatcacctcttgcctcgattgcttcttagatgggggcagcctgtacctctttgactatgctgtgtcgcctgctttcttcctcgccaaagcacggggaggaacgtgcaccctggctgcctctgaccccagtgacgttgtgatccaccgtgcacggtacctcctggacaatgggtttggcatgtactccctgttcaagaacaactgcgaggacttcgccatatactgcaagactgggctgcttgtggagaccgctttcagtgttggccgtagcgggcaacttgcgtctctgactgctgccttcagcgccgtggcctcgtcccccttgcgtttcctgacaaccagtgctagtggcctggcaattgtgaccagcggcatgtactgtgtcgggcggtatgtgtcggatattggtgtccggcgtgatgttgtcaaggtccctgtcgaaaggcttgtggagcagaatgttacttggattcctcagtgtgtggctacagagacagatatcgcggcaggagcaccgcagcagcagttggaggttccttgtgcggttgccgaggaagcatccgttatacagcccgcggcaccgtgatccattgctgaaatgtcatcatgtaccaggtgttggcatgagacaggacaactggaactacgtacttgtgtggaagtacatgtaacgatgtatctggtggtgttatgcaatccattgctgctgctgctgctaatggtgcaagcaatgatgatgatgatggatgtggttccatgaccactattaattattacagaattgagaagacctgtatttgcccttgatgattaatgatttctgttataccgttgcttatggatgc

SEQ ID NO: 1526 - DNA, 1308 bp, Zea mays
  misc_feature (16)..(16): n is a, c, g, or t
gttatgcttgcttgcnttgagggaagcgtcgccgtctgcccacacccgcaccgcacccaaccgcagcggagccgggagccgaaggccgagggtattcttccttcgccgctaagcacgcctcctctccacaggcagccgacccaggggaagcgtcgccgtctgcccccaccccgaatctgatgcttcatcgattgatttggagcggacaggagggggagccattgccggtgttctgattgctgctggaggtcgagggatggtaggggtgctgtcgaatcgcgtggatcgggacgacctcaaggccggggatcacatctacacttggcgggccgcctacatctacgcccaccacggaatatatgctggagatggcatggttatccattttacaagggcagctggacatgagattggaacaggaacattcttggactggttcctttatagctcctctccggcagcaactgagggtcctccctgccagaaatgtgggcacctagtcaagtccgatggggtcatcacctcttgcctcgattgcttcttagatgggggcagcctgtacctctttgactacgctgtgtcgcctgctttcttcctcgccaaagcacggggaggaacgtgcaccctggctgcctctgaccccagtgacgttgtgatccaccgtgcacggtacctcctggacaatgggtttggcatgtactccctgttcaagaacaactgcgaggacttcgccatatactgcaagactgggctgcttgtggagaccgctttcagtgttggccgtagcgggcaacttgcgtctctgactgctgccttcagcgccgtggcctcgtcccccttgcgtttcctgacaaccagtgctggtggcctggcaattgtgaccagcggcatgtactgtttcgggcggtatgtgtcggatattggtgtccggcgtgatgttgtcaaggtccctgtcgaaaggcttgtggagcagaatgttacttggattcctcagtgtgtggctacagagacagatatcgcggcaggagcaccgcagcagcagttggaggttccttgtgcggttgccgaggaagcatccgttatacagcccgcggcaccgtgatccattgctgaaatgtcatcatgtaccaggtgttggcatgagacaggacaactggaactacgtacttgtgtggaagtacatgtaatgatgtatctggtggtgttatgcaatccattgctgctgctgctgctaatggtgcaagcaatgatgatgatgatggatgtggttccatgaccactattaattattacagaattgagaagacc

SEQ ID NO: 1527 - DNA, 760 bp, Zea mays
  misc_feature (706)..(706): n is a, c, g, or t
  misc_feature (742)..(742): n is a, c, g, or t
  misc_feature (751)..(752): n is a, c, g, or t
accggccggattccgggcgacacgcgtgcgaacggggagtcttcgaatatatcccgcactggatacacgcggcgcggccaagcaagtaagcaacccaaaccctccctcccctcccattcgattcttgcctcccacgccgccgccggatcccgcgatggccgaccctcggctgtaccccacggagtccgggtccgacgaccggcgcgatgccgcctatcccggctccgagcgccgcctctacaacccgtaccaggacctcaacctcccctatcggcagctctacgaccttcccacctccccggagttcctcttccaggaggaggccgtcgcgcagcgccggtcctggggcgagaacctcacctactacaccggcgtgggatacctcggcggcgccggggccggggccgcgctggggctccgcgacgccgcccgaggcgccgagcctggggagcccgccaagatccgggccaaccgcgtcctcaactcctgcggcagctccggacgccgcgtcggtaacacgctcggggtcatcggcctcatgtacgccgggatcgagagcgccatggtcgccgcccgcgaccgcgacgactggatcaacagcgtcgtggccgggctaggcaccggcgcgctcttccgcgccgctaacgggccgcgctcgggcggtcgtcgccggggccgttggtgagggtcttgctggcgccgccgncgctgccaagcagggtgggaagagatacctccccgncctctaaanntgattgcg

SEQ ID NO: 1528 - DNA, 3480 bp, Zea mays
cctctcccttcctccgccccatctccaaatgaaccgagcaagagagctatctattaacaggtccgttcctaaattttcagggcccacggcgagattacaaatagaggcccaaatcaattaattcatgtaacataattatttggtagatcaattaaaaaattgcacgtggtgcggccggctagctatcaaagctgccgatcgagtagatcggcacacggcgaacttaccctgtgcacgaacgtacgtgtcgctgactcgctgctgctcaacctgccacgcaccaagacgtacgtcgccgtcgtagctcgtcctcgtgtagtcgtgtgtgcggtcggggactctttcgtttcggtacgcgccgctgctctccatctccagttcccccatgccactggccgctgcgctgcgctgcctctccttccggaagaaaaaagcgacgaaacccaccggctggctccacgctacaagagccggattccaggatccactcgaggtcgagcgcgaaggcgattggcgggcgacggcatccgtccggccacactgacgattctgttgtctcgtatcctgagccgccaatgcgtgcgggtgcggcagatcagatgcgccccgttggcagcacagaggttctcgcatcccggtagccggtagggaaaggcgacgagacgacgacgatggaggcgcgcccgggcccggccgtggaccgtggacggtagggtaggattgattttcgtctagtgcgcggcgtcacgtaacgtacgtcctctcagcgcgccaccgccacccatcgccatgccaatcatctgtcagcctccctccgctttgcccaaagtgctcgctcgccggggccgcctttccttttgggccgcccgcacttgccatttcggagagagctagcggctagcgcagcgcattatttgccttcccgtcctcgcgccgattccatcccgcgaggctagctgctccgtcgacccgtctgtcgtttactcacgccgccggctcttgactctgccgccttgcctcggccagcatcgccggcagcgccgtctcgccgccggagtacatggcgtcggcgtcgccggcgcagttcgcggcggcgcccctcaggatggggtacgggaggccggcgccggcgccgcccccgcccgtgatgggcatgtggagcagcgagccgttcagggtcgacagcggcagcgcccacgccaccagcgcgtccaccgtcaacaccaagctggaggagacaagggttagtgctcgtcgttcctcctcctccttcttcttttctttcttgcatatatatatatgttgtcctctgatctacgtcatcaccgcgcccgcccatgatgtcgcctgcagttagaagacgacgcacaggtagcacttgagccggcaagaagtacggagcaggaaaccagtaggccgccagagagggtgcggagttttaagcatctcgcacttgtttttttccttcgcttttgtcctctcgactgtcacaacatgttttcagaacgtataaatctaaaatgatttgcctcattaggcccagagaaggctcgcgcagaacagagaggctgctcggaagagtcgcctgcggaagaaggtggacacaagatcttcaccattcttgtggtgttagtgttacaaattacaatcatgtttgtggtgttacaattctgttaccttgttcaacaggcctacatccagcagctagagacaagccgcatgaagctgtcgcagctagagctagagcttcaacgggcgcggcagcaggtaggtgtacatggacgagtgagtctgttctattggttaaattaaatcccgtttcaacggtcagcgtcggtgctgcacgggttgatgactgatacagtgtgtctgtagggtgcatatgcgaatagtgggagcatgggagactcggctctcggctacagatgcccgatagatccaggtcaggctcttccttctgcgcgctggtcgttcgtccaatggcatggcaagttcagccgttcaggcagcctctctaacggcgcgctggcccgtgtgcgtggtttcaggtgtttctgtgttcgagatcgactacagccactgggtggacgagcagaagagacacacggcggagctgacgtcggcgctccaggggcagcagacatcggagctggagctccgcctgctggtggagacgggactcagcaactacgagcacctgttcaagatcaaggcggcggcggccaacgcggacgtgttctacgtcatgtcgggcttgtggaagacccccgccgagaggttctttctctggatcggcgggttccggccgtcggaagtcctcaaggtacgtgcgtgcgtgaccggctagatgttcccctctccccgcgaacctacacacagcagtgatgattcatcttgttgttgctggtggcatgcagatcctgagcccgcagctggagccgctggcggaggcgcagcgcatgctggtgggcggcctgcagcacacgtcggcgcaggcggaggacgcgctgtcgcagggcatggagaagctgcagcagaacctcgcggagaccctgacggccgaggccgacccgttcgggccccccgacccctacatgctgcagatggccaccgcggtgggcatactgaaagagctcgtcaacttcgtgacccaggtaaaccggaccggtcgccaaagagccatccatcattccatctccatgcggatgcaatgcaaggcctggcctggcctggccagctcgaacgcgcgcggcgtgtgtgtgtgtgtccctgttgcgctcacccgtacgtgcccgcgcctctgctcggcgcgctggctgtgcctgtgcaggcggaccatctccggctgacgacgctgcagcagatgcacaagatcctgacgccgcggcaggcggccaggggcctcctggcgctcggcgactacttccagcgcctccgcacgctcagctcgatgtgggcggcgcgcccgcgggaggcggcgatcagctagatgcctgcggcgtggcaggccaaaagctcgctcactggtgaggcgaccgtaccaaagaacacgacgccgacgacgacgaagactaaagagtggtagcagttcgctgtatacttgcccccccaatgcaaggtgtaaagcccagtggaggacgaagagatcgacctcgctgtacgagtacgacgaacggaagggatgcttctcggtcggcggcggcggcgatctcgctgtacaaggcgattagtagacgtacaaaatgtaaacggaaatcgattgatgggcggaagacatgtacgtatcttgttttgatacccgcggccggggccctcctagaggcgtactgtatgatggttatgcgggccgtctacaactactactggtgttgggctatatgtatatttatataaaatgtaatcacctgtaaaaaaaaaaaaaaaaaatataaagagcacgcggcatgcaggtgtggaacagttcaggtcaaaaaaagaaaa

SEQ ID NO: 1529 - DNA, 1874 bp, Zea mays
atataactctccaccgcgtcctccagccggcgggcggggcagtgtcgtcgtcctttggagctgcacacacatctgtgaggagaaaccttgtgcttggcgatttggcaccctccagttaattatccttggtttgaggaagaacaacacttcagccagacatgctttaagcagggagaccattttttatttcgagcgcgctacgatggagctctactccggataccttgacgaccatttcaacccccacaagctaagcatcgccggcagcgccgtctcgccgccggagtacatggcgtcggcgtcgccggcgcagttcgcggcggcgcccctcaggatggggtacgggaggccggcgccggcgccgcccccgcccgtgatgggcatgtggagcagcgagccgttcagggtcgacagcggcagcgcccacgccaccagcgcgtccaccgtcaacaccaagctggaggagacaaggttagaagacgacgcacaggtagcacttgagccggcaagaagtacggagcaggaaaccagtaggccgccagagagggcccagagaaggctcgcgcagaacagagaggctgcccggaagagtcgcctgcggaagaaggcctacatccagcagctagagacaagccgcatgaagctgtcgcagctagagctggagcttcaacgggcgcggcagcagcagggtgcatatgcgaatagtggaagcatgggagactcggctctcggctacagatgcccgatagatccaggcgttgctgggttcgagatcgactacagccactgggtggacgagcagaagaggcacacggcggagctgacgtcggcgctccaggggcagcagacgtcggagctggagctccgcctgctggtggagacggggctcagcaactacgagcgcctgttcaggatcaaggcggcggcggccaacgcggacgtgttctacgtcatgtcgggcttgtggaagacccccgccgagaggttcttcctctggatcggcgggttccggccgtcggaagtcctcaagatcctgagcccgcagctggagccgctggcggaggcgcagcgcatgctggtgggcggcctgcagcacacgtcggcgcaggcggaggacgcgctgtcgcagggcatggagaagctgcagcagaacctcgcggagaccctgacggccgaggccgacccgttcgggccccccgacccctacatgctgcagatggccaccgcggtgggcatactgaaagagctcgtcaacttcgtgacccaggcggaccatctccggctgacgacgctgcagcagatgcacaagatcctgacgccgcggcaggcggccaggggcctcctggcgctcggcgactacttccagcgcctccgcacgctcagctcgatgtgggcggcgcgcccgcgggaggcggcggtcagctagatgcgcctgcggcgtggcaggccaaaagctcgctcactggtgaggcgaccgtaccaaagaacacgacgccgacgacgacgaagactaaagatgagtggtagcagttcgctgtatacttgccccccaatgcaaggtgtaaagcccagtggaggacgaagagatcgacctcgctgtacgagtacgacgaacggaagggacgcttctcggtcagcggcggcggcgacctcgctgtacaaggcgattagtagacatacaaaatgtaaatggaaatcgatcgatgggcggaggatatgtacgtatcttgttttgatacccgcggccggggccctcctagaggcgtactgtatgattgattatgcgggccttctacaactactactggtgttgggctatatgtatatctctacaactattaagcctcccctatagactgtccccgctccttccc

SEQ ID NO: 1530 - DNA, 819 bp, Zea mays
  misc_feature (774)..(814): n is a, c, g, or t
acgcaggcggaggacgcgctgtcgcagggcatggagaagctacagcagaacctcgccgagatcctgaccgccgaggctgaccccttcggggcccccgacgcctacatgctgcagatggccactgcggtggagaagctgaaagagctcgtcaacttcgtcacccaggcggaccatctccggctgatgacgctgcaacagatgcacaagatcctgacgacgcggcaggcggccaggggcctgctggcgctcggcgactacttccagcgcctccgcacgctgagctcgctgtgggcggtgcgcccgcgggaggcggcgattagctagatgcccgcggtgtgggtgtggccagccaaaggcccaccaaagaacacgacgacgacgaatagtagcagttcgctgtatactttcccaagctgtaaagtccagtggaggacgaaaaaagcgacctcacagtcactggggttcggttccgacgaaaggatgcaaggcttttaagtcaatggcggtgtctccgcagcagcagcagcagcagcaagcggtgtgcgtttgtcaagcgaagcgactagagaataaaacggaaatggattgaggccttctctatttgacgggcggaagacgtgtacatatattgttttgccacccggccgtggccttctagagaggcgtatgattcatgatgcaggccatactaggatcatatttgtacgtggtggaaccgagagcaaaacaatattacaatagtttaaattagggaaaaaaaaaaaaaaaaaaaannnnnnnnnnnnnnnnnnnnnnnnnnnnnnnnnnnnnnnnnaaaaa

SEQ ID NO: 1531 - DNA, 592 bp, Zea mays
aactggtagtgagtgtcctttgaagctgggctatagacgctagagcacatcctgtgctgtgagaaacctaataaaccttgtgttcagcgatttgacggcctccgttatccgaagaaacaacttcaaccagacatgtggcgagcgaggtgattagctactgacaagtgttgatccaagggagatcgttttgagcatgctatgatggagctctactccggatatcttgaagatcatttcaacctccacaagctaagctccgcctcgccgccgcagtacatgacgccggcggcgtcgcccgcgcagttcgcgccggcgcccctcaggatggggtacgggcggccggcgcccgtgacgggcatgtggagcagcgagccgttcaaggtcgacagcggcgggcacgccacctgcagcgcgtccaccgtcatggaggcggacaccaagctcgagacaagcaggctacaagatgttccacaggtagcactcgagccagagaggagtacggatcaggaaacgagcaggccgccagagagggtacgtacggtcatgagaaggctcgcgcagaacagggaggctgctcggaagagtcgcctgc

SEQ ID NO: 1532 - DNA, 5403 bp, Zea mays
tgcagcggagcctcacagttcgtgtgctgtgtatttgtcactggtgctgtgcagaccaagctactgcgggagggagaagggtgtgtgccggcccgccgccaagcactgctacccggccggcggccatggaggtgagctccgtggagttcggtcacgcggcggccgcctcaaagtgctttgacgacgacggtcgcctcaagcgcacaggtataaggagaccttatctcgctgatggagaaatcggtatcgcggttgtcaatcggctacacagacgttatatatatcatcactaaacgtcaaacttaagaaccggccggtactaattaaaagggatactcagcaagaatcgatactaaagtaaaattttggattttctaaattgagattgatggatataattatgtgcacatacaaatgtgcaagcaagttttttttaaagagacatatttacgagtagtaacagtagttatttagaagagacatatttacgagaagcaagttttttttattttttttaaaaagagacatacaaatgtgcacatacagaattaaagctgatggtgtgtgctcctttcatgaagggacgatgtggacggcgagcgcgcacattatcacggccgtgatagggtccggggtgctgtcgctcgcgtgggccatcgcgcagctcggctgggtggcaggccccaccgtcatgctgctcttctccttcgtcacctactacacgtcggccctactcgccgactgctaccgctccggcgacgcctgcaccggcaagcgcaactacacgtacatggacgcggttaacgccaatctcagtacgtgcggaagcttgacgaatcccctcccccccctttggccgcccggccgttgcagagcaaagagctgactctctcgtttcgatctccttccctggtgtgggtcgtttcgccgagcaggtggcgtcaaggtctggttctgcgggttcctgcagtacgccaacatcgtcggagtcgccataggctacaccattgccgcctctattagcatgctgtgagtatatattatatagaaaaagaccacgagagaacttcgtccgaggctgagctcagcatatataatttggtaattaacgcgacgtacgtgtgctgcatgcagggcgatccagagggcgaactgcttccacgtggaggggcacggggacccctgcaacatctccagcacgccctacatgatcatcttcggcgtcgtgcagattttcttctcgcagatcccggacttcgaccagatatcgtggctctccatcctcgccgccgtcatgtccttcacctactccaccatcggcctgggcctgggcatcgcgcaggtggtgtccaacaagggcgtgcagggcagcctgacggggatcagcgtcggcgcggtcaccccggtcgacaagatgtggcgcagcctgcaggcgttcggcgacatcgccttcgcctactcctactccctcatcctcatcgagatccaggacaccatccgcgcgccgccgccgtccgagtccaaggtcatgcggcgcgccaccgtcgtcagcgtggccgtcaccacgttcttctacatgctgtgcgggtgcatggggtacgccgcgttcggggacaacgcccccgggaacctcctcacgggcttcggcttctacgagcccttctggctcctcgacgtcgccaacgccgccatcgccgtgcacctcgtcggcgcctaccaggtctactgccagcccctgttcgccttcgtcgagaagtgggcgcgccagaggtggcccaagtcccgctacatcacgggcgaggtcgacgtcccgctcccgctcgggaccgccggcggccggtgctacaagctcagcctgttccggctgacgtggcggacggcgttcgtggtggccacgacggtggtgtccatgctgctgcccttcttcaacgacgtggtcgggctcctgggcgcgctggggttctggccgctcaccgtctacttccccgtggagatgtacatcgtgcagaagaaggtgcccaggtggagcacgcggtgggtgtgcctgcagctgctcagcgtcgcctgcctcgtcatcaccgtcgcctccgccgcaggctccgttgccgggatcgtctctgacctcaaagtgtacaaaccgttcgtcaccacctcctgatcgaccgtacgtcctagcttccgtgcagttcaaaacacatacgcacgaacagatcattaattggcgcctagtatatatgtgcagtctttaattaaattaactaggcattaatcgatcgatctaccactacgtcgttctagtgatgcgcgtagcttgcatcatcgctcgctgatttaatttccattgtttttctttgatgatctggttagccgaaatggctagtgaattaagagaaaacaaatagtagcagtactgtgtgagtaatcccaagtcaaatacgttattgaagttgtcggcggtacaaaacgcttgtaaaatgtttgtgtttcaattaatcaagaagaattgtacgtgtttcatatatgaggaaaagaaaaaaggacatatgtttgtttctacaacttctaaataaacaacttgatcgagatgttttcttcatggtacgtctttaatggcaaaaattcagcgtcagcgattcatgatgctacagagccacatttttaatacatagattgttgaatggtttccgttttgatacgaagtgtagaaaacgtacgcgtatggtactggtacacataaacatatctgccatgtttaatcgatatatcatgctccctccgttcattgaaataatagtgaattaatatagatatacatgcaaactacattcatatatatgttacttaatgagtgtgtaactactagctagcgtaaaacaaattatattttaaaacggagggaagtataagtaaaaagaatcgtggcggcgcggtgcgtggaaggatgacgtgtagatgtagtagaagtagtgggacgtccgtgtgtgtcagcagcagcagccaatatgtatacacacgttagtactcaaaatcgttgctaatgaatttttgttataaaagtcttgctagtggacttgtattgttgtaagggtctactaaaattcttatacgtgtcgtgattgcttcttacgcatatgcctcctccatacaacaagcacagcacacagacacaaaacacgccggacgcgcatcgtcgctctcccgagtcgtcgcaactagctagctagctagcaaaacaggagcatctatcgtctgcagagtgcggtgggtgaagaagggacaaggctgggcaggcgcaggcgcaggcgcaggcgcagcgcaatggtgcgacggcgacgcgacggaggcgccgttccgcggcgttatttgcagccacacgccggccgggcccgcgcaaagcggcagaggacacccaaccaaaaggcatagcgacgctttctcttcttctttggtcgcgcactcgcgtgggtcaggtcaggaaaggccgccgagcgagctcacctccgcacggaagcaggcaggcatccatatgcacgttccgcgcgagctgcgaagacgaaagaggagaccccaaggccagcaggcagcaggcatggccccagcctccaggagcacaggagatctcccccgcgccgccgtgtcagcaccggaggatcccctcgacggggacacagggacgacgcgacgggggctgagcaaccctggccaccacgatcgatcgacatgactggtcggatctccggcctccgggaaggatctccggggattcctaaccctccctctcgtctcggctcggctccactacagatacaataattgattcttctctttggcgcgtgcctctcacgtactctcagactcagagcgactgatccagcgcggtggctcattattgcttgccgggcccaggccgctgtgcttgccgtcgccgtcgccgcccggtcattgacggcagcagaaacatcctgtccgtccgccagtcggagaacgttcgttcgtacgtacgcgcgcgcggctgcgctagctggcatgttccttgcacgtgcacctccaacatgtgccgctgccgttctctggatggccctctggatctcgccttgacgaccagcagcgagcgacatatacttggacgccacatggtgggtacaattggccgttgcaaggaaccgcagcgacgcgcatgacttgggcatcgccgccgccacccaccggtcgaccactgagtgggtcaggcgaccagctgatctagtacggaaaaaggcatcaacatgttgccactctgaacaagacatgtgaccatatccaagcgcgtgtccccgctgcccggtgccctttcttacaccgtagaccgtactacccctagctgggcagccggttgatgtggaaccttaaaccagggccagagaatgtgcgctcacgtttcgaacaaaagcgccaagataggacgccactcgatcatttactagcaaaagcactacgacgaccgccggcgagatataataaaggtcaaaagctagcggtgccatggagtggattggcctgcattatttcggccggggaaagcgagctactagaccaggtggggagtggggcagcatcggatacatgcatttatttatatatgcttgtgtgttagggatgagaaccaaccgtgtgtcgttttattggcatcgtttgttggctctatatttccatagaactacacattaattagtatacacggtcgagttttgctaatggttgtaatttttcgttggcggttcataatttatatataggcaccaatagaaataaaaatgcatgcccatatatctagtggtaaatttgtttgtaatgatcgtttccttatgtataccgccgatagaaattatgtattatttttctagcgacgaactttagaaaatagtcagtaaaaacatatttgtattggcggttttcataatatagcaccattatcaataatttagaatcaattttgtcaaaagactgaaggaagacatatatctctgaatgctcgcaaaacaacatcccaaactccgggctacctcctcccccgagggaccacgcctcatgtcgaccagacctctcagggccctatgagccctatacctctctctaagacatcttggggcacaatggccctggtgacatggccttggcaccatgtacgtgcgcccatgaccaaaccggtcgtgcggtgccatgtggttgagatgagactcttgtacttcatatttattggtaagggcaacattacattcaaaagtgttgttgtagccacacctgaggctacggatatacccacgagcacaatacaatgtgcgcgactataatgactaccaactacactaaactcgatagcaatggatgatactatagcccacgcccgagggcacaggcatacct

SEQ ID NO: 1533 - DNA, 1386 bp, Zea mays
atcacgctctagcctgccagctctccttcgtccttccatataaataaagtactcaagcaatcctcgagcctcaggcccaagcaaagcatccagcggagcacaccacaccacccttggtccggcactagcactagctatccagtggagacgaagatggcgacggcgcggtggctgcaggttgccgccatggcggtggcgctgctggcggagtgggcgacggcggcggcgcctcggaagcccgtggacgtgccgttccagaagaactacgtgccgacgtgggcgcaggaccacatccactacatcgacggcgggcgggaggtgcagctgtacctggacaagtccaccggcacgggcttccagacgcggggctcctacctcttcggccacttcagcatgcacatgaagctcgtcggcggcgactccgcgggcaccgtcacggccttctacctgtcgtcgcagaactcggagcacgacgagatcgacttcgagttcctgggcaaccggacggggcagccctacatcctgcagaccaacgtgttcaccggcggcaagggcgaccgcgagcagcggatctacctctggttcgaccccaccaaggagtaccactcctactccgtcctctggaacctctacatgatcgcgttcttcgtggacgacgtgccgatccgggtgttcaagaacacgagcgccgacctgggcgtgcggtacccgttcagccagccgatgaagctctactccagcctgtggaacgccgacgactgggcgacccgcggcgggcgcgagaagacggactggtccaacgcgcccttcgtcgcctcctaccgcggcttccacgtcgacggctgcgaggcctccgcggaggcgcgcttctgcgccacccagggcgcgcgctggtgggaccagccggagttcagggacctcgacgccgcgcagtaccgccgcctggccgaggtcaggcgccgctacaccatctacaactactgcaccgatcgcgaccgctacggcgccgccgtgccgcccgagtgcgcccgcgaccgcgacgtctgatgatgatgcgttgggccggcaagctgcttgatcgagagcagcctgtaatgtatgtatggtatggtattgttgtgtgtcaggttcgtcgtcgtgggtctgcagagacagagagagtccgatccggcgcgtacgtgtgcccgcgtgggcacatgcatacgtacatgcttgtgttgtactgtacgctcgtatctcctcacaccgaaatgaattgcgattaagtatcgaaatttcggcagcttatccatcatgtaatgagttcctctgcagtacttaaaactctcatcgtctcttgtctgtgaaaaaaaaaaaaaaaaaaaaaaaaaaaaaaaaaaactcgag

SEQ ID NO: 1534 - DNA, 2583 bp, Zea mays
  misc_feature (2009)..(2009): n is a, c, g, or t
ctcgacggccgccttggggccccccggggccggccgggaggcccaagcaaagcatccagcggagccacaccacaccacccttggtccggcactagcactagctatccagtggagacgaagatggcgacggcgcggtggctgcaggttgccgccatggcggtggcgctgctggcggagtgggcgacggcggcggcgcctcggaagcccgtggacgtgccgttccagaagaactacgtgccgacgtgggcgcaggaccacatccactacatcgacggcgggcgggaggtgcagctgtacctggacaagtccaccggcacgggcttccagacgcggggctcctacctcttcggccacttcagcatgcacatgaagctcgtcggcggcgactccgcgggcaccgtcacggccttctacctgtcgtcgcagaactcggagcacgacgagatcgacttcgagttcctgggcaaccggacggggcagccctacatcctgcagaccaacgtgttcaccggcggcaagggcgaccgcgagcagcggatctacctctggttcgaccccaccaaggagtaccactcctactccgtcctctggaacctctacatgatcgcgttcttcgtggacgacgtgccgatccgggtgttcaagaacacgagcgccgacctgggcgtgcggtacccgttcagccagccgatgaagctctactccagcctgtggaacgccgacgactgggcgacccgcggcgggcgcgagaagacggactggtccaacgcgcccttcgtcgcctcctaccgcggctttccacgtcgacggctgcgaggcctccgcggaggcgcgcttctgcgccacccagggcgcgcgctggtgggaccagccggagttcagggacctcgacgcgcgcagtgcctccatgtccatgtgcagcagagccagcctatgccctgccgcctgcccctgcacagtacactacgtacacgcttgtctgaaccctgcacaccaccaccatggccggccacgggagggcccgcccaataatctcttcctcctcgtacaccgtgcagcaccatcgcgcgcgtatcctacactacactttaattccggcctccactccagcccacggcaacggcactaactaatctgagggatctatctcccgccgctccgccaggttcttcgtggacgacgtgccgatccgggtgttcaagaacacgagcgccgacctgggcgtgcggtacccgttcagccagccgatgaagctctactccagcctgtggaacgccgacgactgggcgacccgcggcgggcgcgagaagacggactggtccaacgcgcccttcgtcgcctcctaccgcggcttccacgtcgacggctgcgaggcctccgcggaggcgcgcttctgcgccacccagggcgcgcgctggtgggaccagccggagttcagggacctcgacgccgcgcagtaccgccgcctggccgaggtcaggcgccgctacaccatctacaactactgcaccgatcgcgaccgctacggcgccgccgtgccgcccgagtgcgcccgcgaccgcgacgtctgatgatgatgcgttgggccggcaagctgcttgatcgagagcagcctgtaatgtatgtatggtatggtattgttgtgtgtcaggttcgtcgtcgtgggtctgcagagacacagagagagtccgatccggcgcgtacgtgtgcccgcgtgggcacatgcatacgtacatgcttgtgttgtactgtacgctcgtatctcctcacaccgaaatgaattgcgattaagtatcgaaatttcggcagcttatccatcatgtaatgagttcctctgcagtacttaaaactctcatcgtctcttgtctgtatatctatacaacttcttgctcgaagtagtccaaaaaaaaactcgacagtagattagcatctagtggtatgagagttttacgttcatagaaggttactgcagacgcgaactgcttgtctacttccacccatcctatctntcgtgtcatctcttttactttttaaacagtgtactccacaatcttattatgctatataaatattaaaaaaagaaatctaggtacaatttgatgcacatataaaactaatcaaaactgaaccgatagtgatgtttcatagaaaattaccaccaacggcagcgcttgcctactctatagtaggggtcataactgtaggagatagatagatatcccatgggtaatcgtcacatggacatgttccataggccgcttaattaaacataccctcgataagttgttcaccaagttgtgttattgggccgaagttcaggagaagcaggtactatcgggaggatgacacgctccgccagaagtaacacgccccgcatgcaaccggatagcggatcattcaacgtcaaactcgaagggaagcaaccatgcaccggaaaagagtcggcacgcaagaatagcgaaagtagataggcccagataaattttcacgatatgtaaatagatatctcccctgccggctataaaaggccgcggaggtaccctacaaaaatatccccctctctctcaccatcgcgcccaaagg

SEQ ID NO: 1535 - DNA, 1128 bp, Zea mays
cgggcgttcaggccgccgtcaacgtgcagggcgaggaccagaagaagctcgatgtcgtctccaacgaggtgttctccaactgcctcaagtcgagcgggcgcaccggcgtgatcgcctcggaggaggaggacgtgcccgtagcggtggagcagagctactccggcaactacatcgtcgtgttcgaccctctcgacggctcctccaacatcgacgccgccgtctccactggctccatcttcggcatctacaaccccaacgacgagtgcctcgccgacgtcgacgacaatgacacccttgattcggtggagcagaggtgcatcgtgaacgtgtgccagccggggagcaacctgctggccgccggctactgcatgtactcgagctcggtgatcttcgtgctcaccgtcggcaccggggtgtacgtgttcacgctggaccccatgtacggcgagttcgtgctgacgcaggagaaggtgcagatccccaaggcgggcaagatctacgccttcaacgagggcaactacgcgctctgggacgacaagctgaagctgtacatggacagcctcaaggagcccggcgactcggggaagccctactccgcgcggtacatcggcagcctcgtcggcgacttccaccgcactcttctctacggagggatctacgggtaccccagggacaagaagagcaagaacggcaagctgcggcttctctacgagtgcgcccccatgagcttcatcgtcgagcaggccggtggcaagggctctgacggccaccagagaattcttgacatcacacctacagagatccaccaaagagtgcctctgtacattgggagcgtggaggaagtggacaaggtggagaaattcctggcttgaatgtccctgcttcatgccagagctctctcatcagatggactccccaagacatcaagtttagggagggaatatgtactctctctttcccaccccaaataagtcttcttcgtctcatatttcgataaatcaaacaatctcaattttgatctaatatatacacacaacattaatatttatagtattagataaaaatattactagattgatcatatcatatctttttatagtaaaatagatacagatataaatataaaaa

SEQ ID NO: 1536 - DNA, 621 bp, Zea mays
  misc_feature (41)..(41): n is a, c, g, or t
cacgctggaccccatgtacggcgagttcgtgctgacgcagnagaaggtgcagatccccaaggcgggcaagatctacgccttcaacgagggcaactacgcgctctgggacgacaagctgaagctgtacatggacagcctcaaggagcccggcgactcggggaagccctactccgcgcggtacatcggcagcctcgtcggcgacttccaccgcactctgctctacggagggatctacgggtaccccagggacaagaagagcaagaacggcaagctgcggcttctctacgagtgcgcccccatgagcttcatcgtcgagcaggccggtggcaagggctctgacggccaccagagaattcttgacatcacacctacagagatccaccaaagagtgcctctgtacattgggagcgtggaggaagtggacaaggtggagaaattcctggcttgaatgccagagcctctctcatcagatggactcccgaagacatcaagtttagggagggaatatgcatgtactctctctttcccaccccaaataagtcttcttcatctcatatttcgataaatcaaacaatctcaattttgatctaatatatatacacacacaacattagtatttat

SEQ ID NO: 1537 - DNA, 1657 bp, Zea mays
actttacatttttccacagactagattattggacagagacgcgccttgcaactttgagctctctggcctgcccccgttccagcaagatctgtactccgtatccatcgtctccttgcttagtgggcactcaaagtgttgcgcatactgctcaaacaaatgatgatccatcgatagtggctgaggtgacagctctccaagtttcgtctgttcgctcgtggtggaaattccgctgagcgagcgagcgagcgatcctcctcttcccagccccggcgtgaggagcgccggcgatgtcgaccggcggcaggaagatgaggacggcgtgcgtgaccggaggaaacgggtatatcgcctcggcgctcatcaaggtgctgctggagaagggctacgccgtcaagacgacggtcaggaaccctgatgacatggagaagaactcccacctcaaggacctgcaggcgctcgggtccttggaggtcttccgcgccgacctggacgaagacggcagcttcgatgacgccgtcgccggctgcgactacgccttcctggtcgccgctccggtgaacctccacacgaagaaccccgaggaagaaatgatcgagccggccgtcaggggaactctgaacgtgatgcggtcgtgcgtgaaggcgcgcacggtgaggcgcgtggtcctgacctcgtcggcggccgcggtcaccaccaggccgcagctgcaaggcgatgggcacgtgctggacgaggagtcctggtccgacgtcgagtacctcagagcccacaagcctgcaggcccctgggggtacccggtgtccaaggtgctcctggagaaggaggcgagcaggttcgcggaggagcacggcatcggcctcgtcaccgtctgccccggcctcaccgtgggcgccgcgccggccccgaccgcccgcaccagcgtccccaactgcctctcccttctatccggcgacgaagccgcgttcgccgtgctggacgccatcgagagcgccaccgggtgcctgccgctggtccacgtcgacgacgtctgccgcgccgagctgttcgccgccgaggagggcgcggccgcgaggaggtacgtctgctgcggcctcaacacgaccgtcgccgagctcgcgcgtttcctggcggacaagtacccgcagtacggcgtcaaaacgaacctgctctccggcgagcggcttgagaagccgagagtgtgtctgtcgtccgcgaagctggtgaaggaaggtttcgagttcaggtacaggacgttggatgacatatacgacgacatggtcgagtacggcaaggccctgggaatcctgcccgacttgtgatgctgcttcctctgctctcggccggcgatcaggagttcaggactggactttaaaccgtccgacaaaataagtctatttatgctgctactgtgcccaaccgtaattggaccttaaaaaatgtcattacaaacaatcaactgtgtcaagaaaaattgtctatgttttgctttttttttttggtctactcagaaccgtttgtctgactagtaatttctacctcaatcttccatcggaaacccaaaaaaaaaaaaaaaagctcaattttgggctagtttggaaactcaagcttccatcggaaattttgttggggggtttttagaagaaataaactaatttgt

SEQ ID NO: 1538 - DNA, 9300 bp, Zea mays
  misc_feature (378)..(378): n is a, c, g, or t
tcgatcttagataaaattttctttttatatgtctcagcataggataatttagaggttaaaatttgatatattaataaagtaaataatcaattacttctgcagttttttaaaaaatttataactagtctgattgtgcggtgattgaatgattttttttgccatacctaaactacatcacggtaatagattttcgtagacaggtacgctcagtgttgactggtttgtagatgtcaggagcctaaccatcagcgctcagctttagtaccacctcgctagccggagggggccgtggtgagcttataagcgagatttcccctcctcttacagcccgggttttgagagcgagtgaaggggctcgcttgtgttagcccacgagcntcgggaaacgcccaaaggtgtagcgttgagtgggctaggccgggaaggtcgctgacagtaggttatagatctactacctgtataagtacacttaattgtagcattattggcatccagtcgcgggacctattattcttcctttgaatagttatattaaaagatactggggaaggtcttggggatacatatcttgaaaaaatccagcattttgaaataagtattatacagtgctatggaccaaccacttggatgtacgcgtacaaagagacctctggaagatcgaaccatgactctctctgtttttcgtcgtatttcgttcatatatatgcgaactagatcatttcccacgaacgcacgtaatctcctttcgatttaaaaataaaaaaggacagagaaacctaataaagtgtcatcgtctaggctgtacaattcaatggcaagaagcaacagtgatgttcctatgcaggaagcctccattgttttggactattctcctaggttgatcatgtctccacgcatctgtcacgtgtacatgctagatagttaccggtgcatgttgctttctagtttctacttccatgccattaccatcaaataattttcctgttgacgctattcatgtaccccttcctggcctcctgtctctctatcctctacaggcttctagggagaggtctctttaccaatccatgacggaaccaacaagaacgataataatatcatactacaagttatcagcatcgcacacgagacacgacgacccatctgaaacacacaaacccttggacgtctaaaaaaatgcctcatcttggagcgcaaagggccaacggccaaagatagaaagggatcaaaaggtgacgtggcaagccagcacctgtgggctgcctgccagccttgctcgcatcatcaccggcaacaagaacaagaaaaatcttttctttaattatgggccaatatcttaggttgatcgcggtgcatgccccgtgagacattgggagttgactgacccacgccaagtcaccccgtcgccgaaacccacggccacaagagtgaggtgatgacgtttcgtcgtactggcagggtagcaagtagtatagtatagggataggaataggagtgtacgtagggtacatgcatccaatccaacgcagcaacatctccaagcaccggaaaatatcactagaaaacaagcccaaaacacggccgcgaaggcgcaaaccatttgcccacgcagacatggtatagcggtatggctacgggctacggcatggcagtccccagaagaaaagaactacgccgcgctctcttcactctcctccagtgagtctccacccacccaccgagcctatatatccctctgcatcctcccttccctcccagcctatcctacaacacttcccgcaacagaagcatacgccgtgcccatctatctatagctagcactagcagtggtgcacactgaaatggacagcgccagcagcctcgtggacgacaccagcagcggtggcggcggcggcggcggcgcgtccacggacaagctaagggctttggccgtcttcgccgccgcctcggggacgccgctggagcgcatgggcagcggcgccagcgcggtcgtggacgcggccgagccgggcgccgaggcggactccggctccggtgccgccgcggtgagcgttggcgggaagctgccgtcgtccaggtacaagggcgtggtgccgcagcccaacgggcggtggggcgcgcagatctacgagcgccaccagcgcgtgtggctcggcaccttcgcgggcgaggccgacgcggcgcgcgcctacgacgtcgcggcgcagcggttccgcggccgcgacgcggtcaccaacttccgcccgctcgcggacgccgacccggacgcggccgccgagctccggttcctggcgtcccgctccaaggccgaggtcgtcgacatgctccgcaagcacacatacttcgacgagctcgcgcagaacaagcgcgccttcgccgccgcgtccgcggccaccgcctcgtcgctggccaacaacccttcttcctacgcgtcgctctcccccgcgaccgcgacggccgccgccgccgccgcgcgggagcacctcttcgacaagacggtcacccccagcgacgtgggcaagctgaaccggctggtgatcccgaagcagcacgccgagaagcacttcccgctgcagctcccgtccgccggcggcgagagcaagggcgtgctcctcaacctggaggacgccgcgggcaaggtgtggcggttccgctactcgtactggaacagcagccagagctacgtgctcaccaagggctggagccgcttcgtcaaggagaagggcctccaagccggcgacgtcgtcggcttctaccgctccgctgcaggcgccgacaccaagctcttcatcgactgcaagctgcggcccaacagcgtcgtcgccgcctcgacggcaggcccgtcgcctcgggcgccggtggcgaaggccgtgcgtctcttcggcgtcgacctgctgacggcaccggccaccgccgccgcggcgccggcggaggccgtggctgtggccgggtgcaagagagccagggacttgggttcgcccccgcaggcggcgttcaagaagcagctcgtggagctggcactagtgtagattaatgctacggagcgatcgatctttccctagctagctagtcttttttattttttttgctcgatcgctcaactcagatggtagcatcaccgagctgaatttagttccctctcggcatctcacttagttggttcgtttgttaatttccagtttcaccaaaaaaaaaaaaaaaacttgagacaaatcttctcatcaactgtatactgctaatgaaaaaaaaacagtccaagaaggctagatgatggtcaactggcacagaaggaacagaaacattctaaattaacatcatggttaataactgtcaattgctcgtgcatcagatcgaaagatattacgacatttcgaatttccagattccagatgctccctgccatccatgatccatctacatctacaggtggcaggggagctgtatgtaggagtcttcagattttgtagctactagtactacatgagatcaggtggtactccagtactggtatgagtatgtatatgacgtgatgtgttgtgctgcagggtgcaggctgcagattcaccccacacccacagtccacagaacacagatggcagctggatgcatgtatcgaggttgcaaaaggctcttgggagtagctggcagtggcctagcaagctacctatctgatggcagagcccgctgacactatcttctgctgatagatactactactactctttctctctcgcatttgacttttagatattgggtttaatcatttatcttatttaatcttttataaataatagaattggtagctcattaagagtatctccacttcttcagtgacggacccagcgttcgatcgtagcaagcatgaacaaatcttatagagctaattaaatcgtgtagtttagatcatgttctgcaatacaaatctatagacacagcgacaacagcaaagcccggccctggggccgccgctgagtatctctggtaataaaataagtaatatttatataaaaaaatgttaaataagagctagaaactgcgtctaaaataataataaaaaaacgttctatttcagaggagcacagcgcctgccttcgcatggaaggagacggagagatatggtcgtcattgtgaccagacaaaaagagataggacagatcgagtatgcactgttgtttctctttcttcccctccctacgatagagtatatgtataagtataataatttcttataaaacgtaggtgtatgtgtatgtatttacgtattgtattcggcacgctttctctagcttgttgtaaattccgtcgccacatgcaggccagcgacaaggacgcacacgcgcaagtgggtggtggttgctagtaggcatagtaagtacacgctgagtcgctgacattgatatatacatgttgtatcatgggtaggcatacgtacgcgcgcagatatggaagtaccacccccaccttgtcctgttgtgttttgtttatgtgtgtatttattttaatcaccgtctgctggtcgcggttttgcagcacgcacaagggcgcgtcaagatgttcgggcatgtgcaacacattggcttcgaaaccaaacaaaatcacattgcttggcgagccgacgatgcgagtcccatgctgctcagcgagcgagggagggtgggcatcatcggaatctatctggtcggcgcccgcctcgatccgaaacatacagcagtacaaccttgcgttggaggctcaagctcgccggttcgaccatcagcaggagagattgtcggcaactgatagagatcgatcaatggtgtagatagtgcagtcctgtcgtcctaggctagccaacggatttgtggaacaattaaagccgccacgtacgccacgaggcggtttgccactcttttagaagtatatcccatcattgcatgctggttagctatgatgccagctgccagctagtacttatactacgtccaaaattgatgagcacaggcaggacaggttcgtactacaactacactcatacatccagtatatatgcgctgcgcccatatccgacgagcgattattgggcacgcgcatgagaacaagcagagatcacacgcacaccgtctcccgggtctgtccgcgcctcgtcaccaacagatggggtagagacgcggcggggcacggctcttgagagagaccagggggggcctcgctctcggcgatcggagtactatagtacagcaataatctgcacgcagcaaccgtggggacaagttgcacaggtgaagcgggtgccgtacccctatctcctgcgtggcctcgcctaatcgccttggcttggcttggcttgccatgccggcctaaaatattgttgctgcagactgtatgtaggctgtagagcacacaacacaaacagagccaccggtggaccgccggctgcatgcacagcagggcgagagcgaggaagcttgctaccgacgcccacttcccacttgcattgcaagttttggctggagcgtgtgacccagaggggtccaaggactaggactagcattagctaatgtagctgctactagccagcctgcgaccacgacgacggcgtggagagttacccttgggtgaaagcttaacgagacggaagagtaggtccagaatgtgtgtgtggtgcagtgcagtgcagtgcagtgcactgtatgcagtcgacgtgattggctggctgctgcgtggtttcttccgctcgtcgtcctccctctgctcctcgcaacaagcaaccacgtggcacagcgcacaggacacgtcctgcgcatgcgctgcagtttttccgatggggggaaacgaccagcgtgtctgcactgcgcatgcgcccgccatgtggtttttcacattcccttaacagcaatgcagcaatgcaagtacggcagctgcacagcaccagtatcgtcacgctcttgctcatctacaggtacagcactggtcatcagccgtcagcacccacagtggttgtttggaagcaaggatacggggagagattagaagggctaaaatcgattttgctatttaaatttgaatagaataagtccagtattcttacttctaaacaagaccaccgtactaagtactattgtaaaagtccgtaaatctgtaatgatgttggttctacatacgaacgatctttttaggatggagtgagtgtataacagcctaacaggcaagtacgtaccagtagtctagtagtatgtgtgcgtgagtgagagagtcagccagtcaggatgggtggcggagggcccaagaacgacaatgacgcaagtctagcctagccaaaacttgggcagcttttgttgcatgccacgccatggaaaacctgaattgatgctgcctttcgacaagaagctagctttaccgcctgccgtcgaaacagcccaggcccaggaccaggaccccacgctttaattcgtgtctctctcgtcacaaagtcaagcaccccaggcagcgccgctcagttcccggaagtttctcaccgcgtcgaagcatgcacgcatgcatcgggccggactgaaaccctcgtgtcgtcgtgatgattcctgaagtcgtcgcgaggtccggcggtccgttgccgtggcccgtggcagtgctgccgctactgttacagactttttacggtgtgtgggtgtgtggcggtggcgcgcgcacacagctgcactgcacagcgaaaggatcggaggcagcaccgcaggccagcagccgcccggccggtctactgcatggctggggccaggttggttaaggatagagatagacaccaccacgccaggaacaggacgcgacacccgggcagtacaaaacagccagccaagggccaggggggcagcgcgactttggagacccatcggttcctcggccgcagagccagccagagccgccgacgtggacgcagacggagcgtgtggaccgcttctggcaagtggcgactggcgacggtaggctgcgcagagtgcagcagccgtgttttttctttgctccggcagcggtgtggctgccgggtggccacatgcagcggagcgtgtcgcccgctgcgtgccaccctcctctgtgtctgtgttagggcatgtggaggaggaggaccaaatcggtgtgtggagtaggcggtcttgtatggcagtgcttctatagcgagtcaacgctgcgctttgttatgcatatatatatgaggaggagcagtaggtcgttttctcccggcaggttgcatgcgatcgagaggtccgtctagctgcacgttacgccttttctccctcccgcactcgtcgcattcttctattctatctgtacctctgtgcgtggcgtggcgtaatatggccagctggtgtataagacagaaacaaggactctggaatatactgtacgtttcgtaacagctagctagctggtcttccttcctcgattagctgtgtatctgcaagtgggtgtgtatactcgcactctcgcggtattcgtagtcagcagactggattcatcgttaaggaaggtacagctcatgcatacatatagatccaattttcgcgcccttgacggagtcgacggcgagccacagctggacgagcgaggcagtgaagatgaacgagtctgggaccaggcatcgaggtcacgcttttctacggactgcggaaatctaacgtactaattagtactgcagatttgtcatctcgtttgcctggtctggtcgttctcttcttccctgggcaggctaggctggccacagatggccaaatttcaaacgattgacaaaacgcgaaacgagggggggatgaagcaccggcaccgctactgttgtgaatccgacaacgcaagttgggcggacctgttgttatttactagtcctactagtctgttacggagtacagctttccggatcaagaagcaaccgaacccaacgcggagaagatattcattcattcgcctgcccaaatggatcgatccatccgcgcgcgcgcgcctgcttgtgtggcctgtgggctgtggctctcctcggggagcacacccgcgacgccattggcgggctggacaccggtcaaaccacccacatgtgccccgcgtagctagctagcgtgcctaatcgcggattaagtaatcggctaataatagccggcaagttgtgctcaggagggtcgcgctcgcgcgagcgcatcggaagcaagctgctaagctttgccttgctggtcaagtccatcacgcgcgaatgtacttgcttgcacacatatataattataaaagggttagtatatggattcgagtggtagtgatgctagtttatttagtgtacgtggatggatggcttgcactcccacttgtgacaagcaccgtttcaaaagatacggctctgccgctgcccatctctctccactcaactcaactcaacaccggtctgtctgtccgcgagcgagccgttttccttgaccagctctagctcctgtaggtaactcaacccaaaagcaccgagcccatgcaaatttaatcacgtcgccgcgatcgagtcgtgctcgtacgtacgtaacccactactctctcttctctccgcccgtcgtcgccgagacgcgacgatctgccatatatgcgcacgttgccgatcggattattatatacgtaattcgggggctccccgcgcgcttctgcagacacgcatctcgacacaggcccgggccctagcactcctgattaattagccacataatacattatgaccaactcgtactagtgttagctgtaggagtaggacggtaggagtaggagattccttccctcctgcatctttctttcgttgaacttggctcatcgatcgtctccgattcatctgcccattgatcctgctgccgcctgccgcctgccgccggtcctcgtgttccttgcaagttgcgagcgctagcactctgtacagacattgtgcacaattaagcccaggaatccaatgcgaccgacgcatatgaatcttgctgccccaaaagattaagcacatgttcatacacctgtcctctagaaaagaggtgcgggggaaggacagacgtgtgtgtccttgtgaggtgaaggtctggcccggtaagactgacaccacaagaagccgataaggtcctgtcctcctgctagtaatctgaaaaaactggaatggaggaggacagatatgtttgtggttagctggtgcaggtgcaggtacaccacaccactacaacttctgctgccgtttgtgccagcagctaataagattcatgttttgaggcagccgcccgtgggcccgggacgtgtccacatactactactatcgttatcgtcaataag

SEQ ID NO: 1539 - DNA, 1808 bp, Zea mays
  misc_feature (931)..(931): n is a, c, g, or t
cctcgaggccggccggggaagcccttccactttgattcctcctgtctctctagccttctccatgctaatagccagatcaaacgcatcaagacctcatgttgtgtagtaccagcagggggggaaatattaatactacgtcgcgtagacgctagctagctccgtcgtcgtcccaaaagtcctcctgctcttgggctataaatgcctgcccccgcgacccgcccggcccgctacgcgacacacacacaccatcactgcgctgcgctactctactccccaccaccgccgccacccaagagctttcctcgctgcacaagaaatggccacgaaccatctctcccaagggcagcacccgcaggcctggccctggggcgtggccatgtacaccaacctacactaccaccaccagcagcaccaccactacgagaaggagcacctgttcgagaagccgctgacgccgagcgacgtgggcaagctcaacaggctggtgatccccaagcagcacgccgagaggtacttccctctcagcagcagcggcgccggcgacaaaggcctcatcctgtgcttcgaggacgacgacgacgaggaggctgctgccgccaacaagccgtggcggttccgctactcgtactggaccagcagccagagctacgtgctcaccaagggctggagccgctacgtcaaggagaagcagcttgacgccggcgacgtcgtgcgcttccagaggatgcgtggtttcggcatgcccgaccgcctgttcatcagccacagccgccgcggcgagactactgctactgctgcaacaacagtgccaccgccacctgctgctgctgccgtgcgcgtagtagtggcacctgcacagagcgctggcgcagaccaccagcagcagcagcagccgtcgccttgggagcccaatgtgctacagcacatcggngctcgtactcgtacccccccaccagcagcccagccaattcccagcatgcctaccaccgccactcagctgaccatgaccacagcaacaacatgcaacatgcaggagaatctcagtccgacagagacaacaggagctgcagtgcagcttcggcaccgccgccgccgccgtcgcggcggctccggctgttcggcgtcaacctcgactgcgggccggggccggggccggagccggagacaccaacggcgatgtacggctacatgcaccaaagcccctacgcttacaacaactggggcagtccagcataccagcatgacgaggagatttaagattatgcctgcagaatccaaacagccaaagtagtagcagtagtagtcgctagcagcagcagcagccgcctagtactacttgcacacgaagtgacaggattgaattgacctgtacacggggagaaaaaaaaaggaaggaaggaagtggagagagatcccttgtttcccgggcaatcttccttccaagttccatccccgcccccagaagaatgctgctgcctttttgctgttccgttttttttttttaatttttattttcttctccatggcttccagaaaaccctacttactgtaggggatctggtagcagggggccgggcatgcgtgggaggtttgcaggaagcatcaagctgcgaaggagctggaacgagagacaacagacagagagaaagatgtgtgtgtgtatgtatgtgtgtgtcatctgtacctatatgtcttaatttgtgggtccgatagagaacaaactgtgaagttgatgtgtgtgcctgcctgcctcctgaagaaacaatgcaatatccccatggggattttgttcaaaaaaaaaaaaaaaa

SEQ ID NO: 1540 - DNA, 829 bp, Zea mays
gccaggtccccgggactctcactctactccctcgtccctccgtgccaaaacgaaaggggaccgctgctctgctctgcctgcctccccttcatcctccacttcttcctcttggtctggttcgggcagagcatccgcacctgctcggccgattaccccggcgttttctgctccctttcaccccgcgtgcgggcgctatccttcccgtggcgacgtctgggtgaccgctgccgcagccctacactaggttcctaggtattcgccgggcccttccccggcgacgagcacccaccatcttaggctacctctgtggggatcttctgtgaagcaagagaagttacctagcacacaactcaaagttcagtagattattgaggatcaacatttcagccatctgtatgttagttaatatgatggccgatggtaacatctggttagaaagatagaaactcattgcgctacatatggtagtgcccattcgacataagaactaagctggaccttggtagatccaagttattaatggcgcacacttcctgtgatggtgtacatcatgttataagtgtagcacatggggaaactgcatcaacatcaaccagtcatcaagatatgtgcagtgactcggatgaaccacatcaggaagataggctatcaacaagcacacaaaccctgtcatcagagtcttcgccatcaatatcaccaactgcttatagcaccagaaatttatcttttcctagaagagatagtatatatggtcatggaagaagtccatggaattctggtttatggatctcggttgaattggcatgtacattgctcaggttgtagctgc

SEQ ID NO: 1541 - DNA, 1624 bp, Zea mays
ccgggctcgagttttttttttttttttttttttaataaaagatttggggtttcattaccaaagaaagtacaaacattgcaggacagacatgtcaggccaagaacggaagaaagagccttgtctctacaccgcgaaacctctcctccgttccaaatacaacaaggtcacaactcacatagccgtctagctccaacctctacatgacctattaaagcattctagcactgaaaaaatctcgggggtaaggggatgcgaggtatcccctgagatgaagacgtgcaccttgtcctgcagatcaatccagctgtagcctggatgcttgtgaatgcctagccgttccatgtcttctctaaccagagatgcacttccccacctcccctcatgggcatgtaagttatgcatcaaaacatatggagcagaactgtcaggatcaatcttggataatgcattggcggccatctcagcgagtggttcgttctttttaacagtgcaggctcccaggaatgccccccacacagctcggtctggagcaattggcatgctcttgatcagctccaatgcgtcctctagctggccatatcgccctatgagattgacaagcgcagcatagtgctcgacactagcagcaaggccgtagtcatgaaccatggtatggaaaaccatccgtccttcggagacaaggccagcatttccacatgcactcagcagagaaataaaagttatgtgggttggcatgaccttggcactcctcatctcctcaaacagacgcaacgcttctgtagcattaccttgctgctcataacctcctatcagtgcattccaagaaactatatctctttgtgtatgcatatggctgaagatggcctttgcactgtttagttcaccacatctggagtacattgtcataagtgcattgttggtcgcggtgtctggcagaaatgatttttcaataagttggtggagctgagccccaaggcgcaacatgcctcgtgccgcacctgctgccagaactgaagagagagtgtgatgatcaggcctctcgccaacttctagcatcctttgaaatagcttgattgtactgtcataatcctcattttgctcataacctgatatcattgtattccatgtgatggtgctccgctctggcatcctatcaaagaatccccgagcatgttccacatcccctttttgtgtaaaccctcgtatcatcagattccaggtcactgcatcagggtctggcacttcccaaaacagcttctctgcctcctccatctctgaggcttgagtgtaccctgctatcatagtgttccatgacaccaagtccttatgtggcatctcatcaaacaatgccctagctgagcaaacatccccagttctgatatagcacatcatcatcgagttccatgacacaacattcctctcaaacaccatcctcttatgccccttgtgctggttttgtgtttttgggatcatagaaaataacctccttgcatcagttaccctaccggtttgtccatatgcagcaataagggtgttgaaagcaccaacagccttgtccatgtccatcaccgtcaagcgctttgtaagcagatcatcagcctcatgcacctgccattcctgataa

SEQ ID NO: 1542 - DNA, 2627 bp, Zea mays
gcggcgctcgagccggccggatcaaaacgcgcggatcccctcccacattttccctctctcccactgcacgtgcacgtgcacgtgaaacccagacgccaccgatggcaaggctcgctatatgcgccctgctggccgccgccgtcgttgtctccgcggcggtggcgaccatggagtccgaagcggaggagcctgtgtccacgtacattgtgcatgtcgcgccggcgcacgcgccgcgggcgacccgcccccgcgcgctctccggtgcgtaccgctccttcctgcgcgagcacctccccgcgcgcgtggcgcgcccggcgccgaggctgctctactcgtacgcgcacgccgcgttcggggtcccgggggcggctgacgggggcccaggccgcgcacctcgcctcgcggcgctccgccgtgctcgcggtcgtgcccgacgcgacgcagcagctgcacaccacgctgacgccgtcgttcctgcgcctctcggactcgtcggggctgctccaggcgtccggcggcgccacggacgtcgtggtcggcgtcatcgacaccggcgtgtaccccaaggaccgcgcgtccttcgccgcggacccgtcgctgccgccgccgcccagcacattccgcggccgctgcgtctcgacgccggcgttcaacgcctccgcgtactgcaacaacaagctcgtcggcgccaagttctttggcctggggtacgaggccgcgcacggcgggggcgcggtggacgagacggactccaggtccccgctcgataccaacggccacggcacgcacacctcgtccacggcagcgggctccgccgtgccgaacgccgccttcttcgactacgccaaaggcacagccatcggcatggctccgcgcgcccgcatcgctgcctacaaggcgtgctgggcgagggggtgcacgtcctcggacatcctcatggcgttcgacgaggccatcaaggacggggtcaacgtcctctccgtctcgctcggcgccgtcggccaggcgcccccgttctacagcgacagcacggccgtggggagcgttcagcgccgtccgcaggggcatcgtcgtctctgcctccgcgggcaactccggccccggcgagttcaccgccgtcaacgtcgcgccatggatcctgacggtgggcgcgtcaaccgtcaaccgccggttctcagcgaacgtcgttctcggcaggggcgacaccttcgccggcacttccctctatgccggcacgccgctcggtccaagcaagatcccgctagtctacggaggtgacgtgggctcaagcgtctgtgaagctggcaaactgatcgccagcaaggtcgccggcaagatcgtggtgtgcgaccctggcgttaacggtcgagctgctaaaggtgaagccgtaaagcttgccggaggagctggagcgatcctcgtcagcgcaaaggcgttcggcgagcagcccatcaccaccccacacatccacccagcgacggccgtgacgtcccccgcggccgcccacgcctacaggtacatcagaaccagcgcgtcccccgttgcgaccatcgtgtttctcggcaccgtcgtcggcgggacgccgtcttccccgagaatggcatccttttccagccgcggcccaaacctcctcgcaccggagatcctgaagccggacgtgaccgcccccggggtggacatcctggccgcgtggaccggcgagaactcgccctcggagctcgacagcgacacgaggcgagtgaagttcaacatcatatccggcacgtccatgtcgtgccctcacgtgagcggcatcgccgcgatgctccggcaggcgcgcccgggctggagccccgccgcgatcaagtccgcgctgatgaccaccgcgttcaacgtcgacagcgccggggacgtcatcagggacatgtccaccggcggggcgtccacgccgttcgtgcgcggggccggccacgtggaccccaaccgcgccctcaacccaggcctggtgtacgacgccggcactgacgactacgtctccttcctctgcgcgctcggctacacggccaggcagatcgccgtcctgacgcgtgacggctcggtgaccgactgttcgacgcgcccgggctctgtgggcgacctcaactacccggccttctcggtggtgttcggctccggcgacgacgaggtcacgcagcgccgcgtcgtacgaaacgtcgggagcaacgccagggccacgtacacggccagcgtcgccagcccggccggcgtgcgcgtcacggtggagcctccgacgctggagttcagcgcggcgcagcagacgcaggagtacgcggtcaccttcgcgccggagcagggaagcgtggccgagaagtacacgttcgggtccatcgtgtggagcgacggtgagcacaaggtcacgagccccattgccatcgcctggtcggcgagccaagcagcggcgatgtgatccgatccggtccacgtcgagctaccatgtgtgcgctctgtgtgcttcctgttgcagaataagttgcgttatttcgacaccgatccatcctaccaacaagttgtagcataatttactgtaaacaaaaactgtaccgtattttattacgtggactttcgtttctcaacggctttcgatcctc

SEQ ID NO: 1543 - DNA, 1848 bp, Zea mays
ctcttagagcaatatcgatcccatcgctggtcgtacatcatgcaagcggaggggggcagcaaattttcgggctgatgtcgtagcaattgttttttttgccggtgtgtgtcccaaggaagcaaggaatcaatcaacccattggtaataatcttcttcttttttccctgccggaccaaggtcgtacactaattagaatttttatttggttccattagtctctagaccacaaaacaagcgttgcacccatgacacagggtatcgttcttttctctgccttgcaactacaagattggcatcatttgcagctagcagtggcaaatcccttcagcataaagcaacgccagaggaaccgctttattcttctgattcatggaccaagcaaaggtaacctcttgtcagttgtctcccactgcagtaccctctccaatctataaatttcttcacaatatcttctgcacctctcacacaagacatccttacattttcttgctgatcacagctagtagggagcgagagttaccttgaaatcaaggcagtacgtacgagtacgatcgacaatgtcgacggtcacttcttgcacctttctgagcctcgggtccccagtgcggccggcagtctcctccgcgagaccggcggcggcggcggtggcttcccgacggaggccccggtccctttctgtgtgctgcgaggccggccggaaaggggatcacaacccaaagacggatctgcatccatttaacatccctgccttcgttctggtgcacccggtggcaccacgtgaggcaaatatatatcttaattgcattgattatattagttagtactattgtatttcattgaacgctgcatgcatgcatgcttggcatataataattaatcaagcaccggtgcggtaaaataacagttctggtgcacccggtggcaccacgtgaggaacggtggcagctggaggaggacgccgacaaggtgaacctgtggttcgaggtgcctgggcagtccaaggatgacctcaccgtggagatcgacgaagacgtgctcgtcatcaagaagaggaaggagctggtgggccagcggagccctgctggcggtggcgtcgcagagtacggctcgcagtcccagcagcagagcaggaggggcaccgcagatggcaaggagctgccggcggcacagcagggccaggccggcgaggtggtctatgcccggatgctcctcccggcggggtacagcagggatggcgtgcaggccgagctcaagtccggcgtgctcagggtcactgtcgtcaaggtcacggagcgagcgcgcaggaagatcgacgtccccattcaagtcaagtagatatgcgtgtatgtgtatgcacattcgtcctgcgcacgtgtcagcaggggtgctttatttacatctgtctcatgtccaacatgcagactacagcggtcgatctcaccacgtactcgatcgcgtcgactacacatgttcatgggctttgtgttcccatgtactcatcaatcaataaaatgagcatatgtgttctccgccatgcaacataatcttcgaaacaacgaacgcaggcaggctacggaagttgggaaggactcaagcaacgtctgtgtcgctctcacggcccaactccgcgtacggaagcggtccagcctgcatacccaagtataaatggccacggccagcccgacacagccctggcacggctcgtttagcccgtttattagccgtaccgtgccgacacggtactagtgcctaaaactaggcccaagcacggcactaaggcttcttagccgtattgtgccgccggcacggtcggcccgagcagcctgtaggtcagggccagtccgagca

SEQ ID NO: 1544 - DNA, 969 bp, Zea mays
ctgtgcggcgcgcccggcggcccctcacacaagacatccttacattttcttgctgatcacagctagtagggagcgagagttaccttgaaatcaaggcagtacgtacgagtacgatcgacaatgtcgacggtcacttcttgcacctttctgagcctcgggtccccagtgcggccggcagtctcctccgcgagaccggcggcggcggcggtggcttcccgacggaggccccggtccctttctgtgtgctgcgaggccggccggaaaggggatcacaacccaaagacggatctgcatccatttaacatccctgccttcgttctggtgcacccggtggcaccacgtgaggaacgatggcagctggaggaggacgccgacaaggtgaacctgtggttcgaggtgcctgggcagtccaaggatgacctcaccgtggagatcgacgaagacgtgctcgtcatcaagaagaggaaggagctggtgggccagcggagccctgctggcggtggcgtcgcagagtacggctcgcagtcccagcagcagagcaggaggggcaccgcagatggcaaggagctgccggcggcacagcagggccaggccggcgaggtggtctatgcccggatgctcctcccggcggggtacagcagggatggcgtgcaggccgagctcaagtccggcgtgctcagggtcactgtcgtcaaggtcacggagcgagcgcgcaggaagatcgacgtccccattcaagtcaagtagatatgcgtgtatgtgtatgcacattcgtcctgcgcacgtgtcagcaggggtgctttatttacatctgtctcatgtccaacatgcagactacagcggtcgatctcaccacgtactcgatcgcgtcgactacacatgttcatgggctttgtgttcccatgtactcatcaatcaataaaatgagcatatgtgttctccgccaaaaaaaaaaaaaaaaaagcggcc

SEQ ID NO: 1545 - DNA, 1266 bp, Zea mays
accccgctcgggctctccagtccacctccaccgctttcacacgctccgctccgctccgtttccgtcgctcccgtcccaaggagccgcgccacgcgagaggggggcacggtcgcacggacggtagcagttttctgtttcggtgggcggggacgtcgtcgacgaccgaccggagcggaaggacggagatgatggaggagggggcgcccgatctgcgagagctcgtgcgcctgccggatgttctcgtggtatgctcatctactggatggacagatgaaaagcacatgcattatcttcaattattggaagaaacatttgtgcaccaattacatggaagtggttgcatttttaagggactgtttaattgctctccaagatattgtaggcaaatgaaatcatctaagcaaattgttaagtacaatacgcctggtcagcagggatgtgccatagttgagggtggcaaagtcaagtcctgcataaaggccgagcatgttgagtcaccttcctgttgtggaaatcagcaagatgaaaaagttcgttccctggaagataatgcatcaaccactaagcccatggaaaaagccacttcccatgcaagggcagcaagcccaggacaagcttccacgtgctatgttggcaaacacagacattctccttccagaagcgcagaggggtcggatcagaattttgatgaggaaacccaagggactggagaatcaagacatgaatacaacccgaagcgactgaaatctgctgatggcacaagggatcatcaggttgtgaacgcagaagctcatcaggtgggctgccttgatgcgagtgacaaaaatagcgataacttgagtgcatcgtcaaaagtgcgtgctgtattacttgatgttgaagctgggcctccctccggcgactgcgaggatcattgaccaaaaggataatgcaatgtccaccgagtgttttctggagttgactaacacacccactgtttgatgtggcgcgcggtaactgaatcagagattggaagtcaagcagtgcaagttcgtaagataagcttgcttgcccgttattctggtttggaagtcaaaatagttcgttcaacttagcctaggcagttgacggttttgttgtatttctgagggactctgatacgaaaatcaaattccctttcttctgtgtttggcgctgcaacctgtaaacggagtgctttcataattttttgcgtaccgtgaggaatactataatatcagaatttggagcggaaaaaaaaaaaaaaaa

SEQ ID NO: 1546 - DNA, 1284 bp, Zea mays
ctacagcttcacacttccccagcagagcaggcaaaccgctcccagtcccagtctctcacctgaggtgactggcgtctcttgtcgcaagccgccagaagcttcggcccctgacgcgtgggggccccgtccgcccccgcccccgtccccacgttgccggccatggcggggcagccaccgccgtccggggcctccgaggacgacttcctcgagcacttcttcgccttcccctccgcggcctccgccggcgctgccgggggccacgcgggcgccggtgttggcggggaccaccccttccccctcgccctcagcctcgacgccgccgccgaggccaagccggaccgtgatcccgtgcagctcgccggcctcttcccgccggtgttcgctggcgccggcggcgtgcaccagccgcacctccgcggcccaccgcctccgcagatgttccaggcgcagccgaagccgggcgagggaggcatggcgccgcagccgccagccccgcggcccaaggtgcgcgcgcggcgggggcaggccaccgatccccacagtattgcggagaggctaaggagagagagaattgcagaaaggatgagggcattgcaggaattagtccccaacacaaacaagacagatagggcagccatgctagatgagatccttgattatgtgaagtttcttaggcttcaagtaaaggttctgagtatgagcagactgggcggtgctggcgcggttgcgcagctggttgctgatattccactctcagttaagggcgaggcaggcgacggcgggggggcgccgcagcagcagcagcagcagcacgtgtgggagaagtggtcgacggacggcacggagaagcaggtggcgaagctgatggaggaggacatcggggcggcgatgcagttcctccagtccaaggcgctgtgcatgatgccggtctcgctcgcgatggcgatctacgacacccagcaccccctggacggccacggccactcgctgaagcccgagcccaacgcgtcatcctagtacagtaacgtcgtccttagcgtgccttccaattccaacacccaccccccttctccctaaaaagtactgttaggcgccgatattatccggaagaaaaaaagaagtgtatgatataccgagcgtgcgtttccagtgtgctgacccgtgggataggaaaggaccgaaaattgttggtatatgatgatgatgatgtagcctcctgtttgcctgttctgtttcaaatcaaaaaaaaaaacatgcatccaggttccaaaaaaaagggcgggc

SEQ ID NO: 1547 - DNA, 1281 bp, Zea mays
  misc_feature (7)..(7): n is a, c, g, or t
gccgggnagcatatcataagttcctttcttccgccgcaagaagcccagccaccgccccaccgccacctgttcggcttccttgatataaccgtccatctcgattcgatccgcctcgtcactcacgaacgcacgaattcaccaaccaaactccactgtctccaactctccatcgcgtctgctacgcctctcctgcaggacgaccaatggcttccaggaagttcttcgtgggtggcaactggaaatgcaacggtactggcgaggacgtgaagaagatcgtcaccgtgctcaaccaagccgaggtgccctctgaagacgtcgtcgaggtggtggtgagtccgcctttcgtttttctgcagcaggtcaaggggctgctgcggctggacttcgccgtcgcagcgcagaactgctgggtgcgcaagggcggcgccttcaccggcgagatcagtgctgagatgctggtaaacctgcaggtgccctgggtcattttgggacattctgagcgcagagctctgttgggtgaatccagtgattttgttgctgataaagttgcatatgcactcactcaaggtctcaaggtaattgcttgcattggtgagacccttgagcagagagaggcaggaacaacaatggatgttgttgctgcacaaacaaaggctattgctgaaaaaatatcagattggacaaatattgtgttggcatatgaaccagtttgggctattggtaccggcaaagttgcaactcctgctcaggctcaggaggttcatgatggtctgagaaagtggctccactccaatgttagccctgcagttgctgaattgacaaggataatttatggagggtctgtaaatggagctaactgcaaagaacttgcagctcaaccagatgttgatggattccttgttggtggagcctcattgaagcctgaattcgtggacatcatcaagtctgccactgtcaagtcttcatctgcctagtgttttgactttcaatgcacctggatgcttgtcgtactgaatgctgttgatcttttaaagctattgccattttaccatctcgttttggtattctagctccagtgcatcgtttgtatatcatcatctcctgcgtatgtgcacagagtagtcatttacctgaatcatccttgtgtaccctttggaactgcataattgaactgcgctattctagatctgtcctctcatggttacttcaatttatgaggtgttgcatcatgagtcaactcttcaaatttgatggaataattccatttatcatactagtatt

SEQ ID NO: 1548 - DNA, 3819 bp, Zea mays
ctccaacccaccttcatcaaaaagagctcagggggaatctgccgccttttggtcttgtcttgggccaccaaaaaaacaaaataataattggaagtaaagttctagcttaagctagattttaacctatgatgctctgttttctcaggcttacatgaaaaaaaaagtactagccggattctcagtaattctgtaacagcttcatgatgttctggaacatcggcacgagggactagccagattccgagtaattctgtaacagcttcatgatgttctggaatatcggcacgagggccacgagtgcgatctcaagatgctccgagctgttgaggcgaatcccgacttggccagtccccttgttgcttagattagcgtggccaaccaagttgctagctcttccagcggggatctgagactggatgttgcagccaattgccagatccccgtgccaatccacaacagataatgcaacagtggaaagcatccgcccaatcgggtaatctttgtctctcatcgttgcttcaaggcggcctccataggccatgtctcccctcccactcatggccccgctgctaaccaggaccctaagctgcttgttcactatcagtttgtcctcaatcttcataccagctgatactgaatccccaagaagcgtagcagatatcccagcagatgtattgttgcgcctgaagttcttaaatctcgattcgccacggattgtgtatgccatatccctgccgacagactgcaaatcaagcccaagtgaagtagtcttaccttcagcatgcttaattgaacttgcaacctccatttgcagggagcaatccttcttgtcttttgtaagctggccagacactgatagaggaactttaccttttacggcaaacaacctttcaacattaagtccctcataaccaacatcatggtcccagccctgggtttccaatacaggtctgacaagccattcacttggtgtatccagaaaacgatagcgatggctagggtagtcagaatcaaaagatgagggcagtaccatgtcaggcataggcactgaaacattagttggagtagtagcatcatcttctaggttgctgttgctgaaatcatttgcacgagcactggcttctgctgccattttcttcatcaatttacgacgttttctttcctctttcagctgtttttgatagaacaacttctctctgtaatctagctcctcaagataggccttcctctgctccctgttcagcttggcaagctgagcttttgtgagacgcttaaatggaggtaaatcatcataatctgaaccatcatctgaatcagaatcatctgccaaatcatcttcaagatcatcatcatcaccaccaaattgctcctctggtaacttcagtggggcacgagactgaagaagggaagagaggaggaaaggcagtggaggaatccttgtacgagaaagtttaccaatgggactatcctgcaacttaaggagcacattggcttctgctaacacctttgaagcaaaacaaagcagcagtaactgtggcttccagacttgtccatttggcaataccctctggccagccctatttgtcctgcatgctgagtggttttccacgagggatactggattcataaggcgtacatcaccagcagcttgccttatagcttggtgcactacatgagatctctgggtgacaaacatctcatagctcagaggaattccattctgcccatctggtggcgcagatgcagcatgagttaacacgacaatggcattaaaccaaaccgatgctccgaacactttcgtgatggtttgcagcagagggacgtcaccgttgtccctgctctgcatatccaacctatcaaaataaagaacaatatccggagggtttctgctaataagtctcttgacagagttgagaaccttctggttgcggtgttgttctaaagatgagcaggaaagtccaggggtaccgatgacttttactttgattccctcaaccgtaccaactacttgaaccttcatagtactagaatcaaaggcatttgtatccaacctgatatcatcaaaaattgaattaatggtagcactcttaccgaccccagttttaccaagaaccaaaatggtgcatgaaaaatcaaggggctcatttccagcagcttcaagacgttctgccatctctctcgcacggtcaatgctaaacgtcccattagcagttcttctaagttgttctgccagcccaagccggtacagaacctgtgaaacgaccatgttatgagatgtttgccccaacctgccagcgaggcgaagaaacttaacccggatcatttgaagtttttcatggatatcatcattctcatctctatcatcctcggcagactcagtagcctcctgggttcccttatccacagcggctggcctgctggcacggacctgttgaacagaacgggcaggaggctgcgatagggaagaggatgatccaaggccagcaggacgagatatcagagagggaccattagtagaacgagcagaagcagcactgctgggttgtgcagatgtagaactcccacttgaggattgtgcagggggagcagaggtcgcagtattctcttcatctgaggagcttgagtcatccaactcctcaattacaacagcaggctcgcctgcagaatttgtgaccaactctggcctgctatgagaggaagcaatctcttctgtgctcttccctggatgatttttgctttgatgcgccaaagtaccaccttttacatcttcatactcgctcccagaatgtgcagcgacctcagccttgtcaccaggatttgaaaaaaaattgtggtcgttgtctaacctctccttttcacgatcagccaaaacagatgtgaccatgtactccctgaaagattgccccatgacattctcattcacatggtcttgattcacatcatcagcaaaactttcctccacatctacgaaactgggagtgtcgtcctcgtcccacttctctgccccacgctgtccggccactctggtgttcggcgtcaccaatggctggtgatcgcccgtcaccaccgcagactccactgcaccttctccggggccccggttttcttccccagcctcatctccgccaccatcctgccccagcggcacgtccccctcatcccagacctccaccgccacaacacaattgccctcacccgccaaagtggctgccttcaagacggattcctcctccgcggcgactccgccgttctcgcccgcccgatgctccgggcgcccttccctgacgccgccgccgttctccatggatcacacccgacggcggaaggagcgaaaccctactccgacatcaagagaaaacggaacggatcaaacgacactacggcagcaacaggaaggtaaaaaaaacgtacatatattgtggtgaagtctggaacatacaaaaagattgtggtggacggatccggagggaggtggcggctaccaaaccaacctggttggaggcgacggcggcgtgggaaaacgggatcgctagcgcagttcggtcgctaccaggaaaaaggagccgtcgctacaaggaaaaaggagggtggtgacgaactgacgatgagagtcaggcagcgagccagcgacgacgccaatgagagagaagtcgcaagccggtttgtatgcctccgccgtttttacttactgggctctgctaaaaccctggagatatgcttttctgcaaccaaacaaaatttggaatcgcaaaaaaaaaaaacattttagcggcaactttaaaataaaacagtacgatgcccgtaattcaataaaatata

SEQ ID NO: 1549 - DNA, 1975 bp, Zea mays
acccctgcccccgagatcccctttcctcgccccccgaccgtgatccccgtcggtgaccgccatcctcccccgcgacagatctctatgtttgagatctccgtgcttgagggaagccccgccattcatgcctccgagcgccaccattctcgccaccgagctcgcgccctgcacgcccgcgccttcccctccccctgagacagccaccccactcgcgggcacacccaccaccgcgacagccaccaccccctgctcgcgttcttctcctccaagttagccgccgcgagttctccgtgtttgttgatcttcgtccccctgctcgcgtgtttgttgatctccgtcccccctgctcgcgtccttcctccctgagaccctgacctgctcaccaccgctgctcacccctctcctagcccccctcctgctagaaagtggatctcgtccttgctcacctgctagaaagctattcgcctagctccaccggtcccagctgctagcaccgccaacctgctaggcactccctcgagccgaaggtgagggccatgccctaccactttttcggttagatctaaatttcggtggaggtgagcgtggatgaggtcaggtatgtcgcctccttctcttcctccaccgtcttctatacgctccaggcttgcgctggtgttgccggccattccttgtgctcgacctcgcgtctgcgttggactccacacctctgccactgtctccagcgccgacgttgaagcccattgtccctgctcaccctggcgacttgtagtgaactctggaaacacggttcaatgagtgcagcagttcatcacatcactaaccaagaacggctcaaaccaggtgagctggtccagaaactcatgccagttacaggtcaaaatcacaggtctcctacaactggcccccccccccccccaaatttagagctctcttttgttcttttccggcccatgcggagtgcctgaaagcaactcaggcaaagccaccactgaaattcttccggcactgctttgttcaaacttagcaattgtattaaaatctagacgcgccctttgttagctgttgctttacatagcattgagcgcagagctgcgacgtgattgtcggctaaaagtaagcatgctatccaggactacaaggggaaaaagatctgctaaattaagtaaagtagcatgttatccagcgcaagaagttagaaattctgcaatggaaattacgctgaatatctacctctcatgaattctgccaactcggtgttgttgggagctcacggtagcattctttctctactagaaatataagcacgtatatgtttatgtcagctgtattatgaaggctagcagcacgtaccttctcattatacaagtcataaaaacggcaaaaaggaagacgcatacgcatcatcttgctcaaagagcactgatatttctgaaactatttcttcgtgtcagcattaagcatatcccctcaactataaaacctgatattataactcttggaacatctaataataacgttcaaatgactctctaagggttagcactcaattcatgtgctcattctagctgctgctttgaattttatttcttcacacagaaatgaaggacttctgaatttctctaattcactgtttactgcctctccttttgttttgcaaaaaaaatatcagattggacaaatattgtgttggcatatgaaccagtttgggctattggtaccggcaaggttgcaactcctgctcaggctcaggaggtatagcttcttatgcacgagcaagaactgcatgattttttttccacacggtagatagttgcttccatttgtgtctcccaatattcttgatttacatatcgatatcaatgttcttaattctgctttgtgtatcatttgagatgtgcatggtattgtaggttcatggtggtctgagaaagtggctccactccaatgttagccctgcagttgctgaattgac

SEQ ID NO: 1550 - DNA, 2667 bp, Zea mays
cctcgaggccggccggggctctgtgctcaccgtgcccctagtcccacaagccaagcaacagttggatcactgacatccgcgacctcgtcgcagggcccacactacatgaccgtcggcccctgggtgccgcccgccagcctaccagaagcgtttccggcagcgaggtttcctcccatcgatctgtacgccctccccaccggtgggtcgcgcacctccaccaacctaccttcccgccccgcccgtcgccgtcgacgactcgccgtccgtttccgccctccaaaaccctactacctcttaccttccagccccgcgtcctccatggccaccaacggcagctctccgagggttcgggacacggagagcagtctggagaaggtgaagcggcagctgtcatcggggtctgggaggtacctgctgcaagggcccctgctcaagcgatctgagacgttacggaaatggaatgagcgttgggtcatattggacccgacatcaggaaagatggaatacaaactccggagaaatgaaactgccattaaggggaccattctgtttgacgcctcgagcaccattactttatctcctgtgaactttcaagggatgccaaaatataatggctgctgcttctacatcggaactcctcaaaagaaggattactttctttgtgctgaaactcctggtgctgcgaaagcttgggtatctacattacatgcaactcagttagtcttacgagctcataaagaggcagtaaattctttggctgggaatggctctccagctacattaggcacagttgctactgcagttgctaatgctaatgcaacagccatggaggctaccaaggagatagaagctgcactaaaggtttcaatgagggcagctcttgggttggatacaaataactccaacgagggccaacttgatgacctaacaatcatgaaggagaccctacgagtgaaagatgaggaattgcaacatttggctaaggatattcgttcccgagatgctacaataaaggaaatagcggacaaactaacagaaactgctgaggctgcagaagctgctgcttctgcagctcatacaatggatgaacagaggcagcttttgtgttcggagattgagcgactaaaacaagccttggaaagacaaatagaacaatcagtggttaagcttagacaatccgaagagaaggttatcagcctgagcaaagagaaggagcagttgatgaaggaaagagatgctgcatttcaggaggctcatatgtggcgcattgaactagtaaaagccagggagcaagcagtgatacaggaagcaactattgcccgagcagaggagaaggctagagtttctgaagcagatgccgcagctcggatcaaggaagctgctgaaaagttgcatactgttgagaaagaaaaggaggagcttctagccctggttggtgttctccaatcacaagtcctgagagagcagagcagcacaaagcaagtatgcgaggagaggtctgaatcatgctcaggcgccgataattcacctctgttgacaaagcatgttgacgcatcagacgatgatgtggacaaagcctgcgtaagtgactctagatcggtcccggtttcgagcgatagcactgaggtccagctggctgtggatggggtggacatccgtcctgttggcgatgcagagtggagtagcttccagcagccagaagcgctgatcgctgatgtccgggaggtctccccagaggcggacggcggcagcttggatattcctgtggtcaatcccccaccagtcagtgatcatatccagggaggcggcggcgcaacccatccctgaaggcctgaggttgctgctaccttccgagattggtgtggttgctgagaacccaatagatagggatgtctaaatctggagagaagtgccgttgagagtgtatgcggattgtatgtccattgtattcggagtataagaccgaataaaaagatcgcagctgtgtttggctgtgggattgtaaaaaacttttagcgctacacctcaacaggactgggccctcttgggctaccggccggcactgccctgctgctcgtactcctgctgacttggaaaaacatcaggcagcaagctaggcgagatgttgcttttatctcttgggacagttcactagtgaaaggtgagccctctctgtcatgatagcctcgaaaccaacttcagaagcatctggatgccgagctgtaatggagagcagcaatatcactgttctccaacccatctgtgactgcatttgctttgacgagccgtgcaacctcctgtgtgatgttctcacagtatgcacctgctacgcgtgcatcgagtttgagaaactaattgcaatgacctgagtaattcatcggcaagattctccttgtacggtagtaaccttctagagcaagaatgtgcatggacgacaaggggcagttgataggaaaagcactcttcgatagaagatttgcaagctcctcaaagacattcctgcagtcaagattggcatacatctccaccataattttttttcctggcgacaaaagtctacaagagcttccattgcaacctcctgctgatgatatgttgctccaaaacgaggttgtgcaagccttataattatacaagaaaaaaggcctcaaactgcagcttcagctc

SEQ ID NO: 1551 - DNA, 1062 bp, Zea mays
acaatggatgaacagaggcgacttttgtgtttggagattgggcgcccccgacgccccccgggaagacaagtagaacaatcaatgctgaagcttagacagtccgaagagaaggtcatcagcctgagcaaagagaaggagcagttgatgaaggaaagagacgctgcgtttcaagaggctcatatgtggcgcgtcgaactaggaaaagccagggagcaagcagtgatacaggaagcaactattgcccggaccgaggagaaggcaagagtctccgaagcagatgctgcagctcggattaaggaagctgctgaaaaactgcgtactgttgagaaagaaaaggaggagcttctagccctggttggtgttctccagtcacaagtccagagagagcagagcagcacaaagcaagtgtgtggggagaggtctgagtcgtgttcaggcgccgacagcccccctcccctgacaaagcatgttgatgcatcggacgatgacgtggacaaagcctgcgtgagtgactctagatcagtgctggtgtcgagcgacagcactgaggtccagctggctgtggacggggtggacatccgtcctgtcggcgacgcagagtggggtggcttccagcagtcagatgcgctgatcgctgatgtccgtgaggtctccccagaggcagatggaggcagcttggacattcctgtggtcaaccctccaccgatcagtgatcatgttcagggaggcgcaactcatccctgaaggcctgaggttgctggcttgctgctgccttccgagattggtgtggttgctgggaaaccgatagggatgtctaaatctggagagtcgccgttgagggtgcatattgcatcgatgcgattgtatgtccattgaggtatacgattgaataaaaaggtagtaactgtgtctggctgtgggattgtaaatattcgcctcattcccttttgctacggctattcacgtgtgatattttagctcaggtggatggattgtgtgatatcctggtcaagatttaataaaattaatagagtatttataccaaaaaaaaaaaaaaaattt

SEQ ID NO: 1552 - DNA, 2592 bp, Zea mays
gcctagagtcaaagcaacctcaagaccctcttaccacatcatatacatgtaatggcagttctagtctgactccaagttcgaaggaggctttgctaaagaacatatcatcaggcaagaagggcggtagtgctggcaaagtaacaaacaaggataacagactacacaaattggtctttaatgttttgcttgatggcacagaagtagcttactatgttgatgggcagagaaaggttgacgggtatattaaggatcaaagaatctactgtaatcactgcaacaaagtggttagcccatcagcatttgaagctcatgcgggtgagggatcaaggcgcaaaccgtatgataacatattcacatcaaacggagtatcattgcatgagctggcaatgaaaatatcaaaggatatggaactgtcagaacgtgagactgatgatctgtgcagagaatgtggtcagggtggagatattttcccatgcaaaatctgtccaaggtcatttcatccagcttgtgttggactctctaaagtcccctcagaatggtactgtgataattgtcgcaatcttgtgcaaaaagaaaaggctttagcagagaacaaaaatgctaaagctgctgggaggcaagctggagttgattccattgaacagataatgaagagagctatacgaattgtccccatctctgatgatcttggaggctgtgctctatgcaaacagaaagatttcaacaatgctgtgtttgatgagcgcactgtgatactctgtgaccaatgtgagaaagagtatcatgtaggatgcttgaagaatcaatggcaagtggaactaaaggaattgccagagggggagtggttctgttgcagtagttgctctgagacacgatcttcattagacaagataatctccgacggagctcaactgttggtggagccagatcttgaaatcataaagaagaaacatgtgacaagaggtttatgtatggacaccagtaaagatctcaaatggcaattactttctggtaaaaggactactgaagacggaagcatattgctctctgctgcagtgccaatttttcatcaatcttttgatccgatccgtgaagctctcactggtagagacctgattccagagatggttaacgggaggggacctaaggagggaatgcctggacaagattacagtggaatgtactgtgcactgttaactgtgggctctactgtggtgtcggcagcacttttgcgtgtgatgggaggtgatgtggccgagctgccactagttgctacaagccaggatgttcaggggctgggctactttcaagccttgttctcatgcatcgagaggatgctagtttcgctgaagatcaagcactttgtgcttccagctgcacacgaagctgaagggatctggatgaagaaatttggattctctaggaccactccggaagagctggaagcttatcttaatggggcacacctgactatattccatggaacatcatacctgtacaaggctgttccaatgtcatgatatatgggatgaaaaagatatgggtgttgcaatagctagcaggattttgtcttgtcttttctggagtcgctattgtgatgtacataaagagttgatgaggaaacaaagcattggcaagacaatgaaaggttggtatacaggagctggaagccaaggggaagaaaagagctacaagaggtctggattagttttctttctttgtttactcttgaatcgagtgtagtggcgctggggttggcaagtggtggcacacctagcaaattttggtgtaatactagatgcaatgcaattgaagcagttccgtgagtcctggtccgatagccatattttgcaattgaattttgatgtgtttgacaccgacaagtggcggggctcgtatgtgagtaatcggtggtccttttcttgctgtcctggttaaagttgcgatattgctgttttgaagtaacggccactttggaatgacttcctgtgttttttgctatttgtttgtccggaagaatacatgttccatatctatttggctgtcttcagcagccaccaactctcacgagagagcgaagaaaactgtaacacacatcatacattttatcctcccacaacgttcttcttagggtatataactccatacaaaagacttgtatcttattcattagaaccttttaagacacggtttatttagattcttgtatcttattcattagaaccttttaagacacggtttatttagattttgtttttttgtttggatactcttgtattcacctcaatccatatatatacccaccttatatgatacctattatgatatgaaaggtgtccccttggaaacaacaagtaacaaggggctcgcttggttcaacttttttttttctgcggagcttttttaagaatctagctgcggggtgtgctgagaatctaagtatcgtggggattacacgtgaaggaagataagagtctgtcagtaccctgggaatggggtatccttcgctactgtgtcaaggcaagaacacatgcggttagccctaaccacatgctaagggactcagcaggccaaccgtataggcccaattcc

SEQ ID NO: 1553 - DNA, 2068 bp, Zea mays
caaatgacaccgtcatgtgtgacgtatcattcattagaggcggaggcacgtgcgcagagccgcagactcgcaaagcactagcagacactttttttttgacttggttttcgggaggaggaagagtcctgcgtagtttcgttgcaccagcctgcatttgcagagcaaaaacagcataaataaaatggagggtggaatgcgctagagcagagcaacccaccagcggcgagcagtctcctctcctgctgcaactgcagccatgccgtcgtccacgatgcgcctgctgtccaggcgcaccgtcacgcctccaccgcgcccacgccaccgcattccgctcaccacctgggacatctcctttctctccgccgactacatccagaagggcctcctctacgccaagccgccctttcccaccgaccgcctcctcgaccacctccaggcctcgctcgcccaggcgctcgacgcctactaccccgtcgccggccgcttcgtcacggaccagcaccgcgacgccaacggtcacgtcctcggctgctcggtctccatcgactgtgacggccagggggtcgacatcctccacgccgtcgccgacggcgtcgccgtggccgacgtcatcccgcccgacgcacgtgtcccgcgcctcgtccagtcactcttcccgctcgacggcgccgtcaaccacgacggccaccacctcccactcttcgccgtccaggtcaccgacctccacgacggcgtcttcctcggcttcgccctacaaccacgcgctctccgacggcaccgcactatggagatttcatcaacgtatgggcgggcatcgcgcgcgacagcccctccccatccccagctcccccgccgccgcccttgctggagcgctggtcgcccgacgccggcccaaccacaccgccggtcgtcctcccctaccccgacctcacggggctcatcgagaggctgcccccgccgccactatgcgagcgcatgctgcaattctcggccgaaaccctggaggcgctcaaggaccgggcgcggcaggagctcctggcggccggggatacggccggcgcggccgccgttaccaagttccaggcgctcagctcgcttgtgtggcgctccgtcacccgcgcgcgccgcatgccgctcggccaaacaaccttttgccgcgccgccatcaacaaccgcacgcgcctccgcccgcagcttccgccggagtacttcgggaacaccatctacgccatcgcaacggaggccgtcaccgcgggggatctgctggagcgcggccatggctgggccacggcggccgtcggccgcgcggtggcggcgcacacggacgacgccatccgggcgcgcgtggccgcgtggatggccaaccctgtcctgtacaacctcaggttctttgaccccaacggcatcatgatgggcagctcgccgcggttcgacatgtacggcggctgcgacttcggctgggggccgcccctggcgccgcgcagcggcagggccaacaagtccgacgggaaggcgtcgctgtaccccggccgggagggagccggaagcatcgccgcggagcttgtgctgacgtcggagcacatgacgctgctggagcaagacgacgagttctgggcggccgtttcgcccgacaggccttttccgccggcagcgctagccgcccagccaaagtcagacagacactgacagccacagagcatacaataaatatatctcagatcatatgacttctaaatctttcttcttactcacccgatctttggaattaaattccattttaataaagtaatttagttaaagatcaattaaattaatatatttttatttaaaatatatttatataatattattagcaatatgtgatacatttatgtgctatattttttaccatagagaagtgagtctaaaagtgtattataagttgcagagtagaaacatattccactaatatataaaatcatttcttataaaatttatatctaagctttagaaagtattgaaaattctaagctagatcgattattttattaagtaaattctaatttctctaaaacgaacagatccaaac

SEQ ID NO: 1554 - DNA, 3119 bp, Zea mays
ctcggggacgtgattagattctagatccatcctttcttacatacatattttaaataaaaaatatggcgcctctgcctcgtcgccctccaagcatttcaacatacgaggcaaaaactctgctggtttagggtgaaaagcaatatttcaggtaattgaaaatgagcaaaaccaaaagtgaggtagtagtacaagcttagctattaataataacctcgtgttactatctgtccagtgccattaataataactttatgttgttggtgagccgcagtgaggcaatcaaagccacttccagtctcagagtcagacccaccactcctctccctttcttcctctacctacaaagccaccagtccccctcctccggcccgattcatggttcatctccatccccattaattcctcccctcactccatcactcccatgtcaagctccaggaaacccaagactcccatcctcctcttcttcctcttccttctcgccagcctcgccttctcccaagagttcacctacaagggcttcagcgccagtggccgcggcgggagcccgaacctgaacctgaacggcacgtcggcaaccgagatcttgcccagcggcatcctccgcctcaccaacgagacgtcccggctcttcggacacgccttctacccgaccccgctgcgcttcctggaccagaagaacggcaccgccgtgtccttctccacgcagttcgcctttaccgtggtgcccgagttcccgacgctcggcggccacggcttcgcgttcgtcgtcgcgcccgacccgcgcatgtccggtgcgctgcccagccagtacctgggcctactcagcgccgccgacgtcggcaacgccaccaaccacctcttcgccatcgagttcgacaccgtgcaggacttcgagttcgacgacgtcaacggcaaccacgtcggcgtcgacctcaacagcctcatctccaacgcgtccgccaaggccgaccctttgaacctcaagtccggggacaccaccgcctgggtcgactacgacggcgccgccaggttgcttaacgtctccatcgccaacggcacgttggggaagcccaccacgccgctcatctccttccgcgtcgacctctctgggatcttccgcgagcagatgtacgtcggcttctcggcgtccacgggagtcctcgcgagctcgcactacctcaggggttggagctttcgcctcggcgccggcgccgcgccggcgctggatctctcgtccctgccgtcgctgccccagctcaagagctccaagaaccggacctcgctcatcctcgccgtcgcgttctcggcgttcgtggcgctcgtcgtgctcgccggcgccggcgcgtacggtgcgtaccggtacaagaaccgcgacatcatcgagccgtgggagctggactacggcccgcatcggttcaagtacgccgaactccgccgcgcgacgcgcgggttccgcgagcgcgaggtgctcggatccggcggtttcggcaaggtgtaccgcggcgtgctccggaaatccggcgagaccgtggccgtgaagcgcgtgaaccacgagtcccggcagggcctccgcgagttcgtggcggagatcgcgtctatcggccggctccgccaccgcaacctggtccagctccagggctggtgccgccgccgcggcgaccttctcctcgtctacgactacatgcccaacggcagcctggaccgccacctcttcggcgaccacctcaaagcgtcgcgcctgacctggccggtccgctaccgcatcctccgcgacgtcgcgtcggcgctgctgtacctgcacgagggatgggagagcgtcgtcctccaccgcgacgtcaaggccagcaacgtgctcctcgacgccgacatgtcggcgcggctcggcgacttcggtctcgccaagctccacgagcgcgggaccaacccgagcacgacgcgcgtggtgggcaccctggggtacctggctcccgagctgacgcggacggggaaggccacgacggctgccgacgtgttcgcgttcggtgccctggtgctggaggtggtggccgggcggcatcccatagagccccgcgcgccgcccgaggagctggtgctggccgagtgggcgtgggagcggtacgcggcgggggaggtggagaaggtggtggacgcccggctcgccggcgcgtacgacttcgcggaggccgccgcggccgtgaaggtggggctgtggtgctcgcacccggcgccggcgacgcggcccaccatgcgggaggtggcgaggtaccttgacggcggggatgccagcgaggtgccggagcctcctcccccgcctcccatgccgccggcatactctggcgaggtcgggttcgacgatttcgtgcactcgtacccgtcgtcgtcgttcgagcgcgccgccgcagctggcggcggctgggacggcgggacccagatgtcggtcgccacgttccccttctcgtctctgtccatgcggtcatctcacgtcagcacgtgatgcatcgaaattcctgggcccgcttgccagtaagatgacgacttcgtcaaacataatagtgtgaccttggagctaacttgtttatatctgagctgtctattcttttactgcactcagtaacggcaaatggctgagtgacagttggtagcctcttatttaatctttttctttggagtttttgaggagtgtttggttccaaattaagtatatgtaaaatcgaattttgaagggtaaggataagtattaaatatagtctaattacaacactaactatatctcgaacagggcgcggtgccagaattacatgagcgaatcatggactaattagatttaatagattcgtcttaggtttaatagatcgtttttgtcgtttagtttttatctatataattagttttataattaaactataattaatatttcaaaataacatctaaatatttgatatgatagggactaaaatttagcttgaagaaccaaataacccctttagaaaagcagttcaattttgggcaaaagagtcaaatacatatgtggtctcctaagctcaaaatcaaaatgttttggtacactttgtaatacaggattggcaaggaatagaaaaaacataaaaatatagttg

SEQ ID NO: 1555 - DNA, 1818 bp, Zea mays
  misc_feature (1535)..(1535): n is a, c, g, or t
  misc_feature (1578)..(1580): n is a, c, g, or t
  misc_feature (1582)..(1583): n is a, c, g, or t
  misc_feature (1587)..(1587): n is a, c, g, or t
  misc_feature (1591)..(1591): n is a, c, g, or t
  misc_feature (1597)..(1598): n is a, c, g, or t
  misc_feature (1603)..(1605): n is a, c, g, or t
  misc_feature (1610)..(1611): n is a, c, g, or t
  misc_feature (1614)..(1624): n is a, c, g, or t
  misc_feature (1631)..(1631): n is a, c, g, or t
  misc_feature (1634)..(1635): n is a, c, g, or t
  misc_feature (1637)..(1637): n is a, c, g, or t
  misc_feature (1642)..(1642): n is a, c, g, or t
  misc_feature (1644)..(1645): n is a, c, g, or t
  misc_feature (1650)..(1650): n is a, c, g, or t
  misc_feature (1658)..(1658): n is a, c, g, or t
  misc_feature (1661)..(1662): n is a, c, g, or t
  misc_feature (1667)..(1670): n is a, c, g, or t
  misc_feature (1672)..(1672): n is a, c, g, or t
  misc_feature (1676)..(1676): n is a, c, g, or t
  misc_feature (1679)..(1681): n is a, c, g, or t
  misc_feature (1685)..(1685): n is a, c, g, or t
  misc_feature (1690)..(1690): n is a, c, g, or t
  misc_feature (1694)..(1694): n is a, c, g, or t
  misc_feature (1697)..(1698): n is a, c, g, or t
  misc_feature (1700)..(1702): n is a, c, g, or t
  misc_feature (1705)..(1705): n is a, c, g, or t
  misc_feature (1708)..(1708): n is a, c, g, or t
  misc_feature (1711)..(1711): n is a, c, g, or t
  misc_feature (1713)..(1713): n is a, c, g, or t
  misc_feature (1715)..(1715): n is a, c, g, or t
  misc_feature (1717)..(1717): n is a, c, g, or t
  misc_feature (1719)..(1720): n is a, c, g, or t
  misc_feature (1722)..(1722): n is a, c, g, or t
  misc_feature (1725)..(1725): n is a, c, g, or t
  misc_feature (1730)..(1730): n is a, c, g, or t
  misc_feature (1733)..(1733): n is a, c, g, or t
  misc_feature (1736)..(1736): n is a, c, g, or t
  misc_feature (1738)..(1738): n is a, c, g, or t
  misc_feature (1740)..(1742): n is a, c, g, or t
  misc_feature (1745)..(1745): n is a, c, g, or t
  misc_feature (1752)..(1752): n is a, c, g, or t
  misc_feature (1755)..(1756): n is a, c, g, or t
  misc_feature (1758)..(1764): n is a, c, g, or t
  misc_feature (1770)..(1774): n is a, c, g, or t
  misc_feature (1776)..(1777): n is a, c, g, or t
  misc_feature (1779)..(1781): n is a, c, g, or t
  misc_feature (1787)..(1787): n is a, c, g, or t
  misc_feature (1789)..(1789): n is a, c, g, or t
  misc_feature (1796)..(1797): n is a, c, g, or t
  misc_feature (1801)..(1801): n is a, c, g, or t
  misc_feature (1804)..(1806): n is a, c, g, or t
  misc_feature (1809)..(1809): n is a, c, g, or t
  misc_feature (1812)..(1812): n is a, c, g, or t
  misc_feature (1816)..(1816): n is a, c, g, or t
  misc_feature (1818)..(1818): n is a, c, g, or t
acgcgcgcgggcgtagttcagggacggggagaggagaggagaggagaggagaggaagcaggacctgggagacctcgcctcgtccgtcctcctgcctacttccttgcttttggtaggtgctgcttgttttatcttgaaatgggctctcatgatggcgaggatgaagagttgccacccccccctccggtgccaccagatgtgattcccattaaagctgaagatgctgtgggtgaatcaccagcaaaccatatattaaagccaaagagattactgatggacaggcctggtataggaagaaaagggcagccgacccagctctattcaaatcactttaaagtcgctgtgaagagtacagaagacgtcttctttcactactatgtaaacctgaagtatgaggatgatcgacccgttgatggtaaagggatcggcagaaaggtgattgataaactgcagcagacatatcgtgcagagctttctaacaaggactttgcatatgatggagaaaagagcctgtttacagttggtggtcttccacaaaaaaagaatgagttcaccgttgtcttggaggacgtatctactggaaagactgctgccaatgggagccctggaggtaatgacagtcctggaggtggtgataggaagagagtgaggaggccataccagacgaaaacattcaaagtggagataaattttgcagcagaggttcctatgagtgctattggtcaagtcattagaggcgaagaatctgagaactccctggaggcgcttcgtgttcttgatatcatactgaggcagcattccgcagaacaaggctgccttttggttaagcaatcatttttctacaacaacccttcatgctttgttgacttgggtggtggtgtgatgggttgtcgtggatttcattcaagcttccgtggcacacagagtggactttccctcaatgttgatgtctcaacaacaatgatcgtgaaacctggccctgttattgattttcttctttctaaccagaatgttaatgatcctagcagaattgattggcaaaaggccaagcgtgctctcaagggcttgaggattagaaccactcctgcaaattcagaattcaagatttttggtctcagcgagaggatctgcaaagaacaaacgtttccgctgaggcagagaaatggtagcaacggagattgtgataccattgaaataactgtctatgactactatgcaaagaaaggaatcgatctaaagtattctggtgatttcccctgtataaatacagggaaggcaaagcgcccaacatattttccaatcgagctatgctcgcttgttccgcttcaaagatacaccaaagctttgtctacgctacaaaggtcatcccttgtggagaagtctagacagaagcctgaagaaaggatgaccgttctaaatgatgcactgcaacgcagtaactacgattctgaccccatgttgagggcatgtggtgttgtcagttgctccaaaatttacccaagttggaaggaaggatccttcaagccccaaagctgnaaagccggcaatggtgatgatgtcttgtcacgaaatggtcggnnntnntggngggnagtggnnaaaannntgtgnnagnnnnnnnnnnngggaatnaannangtgtngnngaagngggagggnganngtggnnnngnggtngannngganaagantttnttnntnnngtngtnggngngncnanngnggntgggntgnggntntnnnggngctgggntgnncnnnnnnntgtgannnnngnnannngggtcncngaggacnncccnatnnntgntanattnan

SEQ ID NO: 1556 - DNA, 2095 bp, Zea mays
accggtccggaattcacgggtcgatccacgcgtccgaaaggccaagcgtgctctctagggcttgaggattagaaccactcctgcaaattcagaattcaagatttttggtctcagcgagaggatctgcaaagaacaaacgtttccgctgaggcagagaaatggtagcaacggagattgtgataccattgaaataactgtctatgactactatgcaaagaaaggaatcgatctaaagtattctggtgatttcccctgtataaatacagggaaggcaaagcgcccaacatattttccaatcgagctatgctcgcttgttccgcttcaaagatacaccaaagctttgtctacgctacaaaggtcatcccttgtggagaagtctagacagaagcctgaagaaaggatgaccgttctaaatgatgcactgcaacgcagtaactacgattctgaccccatgttgagggcatgtggtgtttcagttgctccaaaatttacccaagttgaaggaaggatccttcaagccccaaagctgaaagccggcaatggtgatgatatcttttcacgaaatggacggtggaatttcactaataggaagttttatgaaacctgctctgtgaataagtgggcggtcgttaatttctctgcacgttgtgatgttcggaatcttatccgtgacctgatgaggaatgcatctgcaaagggaattcaaatggaggaaccttttgatgtgtttgaagagagtccctctatgaggcgtgcacctgtgtcaagaagggtggatgatatgtttgggcagataaaatcaaaacttcctggagctcctaggttcctcttgtgccttctccctgagaggaaaaattgtgaaatctatggtccttggaagagaaagtgcctggccgagtttggtattgtcacacagtgtctagctccattaagagtcaatgatccgtacctgcttaatttgctgatgaagatcaatgcaaagcttggtggtctgaactcgttgctgcaagttgaagcatcttcgtcaataccacatgtgtcgcaagtacccaccatcatcttaggtatggatgtttcacatggtcatccaggacaagatagaccttcggttgcagcggtggttagttctcgtcaatggcctcttatctctagatatagagcatcagtgcacacccaatctgccagactagaaatgatgtcctcgttgtttaagccgcggggtactgatgatgatggcctcatccgggaatcactgatcgacttctacactagctctggaaagcgaaaaccagaacacataattattttcagggatggagtcagtgaaagtcagtttacccaggtcatcaacattgagctggatcagatcattgaggcatgtaagtttctggatgagaagtggtcacccaagttcactgtgattgttgctcaaaagaaccatcacaccaagttctttcagacggcatcaccagacaatgttcttcctggaactgtggtggatagtaaagtttgccatcctaagaacttcgacttctacatgtgtgcacatgctgggatgattggaacaacaaggcccacccactatcatgttctgcacgacgagataggttttaatgccgacgagatgcaggagtttgttcattcgctctcttacgtgtaccagaggagcacgacagccatctcagtggttgctccagtgtgctacgcccacctcgctgcagcccaggtgagcacgttcctgagattggaggagatgtcagacgcgtcctccagccagggaggagggcatacctcggctggcagtgctcctgtgccggagctgcctcgcctgcatgacaaagtcaggagctccatgttcttctgctagctgatgtgcgtgcgcatcaggatcgagctccatgttttgtgttagtaaggcctagttagtaaggctgtagaaagaatgtttaatgtttgcatgctaaagtagctcaggaatgaaacgagccaagggcagaaccaaacaatcaaaaccactactatatctaccagagcacactgatcgatcaaacaacaagagtcagcatcaatcaaaaccaccactattctatctacc

SEQ ID NO: 1557 - DNA, 2414 bp, Zea mays
cctcgagccggccgggaatatattaggggtccctcgagtccctcgcggccggccgttcctgtaccctgcacctgccttttactccattcccctcggtgcgccgccgccagtccgccccgccccgccccgcccagcagacagcgcagccatgccgctccacctccacctgctgtcgtccccggccaccgctgccaagctcgcggcaggtctgcgcgcggcgcctctccgccggtgccacagcttggccccggcgccgcgccacacggatcgcgtggcccttgcgtcgtccctctcggcggtggcgcggtctgctggccccgccgtggcagcggcgcagaccaagcccagcgtttcaggaaagaaacaagtattgatatcgttgtcggataaaacggacttggcttatcttggcaatggtcttcagggtttggggtattccatcgtttccactggtggaacagcatccagcctggaagcagcaggagtcagtgtaacaaaagttgaagaaatcacacatttccctgaaatgcttgatggacgagtgaaaacattgcacccaagtatacatggtggtattcttgccaggagagaccaggagcatcatttgaaggcactaaaagatcatggaattgggacatttgatgtggttgtggtgaatttgtatcccttttatgacaaagtcacctctggtaacatctcttttgaggatggcattgaaaatattgatattggtgggcccacgatgatcagagctgcagccaagaaccataaggatgttcttattgtggtggatcataatgattatcctgctttactggagtaccttaaaggaaagcgagacgatcagcagttccccaggatgttggcatggaaagccatgcagcatgtcgcctcttatgattctgcagtgtcagaatggttgtggaagcaatcaaataaaggagagatgttccccccaagctttactgtgccactggagctgaagtctacactccggtatggcgaaaatcctcatcagagtgctgcattctatgctgacaagagcctttctcttgtcggtgctggtggtattgccactgctattcaacaccatggaaaggaaatgtcttacaacaactacttggatgcggatgctgcatggaactgtgtatcggagtttgatagtcctacttgtgttgtggtgaagcacacaaatccatgtggtgttgcctcacgaaaggatattcttgaagcttacaggttagctgtaaggggagatgctgtcagtgcatttggtgggatagttgcattcaacacgactattgacgaggatcttgcgaaggaaattcgtgagttcaggagtcctacagatggtgagacgcggatgttctatgagatagtggttgctcccggctatacggagaagggtcttgaggttctcagaggcaagtccaaggcactgaggatactcgaggcgaagagaagtggaaaagggatgctttcacttaggcaggtgagtggtgggtggttagctcaggagtctgatgatctaacccctgaagagatcacctttaccacaaagtctgagaggtctccgcaagaaaacgagcttgccgatgccaaatttgcctggctttgcgcaaaacatgtcaagagcaacgcaattgtgatagccaagaacaactgcatgctgggaatgggcagtggtcagccgaacaggcgagagagcgttcgaatcgccttcaggaaggcaggagaggaggccaagggagccgcattggccagcgacgccttctttccctttgcctggaatgatgccgtcgaggaggcgtgccagaacggcatcggcatcatcgcccagccaggaggcagtaagaaggacgaggacgccgtcgcgtgctgcaacaagtatggtgtgtcgctcgtcctcaccggcgtcaggcacttcaagcattagccgtcatgccccatggctggtcatcttagcttagggagttacggaaaaaaaaacaagcttcgaaggctgcagcttgtggagctgccctgatgtttagctttctgcaaagtgcaaaactgcaaattttggtttctgtagggcgtaggctttggtgggtgagctcgtggggaaggtaatgtttctcctggagtcgaataagctgatgggtgtaccgcgagtgacaattgaacccaacctaaggacttgcaggttggtacttttatctgtcaaaatcagccgtgcgcctatgcaccaggagaatcatcgatgtgacctacaatcttcggactacaaaccattgaaaaataaaaagagaaaaggtgcctgggaatttctgtgttcacaaatatatgagcgtttgcagttctgcattatgctgcctggtctagtgcgtggtaagccggccccaaggaggatcctgtcggtagcaatctctgca

SEQ ID NO: 1558 - DNA, 1262 bp, Zea mays
  misc_feature (1055)..(1055): n is a, c, g, or t
  misc_feature (1068)..(1068): n is a, c, g, or t
  misc_feature (1073)..(1074): n is a, c, g, or t
  misc_feature (1080)..(1080): n is a, c, g, or t
  misc_feature (1100)..(1100): n is a, c, g, or t
  misc_feature (1103)..(1103): n is a, c, g, or t
  misc_feature (1120)..(1120): n is a, c, g, or t
  misc_feature (1125)..(1125): n is a, c, g, or t
  misc_feature (1137)..(1137): n is a, c, g, or t
  misc_feature (1169)..(1169): n is a, c, g, or t
  misc_feature (1171)..(1171): n is a, c, g, or t
  misc_feature (1181)..(1181): n is a, c, g, or t
  misc_feature (1187)..(1187): n is a, c, g, or t
  misc_feature (1203)..(1203): n is a, c, g, or t
  misc_feature (1213)..(1213): n is a, c, g, or t
  misc_feature (1215)..(1215): n is a, c, g, or t
  misc_feature (1218)..(1218): n is a, c, g, or t
  misc_feature (1220)..(1220): n is a, c, g, or t
  misc_feature (1222)..(1222): n is a, c, g, or t
  misc_feature (1224)..(1225): n is a, c, g, or t
  misc_feature (1235)..(1235): n is a, c, g, or t
  misc_feature (1243)..(1243): n is a, c, g, or t
  misc_feature (1247)..(1247): n is a, c, g, or t
  misc_feature (1254)..(1254): n is a, c, g, or t
  misc_feature (1260)..(1262): n is a, c, g, or t
ccacgcgtccggctgtcagtgcatttggtgggatagttgcattcaacacgactattgacgaggtattcagcatgctgcatcttactaaatcactagttactggcgtaacatcattgggcacttctatttatatatgccactatatgtttaggatcttgcgaaggaaattcgtgagttcaggagtcctacagatggtgagacgcggatgttctatgagatagtggttgctcccggctatacggagaagggtcttgaggttctcagaggcaagtccaaggcactgaggatactcgaggcgaagagaagtggaaaagggatgctttcacttaggcaggtgagtggtgggtggttagctcaggagtctgatgatctaacccctgaagagatcacctttaccacaaagtctgagaggtctccgcaagaaaacgagcttgccgatgccaaatttgcctggctttgcgcaaaacatgtcaagagcaatgcgattgtgatagccaagaacaactgcatgctgggaatgggcagtggtcagccgaacaggcgagagagcgtccgaatcgccttcaggaaggcaggagaggaggccaagggagctgcattggccagcgacgccttctttccttttgcctggaatgatgccgtcgaggaggcgtgccagaacggcatcggcatcatcgcccagccaggaggcagtaagaaggacgaggacgccgtcgcgtgctgcaacaagtatggtgtgtcgctcgtcctcaccggcgtcaggcacttcaagcattagccgtcatgccccatggctggtcatcttagcttagggagttacggaaaaagaaacaaagcttcggaggctgcagcttgtggagctgccctgatgtttagctttctgcaaagtgcaaaaactgcaaattttggtttctgtaaggcgtaggctttgctgggtgagctcgtggggaaggtaatgtttctcctggagtcgaataagctgatgggtgtaccgcgagtgacaattgaacccaccctaaggactttcaggttggtactttttctgccaaaatcanccgtgccctatgnccagnnaacatnatgtacctccctacggcttnatngacctacaattttgacncaacnttgaaaataaanaaaaaagggctggaaaaaaaaaaaaaaattcncnccggggatcntttttnaaggccccggggaccntttttccttngnggnantnanngggaataggntacttccntganttttccncaaccnnn

SEQ ID NO: 1559 - DNA, 1754 bp, Zea mays
ttgggaccctcgaggccggccttgggtacctcgaggccggccgggacgcagacacacacacttcatcgtggagatatggtggggaacaatactgttgcttccctcttctactattctttgctcatcatctgcgccgctgcttggcacgcggatgcgtcccaagcggatcgactgagagaattcatcaggtctaggaggaacagtcctagtgaggctgataagggcacgtttgaggttgccaacatggggcacagcgtagctagcagcctcctgagcacaagctactccgacagtgaacagagcgccctgaaggcagccgacaagatcactgcgctgccggggcaaccggacggcggcgtcgacttcgaccagtacgccgggtacgtgactgtcgacgagaagaatggccgggcactcttctactacttggtggaggcaccacaggatgcctcggcaaagccgctcctcctgtggcttaacggagggcccggatgctcatcgcttggctacggagcaatgcaagagctcggtccgttccgcgtaaacagcgacaacaaaacgctgagcagaaacaaggcggcttggaataacgtggctaatgtgatcttcttggagtcgccggcgggtgttggattctcctactccaacacatcctccgactacggcctcagcggagaccgaaggacagctgctgatgcgtacttgtttttggctaactggctggagcgctttcctgaatacaaaagccgtccgttctacatctccggggagagctacgccggacactacgtacccgaacttgctgccaccatcttaacccagaattcctacaacagcaggacggccataaacctccggggcatcttggttggaaatccacttctggattcgtatatgaacttgaagggtgcagttgcctactactggagccatgggttgatgtcggacgaggtctttgacaacataaccaggcactgcaagtatgacagttcagatggtgtggcatgcagtggcgctttggaggcggtagatcctggacagattgatccttacaacgtatatgctccgatctgtgttgatgcggccaacggagcatactaccccactggctacctacctggatatgatccatgcagcgattactacacctattcctacctcaatgacccagcagtgcagaatgctttccacgctaggacgacaagttggtcagcgtgcgcgaacttgaactggacggacgcaccgatttccatggtgccaacagtcgcagggctgattgagaagaagctgcctgtttggatttttagtggcgattttgattccgtgtgcccacttcctgctacgaggttttccatccatgatcttaacctgcacgtcaccactccatggcgcccgtggacagtaaacatggaggtcggaggatatgttcaacaataccagggaggattcacgtttgcctctgtcagaggagctggtcatatggttccgtcttcccaggctgatagagcattagtattattggactcctttctgaaaggggtgctcccaccatacgtacaggagcagtaataattcctaaatatgtagagtgtcttgtcaatggcaaactcaataaaaactatccgtttttgtattacttgaattgatgttggttttgcattagctggtttgtggttataattaaaaggtccatctttccccttagggaccgtttgtatccgctcgttttagagaaattggcggccatacttaac

SEQ ID NO: 1560 - DNA, 882 bp, Zea mays
ggccattgggacctcgagggccggccggacgcacacacacacacatttcatcgtggagatatggtggggaacaatactgttgcttccctcttctactactctttgctcatcatctgcgccgctgcttggcacgcggatgcgtcccaagtggatcgactgagagaattcatcaggtctaggaggaacagtcctagtgatggtaagggcacgtttggggttgccaacatagggcacagcgtagctagcagcctcctgagcacaagcagctactccgacagtgaacagagcgccctgaaggcagctgacaagatcactgcgctgccggggcaaccggacggcggcgtcgacttcgaccagtacgccgggtacgtgactgtcgacgagaagaatggccgggcactcttctactacttggtggaggcaccacaggatgcctcggcaaagccgctcctcctgtggcttaacggagggcccggatgctcgtcgcttggctacggagcaatgcaagagctcggtccgttccgcgtaaacagcgacaacaaaacgctgagcagaaacaaggcggcttggaataacgtggctaatgtgatcttcttggagtcgccggcgggtgttggattctcctactccaacacatcctccgactacggcctcagcggagaccgaaggacagctgctgatgcgtacttgtttttggctaactggctggagcgctttcctgaatacaaaagccgtccgttctacatctccggggagagctacgccggacactacgtaccccaacttgctgccaccatcttaacccagaattcctacaacagcaggacggccataaacctccggggcatcttggttggaaatccacttctggatcgtatatga

SEQ ID NO: 1561 - DNA, 975 bp, Zea mays
ttgggaccctcgaggccggccgccatgcctactgttaagttttgtgaattcggaggcacagcgccacctacttccaccatttcggcaaccccgcaggaaaaaaaaaagggcgaaacgaggccaccagctcaccgccgagcggaagcggcgccgagcaaccaacccctctcctcgtccgccgccgtctccccggaccatgtccatggccgcctcctcccggctgctctgggcgtcccgcgccgccgcctacctcaagatctccaccttccccagggccttctccaccgtgctgaaggatctgaagtatgctgacactcatgaatgggtgaaagttgagggtgattcagcaaccgtggggattactgaccatgcccaggatcatttgggtgatgttgtttttgtggagctaccagaagttggcatcagtgtatcccagggaaagaactttggtgctgttgagagtgtgaaggcaaccagcgatatcaattcaccagtgtctggagaggtggttgaagtgaacgagaaactaagtgaggagcctggattggttaatgcaagtccatatgagaagggatggattatcaaggtcaagctcagcaattcaggtgacctcaattcgctcatggatgatgataagtactcgaaattctgtgaagaagaagacaaccattgaagaaatcagagtgtcttctgaacaccaggacctgtttttcaagctttatcactggttatggtctggagaccagctgtgacaaattggcaaggttcatcgcaaggaataaatgttaggatttgccaatcctacaagggcatgggaaatccaagtttgtgttgtcaatgacgtggtcatatttgatatttctttgtagttgtaatctcgtgaattccttcttttttcttaaaaaaagtactctttttgattccttccaaaaaaaaaaaaaaaaaacttttgcggtcttgtctcgtgcaaaaggg

SEQ ID NO: 1562 - DNA, 989 bp, Zea mays
agtcttcgctatgcaccacgagcgcctccgccgctccaacgctccaacgcttgagcgcctccaacgccacggggcccccgggggcggccgggcggggaattcggaggcgcagcgccaccaacttccaccattttggcaaccccgcagggaaaaaaaaagggcgaaacgaggccaccagctcaccgccgagcggaagcggcgccgagcaaccaacccctctcctcgtccgccgccgtctccccggaccatggccttccccaccgtgctgaaggatctgatgtatgctgactctcatgaatgggtgaaagttgtgggtgattcagcaaccgtggggattactgactatgcccagtatcaattgggtgagcttgttgttgtggacctaccagaagttggcatcagtgtatcccagggaaagacctttggttctgttgagagtgtgaatggagccagcgatatctattcaccagtgtctggagaggtggttgaagtgaacgagaaactaagtgacttgcctggagtggtgaatacaagtccatatgagaagggatggattatgaaggtcaagctcagcaattcaggtgagctcaattcgctcatggatgatgacaagtactcgaaatactgcgaagaaggcaaccattgaagaaatcggagtgtcttctgaggaccaggacctgtttttcaagctttatcaattatcactggttatggtctggagaccagttgtgacaaattggcaaggttcatcgcaaggaataaatgttaggatttgccaatcctacgagggcatgggaaatccaagtttgtgttgtcaatgacgtggtcatatttgatatttctttgtagttgtaatctcgtgaattccttctttttcttaaaaaggactctttttgattccttcctatgcaaatttcttggtgcttttgcgaatggttaagatttttcagcaaaaaaaaaaaaaaaaaaaaaaaaaacagcccgggggc

SEQ ID NO: 1563 - DNA, 928 bp, Zea mays
cctactgttagttttgcgaattcgggcccgccgcgccaccaacttgcaccattttggcaaccccgcagggacaaaagaaaggcgaaacgaggccaccagctcaccgccgagcggaagcggcgccgagcaaccaacccctctcctcgtccgccgccgtctccccggaccatggccatggccgccgcctcctcccggctgctctgggcgtcccgcgccgccgcctacctcaggatctccaccttccccagggccttctccaccgtgctgaaggatctgaagtatgctgacactcatgaatgggtgaaagttgagggtgattcagcaaccgtggggattactgaccatgcccaggaccatttgggtgatgttgtttttgtggagctaccagaagttggcatcagtgtatcccagggaaagaactttggtgctgttgagagtgtgaaggcaaccagcgatatcaattcaccagtgtctggagaggtggttgaagtgaacgagaaactaagtgaggagcctggattggtgaatgcaagtccatatgagaagggatggattatcaaggtcaagctcagcaattcaggtgacctcaattcgctcatggatgatgataagtactcgaaattctgcgaagaagaagacaaccattgaagaaatcagagtgtcttctgaacaccaggacctgtttttcaagctttatcagtgcttatggtctggagcttatggtctggagaccagctgtggcaaattggcaaggttcatcgcaaggaataaatgttaggatttgccaatcctacaagggtatgggaaatccaagtttgtgttgtcaatgacgtggtcaaatttgatgtttctttgtagttgtgatctcgtgaattccttttttttctttaaaaaggactctttttgtttcttgctatgcaaatttctt

SEQ ID NO: 1564 - DNA, 1339 bp, Zea mays
cattgggtacctcgaggcccgccgcccaaccaccagacacagactccaccaccccgcttcgatcttctgttgcagctgaaatctgtcagattctgcagttcattccaaatggctgctgcagcagagcacggcaactgcgatgcttgggcggccagagacccttctggggttctctcaccatacaagtttaaccgcagggcagtgcaaagcagcgacgtttcgctgaagatcatatactgcggggtgtgttacggtgacgttatgtggatacagaacaagcacaacgactcagtttatcctctggttcctgggcatgagatagctggggttgtgactgaggttggcgcagacgtcaaggccttcaaggtgggtgaccacgcaggcgttggaacctacgtgaactcgtgccggcactgcgagaactgcaacagctctctggagaactactgcccagaaacagttttcacttacaacacaactgatgctgatgggaccatcacaaaggggggctactccactcacattgtcgtccatgaaaggtactgcttcaagatacccgatggctaccctctggcgcaggcagcgcctcttctgtgtgctggaatcaccgtctataccccaatggcgcggcacaacatgaagcagcctgggaagtcgctgggagtcattgggctcggtggcctaggccacatggcggtcaaatttggcaaggccttcggcctcaaggtcacggttttcagcacgagcgaatcgaagagggaagaagccattaacctccttggagcagataactttgttatatcgtcagacacgcagcagatggaggccctgaaaaactccctgcacttcatagttgacactgcttctggtgaccatccattcgatccgtatctctcgctccttaaggttggcggtgtgatgacaatagtgtgctttccaagtgagatcaagatgcaccctgcgagcctcaatcgtggtgggcggaccttgtctggtagtattgtcggaggtacaaaagacatccaggagatggttaacttttgcgcggagaacaaaatctatccagagatcgagatcatcaagatggattatatcaacgaggctctcgccaggcttgttaaccgagacgtgaaataccgctttgtcatcgacatcaagaactctttcgagtagcatgctcattcacatgatccctgtcttctttgtcaatgtatgagagataatgagtcgtttcgaataaagcttagacatgataaataacaagtatgcttgtgactgtaaaatcgttctataaataagtgcgctgtgttgacccaaaaaaaaaaaaaaaaaagcggcc

SEQ ID NO: 1565 - DNA, 2393 bp, Zea mays
ttgggtacctcgaggccggccgggacagcacaaacgttcctctcctcttccatcgtcgtcctcgctcccggccccgcctgtctagtcccctcttctcgcgtgcaccccctgtactgtacgtgctaggcacacagctagctgcagccacagcagggcacagcaaatggtttccggtgcgggtcatggtgggtacggcggcggcgacgacgggcaggccgtggacttccggggcaacccggcggacaagtcgaggaccggaggctggctgggcgccgggctgatcctgggcacggagctggcggagcgtgtgtgcgtgatgggcatctcgatgaacctggtgacgtacctcgtcggcgagctgcacctctccaactccaagtccgccaccgtggtgaccaacttcatgggcacgctcaacctgctcgccctcgtcggcggcttcctcgccgacgccaagctcggccgctacctcaccatcgccatctccgccacaatcgccgccacgggcgtgagcttgctgacggtggacacgacggtgccgagcatgcgtccaccggcgtgcctggacgcccgcgggccgcgcgcgcacgagtgcgtgccggcgcgcggcgggcagctggcgcttctgtacgcggcgctgtacacggtggcggcgggggccggcgggctcaaggcgaacgtgtccgggttcgggtcggaccagttcgacgggcgcgacccgcgggaggagcgcgccatggtgttcttcttcaaccgcttctacttctgcgtcagcctggggtcgctgttcgcggtcaccgtgctggtgtacgtgcaggacaacgtggggcggggctggggctacggcgtctccgcagtcgccatggcgctcgccgtcgccgtgctcgtggccggcacgccccggtacaggtaccgccgcccgcagggcagcccgctgacggcggtcggccgggtgctcgccgcggcgtggaggaagcgccggctgccgctgcccgccgacgccgccgagctccacgggttcgccgcggccaaggtcgcccacactgacaggctcaggtggcttgacaaggccgcgatcgtggaggccgagctggcggggaagcagcgggcgagcgcggcggcagcgtcgacggtgacggaggtcgaggaggtgaagatggtggcgaagctgctgcccatctggttcacgtgcatcctcttctggacggtctactcccagatgaccaccttctcggtggagcaggccacgcgcatggaccgccacctccgcccgggctccggcgccggcgccggcggcttcgccgtcccggccggctccttctccgtcttcctattcctctccatcctgctcttcacctcgctcaacgagcgcctcctcgtgccgctggccgcccgcctcacgggccgcccgcaggggctcacctcgctgcagcgcgtcggggccgggctcgcgctctccgtcgccgccatggccgtctccgcgctcgtagagaggaagcggcgcgacgcggccaacgggccggaccacgtcgccgtcagcgccttctggctcgtcccgcagtacttcctcgtcggcgccggcgaggccttcgcctacgtgggccagctggagttcttcatccgcgaggcgcccgagcggatgaagtccatgagcaccggcctcttcctcgtcacgctctccatgggcttcttcctcagcagcttcctcgtcttcgccgtcgacgccgccaccgcgggcgcgtggatccggaacaacctcgaccgcggcaggctcgacctcttctactggatgctggccctgctcggcgtcgccaacttcgccgtcttcgtcgtcttcgccaggcggcaccagtacaaggccaccagcttgccgtcgtcggtggcgcccgacggcgccgggcacaaggagatggacgacttcgtcgcagtcacggaggccgtggaaggagtggacgtgtagggcgcgcatgtcagactcacacttcatcggtgggtgtgggtggcctctgctgtttaattttgcctttgggtagtgtgtatgtgtatggcgaagttttctttctcttgccagtttccagtttgctgctgcttcggcctgctctcctgtaaataacataggagacatgctaattgaggccaagtctttatccagttagatcaacaagatattgaattgggcatgaaggctgaacaccaatcacacctgattgatgcattgcagtaaaaaaagagagataagaggaataggaataaaggaggtatatatgtagattaaaaaaaacatcaaaaaatcgttttttcttcgcccggagccaccctttttaatttcccgcggccgcaatggggcccggaaacatgccaacttcggccccatttccccttttagggggggc

SEQ ID NO: 1566 - DNA, 3410 bp, Zea mays
atctaaacaatgtttcttaaaactaactgtagtactttggagttgggcaaaactactgtggtgttattatgacaattgcaaaaaaaaaatagcattgtaacataatggttttaaaaaatatagtggacaaacatgcccggagatttgcgcagctgtactacttgtagtcgcccaggccgaccgggatatcaacgtcggagagaggctaccgatgcaccggagcggatccgaattgtttagttgccggattaccagatcgggaggcacaacttgtgttctccgttcttccacgtgaacccatatctgccaccatcagtaaacaacagttggggctaatagacaatgagaaaaaagtccggtgcatcccccctggccgtgtctccacgtcttgtggctgaagccgaacccaagacaagcagaaagcagccgagagaggtcttcggcgcgcacccgctacggaaaaaagcgcaaaagcacgggccgtctcagcaaaagcgcagcgctgagcgggcggccgtggattggcgggtccgcggcagcgcgcgctttttccccacccgtcgcggtcggcgggggctccatgcccgcggggccacgtgggaggccagggcgccgaaccctcccgagcccgcggcacgcgtcgcggctgcactggccaggccacggccccgcgcccattatatcctgcccccgccgcgcatcaccgcccaccccgccgacaccctgccaccaacgacaggttaccttcttcgggcccttctcaccatttcctcatttaagccccgtgtgccttgctcctcggtgtttcctccagatagtagtgtttcctcagtggactagtgtgaagctgtgcttagcgtagcggaagggaggaaggacaaggcaaggcaactgatggcggcgggcggcggaggcggctcgccggcgccgttcgtgtggaagacgtacacgatggtggaggaccccgggacggcaggggtgatcggctggggcagcggcaacaacagcttcgtcgtcgccgaccccttcgtcttctcgcagacgctgctccccgcgcacttcaagcacaacaacttctccagcttcgtccgccagctcaacacctatgtcagttaaatcacacactccagctagctaaattgattgccgtctctcttctacgagctgaaccctgctcttgggagagcgctggatctgtataaactttggcgtgtgtaccgaatgctcttgctgtgctgtaccaacacaaatttgtaaattggtttttgttggagaaaaaaaaaggaaatatgtaagcttgctacctgcagcgacgaaattcttcaaaacatctttggagatcgaccattcaaattttttttttttttttgtggacagagatggagccgcgtatatatatgcaacaaaattctgcagacagttcggtgaatatatgcacggagaaaaattggtttttttgcgcaatttacctatggatttctgcaagaaccgaacacaccgccgtgagaactttataaatcgcgagagccaagagctgcacagctagtactagtacttcccttgccctgacttggtattttcagggcttccgcaaggttgatccggaccggtgggagttcgcccacgcgtcgttcctgcgcggccagacgcacctcctgcgcaacatcgtccgccgcggcagcagcgccgccggtgccggaggcggaaagaggaaggacgccagccccacggagctggcctccggggacgacatgaccatggtggccacggaggtggtgcctcaagcaagagcagcgcgccatcgacgaccgcgtcgcctccatgtggcgccgcgtgcaggagacggagcgcaggcccaagcagatgctcgcgttcctcctcaaggtcgtcggcgaccgcgacaggctgcaccgcctcgtcggcgacgcccccgtgccagataacgggttcgcctccggcggtgccgccgagccgcccgccgcggaggtcggcgagaagcgggccaggctgctgctcgacggtgacagcatggtggcgctcggtcccgaggccgtcgacttcgccgggttctacagcggcggcggtgcgttcggcgatgttgccgtggatgctgccgctgggtcccgcggaggcgggttctcgtttgcgttcggcgtggacgcggggtactgaatgacgagcaggcgccgccattgtcagcagcttggcccgcttatgctgctgtcgagcttcctgccaatgccattgcgctgagcggcggcagccgtcacatggaagcatggcaggggatggatgataatgatgttaagttctatccctgctacatggataggatgtgtgtctgatgctgcttttcgtggatctatatgggcggggagcgactactgcgtcgagatctaaaaataaggggatatactgtcatggagtgtgaccttcgaagttcccaatatgagtaggtttgatgttgtacatgaccagtgcagcagcactaatatttcaatctcctgcggatacgcagctggaaaattggcatcgctattatttagcccttttctgcgtatgtctcaagcgaacaatctaattaagttttcttagagcatctccaagagactagttaaataactcgccgagccaaattttagctactaaatagtaaattaaatctccaacagactagctatctgactagtaagctatctgactctgtaaattgtctctcactagctaaatttagctagccacctgactagccaaactagatagatagtctgttggactgagatgctatatatagagtgtagtctttatgaaaatgtaaatagatagttaaatagagagaaaaaaatgaagagtctcttggagatgctcttaccatcgtacatgtaataattgtgttgatataaactgttacaaaacaatgagcaaaggcacagtcaagatgaaacatagagagacaagattaacatagagaaaggatctatctgtttggttcacttatagatttctgaaactttaatgtgattctagttgtgaacggtaaaaaaacagttgcgaggggacggttataaaaaaatttaaaatttatttagttaaaacaactttaaaatctaaaacttatttagtgaaaagaaggcctgtagaacgatagcatggtaacatagataacaaaaaattagaaaatctagagtataaaataaatctgaattgaactatagaaatctatagatttttagaaatcgattttgctgttatagctgttggttgagattcaagatttttgacagcgaatttggtttagaaggctgaactaatcgcactttaaggcagcaagtcccctatctcttctcatatctcatcccctattttaaattttattttgtaaaccaatatcaaccagtgtcactgtcacg

SEQ ID NO: 1567 - DNA, 3350 bp, Zea mays
  misc_feature (3327)..(3327): n is a, c, g, or t
cccccgctctcatgcaaagctaggataggggcgtccaccaacttgctctttaatgtctgataactgacctcgcaatttctggatcagatgaagagaacacccttatccaagagtctagtcaagggcttagcaatgctggaaaaatttggtacgaaacaccgatgatatccagccagccccaagaaacttcgaatttcggagacactagagggtctcttccactccaccacagccgcaacattcttgggatcaaccgcaatgccctgctgattaatcacatgccccaggaaagccacttcggacagccaaaatgcacacttcttcaacttgccatagaactgattctcccttagggcacccagaacgagacggagatgctgctcatgctcgacctcggtctttgaataaatcagaatatcatccaggaacacgaccacaaagtcgtccaggaattcatgcaacatcctattcattgcttccataaaggcagcaggggcattagttaagccaaaagacatgactatgaactcataatgcccatacctggtgcagaaggcggtcttctcaatatcctcctcacgaatcctcaattgatgataaccagagttcaaatcaattttggagaacacctgggcacccctcaactgctcaaagaggacctcaattcggggaagcggatatttattcttgattgtcacttgattcaaagcgcgataatccacacacagccgcttgcttttatccttcttctcaacaaacaatactggggaagcccatggagacctgctaggcctaatgaagcccttagccagcagatcatccaattgccgctttaattcaatctgctcctttggggccattcgatacggggccttatgaataggctgcgtacccgggatcagcttaatctcaaaagctgcatcgcgctccggaggaatgcctggaagctctgccggaaacacgtcagcaaagtcacacaccacccggatgtcctgcacccgcaaggcagcctcaccctccaccaccatggagaaaaagatccccgacttccttgaccggcgatcaggaagcaattgcgccaacaaggataacgtgaacttcggggaacttcccaagaataccacctccttacccgacggcgcctgcaataacactgtcttccagaagcaggatataaccgcgcgatactgggataaccagtccatacccaagataacatcgaatgcccccaaggaaatcaccaccagattggccgaaaagacctcatcagcaagaatgacggaacacccctgacaaactgaacagctactaatggagccattagcagaactgaccaaaattgggtgacccaacctctgcaccgaaagaccagcccgcgacacaaaatcctccgaaacaaacgaatagctagcgccagagtcaaaaagagcatgggctgcaaatgaatcaactgaaatcgtacctgtcaccacgtctccttgctccctgccatccgtagcgggtagcacataagctccagaaatacccgcagaagaggaagctcccggagtgaaattaacagaagaaccccactgagccaccggaggaggctggcgcggagctccaaactgagtcagcacaggggtagacggtgcaggagtaggcacaacctgatactgaggaaaaccttgcatcggcacgaactgagaagtcccaggcacataaagctgctgtggaggaagaggaactgaaaactgctgctcagcacttgacatcatattgatagtgccctgagaagaggaggaagttatcggctcccatctgagcttcccattgggattcctcctacacaccacatccttgtggtcctgactgcagatagaacacctgccactccactgacactctgcacggcgatgcgcatctccacagcggaaacacaccagccccaacccgggcttaggaacggcccgaaacctctgagtacttcctcctgaagtacctgagtcagaagatttgccacggtaaggatggtggcgctgatgctgagacttgcccctcttgtgagctggacctccagtgttgcccctcctcgtgtcctggctacgaggttgatcaacacccgaagacttctgcgactccatggtgtactggtgttgcatctccacacccagcgcctgctccactgtggtacggaagtccaccaacggaaaggcccccagagcatgcctgatagaaggcttcagaccctgacggaattggctcgccttctccatctcattataagccacatgagggacaaagcggaccattttgttgaagcccacctcatactctgtgacagacttcttctcctgcttgtaggactgcaagtcaatcttcattttctccagaaaggtgaccgggtagaatctcctttcgaactgcctgatgaaaacatcccatgataggactcctggtgaggaggagtgcgctgcctgcacgcctctccaccaaatctgcgcctcacccttcagcagctgagtgccaaagcgaacccgatcttcataagcaatctcgaagacattcatcttatcctccacataagtcagccaatctgccgcctcgaccggagtaccactgccatcaaaagaatccaacttcatgcccatccactgcatcagagaaagaccactgacaggaagaggcaccccggccccgccacctggagcagcacccgcagggacagcgcccccgggcactcctccacctccagctccctgagcagcactcgcagggacagcgccctcgggcactcccccaccacccgcaccctgagcagcacccacaggggcaacgggaatagcttgcctcagaatggccaactcctgctgcatggcctgcatcgcggctaacattgccgccggactcatcgagtccccactaggaacttgcgggctgccccgagccctacgaggcggcatagcgccggccacaggggtgagaataataagtaaataagattggcatagcatttcttcagataatgtcaaactagcacatacaattacataacatatcaatagtaaagtagaaatcccatcctacatgtgcagtgtgtcaatttattattactccacttgctaggacctacagcctattcctctgataccaactgtaacacccccactggtcgcacacattggatgttaccaaaaacccttcccactaaacttatgcaacacaagaggcgtaataaagaaaggaaatatagcaaaatccggcagcatctcctttgaaactaacataacaaggaggggaaaacatgaagttcatacatgatataaagacatataattcacatagtanaagctaaatgcataagtggtaac

SEQ ID NO: 1568 - DNA, 1964 bp, Zea mays
  misc_feature (4)..(4): n is a, c, g, or t
  misc_feature (8)..(8): n is a, c, g, or t
cagnagancttttgaaaaaaagcctggattgttgttggaactcctggaagattgtgggaacacatgtcgatgaacaatcaacacctagttgagctgcactcattgtcattcttcatcttggatgaggctgatagaatgatcgaacgaggccatttccgtgaattacaatctatcatggagatgcttccactgaccaatggttctgatgaacaagctgcaagaacaatgccaaactgtgagactgtaccaattttgcaaataaagaagcggcaaacctttgtgttctcagccacacttgcactctcatctaattttcggcggtgctggcggcgtggcctatctacttcgaaggcatcgacgcctgatgatgtcagctctattgaagcattgtcaaaacaagctggaatgaaatctaatgctgaaatagttgatttgacaaaggcttcaatcttgcctgagaagcttgaagaatcttttattgagtgcagtgaagaggataaggatgcctatctgtattatatattgagtgttcatggtcaaggtcgcacaataatattttgtacatcaatcgccgcattacgtcacatttcttccatactgcgcattcttggaattaatgtattgacaaaccatgctcaaatgcaacaaagagctcgcatgaaggctgtggatcgcttccgtgaaagtgaaaattccattttggtcgcaactgatggttttgcaaggggtatggattttgatgatgtgcgaacagttatccattatcagttgccacattcaactgatgtctatatccacagaagtggaaggacagcacgcaagtcattggctggctgcagcattgctttaatctctcctactgacaagtccaggttttattctctttgcaaatctttgtcaaaggagaatctccagcagtttcctgtagatcatgcttacatgtctggagtgatgaacagactctcacttgctcggcagattgacaagattgcccgtaaaacttcacaggaaaatgctaacaaatcctggcttcaaaggaatgctgaatctatgggattgattttggatgctagtgacagtgaagaagaccatgtgcagggacacaagaaacgaaaggctacttctgcacatctccaaaagcttcaacaggagttgagtgatctcttgcaatgcccattgcagcctaagactttttctcgacgctatttggctggggctggtgtctcgccattacttcagaagcaactagaagagttggccaagagaaacgcaagcaacaatagcagcaagagtaagaataaaggatctgggtttgttgttattggtcaggatcgtgtcgagcccttgcaagcacttcaaaattctgggcaagaggtctgtgtgaacatagacaaagaaagggaaaagcgaagagtctctgagaactggaggcggaagaagcatgaagaaaagaaacgtacacgagagcagaagcgaaaggataagagaaaagctaaagagatggcttgatgacacatgggatagctaggggccttcaaggggtttacggaagctctttaagctcgcgtcaatcctttcagaaaggaacggaatgcattcatcaatgtttttgctgtaatacaatgcgtgcgctaagttagcgcttgcctttaacagattggaggtggtagtttgattttgttttgcggctgaagaaaataaacttagaatgcacgagcactggctctggatgagaaaagaaattaagcagatagctcacgtataacctcattggatctgtaatatgtacgcctatcagatttaaggtacaaattaattttattagggatgggaatcgactgacctggcctatctttggacttggacctggcccattgccttaaggccaattttaggagtgatggagattatgatcttgctggctaaaaaaaaaaaaaaaaaaaaaaaaactcgaaacctcgtgc

SEQ ID NO: 1569 - DNA, 3230 bp, Zea mays
attgcgccaacaaggataacatgaacttcagggaacttcacaaaaataccaccgccttacccgacggcgcatgcaataacactgtcttccaaaaacaggatataaccgctcgatactgggataaccaatccatacccatgataacatcgaatgcccccaaggaaatcaccaccagattggccgaaaagacctcatcagcaagaatgacggaacacccctgacaaactgaacagctacgaatggagccattagcagaactaaccaaaattgggtgacccaacctctgcaccgaaagaccagcccgcgacacaaaatcctccgaaacaaacgaatagctagcgccacagtcaaaaagagcatgggccgcaaacgaatcaactgaaatcgtacctgtcaccacgtctccttgctccctgccatccgcagcgggtagcacataagctccagaaatacccgcagaagaggaagctcccggagtgaaattaacagaagaaccccactgagccaccgggtgaggcaggcgcggagctccaaactgagacggcataggagtagacggtgcaggagtaggcgcggcctgatactgaggaaaaccctgcatcggcacgaactgagaagtcccaggcacatagagctgctgcggaggaagaggaactgaaaactgctgctcagcacttgacatcatgttgatagtgccctgagaagaggaggaagtcaccggctcccatctgagcttcccattaggattcctcctacacaccacatccttgtggtcctgactgcagatagaacacctgccactccactggcactctgcacggcgatgcgcatcaccacagcggaaacacaccagccccagcccgggcttaggaacggcccgaaacctctgagtacttcctcccgaagtacccgagtcagaagatttgccacggtaaggatggtggcgctgatgctgagacttgcccctcttgtgggctggacctccagtgttgcccctcctcgcgtcctggctacgaggctgatcaacacccgaagacttctgcgactccatggtatactggtgttgcatctccacacccagtgcctgctccaccgtggtacggaagtccaccaacggaaaggcccccagtgcatgcctgatagaaggcttcagaccctgacggaactggctcgccttctccatctcattataagccacatgagggacaaagcggaccatcttgttgaagcccacctcatactctgtgacagacttcttctcctgcttgtaggactgcaagtcaatcttcattttctccagaaaggtgaccgggtagaatctcctttcaaactgcctgatgaaaacatcccaagataggactcctggtgaggaggagtgcgctgcctgcacgcctctccaccaaatttgagcctctcccttcagcagctgagtgccaaagcgaacccgatctccatatgcaatctcgaagacattcatcttatcctccacataagtcaaccaatctgccgcctcgaccggagtaccactgccatcaaaagaatccaacttcatgcccatccactgcatcagagaaagaccactgactggaagaggcacctcggccccgccacctggaacagcacccgcagggacagcgcccccgggcacttctccacctccagcaccctgagcagcacccgcagcggcgacaggaatggcttgcctcagaagggccaactcctgctgcatggcctgcatcgcggctaacattgccgccggactcatcgagtccccactaggagcttgcggactaccccgagccctacgaggcggcatagctgcagccacagggatgagaataataagtatatgagataagcatagcatctctctagataatgtcaaaactagctcagacaataacataatcatatcaatagtaaagcagaaaacccatcctacatgtgcagtgtgtcaatttattattactccacttgctaggacctacagcctattgctctgataccaactgtaacaccccactgatcccacacaatggatgttaccaaaaaaaaccttcctacaaaacttatgcaacacatagagaaagaaagtattgcagaatccggcagcacctcccttgaaagtagcataacaagggaaacatagagtttatacgggatataaaagaaagataattgacatagtataatcgaattgcaacggtagaaatgaacattcatgaccggacaatagatagacaactcagcccaccaaactaaacagttcaactaccatgaaaggttagaatgtaataatcctctagatttgaccctccctgtttaatatcattattaagcagtggttcctttatttaaaggtgtggtggccgtgctgctacatcccttctttcccaaagcaaagatcatgtgcctgcctcagacaatgcaagagtgagatgacacatctcagcaagtaaaaaaagagcaaacaacaattggacaatgtaaaccaaccgtgcataagcaaccacgtggttcccaacttatttcttaaatattaatttgcagcaagtaagcaagtaatcaattactcaatgccaagatgaatcacaaagtaaagatccacattatccacatcacaataataggttccacacttcccccatgaatgcacatggctacagatgcagtatgacttctgccttcatacctctaagtatatgaagctgcatcataccccttctcgggcaacatatgatgctcattgtaccggtatggtcggaccataagatcgcgacgaaacttcaatgcaatggatgatgaatgcattatgcatgtcaacaacatgagttcttcccaaataaaatgtgctagacatatacttccactcatttcacataataaaccacatgggtaacatgatcaaaccacaacctccacttgtataataaataaacatgattaacttcaaacaacggtacccaattaggaatatgaatacgaacacaaatagcacaaacataatcaagtataagactcttcaattaatagacggaataaccatcactgttttacttgccttcaccggaagtttgggcaaatccctaagtacgatccggaagtccaccacctgtttttgacacacaacttagtgcaccaatttcacacaatcaggctcataaacgacgccgcacctacgcacaatctcaaaccccgccgcgaataacatctctccccacaccgaccaa

SEQ ID NO: 1570 - DNA, 4131 bp, Zea mays
  misc_feature (2980)..(2980): n is a, c, g, or t
  misc_feature (3090)..(3090): n is a, c, g, or t
  misc_feature (3298)..(3298): n is a, c, g, or t
gatagagctgaacttgttaccatatttatattgatgtcaaaaccattttgtttgctttacctgtatggttgcatctcatgttatttggaagcaatagatgtcaacttgctttcggcctgcagctatactgagaaaatggccaaaacctgtataaacaacagtccccggtgtcctaaaatcttttgttgtgttttttcaggtacacaagagcagaagcgaaaggataagagaaaagctaaagagatggcttgatgacacatgagatagctaggggccttcaaggggtttacggaagctctttaagctcgcgtcaatcctttcagaaaggaaaggaatgcattcatcaatgtttttgctgtaatacaatgcgtgcgctaagttagcgcttgcctttaacagattggaggtggtagtttgattttgttttgcggctgaagaaaataaacttagaatgcacgagcactggctctggatgagaaaagaaattaagcagatagctcacgtataacctcattggatctgtaatatgtacgcctatcagatttaaggtacaaattaattttattagggatgggaatcgactgacctggcctatctttggacttggacctggcccattgccttaaggccaattttaggagtgatggagattatgatcttgctggctatcatgggtttggcctagatatttttctgctataatgcatggacatgaatcctatcaatatttctataaagtattgcgataacagattaaaattattaacaatgcagcaattttcataaaattttgagtgaacgataatttaaattttatcaatttttacttccaaaatatgttatttctatacctaatctaaagggcaagcctgtacaatgggtatagctgtcccattaaatcacgagatctcaggtttgaaacatcaaaggaaaatcggaacatcggatatactaggcctattcctctttagatgtatttgaaagtatttggatcaattgtttagccttcaaggggttacggatcctacgcatgcacgtcgatcgatcaatccctgagcgctagcgttgcgtgcctcgatctgttctcagtcctcaagcgcctccgtctcccaactctccatctcgacgggagacatggctcgggcgtgaaaacagcccataattttggcggcggcccacgccgatgaggccttggacgcgcccgcggcccccgccgggatctagttgtgaagagtctgttatttatccagagagagagttcaggaagcgggtttgtttcctagatggatagattagatggagaaagcatcgtgtttgtttagattagatggagaaagcactgggtgtatatatacccaggatttcctcctcctgtttccctgttttttcatctgaactgaacgttcctgttcatcttcaagccctcaccggcttgttgaactcagtcgatcctgcatctttctccaacaccgccgcacgcgaaaatggcagaatccgtcctccgaccccgacacaccgaggcggcggacgccgatgaggatatgttggacgcgctggaagccttgtcacgccgaatggcagaattcgtcctccaggacacggaggccgatgaggctgccctggacgcaccggaagccgtcgcacgcagagcggcggaatacgtcctccaggacacggacgcggcggatacccaagcatcggaggacaacttcttcttcgaactcgcggaaaccttcatgcaggagacggaggcggaggaagccgccgtggaagctatggtgttcaatgcggcggaggaagcgggtgaagccgcctcggaagcactgaaagccgccgtggaagctaataagctatagtgttcaatgcggccgaggaagcggttgaagccgcccgtggcgacaccctcctcgacgccgccgtgctcagctagaaggggactgagctgcagtaccgaggaagggctcgttcggttacgagtgaattgaagggattaaatcccttcctagttaaaaatgaataaaagggattttaatctctcacaaaaaaaaaaaaaaaacgtcggattgcacctgaaatcgttccagctaatcaaagtttatataaattagagaaacaatccggttaagaatcgttccgacctatcaattcggtacaaacgaacaagacctcaatccccttcgatccaaatgcaaccgaccaagaccgaaatggataagttaacacgccgttgctgaactcaactgtttggaagtctgctacccgatcaatagtttttcctccttttttctttgttttttttggcaaggtgaggggttgttgagaggctagaagttcatcccttccatgtctacctgtattgcagtttacatgggaagttgtttaaattcggttttcagtaaaaaaaaatgacgagctaaagtctccatctcctctgaaatgctgatctgctcgaaaaaaatgacgagctaaagaagcctataaactgtaaagggcgtgtgcgaaaggctgatccgctcgaggtcgcactgggacatagtacaaatgtacaatgcaatagtgtctcgcatgctgccatggcggaagccaccacgccgccgtcgtctttgaaagccgccgcctccaggccgccatgccgtcgtctcgtcgtctctgaaagtctctcatacaggcaatggcggtgctgaggcttcgattttggcccgactccgccaccgagtttaatgtacttttgtgtgttcatcattttttttctttgttgctgcagttgagatcaggaatgcggggctcgcttagagcaactcctacaggttgctaaaatattgttgccaaaaacgtcattattttggtggatgctaattttttttaaaacctccaaagccacagcagaacgctaaatgatcaccttttaaattttcaaatagcctacgtgggcctgtgcacacacacgggcctggtttgcagtccattttctgttcgtgcnattatttttttttttgccgtgcgcctacaccggtatgtcaagcgccaccatacttcagcggccagcggggcaattccctatgtgccaccagaaaatatactcattctcantggtctcacatattatgcacacaaaaaattacctatatatcactcagtggcacacaaagaatgcatataaaatttggtggcatacagggtttcctacttcagcaccttggagatacgaagagagtagttgtgcatctgtagtttttttacttttccaagtatttcaacggcctgttagtcatatcgtaatgagccgacgaagcctgtnaatgcaattggtgctatattcaccgtcagatggtgatgactatgaattcgttctctctaatactcatgtgactatgaatgtgaatgcgtcaaatagcgaaacaaaacatcgtgactactttagcgagatagacaagcaggacattggaggtacgtgtgggcattattattttcgaccgtatgtcacactattgattttatttttatccgtattttgaaatattaatagtacatgtatgctttattatttttcacatgcaggtttcgaatgagacattcactatttgtacgtatttggaaagccatagaacaacatgatcattactttgttcagaaaaagaactcagctagaactctagacctttttagtctgcaaaaaattattgcaacattttggatgttatcttatggagtagttgctgatgctattgatgattatgttcgtataggtgagagtactacaattgagagtctacagagatttgttcgtgctgttgtcgaggccgaaaagatctttggatttggcatgttttctttggaatgcctgattcacacaatgatatcaacatgttgtatcgaatgtctttatttgcacgcctagcagatggtcaagctctaatggtgaattatactataaataacaacgagtacacaatgagttagtatcttgccgatggtatatatccctcttgggctacttttgtgaagacaattccgttaccacaaggtaacgagaagaaatatttttgctattgtacaagaagcttgtagaaaagggtgtcgaacgagcgtttggagttctacaatcaagatttgcaattgttaggggtccaa

SEQ ID NO: 1571 - DNA, 527 bp, Zea mays
  misc_feature (491)..(491): n is a, c, g, or t
  misc_feature (500)..(500): n is a, c, g, or t
gcgtggtcccggccgaggtacgcggggggcggctgaaagcctgcaaccaaacaggccctctcgattagcgaaaaaaaagcccagcgaaaacaaaaccctcgcatctttcctttcctccccaactgcggccgcctccacccgctccaccgccgatggccgagcctgagcctccgccgcaggtgtcgtctgaacctacccctcccccgcaggaaggcagcggaaggactaagaaaaagaacaagaagaatcgttccaagaagcaaccgaagcgagccgccgctgacaccgacgggttatcctcaggcgccagccccatggctgaggaccctttcttcgtcctcgccggcggaaaggaaggagggtttctggatttggaggagatcgatgaggcagacttcggcatcttcggaggcgtcttggatgacgtaggacagagcgtcctggaagctgggaaggatcatgggaagaagaagaagaaaacaaagaagcgnaacgtgggngggtgatggcgagggctttcagtggcg

SEQ ID NO: 1572 - DNA, 2557 bp, Zea mays
  misc_feature (199)..(199): n is a, c, g, or t
ttttgtagctaaaaagctgctaaagtttatctcgcgagattggaacagggcctaaacgcatagccccatatagaaagaaacattccatgacattcgtgctctgcttggcatcgatttcagggttcagggggacgacgacgtgacgatcaaggtgctcttctgcggcatctgccacaccgacctccacatcatcaagaangagtggggcaatgccatgtaccctgtcgtccccgggtaccacactgcacatacttctcatagcctaatcatctaacgcctagatcgatttctaatcgtcttacggcgccgtacgtgtcaacgcaggcacgaggtcgtcggcgtcgtcacggacgtcggccatggcgtcagcaagttcaaggccggggacacggtgggcgtgggcttcttcgtcgactcctgccgctcctgcgagagctgcagcacggggcacgagaactactgccccgacctcgtactctcctccaacggcgtggaccaccaccaccacgacggcggcgcgagcgcgagcgcgaccaccaaggggggcttctccgacgtgctggtcgtcagccaggacttcgtggtccgggtgccagagagcctgcctccggacggcgccgcgccgctgctctgcgccggagtcacggtgtacagcccgatggtgcagtacgcgctcaacgggccgggcaagcacctcggcgtcgtcggcctcgggggcctaggccatctggccgtcaagtttgggaaggcgttcggcatgacggtcaccgtcatcagctcgtcgcctgccaagcgcgaggaggcgctcggacgccttggcgccgacgcgttcttggtgagccacgacgcctcgcaaatgaaggtaactaaacacacacagcttgacagctagctatagcccaaggccacatcctcctgtgaagtgtgaaccaaacctggtacctgatgccatactgtctttgtttggacgcaggctgcagccgccacgatggacggcatcatcgacacggtctcggcggggcaccagatcgtgccgctgctggcgctgctgaagcccatggggcagatggtggtggtcggcgcgccgagcacgccgctggagctgccggcgtacgccatcatcacgggcgggaagcgggtggccgggaacggcgtcgggagtgtcgcggactgccaggcgatgctggacttcgcggcggagcatggcgtcaccgctgacaccgaggtcgtgccgatggactacgtcaacaccgccatcgagcggctggagaagaacgatgtcaggtaccgcttcgtcgtcgacgtcgcgggcagccagatggataccgttgcttagaagcctggatgcgtggttcgatcgagtcatgtagcagccgtcgttgtgcgtggtgtgaaattgtttgctcgtgccgtctatttgttggtgggtgtgggtcaataaactaggcagaacaattgggccgtatgcatgcatggtctgcacttcctgccattcgttgaatccttatgtacctttgaattttaaatttgactgagaaagtggatgctgaaacaccgtaggtgtatacacttgtttgtacgagcgcttccgacattctaagccttttgagattgatcaaatcactgtacacctcccactgtctttatacgctctgcacgccttcgggaaagattcaaatgtcggatcacattgactggcttgtgcttggagacttcaatctataccgtactccacacgatagaaacagagctggtgctgactttttcagagatgtttatattcaatgatgctaccttttaaaaggtaaacgttttacttggacaatcgagaagtagccgcctctgttggagagacttcattggttttttacctcaaccagtggcagttggactccccaccatcgtcgcgtgtcaccacttcctactcaccacatttaaatggtaaaaagctaaaactattcacaaataaggattaaacaatcatttgcctccaaatccacaatcacacccacttatcaaacagagtacatatgtctttgtcttttatgctctatatacttaaatgagcataaatgaaaatcatatcaacataggggcacctaacaagtattaatacatatgtcactactctcacgatgcaaatatcagatcatgtcccatgtctgagtaacatcactactcatatttcaaagagacactttcatctttgaaaactattggttgaaacgtgaggacttcatgcaacatgtcaatttgggcaggcatattggaagacaacacctagatgctactaaaaatcttcctgcaaataaagtttaaaaacttgagaagagtactgaaagaatggaagaaaaccctttcaaatttgaaagagaattttgccaatgttaagctcattctatctctattgaatttcctacaagagttctgagatttcactccggttgagtgaaattttagatctttaatggagaattagcttgtttcacttcctcaggtgtagcacccactttgtaatttgctagaaagaatgccaatagaggaaacaatttctcct

SEQ ID NO: 1573 - DNA, 3439 bp, Zea mays
  misc_feature (69)..(69): n is a, c, g, or t
  misc_feature (485)..(485): n is a, c, g, or t
tttagggggggcaaaagccaaagccaaaagtcaaaccaaacacaccctaaaccctcgcgtgctctcgtntgttgatccaccagactcgtagcaagcaaaacgcttaggtctctcctctctttaggatttagggtgtgtgcaatccgccactcggccggggagatttcctctccgacatagatatatagaatggtggcagagaacatgggaatggactgtacgcagggaggaaggaatcggaaaggcagaacagagaatgggcagaacgtgaaatggtagactactattatagtcttaataagtagtagagatatactgctgtaaagaagaagaaatgatgaataacgcccaaccgtgattcttctttcttctagtgcgtctgcctttgttgtatgattcttcgagttctttttattgcaggtgcaaggtgcaggtgaggtcgtcggggccgcggcgctgtgtgcggccagcgatgaagcagcggntgccgtcccacgccgtcgctgtccacgccctcctgtgtgtgtaggcctgccttgcaatttgcaaattgtatacaaaaacagattgcaaaggctaacgttttggtcggcttccttcacttgttggctagtacgtatgattctccatgccatgatccacctctttctgattgctgttgctccatactcatcagggtggtgactggtttgtggctatcattgttcattgatcgatcaagggcttattagttagcatactaaatagtggactagtgacacaactagagacagctagatgagctcacacaggaaaaggaaaaataaagcaccccaactgaaccacttctctgtccgtgtctaccgactgatgagtgagggccacaactttatttccagagctatactatagtcatgtatatgtatatagtccatttaaatacacacacatagataattcgcttttatgaaaacataaggctggccccaatgataatcctatcttatcaccgtacctgttatggttaacatatgttcttcctaacacccatgttgatgtactatcagaatttctcattatataataatcaatccccttctgccatgccatgtcgtgggtggctgatgaggccacagaccaacaatctaagccacatatatagatacaaccatagctgccatccactaaattaagaaaagcaaacaaaaattaaaccatatcatcatcatgcatccatccaccgccaatctaatctttgctaagtaggtttgcggcccgctatacattgcgtcctcgaggccggccgggccgggacactcacacagccatctctcccagtgtcccagctcagcttagcaatccgtctctctatctacaggcgggggaattaatagatggagggcaaggaggaggacgttcgcctgggcgccaaccgctactcggagcgccagccaatcggcacggcggcgcagggcacggaggagaaggactacaaggagcctccgccggcgccgctgttcgaggcggaggagctgacgtcgtggtccttctaccgggccgggatcgccgagttcgtggccaccttcctgttcctgtacatcagcatcctgactgtgatgggcgtgagcaagtcgtccagcaagtgcgccaccgtgggcatccagggcatcgcgtggtccttcggcggcatgatcttcgcgctggtgtactgcacggcgggcatctccggcggccacatcaacccggccgtcaccttcggcctcttcctggcgcggaagctgtcgctcacgcgcgcgctcttctacatggtcatgcagtgcctgggcgccatctgcggcgccggcgtcgtcaagggcttccaggagggcctctacatgggcgccggcggcggcgccaacgccgtcaaccccgggtacaccaagggcgacgggctcggggcggagatcgtcggcaccttcgtgctcgtctacaccgtcttctccgccaccgacgccaagcgcagcgcccgcgactcccacgtgcccatcctcgcgccgctccccataggcttcgccgtcttcctcgtgcacctggcgaccatccccatcaccggcaccggcatcaaccccgcgcgcagcctcggcgccgccatcgtctacaacaggtcccacgcatggaacgaccactggatcttctgggtctggcccttcaaccccgcgcgcagcctcggcgccgccatcgtctacaacaggtcccacgcatggaacgaccactggatcttctgggttggccccttcatcggtgctgctcttgccgccatctaccacgtggtcatcatcagggccctccccttcaagagccgtgactgattatacgtacattgtttattaccaacagcaaccatgcagcatacgaatcatcgttattaagctatatatgtataatatccagcatgtcttgttaattactagtatatgtgctagtaagtggtgcgtgctcgctcttccatcgctgtcgtcgtctcatctgctattgttcgtcatatatatatgtccatgtgagctagctagtgtgtatcacgcgcggaggccagttcagctagccatcagtctgcaatgcactttgtgacttctctgtttagtcctctctcgcttgggttttggtacggtgaagtatataaactaagcatgcatatgtgtaaaaattcaaattcaagtgtatgcatgcatgccaataatgaaagttaagaagaagactccctgtttatgataagatgttgttgtaccgatttatttgatgtgtccaaacgttgtgactttggttcaaatttagtcgtaacattaaaaaaaaatcaaagttagtgacgtacggcagctatgcatgtatacctggaatttgtcaaatggttcgacctcttttgtcggggagggggagggagcgataaataactatatatatatttcttcttttaatagtggataaggtcggcggataacataaaatagctcatcgtcaaccaaatgcatgacgccatgagtaataagcaatgctatcattttctctctctctctctctctctctctttctcaatgctatcgggactgccggactggctctaaaaatactaccgaccatgcattctagaaattttatttgtaaatgatgactttattatgcaggatcgggattatacgaatagtatatatatagtttatatagaactattgacgaaaagaaagagtcagtgagaggtctctttcagagtagggaatggcaatggctctgctccactatagcgtgtgtgtttttgctttggcggcacgccggcacttatcatatgcgacaaatattatacagatccgtttgctacagctcaacttatcagttaaatagttttattggacaagctatttttcgaataactctgctgctggtagggttgaaccttgtgagggtcgaggcacaccagaagcgaccaaaa

SEQ ID NO: 1574 - DNA, 1101 bp, Zea mays
  misc_feature (1081)..(1081): n is a, c, g, or t
  misc_feature (1086)..(1086): n is a, c, g, or t
aaaaccacctcacgagcccaaccaaattcaaaccaacgctaccgtgcaaccaaaccaaccaaccccattcctccgccggccgccggcagccgcccgcgatgtcgaaggccgcggcagcgtccctcccgccgccgccgccagaggtggcgcaccttgtggagcagctccagcgccaccacctcgccccggacgcgtccctcctctccagctccgcgcactccgacctcctccaggcgcgcgaggaggtcgcggcggagcgcgcgctgtacctcgaggcactggcggtgtacgcggaggcggtggccatggtggaggagtaccatgcggctgccggcgccggcaagaagctcaactgctccccgcaggtgtacgagtctttggagcaccggttggccgtggcagaggcagcacagaggcttaggctcccactgctctctcaggacggggaggtccatgagcaggagatcgaaaagctgagcacctattcaagaagttcattcgatagcaccctcacaagcgcgacacccagctcaagttcaatctcgacgagttacaacaattatagcagcagcgctagtgcggtgactgttgctgctccacattggagtggtagttctgatgcagttgaacctggagttggtggtgttcctgaccgttttcttgggatcacttctgattatctctaccaagtgcaacaagagcagccagccatgtctgttgacatggttgattatcagagaactttggctagggagattgaagcccggttagaagccaagtgtgatgctttggctgatctatttgctatggatgaaagggattcgtcatccctcagtcaaatttcaagtgctaggcttccagaaagggtaaaattaatcatcgaagagatagagaaggaagaggcacatctcctggaggaccttgcttcaatggacagaaaatttgctgaacattataatgtcttggagcaaattcttgctgtgcttatacagtttgttaaagacaagaaattggagcatcagcaccaatttgatgatctgaagaagacctggcttatcaaaaggtgtcggacaatgaatgntaaantaagctatctggagc

SEQ ID NO: 1575 - DNA, 1288 bp, Zea mays
cctcgaggccggccgggccggggctggcgaagaattcgccgcaaaaactcaacgcggtccattggctaagttggctctgatgtccctatcggccaccaaccgaccatgagataggagtacacaagatgggcgtgagatgagccggccggggaggaccctcatcctcctcctcctgctgctctggcctctggagtcgccgcccctcccaagaacaccaggctctaatttaatttaagcggagggaagcttgatcgatcagtctgacactgccctcgttaagttatagcaaatgcctcccgcttcgacggatgcaaacaacgcgatccagaagctgtacgaggtctgcagagcctcactgtccgagaaggggcctctatctcctcctgactactctctcgacaacgtccgtgctgcgttagacatggttaccccgtccgacgtcggccttgaacgcgaggctggagctgtgcgtgcttggaggagcccacgggcggccctgggtcggaagaggattttccattccagcccagccatcagatatcgccatatatacgagtgcgcaagcttctcgattgggatgttttgcatgccggcatcatccatcatcccgctccacaaccatcctggaatgaccgtgctcggcaaggttttgtacggcgcggcgcacgtcagatcgtaccgctggattgaatcagccggatcgtccattaacctgtcgaaagcgaggccagccaaggttgtaagggacggcgagatgtccgcgccgtgcggagcgatggttcttcgtccggaggaaggcggcgacgtccacgccttgagagccatcactccctgcgccgtcctccacatcctgacgcccccgtactcctcgcaggacgggaggcactgctcctacttccggagacgcccaagatcacacccatcgggcgttttattgaaccgaacaggggggtctgagttcgtgtggctggaagaataccagccacgtcacaacttcatcattagaagggacctgtacacaggacccgctttaaagttatgatgacatcatgacaaacaggggggataattatatatatacgcttcccctttggcttcttattaagttatatcgatggacaagcacttagctatatgtgcttggcacttttttatttatatggtagtattaaaaagacagttgattatcctacgtacagggccgcctgctgtatgtattattctaagataatgttattgtacatctgatgatgtcacccactgacagaatgttatttatataataatt

SEQ ID NO: 1576 - DNA, 1692 bp, Zea mays
gccggccgttccgggacgtccgacagcctcgcggtggtggccggcctcattgtcgctgcagcgttcgccgccgggttcaacttgcccggtgggtacggagacgacggcaaggcgaacctcaagcacgagattgtcttcaagaccttcctgttcttgaacaccggggccgtggcgacgtccatgctggcggtggcgctgctcgtctatgggaaggcgtcttcgcactccgacggctcgtggaagaccttcgcggcggcgctgcacctgctgtgggtgtcgctcgtctgcatgatgctggcctttcaggcggctctgttttccgtggcgacaacaagggcactaacttacgggttcctagttgtatacatgtgcatctttatcttgcaggtgcgtatcgcgaagtggctgcggcctgacacgaggttgcgcacgatttggaggtttcactggaaagggaggcatgtcgacatcaatcggcaccctccgggccccccgggtttcgtagtcaatgtatatctgtttacagctctaagtttgctagtgcctattggttttgaagtcatgtttctattaggtgggagatccatcgatacttcctcttaggatgtaatcggatcgaaaacaaaacagacggatatttcttgaaaaaaaaaaaaatgacggatgcaaacaatgcgatccggaagctgtacgacgtctgcagagcctcactgtccgagaaggggcctctatctcctcgtgactctctcgacaacgtccgtgctgcgttagacatggttaccccgtccgacgtcggccttgaacgcgaggctggagctgtgcgtgcttggaggagcccacgggcggccctgggtcggaagaggattttccattccagcccagccatcagatatcgccatatatacgagtgcgcaagcttctcgattgggatgttttgcatgccggcatcatccatcatcccgctccacaaccatcctggaatgaccgtgctcggcaaggttttgtacggcgcggcgcacgtcagatcgtaccgctggattgaatcagccggatcgtccattaacctgtcgaaagcgaggccagccaaggttgtaagggacggcgagatgtccgcgccgtgcggagcgatggttcttcgtccggaggaaggcggcgacgtccacgccttgagagccatcactccctgcgccgtcctccacatcctgacgcccccgtactcctcgcaggacgggaggcactgctcctacttccggagacgcccaagatcacacccatcgggcgttttattgaaccgaacaggggggtctgagttcgtgtggctggaagaataccagccacgtcacaacttcatcattagaagggacctgtacacaggacccgctttaaagttatgatgacatcatgacaaacaggggggataattatatatatacgcttcccctttggcttcttattaagttatatcgatggacaagcacttagctatatgtgcttggcacttttttatttatatggtagtattaaaaagacagttgattatcctacgtacagggccgcctgctgtatgtattattctaagataatgttattgtacatctgatgatgtcacccactgacagaatgttatttatataataattatatgaaaagcaaaaaaaaaaaaaaaaaaggcccctaggtgtttttgagccc

SEQ ID NO: 1577 - DNA, 799 bp, Zea mays
attcaattacttgccaatacgagggtgtccagaaggccttgcaaatactcccttgtacatgtgatttgtttttgggaactccaaatcaagcggcgatcatggagacagcacaacattatgaactgcagtacacctatcacctgtaaggttcacttctgatagaaggggatgttgcaccaatagacgatgctctagatcttctcaaatactgcagtctgatagtccatacagaaggtcccaacaccttttagaactccagcagcagaattgaatccataattgggatctgagaccccatttgttcccttgccacgcaatttgttgggaacgaatctaagctaaattacgggaataggagcaaattggagtcattctgcaacaacaataagtgttgttaggggcatcacttattgatccatgtcaagaacttctgatagatttagccatccacgggaaacaaattgtgctggttttgtcttgtgaatgcattctatggatagagaattttctccttgttctgggaaccgctcaaaggcaccaccgtgcttgggggatggtttcacacgctgccgcttttgtcccaagctgaacgacagcttctccctattctcccggcacgcctctcttgccattaccgtccatcaccgttaccacttgccctgtgtccttctcgtcatccgctgccacctggcagcgaacgcgcaaccgttcctcccacccctccgggaagcagggaagccaatgtggaacgtggttcagcggcggctgcctccccgccggaagagcggagtatctgcgc

SEQ ID NO: 1578 - DNA, 1841 bp, Zea mays
gcccgttttttagcatgaagtattatttacagttttaacttatgttagctgttttgccaggttttccctacgggggtataacattacaaatttgaacagggggagaaggctttcgaatttttttttttttttttgacagaactgaattgcgtgtttgcattttatctttgaacttgcgacattatgctttcaatgacaaaacacatcttggtatcttcttcctctactgcaacatgtttgtcagcccggcagcgtcccccagaccaggggcagaaaatcgacgggctgggttgctgtctggtcaggcagcactgccttgaccagacagccaaacaaggcagtctttgtgatctctccctgaagctctgcaataggtacagagttccaagtaactgccagcaaagcaagagccattcaattacttgccaatacgagggtgtccagaaggccttgcaaatactcccttgtacatgtgatttgtttttgggaactccaaatcaagcggcgatcatggagacagcacaacattatgaactgcagtacacctatcacctgtaaggttcacttctgatagaatgtgatgttgcaccaatagacgatgctctagatcttctcaaatactgcagtctgatagtccatacagaaggtcccaacaccttttagaactccagcagcagaattgaatccataattgtgatctgagaccccatttgttcccttgccacgcaatttgttgggaacgaatctaagctaaattactggaataggagcaaattggagtcattctgcaacaacaataagtgttgttagtggcatcacttattgatccatgtcaagaacttctgatagatttagccatccacgggaaacaaattgtgctggttttgtcttgtgaatgcctaaaggccaacacagaactacagaaggagtatagcttattgctctagtgcttcagagtttttccatgccaaggggccactaacttaattttaagctgaagagggtgcattctatggaccaatgactaaatttgaagctgaagagatacattctatggatagagaattttctccttgttctgtgaaccgctcaaaggcaccaccgtgcttgtgggatggtttcacacgctgccgcttttgtcccaagctgaacgacagcttctccctattctccggcacgcctctcttgccattaccgtccatcaccgttaccacttgccctgtgtccttctcgtcatccgctgccacctggcagcgaacgcgcaaccgttcctcccacccctccgggaagcagggaagccaatgtggaacgtggttcagcggcggctgcctccccgccgccgcgaagctctcccacccgtcgacggagccgcaacccggatccctcctcggcaggggcttcgggaacgggacctccctcaccgcagcgacgaactgggcgagctccgcgagcgcgccggaacagagcaacggccgcgtggggtcggccgcgccggggaagccgccgagcgcgtgatcctcgagcgcgaggacggcgtcggtgacgttgggctccgtgcggccgcgggcctcggcgaaagctgcggcggcgtggcccagggacgcgatgtagcggccagcgatgtcggagagggcgcggagcgcggcaggttcagcggcggagtagccggaagagcggagtatctgcgcggtggagacggtggagattgcggcctgtaagtggcgtgggacggcacgggggtgcttcgccggagttcccatacatggcgccgagccgccgacggtgaggaaaggcctaaaaccctagcggttggatccttcgaatcgagggttttatgctat

SEQ ID NO: 1579 - DNA, 3111 bp, Zea mays
ggcggtgggagtcgcacatatggtaagttccgttgccgcccgccgccctttcctttctcgaggagctcgaggagagagacggagcaggtagcagcagctcagctcgcgaggggaggccgggaggggggggggggggggtgttctctattggattggattcctcttgttttgggcatttctcgcctctgctgcttttgcctttcatagcaacatcttatcaaagtttattcttacgagctgttaccatgccatgctccctctctctctctcttgctctgtctgtgtgtcccctctctctctctcctcctcctctctctctctcactcccccatgccctctgcttgtgcttgtgcaatgcagggattgcggcaagcaggtctatttgggtaagtttcgttcatgtccatgcatacacatccgtacttgggagagaggtgggtgactgccccaatccgaggcgttttcggttctggatccctcacaaatggcttggcttgtggacgacttgcaggcgggtttgacaccgctcatgcggcggctcggtaattaaagcctctttctctctctctgtcttcgattcccattggctctctaccctgactccatgccaagttctccgccaatagcagcgggtctcgccgccgaattgtaataatccggctgtctgcttttccctaccaacctcagggcgtacgatcgggcggcgatcaagttccgcggcgtggaggccgacatcaatttcagtctggaggattaccaggacgacatgaagcaggtgatttatactcctatacggagcatgtagcgagaaagatacatgtaattttttctttccttcgtctaccagcagatgggccacctgagcaaggaggagttcgttcacgtgctccggcggcagagcacggggttcccccggggcagctccaagtacagaggcgtgacgctccacaagtgcgggaggtgggaggcgcgcatgggccagttcctcggcaagaagtatgccgtcgtcctcgtccgtccatctcccttctcgccttccttccttccttccttccttccttcttcccacaaccactgctttcctcttttcctcccagtccctgcatcggcatcggcatcgccccttttctttccttgtcgttgcgcatctcattgttcatggctgtcacttccggtctgtgtcactgcaggtacgtctacttgggcctgttcgacaccgaggaggaagccgccaggtaaaataattggaccgcactgtgtgcccgcgaggcgtttctcggagcaccgccacccccctctgggccgcgaaactgactgatggatggatgccccgtgtctgtgggattgtcgggtcgtgtgtgtgtgtgtgtgtgtgcagggcgtacgaccgcgcggccatcaagtgcaacggcaaggacgcggtgacaaacttcgatcccagcatttacgccgaggagctcgagccggcgggttcgtctatcccccgcccgcgatctccgccacgatcgcgccccctcgtcgctgtgcggcgatttcgctacaggctacagcctatacaggcaagctctgacggtccgctgtttcgccgtgcagcgtcgacgggcggcggtggcgatgaccacaatcacaacctggacctgtcgctggggagctcggcggggaacaaaaggggcagccttgacgacggcggcggcggaggaggcggcggcgacgacgagacctcggaccagcgcgtccccatggcgttcgacgtcgactggcagacggccgcgccccggagcacgaaagcaaaggtacccgttcggttcggtctcgcgttccgcatcaacgaggcgtgtcttgtaaaatgttgcctaataaagcaagctttgtcacgtttcaaccaccgggtacggtggccggcgcagctggacgcgagctccaagcaaccccagacccagatgctgcctcctccgcctcctgctgtcttgcgagtcgcccaccagctgccgttgccgttcggtcccaggcatccgcaagtgggtatccgcatcggatttccttcatgtgttccctcccttgctaggcgccgcgcgagctgggtggcttgctgacgccttgttttgtttggtgtgcaaatcgcggcagtcgcagttcctgagcaacggcggcgatccggggacctcgggaggcctgtccctcgcgatcggcggcgcgggcggcgggcactggcctccccagctgcagcacctgcagcagcagaggctgcacggcgcctgggccaacggcggcggcacgagctggccgcctccgccgcacccgcacccgcacccgcacccgccgccaccgagcaccgccgcggccccagcggctgcctcgtcgccggccccgccctacgttgctactacgacgcaaggcccggcaggctgggctcagaagaatgggttccattcgctggccaggccaacctagtatgccaagaaccacgactggccggagcgttcattcgtcgtcgatcgtcgacccagggcaaacgacacctccaaccactgcacgacgacgttttaatttaccggatgccattctctctctcccctccccccttcccttctcccttctcccttctcccttctctgtgttcttgattgggtgagacatggatccgaggatggatggacggcctgtacctgaggagttcccgggaagaagacgagtgagtgagtgagtgattggtagggtaggcgactaggcgtcgcgtcaggcagtacgtccttttggcgccttttttcttctttcactcaccattggcgaccaccaatgaatgatgacactgactggggtgtcaacatcgcagctggttttgtttggtctcatgttgcatcactcgctgctccacgatgccttgctatggttggggggagatttgctccatccaccccacgccggtcaggcgacagagcctccgctgcgtcgtctcatccgtctggtgagttgccactgtcttagaatctgagtggtacggtacgtgtggatctcgcgcgcgtgtaaacctagtattatgtactacaaactgtcatcatcggagatcactcgaataagatatcgatcttgagattaaaaaaaaaaaaaaaa

SEQ ID NO: 1580 - DNA, 1966 bp, Zea mays
cattgggtacctcgaggccggccgcgatcttttatcgagtccaggccagcgaccgcgtttccgccttctcctccccttccacctccgatggccacaacggcgacaacgatggcgccggtgacggcgccggtggccacagccaacctcgaacctacaccaacacctctgcatccacgtcctgccgcgccacctcatctccgggcgctttccaccttggcccccgtcaagtcagaggctcctcccaccccctcgtcttctaccgccatcaccgccgcagccggagcggaggatccatcctacatcatcaccgtccctagttattcagcgtggttctcgttcgactccatccacgacacggagcgccgcctcctgccggagttcttcgtgggggaggccgccgcggcgtcagggtgccggggcccgcacgcgtacaagtactaccgcgactccctgatacggaggttccgggcgcggccgggtcgacggctcacgctcacggaggctcggaggggccttgttggcgacgtcggctcagtccgccgcgtcttcgatttccttgaggaatgggggcttatcaactacggtgctttgccatcggggtcaaagcaagctaaagagaagagggaagaggctgcacaacagtcctcgttgccttctggggcaattgcacccaggaagctctgtaccggttgccgcaccgtgtgtgggcttgcttactacgcctgcgacaaggcagatataagtctttgtgctagatgctatgtaaataataactaccggccgggcctgtctcctgctaacttcaagagagttgaaattactgaagatgcaaaaccagattggacagacaaagaaactcttcacttgcttgaggctgtcttgcattatggggaagactggaaaaaggtgtctgaacatgttagtagtcggtcagaaaaagattgtattgcaagatttataaggctaccttttggagaacagttcatgggacacaaggaggatagaatgaggtttgagaatactgatgacaatactgatgagcctggagcaaatgtctcaaaacgactacgtctcactccactagcagatgcaagcaatccgattatggctcaggttgcatttttatcagccattgtgggttccgatgttgcctcagctgcagcgcaagcagctatttctgcccaatcccgtgttgaccttaatgacggcgagattgaaacttcaataaatagcattaagcaagaagaatcatctcacacaaatgggctctcagccaacgtgttactgaaagaggcagctgctaatgcacgggcacaactcgagaaggaaaggaacagcatagagcaatctttatcaaacatagtagacgtccagatgaaggaaatccaagataaaatatgccggtttgagcagaaggagatgctgatggagaaagagcggcagcagctccattttctaagggatctacttttcacagaccaattggcagtcatgcagcatcaacaaaggagtccagctgtagccacagagtgcaagggtgatgagaagccaaagcccgtggctagcatgagttgatacgagtagatcctcagcgtagcatggtttcacttcagatgtagcattggagccgcgttcatccgcatctgccgttggtaggattggaactaatttaatatactacatataggccctggttctctattggatggtgtttctgttaaatttggcgtcccctttcccttcttgcaccacagatgcctggagtgcaagggaagttatgatgacgactaccgattaccacatgcttcactgcttgtgcgctaacacgttgatatctttgccagtggcgcaaaaaaaaaaaaaaaattgaccaaaacatccacgcaaagctccggtagattcgatggtgactagcaaggaaatacatactctctgttaatttatattttatttgattttttgccct

SEQ ID NO: 1581 - DNA, 1240 bp, Zea mays
gccggccgggctccgaaaaaactcagaacatgtactagctaattaattaagcaaccgagctctcctacccagttcagcgaattcaccgacgccgacgacgatgaccctgacggccttgggtcttggactagcactcctcgctgcggccagcccgtgcttggggttggggagcagcggcagcggcagcggcggcgcgtccgtgcctagcgtcgtcaccgaggcgttcttcgacggcatcaggtcccacgcacgggacggatgcgagggcaagaatttctacacgcggagcgcgttcgtgagcgccgccggcgcgttcccgggcttcgcgcacggcggcacggaggcggagggcaagcgcgagatcgccgccttcttcgcgcacgtcacgttcgagaccggatatttctgctacatcaaccagatcaacgggaggggccaggtctcgtgcgactcaggcgtgaagcagtggccgtgcgcgccggggaagcagtactacgggcgcggcccgctgcagatctcgtggaacttcaactacggcccggcggggcagagcatcggcttcgacgcgctgggggacccggacagggtggcgcaggaccccgtgatctcgttcgagacggcgctctggctctggatgagcagcgcgcaccaggtggtgccgcaggggttcggcgccaccatcagggccctccacggcgccctcgagtgcaacggcaacagccccgccacggtgaacgcgcgggtgggctactacaaggagtactgcaagcagttcggcgtcagcccggggaacaacgtcacctgctagagacgtgccggggaccctagataaaccctaaatactccagctcgtggtgaagaataaaaatggactcatgatgctgaaatgaaactcgctgctatatgcatgggtccacccgaataacgaagaagactggcgagaagctgtcgactcttagcgaagatcagaatatcaatctattctgtctatactatgtgtaaaaaaggttttttaataccactatatgctataaaaaccgagtttcttaggggctgtcgctcgatgatcgaaacgccgaaactcgcgacaattagaggcaagaccaaagcacactgaatgccaggcatgaatgtggatctcctagtccttggaggatttgtggaaattggcttgaaggaatctgacgcccgactctgatacgagaccaagctcgagtcacccagagggatctctagagtc

SEQ ID NO: 1582 - DNA, 6650 bp, Zea mays
  misc_feature (1985)..(1985): n is a, c, g, or t
aacaacattccaactgtatccaatcaggaaagcatagtacaacaaatataaatttatcagagagattatattgaagttcaaaaatttagcatgtacaccgcacataccacagtatgttaattcgtctattgaagattggaacagatatacagtcaaacagaagtagcttaccatgcgagccctcaaagttctgatactaacagcaggctccaccagttcccagtgtacagaattccacatggactgtcttctctttagttcattttttatagtcttcagccaaaaagaaaagaggaaatgataaacaacaaaatcattgtaagtcatctaatatgaattgatggcatgttgaaaacttatggccttttttaatgctgtagttttcagaaactttggtattagaaaattgtaattttagaatctagaatgtgcaaaaccatagtttagaaaaaagaggtctagggttgagtttctaaaactccaaaagtctacagttttagcaagatcatggccgccggcctgcaggcgtgcgtgcagtgtcccacgaagcagggggcgactggcgggtggcatggaggaaaaatgcaaatggacgcatcctgcgtgaaggcgggtccctggaagccggggtgtggacaggtccacattgtgaaggcgatgagtggatgaaggcagataatctgtgatgaagcagtgcggacggagatggaccacatgaatgaagtccgcgcttgacaatggccgcacagacagaggcggaccacactagatgtagtggggttggcgtggatgaagttcaggcgacaaagactgtggatggatggtgatggggcacaagaaagaaagcatggcgacgggccaaaccagaaatgccagaggaaggatcccctcaaggggaaaaaatggatcgggtgggtcaaattagtttaacccttaccataattcttgacttaattaccataagctatgtgtatatagagagcctcatggggccatatgggccttaacgggacatgactaagaatctaattgaacacatcttttgttcaatctttgtatttttcactttggtggactctggcttattctcatctaatggagtatatggaccaaccattttaggcaaaaagggtggattgaaagagtttctggaagggtggtcctgcaatattgctgttcttcgttaacttaacttaactgtacgactaaatagcttcttactgcttgtaataggaaattttagtgacaacctattcgcaagaggaaaaactttgttgccaggctgatttatggagaccatattctaactgagcatggtgaaaaagcagcggtagtggacctcttctacaaaaatctcattgggcagggtggacagaggatatgacagttgacctggaagctcttggctttcctagacacaacctggctgtcttggactccccctttgcagaacaggaggtcctggagaccatcagaggtttgctaaacagaagatgaatatctgacattagaggtggtcttactgttggggttttggtagattgcttaaagctctgggcctgtctgtctgaaattgagctgcaccctcacattgaagatagacatatctttagtgtagccccaaatggaaagtattcggcgaaagcagcttacaagggtcttttcctaggatcctgtacatctggtcaatacaagagggtctggaaaacttgggctccatcaaaatgtcgtttcttcctatggcttgtggcccataacaggtgctggactgctgacagaccggcaaagaggggcatgcatccaagcagctgtccgttatgtgaccaagaacctgaatctattaaccacctgctggtctcatgtgtgtttgcaaggatcttctggtataaattgctcagaaagtttgggttgcatagccttgctccccagctgggcctgacatccttaatggtcaagaaaggtttgagatctctgatctcttcggnggcctggatgatttggaatcaccgcaatagatgtgtgtttgatggtcaggctcccagtctctcctctatccttcggcaggccgacgacgggagaagactttgggaattagctggggccaagggtctccttggcagctcctttgtctgacaccccccccctgtttctgtagtagttttttgagtccggtttccattgctggcctccgtaaggagttccttgctgtaacctctggtcttcttaatatatttaaggcgcagttcccctgcgccttcgagaaaaaaaactaattttgtaactgctacctcaaatagcaattttctattactatgataataacttctgtatctttatgaacgatgcacagctatcaggtgtgcaatggcaactggaaaagagcagggtgcaatttccactgccagtagcggtgatcaaaccaagggcggtttgcgtggaaaattaaacaaagttgttttagcttatagtggtggtttggatacatccgttattgttccatggctcaggtatatatattccttattttaattgtcttttacgaagtttgaagtctacatttgtctaacttctgcaagctttattttttttggtttactaattcaagggagaactatggttgtgaagtcgtttgtttcactgctgatgttggccaggtatgtttcctaatattattgcttggcctattctgaagcttgtaatgtctagccaacatattcctgtttctttccctcccatgtctctttcttatttcacatacttgcataatgtttctgctggttgcattcctgccaggagttccaaaactaatagtttcttcacctattgtttctatggctttgtattgtcctaatttatgaagttgtgaatcctttttatatttttaatcttcctagtgatttattattttttggttgtcaatatgtaaataggcagtgtcatggcttggattttctatccattttcttgtatctaaccatctgtttaaatacatttacttaaccctccctagggtgccattgaattggaagggttggagaagaaggcaaaagccagtggtgcatgtcagcttgttgtgaaggacctcaaagaagaatttgttagtgaatatatatacccctgcctgcgtgcaggtgcagtttatgaaagaaagtatctgcttgggacttcgatggctaggcctgttattgctaaggtgaaattaatacaatagctgcatcttgttattgtataatcacaaataatctgcatgaatttcttgaaaagtaatttctgatgtttgcataattccttgagatttgattgatgtcatggtttacagtgtactgtaaattaaatgcacatgatggtagagataacatttgaattataatcgctactgcagcaccaaagttgctgatgtaaacttgacgtaacttttggtagccatttactcttttatagcatatatcaaatctgttccaatagtacatggtatgcttcttggtgtacatagacttggcaaatttgtctttacatatttgtttcataaaagtctcaggtacaagccttagaagctttggatgatcatctttgttttgttgatttggtctgctagccctgtagagtaggtggctcagctgttgtttggcttggaatgatctgtccagttaacctactgtgaatcttatgggcatcatgcagaactagtggagcaagaatatcatggggtagggcgtgctgtttcttttatttagttgaaataaaatattgaaatatgcttcaaataatgttctgaatgctgcatatattctttaggatctgtaggtgggattgtgttggcagcattaatacactcttactcttttgaatgctccaagttttatggcattatatctccactgcaggcaatggttgatgttgccaaggaagttggtgcggatgcagttgcccatggttgcactggaaaaggcaatgatcaggtagtgacgctgttagcctgtatattaatgtgtctggtcatcttgtaatgctaccccgtgcctgcaggttcgctttgagcttacattctatgctttaaatcctgaacttaaagtggtggcaccttggagggagtgggatatcacaggacgtgaagatgctattgaatatgcaaagaaacataatgtacctgttccagtttcaaagaaatcaatatacagccgagaccgaaacttgtggcaccttagccatgaggtattgtccatttttcatgtttattgcttcaagttttatcaaagcattttttgtagtttaatatctttttctttacatgtaggacagaatcttagttaccagaactttacaagatggttacgttccaacttttaagccaatatatgcaaaatgccacattagtgttctgaattaatgtcctgcacttgtcgacacctttaaccaaacaacatgacgcccatctttgatgcgagatgaagtgaatcattctctacattgcagggtgacatcctggaggacccagcaaatgagccaaaggaagatatgtatatgatgtcgattgctccagaaaatgcgccctcgaaacctgagtgagtgatcaatattaaatctttccgctcttttttttttcatttttgctgcaatctgtagcacagtttactgtgtatgcacaattgagcattactgcacctggtattccagagttggatccatccaaagcaggattggcctggaacttaatatgatcagtataaacataggttttttttccatttgtacactagatgcatatgtatgcataccgtgatagattaatgccgagccgcatacattcaggtatttggagattggtatcattgctggtgttcctgtttcaatcaatggccgagacctctcaccagcatccctcctcgcggagctcaatgaaatcggtggaaagcatgggattgggcgtatcgacatggtggaaaacaggctggtcggcatgaagtcacgtggggtctatgagacccccggtggcaccatcatggcagccgcggtacgcgagttggagtccctgaccctggacagggagaccatgcagtggaaggacatcattgccctcaagtacgccgagctggtctatgctggccgctggtttgacccgctccggcagtcctttgatgccttcatggagaaggttaccgcgacgaccactggttcagtgaccctgaagctgtacaagggttccgtgaacgtcgcgtcccggaagagcccctacagcctgtacagggaagatatctcctcgtttgagaacggggagatctacaaccaagctgacgccgaggggttcatcaggctgtacggcctaccgacacgggtccgggcgatgctggagaagggtatctgagtagttgcctgcttgatttagaaataaaaacatctgtttcccagtgattgcagacagatgggtgtttggtggggagttcaccatgctgttttaccatccgtttacattgtccaaaccaaaatattatcattgctacatcagctgcttttctcattggtttatattgagcagaccattctggtcgattatcgtcatctattgatctgcgataacgttggagcgatgtctatctatgactttagataccttgacgattcgaactgatacaccgttcatgccattacacaaatttcaatttctggtacttaagctggagattattgattaaaacgagggctactagggggatacaataagttaaagcacgctttagagtttagactgtctctagcagcttgtggttgtcgcttatccatcactgtacctatattctcttaagaccgcgtccagcgattcatccatatgctctagcagtttatccatctatgtacctatatttaaacttaactctgtgaacaataaagtctacagtataaaatagtattttaaatgatcatatggatgaaccgctggacatagtctaagagaatactaagtgacatttacttgtgtatcggcttaacgtcgtgagacgtacgaatatcaaggctacaagtttgacagcagaagtaaatgcaacagactctgcagcggtacctacaaggatccaacttcctctagcagctcgtagtttatgctccagtagcttacccatcctaatacctatatttaaaatctaatctgcgaacaatgtactctacagtgcgcaaaacaacattttaaataaccatatatcgcgcaggctaaatggcggcaaggccccctctcaccacggctgcgtggcgagcctccaacaactgtttcattctcgtggtttgtgcccgtgagtgattattagtagatgaaaaaatgataatagatgaaaagtatggataaaaaatgatattttatggttatagtgaagtatagagggaaccgttgtgggagacgaaaaagtaaggatgtaatcttgacaatatagcgttaaagtgggatatagagagaaatttagagggatcgctagtctcaatgaacaagagcaatgtaatgtagctcatggatatgcgcgatacctaggtattgcattttatgtgaactcatacgtgagatgctggacgcgttagtgttataattttgtacatattttaggcacccgaaaccatttcgtgagtaaaaaaaataaaataaggtgatatttggttcagatctt

SEQ ID NO: 1583 - DNA, 1783 bp, Zea mays
ccagtaggtaaacctctccgtagtcctactcttgtccgacccgcgcggccgccgccagcccgcgccctcggagcccccttccgcttctcctctccgggaatggcgtcggcgcgaggaccttgcggaattagtgtccgttctgacttcagttcagcctgccttattcacaaggctggagccccatcgaattctgtttctggcgtgatggctgttcaggttcaccgccaccgtaacaaggtccgcaatggccaagctatcaggtgtgcaatggcaactggaaaagagcagggtgcaatttccactgccagtagcggtgatcaaaccaagggcggtttgcgtggaaaattaaacaaagttgttttagcttatagtggtggtttggatacatccgttattgttccatggctcagggagaactatggttgtgaagtcgtttgtttcactgctgatgttggccagggtgccattgaattggaagggttggagaagaaggcaaaagccagtggtgcatgtcagcttgttgtgaaggacctcaaagaagaatttgttagtgaatatatatacccctgcctgcgtgcaggtgcagtttatgaaagaaagtatctgcttgggacttcgatggctaggcctgttattgctaaggcaatggttgatgttgccaaggaagttggtgcggatgcagttgcccatggttgcactggaaaaggcaatgatcaggttcgctttgagcttacattctatgctttaaatcctgaacttaaagtggtggcaccttggagggagtgggatatcacaggacgtgaagatgctattgaatatgcaaagaaacataatgtacctgttccagtttcaaagaaatcaatatacagccgagaccgaaacttgtggcaccttagccatgagggtgacatcctggaggacccagcaaatgagccaaaggaagatatgtatatgatgtcgattgctccagaaaatgcgccctcgaaacctgagtatttggagattggtatcattgctggtgttcctgtttcaatcaatggccgagacctctcaccagcatccctcctcgcggagctcaatgaaatcggtggaaagcatgggattgggcgtatcgacatggtggaaaacaggctggtcggcatgaagtcacgtggggtctatgagacccccggtggcaccatcatggcagccgcggtacgcgagttggagtccctgaccctggacagggagaccatgcagtggaaggacatcattgccctcaagtacgccgagctggtctatgctggccgctggtttgacccgctccggcagtcctttgatgccttcatggagaaggttaccgcgacgaccactggttcagtgaccctgaagctgtacaagggttccgtgaacgtcgcgtcccggaagagcccctacagcctgtacagggaagatatctcctcgtttgagaacggggagatctacaaccaagctgacgccgaggggttcatcaggctgtacggcctaccgacacgggtccgggcgatgctggagaagggtatctgagtagttgcctgcttgatttagaaataaaaacatctgtttcccagtgattgcagacagatgggtgtttggtggggagttcaccatgctgttttaccatccgtttacattgtccaaaccaaaatattatcattgctacatcagctgcttttctcattggtttatattgagcagaccattctggtcgattatcgtcaaaaaaaaaaaaaaaaaaaaaaaaaaaaaaaaaaaaaactcgagg

SEQ ID NO: 1584 - DNA, 2071 bp, Zea mays
cattgggacccgcgtccggccgggaattctcaccgcccatacaagtgaaggaaggctactggtgctggtgccggcactggcagccggtgcctaaaccatatctaccggcctcatataactttccactggccgtagtcggcttcttctctgaactgaagcaaggggggagacaagcgccatggctgaggatgccagaggagagaagaaggatgcctacgcggcggcgccggcgtccaagttgccggcgaagcaacggggagggttcaggagcatgcccttcatcctagcgaatgacttctgcgaccggcttgcgtcggtggggttcacgacgaacctgatctcgtacctcaccctgcagctgcacctgccgctcgtggaggcctccaacatcatcaccaactacaatggcactgctaaccttactccgctcatcggcggtctcatcgccgactcctttgccggccgcttctggaccatcacattcggctccatcatctaccagctcggcatggtctgccttaccctctccgccgcgctcccctcgctgcacccgccatcctgcgccaagcacgctgcagactgccagcgcgcgtcctcctaccagatttccgtgctgtacctgtctctgctctgcacgtcgatcggcaccgggggcacgcgcccctgcaccatggcgttcggcgccgaccagcttgagctgaacgcgcacaggcaccggggcgccaagcccaagtggagtttctttaacctctacttcttcgccgtcgagctcgcgaagctcgcggccgtcaccgccgtggtgtacatccaggccacacgtcgggtggggttggggaatcggcgtgcctaccgtcgccatggtcgccgcggtgatcgccttcgtgtccgggtactcgctctacatcaggatgccacccgggggcagccccctggtccggtgtggcgcaggtcgctactgcagcatacaagaagcggaaagccgtcgtgccggacccgagcctcctgtacgaggacaaggagctcgacgctggcatctccaccaccggacgccttcttcacaccgaccagctaaagtgcttagacaaggcggctattgtgacggacggcgacgtgctgccgtcgggtcagccgaagctatggcggctgtcgacggtgcaccgcatcgaggagctcaagtcgatcatacgtatgctgccgatctgtgctgccggcatcatcctggtgacatcggcgtcgcacaatcacagcttcgccatccaacaggctcgtaccatggaccgtgacatcacgccacacttcaagatcccgccggcctccatgctcatcttcaccaacttcggcatgttgctgaccctggccttgtacgaccgcgtgctcgtccgcgtgctgcgccgcttcactggccgcccgaacggcatcacccacctccagcgcacgggcgtgggactgacgatcgccatgctgtccaacgtggtggccgcggtcgtcgagcggagacgccagtccgttgccgctgcgagtgggctgctcgacgctcccaaggccaccctgccgatgagcgccttctggctggtgccgcagtacgccatccatggcatcgccaacgccttcatggacgtcggccgcatggagttcctgtacgaccaggcacccgagagcatgcggagcacagcgacggcgctctactggctgaccttctcgatcgggagctacctcggcacgctgctggtgaccatcgtgcacgacaagacgaagcgaaccgggcaatggctcccggacaaccttaaccgagggaagctagacaactactactggctagtcgtggctctagaggtggtcaacctcgtctacttcttcatctgcgttaagtactacccctttaagccattggagatggtgagcggtgaggagctctaccaccatggcaatggcaccgacgacgccaagaagcaaggtggaagcttagagtgagcaaatccggatcccaacaagaaggcttgggtccggatgaaataattgtacttcgacatttctttaaaaaatcgcccctatcttaaaccagttttgaacc

SEQ ID NO: 1585 - DNA, 4134 bp, Zea mays
  misc_feature (618)..(618): n is a, c, g, or t
  misc_feature (1268)..(1268): n is a, c, g, or t
atggccaggcctggctccctactgccgctcgacttaggtgaaggtcaaggttaatgagtgccatggcaagctgcataagatggggccgcggatgagctcaccgagtagcaggctaggcagctcaacttcaacctcaattcaccattacaccgccttgttcgctgcgcagcccgctgctggtctgtaacgggcaagaatctaccagcttcgtttttatttggttggtacgttctattatgcttctaacattggagcaccactcttcactacactgtagatatctgtaatttcggtactgttgttttgttgtaaataagaaagtcctaattttctttgtatacaggaaatatgcttattgcatgatatgtgctcacattacaatgcttgcaaatggcctgtttatttgggtacgtttattctattctctatggaacatatgaatgcttttgccagtgagtctttcttgtacttgtatttctacttcttgaacaagtagaggcttattaggtccactttatcatttgatttaatctgtgtggagtaatccttttaaccttttgccatatccgtgtgttctgtgggctactaagactcattttggtgtttgaactgccatgncaaagtattttgttgtgtccaagaatgatgtcaattacacactctgacgtgtgaatctatcgactgtaaagtgttggagcattgagacaattgtcctagctttgttcttggcagtttgcatttttttgtttcttttgttttcttatttgaatttgtttgaattaatcatatgtatcttgaacccgtgatgacgaatcgatggctcgatgatgattattcttgctttaaccacaccgaaccaaaggccattggaagggtgctttctttctcccctttgcgccagtctcctctttcttgtcgtttccttgtgaaatcttgatctcttgttgaagaatgcatttcctgttttcttcgcaagagggtgaggtagaaggattcggtaagattttggagcgcagcaaggggaagctacaggcctcctccgatggttcttggcttgtagaaaacactggcctttcactgagagcctttgccctgttttgaagaatatttcccctttaattttttcgagccacattttgttcagctgatcgattatttctatgacttcatgacagataatctggaagaggaggatgcgtaactaaatttgtagctaaatttacagataatgaaagtgattcataatctgagatgcatatataaccaangtattagcattttctaaattaactgaggagtgttttgcctcgccgggatgctccgatctttaaaaaaattgtatgatccttgaagtactgtctcatctcctgtgatttctgtaaaaaatcgtaacaattgtttgagcgaacgagctaaccaccttcacttactttgcaggctactggaggaagaggatgaggtaggcttgtgatgggtggaattcactacagttttgctttagcaaacactgagtagaacctaatctttagcatgcttaatagttgtgttctattttttgaattatatggttttcatgtcatttagtcggaacatgatctcatatggatattgattcctttttctggttcatctgcagctcgctgagtggataaaaacaagctccatagaatcagaaaatgtaagcaaggccctttgtgaagatattagcaaactgtcaaacaaggtatgccatacctgataatggccctttgtggctgcatatgaagaatttcagtgaacatgcgtgtcactgtggtgtttcaaaaaacactcctttcagccgaaacataatctattgtccatgccagctattaaattcttgaatgaacacacttgtaaaataacaacgcagacatgtttaacattcacagatcaggcaacactttcacagaccaaggcgtgcgacatccatacgagaagaagcgcaggcgcgcgcaataggccgcgcattcttcgacaagctcgtctgttgctgcctgcgggagcgggagcaagagcggcatggctgcagctgctcctgccgctcgtggaggcctccaacatcatcaccaactacaatggcactgctaacctcactccgctcatcggcggtctcatcgccgactcctttgccggccgcttctggaccatcacattcggctccatcatctaccagctcggcatggtctgccttaccctctccgccgcgctcccctcgctgcacccgccatcctgcgccaagcacgctgcagactgccagcgcgcgtcctcctaccagatttccgtgctgtacctgtctctgctctgcacgtcgatcggcaccgggggcacgcgcccctgcaccatggcgttcggcgccgaccagcttgagctgaacgcgcacaggcaccggggcgccaagcccaagtggagtttctttaacctctacttcttcgccgtcgagctcgcgaagctcgcggccgtcaccgccgtggtgtacatccaggacaacgtcgggtggggttggggaatcggcgtgcctaccgtcgccatggtcgccgcggtgatcgccttcgtgtccgggtactcgctctacatcaggatgccacccgggggcagccccctggtccggttggcgcaggtcgctaccgcagcatacaagaagcggaaagccgtcgtgccggacccgagcctcctgtacgaggacaaggagctcgacgctggcatctccaccaccggacgccttcttcacaccgaccagctaaagtaagttaagattaaatgagaaataagagtcggacatttgatctgcacgtgctgattcgtcttcccgatccttaggtgcttagacaaggcggctattgtgacggacggcgacgtgctgccgtcgggtcagccgaagctatggcggctgtcgacggtgcaccgcatcgaggagctcaagtcgatcatacgtatgctgccgatctgtgctgccggcatcatcctggtgacatcggcgtcgcacaatcacagcttcgccatccagcaggctcgtaccatggaccgtgacatcacgccacacttcaagatcccgccggcctccatgctcatcttcaccaacttcggtatgctgctgaccctggccttctacgatcgcgtgctcgtccgcgtgctgcgccgcttcactggccgcccgaacggcatcactcacctccagcgcacgggcgtgggactgacgatcgccatgctgtccaacgtggtggccgcggtcgtcgagcggagacgcaagtccgttgccgctgcgagtgggctgctcgacgctcccaaggccaccctgccgatgagcgtcttctggctggtgccgcagtacgccatccatggcatcgccaacgccttcatggacgtcggccgcatggagttcctgtacgaccaggcacccgagagcatgcggagctcagcgacggcgctctactggctgaccttctcgatcgggagctacctcggcacgctgctggtgaccatcgtgcacgacaagacgaagcgaaccgggcaatggctcccggacaaccttaaccgagggaagctagacaactactactggctagtcgtggctctggaggtggtcaacctcgtctacttcttcatctgcgttaagtactacacctttaagccattggagatggtgagcggtgaggaggttgagctctaccaccatggcaatggcaccgacgacgccaagaagcaaggtgtggaagcttagagtgagcaaatccggatcccaacaagaaggcttgggtccggatgaaataattgtacttcgacatctctttaaaaaatagcacctatcttaaagcagttctgaattagttaaccattttgttaattattttcatctgaataccttctggactctgaacaatcaggagcggacttgctccagtccagcacaaggcaaagcgaacacagagctctcatagctccggttctagtaagaatcactccggtaaagtcgagcagtaaaaatctaaactgctacatggtcggattggagtgaatctagtgattctagtctatgttttgtactataaagtaagagcaaaaaaaaatgtttcccaccactctcaacttgctcttttactctctaacctctgaatc

SEQ ID NO: 1586 - DNA, 1325 bp, Zea mays
attaggggcgggcgcaggccggctcgccgtcctctcgtctcgggctctcggctcggctcggccacccaacgggcaagacgacgagggtttttgccgccgccatggcgatccctcgagcacgtctaactcgcctgctcctccacttcggcagccggggctccagattcctagcgcaacccttctctacctcttcctccgcacacggcctcttcccctctctgtggccgacgccgtccaccgccggcgcgtggcggcgcgcgttccacgatgggcggccgcgagggccgctgtggcggagcaagaagctgatcgggaaggaatccctatttgcgatccagggcctcaagcggttcaagggggacgaggagaagctagcggatttcgtgcggcggtatgtggccagactgctcaaggcggacaagctcgccgtgctcggcgagctggaacgccaggaggaggtcgatctggctgtcaagatgtttaggatcatacaaaaggaggactggtataaaccagatatttacatgtacaaagacttgattattgcactagccaaatgcaagaagatggaggaagcaatggtaatctgggggaacatgagagatgagaacttgtttcctgactcacagacttatgccgaagtaataagaggattcttgagatatggctccccatcagatgcaatgaatatttatgaggacatgaaaaagtcacctgatccaccagaagagttaccttttagggtattgttgaagggtcttttacctcacccactgctaagaaatagagtaaagcaagattttgaagagttcttcccagaaaggcatatctatgatcctccagaagaaatttttggcatgcactgaggtatactcagtggcatgaatgtgtttatcaattggatggttgcgttgcaaaaaaaaaataaatgggcgaaaactgagaagctgattattctgatttctgatagacagattagttgtccatatcattgtgctatcctttgttgttcagccaagctcattaatactgggccatctattcaactcaaccagtacaacttttcatggttgcaatgcctgatcttatgagtagtaacagaaaaaaatgtgttcttctttgggcccacttgtatgattaggttgttagaacaatgtactggcgtctggctacattcatgtcgttccttccctaactgcatgagagacctacttcgcatgaacattgtgatggtacctcatttcgtgaccctgttgagtttatgggtgatgattattgttaaaaaaaaaaaaaaaaaaaaaaaaaaaagaaaaaaaaaaaaaaaa

SEQ ID NO: 1587 - DNA, 3517 bp, Zea mays
  misc_feature (3099)..(3099): n is a, c, g, or t
aacatttggtctcctcccaccgtttctcagcactgcgtactctctctctccctcccgagcgtctctccccttgctgcttcctcctcgaccgcgcaccgccgcctccacgaccacgcgccgcccctctccgcctcctctacggccgcgcccctccgctctgccttcgccacggcacagccaggccggggccgccgcactgcctccttccccgtcgtcgcgccctctccacacacacaacacctaccctactgtcccccgtgccaccgtcgatgggtccctaggcgcgcaacccgtgccaccgtcgatggagtccttaggcgcgcatctgctccacctcgtcaacgcgtacctggagcaggagctagatcgtcgctgccgcttgtactgcttctcggagtcgcccctaaaatctgtgaaggcccatgtcgaggcgcataattggaaagccttgctagagagagattagattactgctggcttaacaaaaaagcaaaaggacctaatgttgaatccagtaactagtcgtgaaaaggttgtgcacatgtgctggtacgaagatccaaaatttctaacatgaggctgggctttctagcttaacagaaacgccgaccagaccagtttacagtcatgttcttttgctactctgttcccgtttattatagaaggtttggatgcatatgtttactttatttgaattgatggatagagaagtatagaatgttttttgcatcgtttattaagtgagcgggctatgtgttaaatggatgtgcttaatagtctgcaggcttatggtggagtccaaacctgattatgatgtttagaattcagagcaattaaaggaccacaaccatgctaatatatccctgtgttctaaatacattgcttttttggtgatagaaagaatgttttttttgttcttttggcctcatctgcagcttgaaaagctactcaatttaaagaatttgctcttgcatactatattaatttagttagaatttttagttttgtgataaattttgagtagacgattgagaatgaacggattctgtatcatgtgtttcctctatacctcactatggctgttacttacatgtttgccttttggggcaatgggtgtaacttccctgtgagtttagaatatttaacttttggatctaaagccttggtatgagtcagtgttgtacatctctttcttttcgtatgaaaggctgtcgatcttttttggttcagcaaaattcttattttgcttggtttagtacaaccactgcatagtatatataacttcttgctaacaaaataaaatctctccatgtgaattcttttataatgcactagctaatgctattttcctatgcatgattacattggcattgcttctgttggtgccacatctaaacctagggtagttcagtctattcaaagtgctcacatgcttctagatggcatgatgcatgttagctgttaatggttcctaatagcctttgattgcagattgaaaaaggatggtgcgtagctgcaaaagagaggacatcttgcttttgtgctcgcaagaaggatgcaaaggatctgtgatgatcagctgctgttttgggttcttgtcatgtaacatctcctatttttaaagagcaaaactgaaaatgcagttccggtcttgttggtgaaccgctagagacttaatgattttatatggtgctgtcggttgtctgttgtcttatatcttactgtatatggtaatcatctttgttttttctagatcttcatgtaattgttgctattcaatcgttttttaaatggttgatagggcgcgcaacattaggtgtggtatgtgtctaggtgtggtacgcgtttagatgtggtgctgcaacttcaatgtgggttatattcagtctatctacaactaaaaggttttgttggagattcaatcatcctctacttaatttgaatatagcatgtatactggatagggcgcccgaaggggcgccccatgatctagtggtcttcatagctaagggcttgttcggttattcccaatacacatggattggatgggattggaaaaaaaatatgaagaagtttgacttgtttgggattcaaactcatccaatcccactcaatccacatggattgagagttaaccgaacaagccctaattaggtttcagaccaggcgtgtctaccacatggcacacgacacgtactttcccaacaaatctattttctactttttctttatccgaggagcctttccgagatttatttacagtacgtacgtacgcctcttcgcctaaaactgtaaaaattatttgaaagaggtagaacattttaaatgtacctaaaattctataacaaaataacagtatgtacaatatcaaataattacactgttaattttttgtattaattatattttacagaccatatattttataccgtataattatttttaaaaataataataataataattaaatttaagataatttgactgtacgagaaggtttgaaacggagttggtgtttggcatggaatccatagcaaaggcagacggcaatgcaatgcaatgcaatgcaatgcaagtcaactcgtttcccgtttggcgcagcaaccgggtgccgcgtcgcgcgcggcggatcccgtaacggcgccgacggcaacggcgacggagaagggcacccgcggcgtgcgcgccggcccgcccagctcacgatcacgagcgcgctgtggtggaaccggtggcacggagtaaaagagtagggagagcagcggcgcctatgtggacagcaagcagacaaggcggggcaggacaggacaggaggcaggagcacagcgtggatgtcgctgagacgctggcgtgcgcggggtccgtccgggtgaagccaagcgaggcgtgcgcccgtgcctcgtcacgcgcgcggacgggtggcagggcagctcccttggggttgtttttttgtcgcaggcgatgcgtgccgcggccagccggcgtcgccttctggcttctgctaccgcgggggcccgccatccctggcccgagctggcgagctccacgcctcattaccacctacccctagggcactggcttgtgggaccgggtttattnatgtaacatacggggacgacgccacgaccggttgcggaacacctcgatcttcttcctcgtgtgaacctgacgtaagctagcgggaacaccagtcgctcgctcgtgcgcctcaatcagtcctccaggcccgcccaacgcatatctgttggtttggaccaactccaacagactctgcatgcggctccgtatctcgttttttgcacagcgtagcacactattcatcagtccagcagactccgtatccgtctccctaaaaagcacgtcgtgtacctgcactcccctttttcacgttgtctctctcctctccgcacaagactgcatgcgctcgcgggtgctcgcgggacccagctgtcacagtctacatgtgaagtgtaaatacgaagtctgttagaaataccctcatgcgctcctcgtatca

SEQ ID NO: 1588 - DNA, 1535 bp, Zea mays
atcaaaaggacaggccacaaaatatcctcaaactctatgcctccccctcggccaccgacgcgccgccgcccgccgcccggcgaggcggggacgtcgtctgagaggcccgaggaggtgatcgtggaggaggaggaagaggatggacacgcaacgagaacgcgcccggaggacccgtcacctgcggctggtggcggggagggcggcagggaatcctcctcgtcgtaccagcggtacgacatacagcaggtggccaggtgggtggagcagatactgcccttctcactgctgctgctcgtcgtcttcatccgacagcatttgcaaggtttctttgtgacaatttggattgctgcggtgatgttcaagtccaatgatattctgcgtaagcagactgctctgaagagggagagaaaaattccagttcttgtcgggattacaatttagtccctcgtggtccccgggctggattttactggtgttacaagaacggggatcttataagacctctcatgatgcttcctccaaaagaaataccaccattttggcacgcaatattcatcatcttggtgaacgatacaatggtgcgccaaactgctatggttgtcaaatgtttactgctgatgtactataagaacagcagagggcgtagctatcgtaggcagggtcaaatgttgacgattgtggaatattttctacttttgtatcgtgcattattgcctacacctgtgtggtaccgttttttcctgaacaaggagtatggaagcctattttcgtctctaaccactggcttgtatctcactttcaagttgacatctgttgtggaaaaggttcagtcttttttgacggcattgagagcattatctcataaagacttccattatggttcatatgcaacaagtgagcaggtagttgctgctggagacttgtgtgcgatatgccaagaaaagatgcatgttcccatccttttgcgctgcaaacatatcttctgtgaagattgtgtatccgaatggttcgagagggagcgaacgtgcccgctgtgcagggcattggtgaagccagcagacctccgctcgttcagcgacggttcaacaagcctcttcttccagctattctagtccgagacagccaaaagagcggcaagccggagcgctccacccgatgatgcagatgttagctgtgtgtgtgcgtgtgttgctgcttgcaacgcctgcgagcagtgcggccctgatgcggtgctgggagagtgtacaccaagctgaagctgaaggcgtacatgattgtgtattgtgactgcacatattttcatcatcccctgtataggctctcgcgttgatgcttgagcacctgaggattttacctgaccatatacggcacaaattattacataaatagaaatggtgagtatatacaacgataaatcaatacggtccttgtttctgctgtgctctgttcaagctgtggaataaaaccgtcaagtactgtgttgggatttaaaacaactaaaataaaggacacaaaggtcaagaaaaatgttgctt

SEQ ID NO: 1589 - DNA, 1878 bp, Zea mays
cccgggcacaaaaatccttaaactttgcctcccagaaaaattcctcccaccgcgacggcgacgagcacggggaccctccaccgcctccgcctccgcctccgcctcgccgcgtgcggcctccgcaccgccccgacgtcgacccctccgccctccccctcggccaccgacgcggcgccgcccgccctccgccgccgccgccgccgcggcgggctcggtctcctctggaagctcccctacggccgcgcgccgtcccgcccgatggacgcgctgccgcctctgcagcgcgccacgtcgccgccgccccagccccggccccagccgcccgtgccgtccaggaggtacggcgtgcacttctcggcgtccagcttcatccaggcgccgctcaccacgctgctcgagtactccggcatcctccgccccgatccaggcggcggaacccagcaggatggggccggggctgggccgggcgaggtgtcgatccggattgtggcgcccggcgaggcggggacgtcgtctgagaggcccgaggaggtgatcgtggaggaggaggaagaggatggacacgcaacgagaacgcgcccggaggacccgtcacctgcggctggtggcggggagggcggcagggaatcctcctcatcgtaccagcggtacgacatacagcaggtggccaggtgggtggagcagatactgcccttctcactgctgctgctcgtcgtcttcatccgacaacatttgcaaggtttctttgtgacaatttggattgctgcggtgatgttcaagtccaatgatatcctgcgtaagcagactgctctgaagagggagagaaaaattccagttcttgtcgggattacaatattatttgttgttcacgtatctgggttttattggtgttacaagaacggggaccttataagacctctcatgatgcttcctccaaaagaaataccaccattttggcacgcaatattcatcatcttggtgaatgatacaatggtgcgccaaactgctatggtcgtcaaatgtttgctgctgatgtactataagaacagcagaggccgtagctatcgtaggcagggtcagatgctgacgattgtggaatattttctacttttgtaccgcacattattgcctacacctgtgtggtaccgttttttcctgaacaaggagtatggaagcttattttcgtctctaaccactggcttgtatctcactttcaagttgacatcagtcgtagaaaaggttcaatcatttttgacggcactgagagcgttatctcataaagacttccattgtggctcatatgcaacaagcgagcaggtggctgctgctggagatttgtgcgcgatatgccaagagaagatgcacgttcccatccttttgcgctgcaaacatgtcttctgtgaagattgtgtgtccgaatggttcgagagggagcggacttgcccgctgtgcagggcactggtgaagccagcagacctccggtcgttcggtgacggttcaacaagcctcttcttccagctattctaatctgagagagccaaaagagctgggcaagctggggcgctccaccctgtgcagatgttaggtgtgtgtgtgtgtgtgtgtgtagtgttgctgctggcaacgcgtgcgagcagtgcggccctgatgcggtgctgggagagtgtacaccgagctgaagctgaaggcgtacgtggttgtgtactgtgattgtgcatattttcatcccatgtataggcactcgcgggatgcttgagcacctgaggattttttacctgaccttatacgcacaaactactacgtaaatagaaatggtgagtatatacaatggttccggatgcgtcgataaaaaaaaacgttaatttttttttttttttt

SEQ ID NO: 1590 - DNA, 1708 bp, Zea mays
atcaaaaatagtgagtttgaggacattggaccgcaccctgcagaggccaagcgtcgaacacatggcgtgcaccttcctccgccgcgcgttctccctcaccgccgccggcacccacgcgaccccccgagttgccgccgccttcgcttccacttcctcctcatcctccgtcgtcgtgcctctgcgctccccactagactaccgtcttctccgccacctccgctccgagatcacctacctcgcggagcgccgccctccccacgtgccgccgagtagcttcaagtcgttcgccgtggaggaccgcccgggggagcagtgggtgcgcctccgcgccagcgcgggagggggaggcgaggaggtgaaggtcgaggccaccatgttcgacggcgctgcggagcctgtcccggacgacgcgcccctcttccgccgcgtggagtcgctcgagcgcgggccccgcctccacctcagcctcatcgtcgagatcgcccggggcgaccgcgtcctcggcttcgtctgctccgcctggcccgacgacctcgccgtccgccacgtgctcacgctcgcagctggcggcggcagcagtggtggtggtcgtcgtggtgggcgcgatttcgagaaactggggggcgaggagagggaagcggtgacgaagttcttgaaggagagggaggtggacgccgagctcgccggattcttgcacgactacatggcaaacaaggagaagatggagctgctccggtggttgaagactgtcgaatcattccttaacaagtaggataagatcgcacacagaagacaccgccgatgttactgcctggtttgggaacgggtacgctccaacaacaactcgtgacggtctcctgcagtctctgtgatcatccgcatctacccctctgctgacaattgtgtgctgaagatgtttgtttttaatcagcttagatagctcagcgcacagcgctcttggaaactggtgatctgaatatcctactggtactttcatttctttgtgataagattgttctcaacggtgtatcttttaagatacaccccattggggtttttttcccttttgcaatataccaaatctcattttggatttccaaccagttgctatgtgcgtgcttagagtaaaaatctgctcttctgaactctgacggttcaatgtcgaaggaggagctgtaacggttggattaagcggggcgacggctcacatttcagaagccttcacatgatggcattgacacacctcaatccaacagtcgtgccactgccaagctccatcgcgccacgcgtgatgtacgtgattatgatctcactgactagcgggcccgcgtacagattcaaccctcccctcccctcaacggctagttccacctccgcatccgttgggacaaaagggggaaaaaccagagggaacttcaccagccaccaaagtaccacacctctcctctctcaagaaccaccgcactctctctagcaggcctctgttttgtactgtaagcaggcctctgtagagtttgcaaaatgaaatttgaaatagaaaataaatactgtatattatattgtttgtaaagtgaagtttgaaacaggagcgaaaaggtagatagtcactcagcttctcgagagatcgccaaagacgcggcgccggcagcaagttctgcggcgatggggcacaagtacacgccgacgtactactcgggcctgcaggtcg

SEQ ID NO: 1591 - DNA, 2286 bp, Zea mays
ttgggaccctcgaggccggccgtggttttctactctcctctccactcctccctcggcctggagtccagtcctcgactccgcctgccgcctgccgcctgacaagccacgcgctgcggccgccgtacgggcactagggttttcttccacttcgaccgcgggctcgggatctcgcgtcgcaccgcaatgcagcacaagtgccgctgatcccgtggctgcctccttcctttcctcctcctgcggtcctgcgccgcctctgctgcagcgggcagccgccatggcgcggcgccacgggtggcagctccccgcccacaccctgcaggtggtggctataacagtgtactctgtgctttgtatagcattctatgctttcttctctccatttcttgggaaggacttgtatcaatatatcgctgtcggtatttatagttttttggctttatctgtgctgattctatatgtcagatgtactgcgattgatcctgctgaccctggcatcctgatttccatggatgacatactaatttataaatcagaagcacatgtagacactcaagatgaagctggtaagccaggattgaggaacgatgaggatatccgaaagcataaatcatgctttggaagggtttgtttttgttgcgctatttttacaactggggactgtcgcggaggggatgaagctaaccatcaagaagattatggtgaagaggcactcttttgcaccctttgcaacgcagaggtgcgcaaacatagcaagcactgtcgaagttgcgacaagtgtgttgatgggtttgatcatcactgccggtggctgaacaattgtgttggaagaaaaaattatatcacatttttatgccttatggctgtgagtctggcttggcttgctgctgagtgtggagttggtattgctgtttttgttcgttgcttcactgacaagacagtcatagaagatcagattggggaaaagctgggttacggtctttcacgtgcaccctttgcaaccattgtggccctggctacagctctttcaatgcttgcttcagtaccactaggagaactatttttcttccatatgatattaatccggaagggcataacaacttatgaatatgttgtggccatgagggctcagagtgaacctcctggaccttctgtcaatgatgaccaacaaagcttggcatcttctccaatgagttctgcaccaacagcttttagtgggagctcgtttgcacggcactacaaaggcgcatggtgcactcccccacgtatcttcattgaccaggacgaaatcatcccacacctggagcctggccgagttccttcaactgttgatcctgataccacagacccaatggaaagaaccaaaacccatcctaaacggccagtccgcatcagtgcgtggaagcttgcgaagctcgattcaaatgaggccatgaaagcagcagcgaaagccagagcctcttcgtccgtgctgaaaccgatcaatacccgcaaccagtatgaggcagacagtgatagcctcagtagcagaaacagtgtcataagtgctgataccggacaccataggtaccctcggtcttgcgggaattcgcagtacaagccctcttatccaccaagcagagcaagtgcagatgacatcgagttgtacccccagacaccgagcagcttccagagcaactcacggacttcaactcccatagccgagcaccatccatccaagcatttcaacccaatctaccagacatcagcaaacaggtctccattctcagcaaaagcaagtgtcagtgaagctcctgtctctgaaatcaccaatgcagggaggtcctaccccccaccacaagcggacagatcctcccggtcatctgtttactgggatcaggaagctggcaggttcgtgtctgctcaggcaaaccagggatctagctctcgccctgcctatcctgatcttctatacaccgggcagaatatattctttggtggacctctgattgcagatcccgcagcaagaagcttcagagatcctggtggctcgagccaaaggtctgccgggcctcggtcgcaccagctcccggtgttcgttcccagtgacccccagaaagatcagctgtccaggttaccgtgaaatgctatatcttttttttggggggggggggggtggggtagtagtcttccgaaacacatgttgccctgccgggttattaatgtatagttattagctcttagacctgacagaatagttcatgactttgtatcgggttcatggaaattaagacctatttaggcactatc

SEQ ID NO: 1592 - DNA, 2055 bp, Zea mays
  misc_feature (1018)..(1019): n is a, c, g, or t
aattcggcacgaggatttcttccctggctgaaggcgtgggtctcgagagctgcttaaaaagctttgcacaaaaatggcttcgccggcgaccccgtgcccccccctcacgtcccatcgcgccgctcccttcgtcctggggtgtcctcctccatggccaccgccaccgccgcctgccgctcgcccacggccgccgccgccgcgccctgacgctgctgctgctgctagactgctagaggaggaggccggggcaggcagctcgcgagctcgatcgcctggcgggcccgagctggagtcgatggtgctggatctcaatgccgagtcgccgacgcccggctcggcctcggccgcctcgagctccagcgtcgtagtgggcgggggcttcttccggttcgacctgctcggagggacacccgacgaggagggttgctcgccctcgccacccatcgtgacgcgccagctcttccccttgccgtacccggacgctgcaggtagcaccgccgcctcgacggcgtcgaacgggtcgccgccgccggaggtggcgggggcatgggcgcgccgcccagcggatctcggggcgccggcgctggcacaggggaaggtggtgtctgcgccttcgtcgcccgcggttgtgtctcctgccgccgggaagaagagccggcgggggcccaggtcgcggagctcgcaataccggggcgtcaccttctacaggaggaccggccgctgggagtcacacatctgggactgcgggaagcaggtctacctgggtggatttgatactgcgcacgccgcagcaagggcctatgatcgcgctgccatcaagttcagaggccttgacgccgacatcaacttccagttgaaggactatgaagatgacttgaagcagatgaggaattggactaaggaggagtttgttcacatactccgacgtcaaagcactgggtttgccagggggagctcaaagtaccgtggtgtgacactacacaagtgtggtcggtgggaagctcggatggggcagctnntctcggaaagaagtacatctaccttggtctatttgacagtgaaatcgaagcagcaagagcgtatgatagggcagccattcgcttcaatggaccggatgctgttaggaactttgattctgtttcctatgatggagatgtcccacttccacctgcaattgagaaagatgtggttgatggagacatccttgatctgaatttgaggatttcacaacctaacgtgcatgatctcagaagtgatggtaccctgactggttttggattaagttgtaattctcctgaagcttcaagctccattgtttctcagccaatgggcccccagtggcctgtccatcctcacagcagatcgatgcggccccagcatccacatctgtatgcatctccttgtccaggcttctttgtgaacctcagggaggcgcctatgcaggaagaggagaaccggtccgagccggcgtgtccccagccgttcccctcctgggcatggcaaacgcagggctcccgtgccccagttctccctgccaccactgcagcatcatcaggattctctaccgccgctgccaccggcgtggacgcggccacagccggccacagcgtgccgccgccgtctggtagcctccggcagttctcgggctaccaccagctccgcttccccccaaccgcctgacggagacagaccacctcctgttgagttggcggcggcggcggcgtctcatagctggccggtggttggctggctgcccatgcaacgccacgccggtgggtgcgggtcggtattcggtaacagtcgccactgttgggtatggttttgtgggactacagaggatgcagtgatctctcgctgctgctgtgtgctgtctctctcgctccctctacccacccacacctgtttgtaatatgaatttatcgccctctcgcgctcgtgattcgtccatcttcgtttcgttttgatggccaccggatgggatcatgagcgtgttgcgagaaattgtgtaataaaccatgcgtatttttatttatatttatttattgtgacgatggt

SEQ ID NO: 1593 - DNA, 1331 bp, Zea mays
ggggccccccgggcccgccgggaccagttacctcgcctcgcggataagaggcgagggctagcaaaccaaagccccttccgccctccgcccaaaaccccacgcgagctcccattcccatccatggcgaccaccacctcttcctcctcgctgaccactcctctcctccgcccgaaccccaataccaaccctgctcccagatctctccaactcctcaggagcaggaggtgcgctcgtgccgtaactaccgccgtagccggaggtgcggtgccttacggggctaatccgcggcgcgggatttggtcgatcagggatgacttggtggtgccaaggtcgccctacttcccagtggagtccgcggcggggcaggagcgtgggccgtcgcccatggtgatggagcggttccagagcgtcgtcagtcagcttttccagcacagaattattcggtgcggaggccctgttgaggatgatatggccaacatcattgtagcacagctgctctacctcgacgctattgatcccaataaggatatcattatgtatgtgaattcgccaggagggtcagtgacagctggaatggctatatttgatacaatgaagcatatcaggcctgatgtatccactgtttgtattggactagctgcaagcatgggagcttttctacttagtgctgggaccaaaggaaagcgatacagcttaccaaactcaaggataatgatccatcaaccctcttggaggggcccaaggacaggagactgatcttgagattcaggccaatgagatgctgcacccacaggcgaacttaaatggataccttgcataccacactgggcagcccctggataagatcaacgtagatactgaccgtgactacttcatgagcgcgaaagaagcaaaggagtatggccttattgatggagtaatcatgaatcccctcaaggcccttcaaccacttccagcttccagttagtcatgaagtgtgctagaactccgtcaaacatttttgttgtatcaatgtgtatgttggaagccctggctacgtaatattctacgtccaaatgcatcaaagattgtacaaaacaagatatgcggttaggatatccatccttggtgatggatattggaactaaactaacctaacccttagagttaatttgtcaactctatttttctaaggaaattcctctcataaaaaaaaaaaaaaaaaaaaaaaaaaaaaaaaaaaaaaaaaaaaaaaaaaagaaagacaaaaataaaggatacaaactaacaaacggcgggcctgccaaagagataccatgttttattttgaaacgctaacttaaattcaatgg

SEQ ID NO: 1594 - DNA, 3285 bp, Zea mays
tcgcctcgcggataagagcgagggctagcaaaccaaagccccttccgccctccgcccaaaaccccacgcgagcgcccattcccatccatggcgaccaccacctcttcctcctcgctgaccactcctctcctccgcccgaaccccaataccaaccctgctcccagatctctccaactcctcaggagcaggaggtgcgctcgtgccgtaactaccgccgtagccggaggtgcggtgccttacggggctaatccgcggcgcgggatttggtcgatcagggatgacttggtggtgccaaggtcgccctacttcccagtggagtccgcggcggggcaggagcgtgggccgtcgcccatggtgatggagcggttccagagcgtcgtcagtcagcttttccagcacagaatattcggtgcggcactggattgtgtaaagtgtttgacctccttagggcttgtttggttggatacttggatctggattggaggggattccctccctagtcaaaattgaatagaaggggatttaatctcccctcaaccgaacaaagccttaccaggaagggttttactggattgtattgtgaggtttgtgtgactatatatctgtctctatgcagagaattattcggtgcggaggccccgttgaggatgatatggccaacatcattgtagcacaactgctctacctcgacgctattgatcccaataaggtgaaaacgaacgggacaaccgtttgctgctgtaattcccatgtgaatagaacatgcttgcgctttaaataaacctttgtttgttgataccagacagtgaaccaacattgtagtactaaactttgtacagtgcttctttaactttctgtgttgcggaattgggttatacaattgtaaccactgaacttgtaggtttatccaatgttgccatttcatctagctagggactcgaatacatggcaattatatattcaaaacgtggtttcttccatctagtgcatgatccttgtcaaccttcctgtaggatatcattatgtatgtgaattcgccaggagggtcagtgacagctggtaatagctcatctaacatagtatgtctgcgttagctgcttcaattaatactaatgcattttcgttttctgttaggaatggctatatttgatacaatgaagcatatcaggcctgatgtatccactgtttgtattggactagctgcaaggtactgaacacaaattctgctgaacgatcatcaattgattcagttctttgcatgttataggatcttaatgttcatgtttgactttcagtctgggtttattttccctatgtagtccattctgttctcaatgtgggaagcgcaattgatcctttgtgtttgcagtaattggaaggttcagttcatgtaacctatagtctgggatttgggattgtagtaactagatttttttttggctttggttgtgctagtatagttcttgtttgcagacaggacttgcatggcatgagtttttaaaactaccgtagtaccatagtttcagttaacaaattacacaattgtcaactccagatggatgccaaaagcagcaatgtccttttactttgcatacttgccctgtgttggggttattattcagcaaattcaccttttgcagcgagcttgctcaatgattatctgcacagaaatgcctacttgcctagtaatttaattttcgttataacttggtacatgtagttctgctatgaatgaaaggtaggaattaagtatgctttcacgaaataagaattatgtattcctgcttttcgtatttaatattttagtgtaactagccatacataattaaataaaggatgttagagatctaatttgtgtttcagttttacagtttgttagtgtgaacatgtttattatttattactgagattctgtggccatttcttgttattgtttaactccaaattatgtcatgcctcatgcaatgttatcttttattacctggatgattctgacactctttctgctgtttgatgtttctgtttgacagcatgggagcttttctacttagtgctgggaccaaaggtaccagtagtgattgctaataaaatacatgtaggtgtagcttacatatccaagcttcgttaatagaagtcataaaaccggtgaaaatataatgcaggaaagcgatacagcttaccaaactcaaggataatgatccatcaacctcttggaggggcccaaggacaggagactgatcttgagattcaggtaaactcgcaatgtggggctatggaaagtatcatgctttctagaccagtacagtatcttaaccaaagatattctcagttctcgtttcttctcaacaaagatccttattttctgattttcatactcagctgagcttacggttgttatattttgcatattatttttttatctctacatattgcgtattgttacaagccaatgagcccctcttttggcaaccgagtaagaattacagttgtttacaccagcagttgctgatcctcaacattgggctgcccctggataagagactgatcttgagattcaggccaatgagatgctgcaccacaaggcgaacttaaatggataccttgcataccacactgggcagcccctggataagatcaacgtagatactgaccgtgactacttcatgagcgcgaaagaagcaaaggagtatggccttattgatggagtaatcatgaatcccctcaaggcccttcaaccacttccagcttccagttagtcatgaagtgtgctagaactccgtcaaacatttttgttgtatcaatgtgtctgttggaagccctggctacgtaatattctacgtccaaatgcatcaaagattgtacaaaacaagatatgcggttaggatatccatccttggtgatggatattggaactaaattaacagtattagggttagtttgggaactccattttcccttgggattcctattttcccaagggaaaatgaactaattttccttgggaaaatgaaattcccttgggaaaaatgtggtttccaaactaacctaacccttagagttaatttgtcaactctatttttctaaggaaattcctctcataaggcttggtttcctcgtctatgtactctatatggatgcctttttttataggaccgatgtctttctattttaggtcaacaggtgacggtaataactgtgtcttcattagggcatgtgcccccattaattaagggtttcttgagggatcaagtgagaaaaaaaatcaaaaaaaaaaaaaaaaaaact

SEQ ID NO: 1595 - DNA, 1370 bp, Zea mays
cccccgaggtcggccgggacacgttaccccgccgcgccctcgacattggggggctcgcggccgccggccccttccgccctccgcccaaaaccccacgcgagctcccattcccatccatggcgaccaccacctcttcctcctcgctgaccactcctctcctccgcccgaaccccaataccaaccctgctcccagatctctccaactcctcaggagcaggaggtgcgctcgtgccgtaactaccgccgtagccggaggtgcggtgccttacggggctaatccgcggcgcgggatttggtcgatcagggatgacttggtggtgccaaggtcgccctacttcccagtggagtccgcggcggggcaggagcgtgggccgtcgcccatggtgatggagcggttccagagcgtcgtcagtcagcttttccagcacagaattattcggtgcggaggccccgttgaggatgatatggccaacatcattgtagcacagctgctctacctcgacgctattgatcccaataaggatatcattatgtatgtgaattcgccaggagggtcagtgacagctggaatggctatatttgatacaatgaagcatatcaggcctgatgtatccactgtttgtattggactagctgcaagcatgggagcttttctacttagtgctgggaccaaaggaaagcgatacagcttaccaaactcaaggataatgatccatcaacctcttggaggggcccaaggacaggagactgatcttgagattcaggccaatgagatgctgcaccacaaggcgaacttaaatggataccttgcataccacactgggcagcccctggataagatcaacgtagatactgaccgtgactacttcatgagcgcgaaagaagcaaaggagtatggccttattgatggagtaatcatgaatcccctcaaggcccttcaaccacttccagcttccagttagtcatgaagtgtgctagaactccgtcaaacatttttgttgtatcaatgtgtctgttggaagccctggctacgtaatattctacgtccaaatgcatcaaagattgtacaaaacaagatatgcggttaggatatccatccttggtgatggatattggaactaaattaacagtattagggttagtttgggaactccattttcccttgggattcctattttcccaagggaaaatgaactaattttccttgggaaaatgaaattcccttgggaaaaatgtggtttccaaactaacctaacccttagagttaatttgtcaactctatttttctaaggaaattcctctcataaggcttggtgtcaaattaaataatcattattttctaattattctcttcttaatttattaatctt

SEQ ID NO: 1596 - DNA, 898 bp, Zea mays
attgggaccctcggggcctcgcggccctcccggcccttcggcctccgcccaaaaccccacgcgagctcccagtctcccactccatccatggcgatcgccaccactacctcttcctcctcgctgaccattcgtctcctccacccgaaccccaacactaaccccgctcccagatctctccagctcctcagtagcaggaggtgcgctcgtgccgccgtagccggaggcgcggtgccttacggggctgctccccggcgtgggatttggtcgatcagggatgacttggtggtgccgaggtctccctactttccagtggattccgcggcggggcaagagcgtgggccgtcgcccatggtgatggagcggttccagagcgtcgtcagtcagcttttccagcacaggattatccggtgcggtggtcctgttgaggatgatatggccaacatcattgtagcacagctgctctacctggacgctattgatcccactaaggatatcattatgtatgtgaattcaccaggagggtcagtgacagctggaatggctatatttgatacaatgaagcacatcaggcctgatgtatccactgtttgtatcggactagctgctagtatgggagcttttctacttagtgctgggaccaaaggaaagcgatacagcttaccaaactcgaggataatgatccatcaacctcttggaggagcccaaggacaggagactgatcttgagattcaggccaatgagatgctgcaccacaaggctaacttaaatggatatcttgcataccacactgggcagcccctggataagatcaatgtagatactgaccgcgactactttatgagcgcaaaagaaagcaaggagtatggcctttattgatggagtaatcatgaatcccctc

SEQ ID NO: 1597 - DNA, 2883 bp, Zea mays
ctgtcctattcttctgatgtatgggtatgggtcactgtagagaccccggtgtccattcagcgctgcgaggcctagctggctaggtgcgactgctttcaacctccactacggccgacgggtcgtctatgatttaagttggatagtgttacgtcctcacatatttgttcgtgctgttcaatctaactagcatgctagagttatacctgctagtatatgaggtaatcatgatttatattatgattttacgggaaattgtctacttttttttctgaaaaaaatgttatgacaatgctatgtatacctatcattgcaagtgcagtgcagccgataaaggcatatgtatatcaaccatgtcaaacagtgacaaataaaggagcaggccgggggcgcctttgagaaagaaagagagagaggtggccacatcctgatctgtgttcagtgttgtgctgctgctgggtttgtggccactggccaggcaggccaacaccaatggcgactgcatcattgcccacacaccgaaagctaagcaagggagaaataaagggagaacagctcccgtgcactacccccagcccagcagctatggtattggtatggtagctagctagggttctgtaaccaatctcacccatcttttctttccttcgtcggagaaggggagaaaagcgtacctgaaacgattccctgcattcaattccgctgcatacttgcattgcatctcatccctcctgctcctgcgtcctcctcctctatttctctcctgctgcttgctactacctcatcgatccattccatccatcgccgaggggggagggccgccgcccgcccgggtcgcatcgcatcgcccggtcggccggggactcggggcaggcgagcgacactagctataaaagacctcccgccgcctgcgactgggccgtgtgcaagcaaagcgcaaggccgatctggggttggagggccggccatggtgatgatgatgcggtcgtgcctcggcggcggcctgctaccggtggcggtcatgctctgcctcaacgtggtggcggcggtcatggtgtcgctcgtcaaggtggccatggacggcggcatgaaaccgctcgtgatcgtcaccctgcagcagctcaccgccgccgtcttcctcgcgccaatcgcattcttcaaggagaggtaagcatatatgatggtagcaagatgatccaaaggctgcagaccgctgctgacccacacccacccacgcacccacccaccatagctttcttctttgttttttcaagaaaaagagaagccttgatgagctagcatggtatttaaattccaggaagtcgaggccaaagctgacgctggagatcttcgcctacatcttcgtcagtgcggcgctcgggtatcttccattcattccactccacgccatggctgaatctgacacgaagctagcttaccacattgacgtaccagcctgcgccatatattgcagggcagctcggcgtcagtacatgatcttcgtggccctgcgctacaccacggccaccttcgtgaccgccttctccaacatcgcccccgtgctcaccttcctcctggccgtcgccacgcggtccgaagcgctggacctcaagagcaggacggggttggcgaagctgctgggcacgctggtgtcgctggccggcgccatggtgctcaccctctacaagggcgtggcgctcacccacgcggcggcagcctcgcaggaccagcagcagcactcccacggccggttgccgccgagcgccgccgacagccgcggcaagtggacgctgggcaccgtggccatcctgggcaactgcgtctgcctctcctgctggttcctgctccacggccgcctcgccaagaagtacccgcacgtctactcctgcaacgcgctcatgtccttgctcagcttcctccaggtcgccgtcgtcggcctctgcacccagcgcagcatctccccctggatcgtcaccagcaagttcaacatcctcaccgtcctatacgccgtacctgccagctgctcgctcgctgctccttcattcgttgccaacttgccctttctctcatctctgaaatggtcctggatcagggcatcgtcggctgcggcgtctcgttcgtgctggtgacatggtgcatcgagaagagaggagccgtgttcgtggccgccttcataccggtggtgcagatcatcgtctccgtcatcgacttctccatcctgcacgagcagctctacctcggaaggtacgcacggacacggtaccatgccatcactgaatggcaatcgacctgatcgaaagtgaagtcacctgctctgctctgctctgcttccccctttgtgctgtgcagcgtgctgggatcagtgctagtgataggtggcctttaccttctgctgtggggcaagaggcaggaggccctgcactgtcctcctcctcctccaaaggttgccgaagaagaccctgctgacaaagagcagcagcaagtgcagcacaactgaagacggacagcatcctctgactgttggtcgtttggttgtaacagtgccagcaataagatccctctgcctccttttcttttcttttggtgtctcaggggggtgggcaatgttccttccttctcagatcgatcaccaacaaagtgtttagattctaatccaaaacagtagaatggtcttaaataacaaaaaaaaaaaaaaaagtactcctgcttactgatgatagcaacaccactaccaactaggcctctggagaaatacagagtagagtgtgtgtgcgcgcaatactggagagcagaatattcctgcaaatatagtacgcagttgctgtccgcctttttcttatgaggacatatctggtgctagagaaaaaaaagaaaaaaaaagcgtac

SEQ ID NO: 1598 - DNA, 1775 bp, Zea mays
aattcggcacgagggctagctagggttctgtaaccaatctcacccatcttttctttccttcgtcggagaaggggagaaaagcgtacctgaaacgattccctgcattccattccgctgcatacttgcattgcatctcatccctcctgctcctgcgtcctcctcctctatttctctcctgctgcttgctactacctcatcgatccattccatccatcgccgaggggggagggccgccgcccgcccgggtcgcatcgcatcgcccggtcggccggggactcggggcaggcgagcgacactagctataaaagacctcccgccgcctgcgactgggccgtgtgcaagcaaagcgcaaggccgatccgagggtggactgtggagggccggccatggtgatgatgatgcggtcgtgcctcggcggcggcctgctaccggtggcggtcatgctctgcctcaacgtggtggcggcggtcatggtgtcgctcgtcaaggtggccatggacggcggcatgaaaccgctcgtgatcgtcaccctgcagcagctcaccgccgccgtcttcctcgcgccaatcgcattcttcaaggagaggaagtcgaggccaaagctgacgctggagatcttcgcctacatcttcgtcagtgcggcgctcggggcagctcttcgtcagtacatgatcttcgtggccctgcgctacaccacggccaccttcgtgaccgccttctccaacatcgcccccgtgctcaccttcctcctggccgtcgctacgcggtccgaagcgctggacctcaagagcaggacggggttggcgaagctgctgggcacgctggtgtcgctggccggcgccatggtgctcaccctctacaagggcgtggcgctcacccacgcggcggcagcctcgcaggaccaccagcagcactcccacggccggttgccgccgagcgccgccgacagccgcggcaagtggacgctgggcaccgtggccatcctgggcaactgcgtctgcctctcctgctggttcctgctccacggccgcctcgccaagaagtacccgcacgtctactcctgcaacgcgctcatgtccttgctcagcttcctccaggtcgccgtcgtcggcctctgcacccagcgcagcatctccccctggatcgtcaccagcaagttcaacatcctcaccgtcctatacgccggcatcgtcggctgcggcgtctcgttcgtgctggtgacatggtgcatcgagaagagaggagccgtgttcgtggccgccttcataccggtggtgcagatcatcgtctccgtcatcgacttctccatcctgcacgagcagctctacctcggaagcgtgctgggatcagtgctagtgataggtggcctttaccttctgctgtggggcaagaggcaggaggccctgcactgtcctcctcctcctccaaaggttgccgaagaagaccctgctgacaaagagcagcagcaagtgcagcagaactgaagacggacagcatcctctgactgtttggtcgtttggttgtaacagtgccagcaataagatctctctgcctccttttcttttcttttggtgtctcaggggggtgggcaatgttccttccttctcagatcgatcaccaacaaagtgtttagattctaatccaaaacagtagaatggtcttaaatacagtactcctgcttactgatgatagcaacaccactaccaactaggcctctggagaaatacagagtagagtgtgtgtgcgcgcaatactggagagcagaatattcctgc

SEQ ID NO: 1599 - DNA, 751 bp, Zea mays
tacccgggcgtcggcggcctcgaggcgggcctcggctccctctcctctggctgccgctctccacagtcctcgggctccaagccttgcgtaaaccccgacccccacgcgcatagatgaagacgaggtcgcagacgtcgccgaagcctctcaagacggtggcgatggctcccaggccgagcagcaccaagcggaagccgaggcccaagccggcggggaagggcgacccccgcgcacccaagaagccacccaccgccttcttctacttcatggaggattttcgcaagatctataagcaagaaaaaccaagtgtaaaatcaatgcaggaaatagggaaggcatgtggcgaaaaatggaatacaatgacatttgaggaaaaggtcaagtattatgatatagctactgagaaacgtgcagaatttgagaaggcgatgattgaatataacaagaaaaaggaaagctgaacatttgtctgttccaaattcccgatggttcactgtaactggatgaatcaatcagctgtatattacagaactttgatttctagtggaatttatagataccactattggaaccgtcagctcacgcagatatgtatcttctgtagtcgacttgcatattttgatgacaccgagtcttttactggtggttttcatctggatataatttgtgtttcgtgctaactgctcgttaaattgcttattatggagttgtatgtatgattgtgtataaaaaaaaaaaaaaaaaagcggcc

SEQ ID NO: 1600 - DNA, 805 bp, Zea mays
aaaaaaggacagtagtagtggcccatatcttcgtcgcagcgccggcgctccatctttcgctccatcccttactcgcgctcggcacaccggttctcagggcggcggcgctcaggctcgggctctcagcgacggcgtcaacggcttcccctcccgcctccgctcctccgcacaccggccggtgaccctgctcttatggcggcaagcgcgggcgagagccagggggtggaaagactcctctcctatgctgaagatctcgtggccgtcctttgcgtcagcaccgactgcgacgacaatgcacaggtcggtgccggagtgcagaggctgctgtctgcctgtcgatccgagtctgacgatctcgagatgcagctcaaagagtatcaggaaaaaatacactcctgcaaagaaaagattgacaaagcaaaagctgaaaccattactgacgatgaactcaatgcactacaaagcaagatggaagaaaaactgcaggaagagaagcagcttcgccaagagttaagagtgttacatgatgagcttgatgacctagaaagccaaagactttctataaaagaaagaaaggatgctgtcaagaagaaaaagaaagacacacagaaagcagaacgtacgctttccatgtgtctgtcggttacaaatatcatcccaaatttggaagaccaggataaggtttcaggatatattgtcgaccagaacaggaagaagatagagaagtttgaattcgagaacacgacgccaccagttgagatatgcgacgagctctggaagaagattagcgtgtttcagatcattc

SEQ ID NO: 1601 - DNA, 971 bp, Zea mays
ctttcgctccatcccttactcgcgctcggcacaccggttctcagggcggcggcgctcaggctcgggctctcagcgacggcgtcaacggcttcccctcccgcctccgctcctccgcacaccggccggtgaccctgctgaactatagtcttatggcgggcgagagccagggggtggaaagactcctctcctatgctgaagatctcgtggccgtcctttgcgtcagcaccgactgcgacgacaatgcacaggtcggtgccggagtgcagaggctgctgtctgcctgtcgatccgagtctgacgatctcgagatgcagctcaaagagtatcaggaaaaaatacactcctgcaaagaaaagattgacaaagcaaaagctgaaaccattactgacgatgaactcaatgcactacaaagcaagatggaagaaaaactgcaggaagagaagcagcttcgccaagagttaagagtgttacatgatgagcttgatgacctagaaagccaaagactttctataaaagaaagaaaggatgctgtcaagaagaaaaagaaagacacacagaaagcagaacgtacgctttccatgtgtctgtcggttacaaatatcatcccaaatttggaagaccaggataaggtttcaggatatattgtcgaccagaacaggaagaagatagagaagtttgaattcgagaacacgacgccaccagttgagatatgcgacgagctctggaagaagatttagcgtgtttcagatcattcttgttgtaaggcggcggaaacctgtgcctgtagattgtcgcggtgtggttgatgcagtttgccatgttgtttgtatcattagttcatgacgctgtactgttttgtaaggcggcggaaacctgtgtttgtatcgttagtttgccatgtcagattagctactacttattgtgttttaaattattccaaattataagttattctattttttctgagagcc

SEQ ID NO: 1602 - DNA, 1123 bp, Zea mays
ccggccggggaaaaaaggacactagtattggcccatcttcatcttcgtcgcagcgccggcgctccatctttcgctccatcccttactcgcgctcggcacaccggttctcagggcggcggcgctcaggctcgggctctcagcgacggcgtcaacggcttcccctcccgcctccgctcctccgcacaccggccggtgaccctgctgaactatagtcttatggcggcaagcgcgggcgagagccagggggtggaaagactcctctcctatgctgaagatctcgtggccgtcctttgcgtcagcaccgactgcgacgacaatgcacaggtcggtgccggagtgcagaggctgctgtctgcctgtcgatccgagtctgacgatctcgagatgcagctcaaagagtatcaggaaaaaatacactcctgcaaagaaaagattgacaaagcaaaagctgaaaccattactgacgatgaactcaatgcactacaaagcaagatggaagaaaaactgcaggaagagaagcagcttcgccaagagttaagagtgttacatgatgagcttgatgacctagaaagccaaagactttctataaaagaaagaaaggacgctgtcaagaagaaaaagaaagacacacagaaagcagaacgtacgctttccatgtgtctgtcggttacaaatatcatcccaaatttggaagaccaggataaggtttcaggatatattgtcgaccagaacaggaagaagatagagaagtttgaattcgagaacaccacgccaccagttgagatatgcgacgagctctggaagaagatttagcgtgtttcagatcattcttgttgtaaggcggcggaaacctgtgcctgtagattgtcgcggtgtggttgtcctcccaggatgcagtttgccatgttgtttgtatcgttagttcatgacgctgtactgttttgtaaggcggcggaaacctgtgtttgtatcgttagtttgccatgtcagattagctactacttcttgtgttttaaattattccaaattataagttattctgcccccaaaaaaaacaaacaaaaaaaaaaaaaaaaaaaaaaaaaaaaaaaacaaaaaaaaaggggggggcccctcctaaaag

SEQ ID NO: 1603 - DNA, 4603 bp, Zea mays
  misc_feature (1312)..(1312): n is a, c, g, or t
  misc_feature (3824)..(3824): n is a, c, g, or t
ttgactttatgtgagtcactgtttggttacctgtacgtaggagacgtggtttgcataaacagatgcaacataagtcatttcatttgcatccacagaaacgctcaaaactggcgtatccacctagccaccctagcgggagcctgcacgctcctgtacaggtatccaatcagactgtatgtgtccctcatccgcgctctcatccctcgtattttcgcgtgatttatatctccccaatacgtgtgcatgatgactcccgtatttttttattctgccgcatgcatccatgcagagctagatagaggatttttttttcaattttttaagtttttagactttatttaaggaaactgttggagtacgcactataattcgctcctaagatttttttagagtatccttaataatcatgttttaagaaaatatttttagcatttttttggagttgctctcaagctcctatccgtctcgtgaacgctaaaccctaaacctcaactcgatcagatatgtttctccttgatgaaatttagtgaagacaaacttgttagacgtcgtactctcgatcgctcctggtaagagcttgttcggttagctctcaatccatgtggattgagtgggattggatgagtttgaatcccaaacagctcaaacttcttcacaattttttccaatctcatccaatccatgtgtattgggaataaccgaacaagccctaagctgctccaattactttttttagttgacagtgaactgtttgactttggtgacggagctaactagctaagcagatctgactgacttgacaaggttaaacaacaagcaatgcacatcgtacgcgaggccaagtatagctggtttcgtattgggctgcgtaaaatatgttattgattccgtattgttggtttcgtattgggctgaaagtgaacagggcccatagacaaatagcttcttcccgttggtatcaattacttgatgttgtcgctaaagaaaaaagagtgcagctatcaatttattcccctgtagaaacacaagtactcagagcagagcggaagcacaaatgcagagctcaagagaactgaaggtacaaatgatcaagctgcagagtctactgaacccaacaaatgaactggatagcttcacagcaacagcacacggactctgaaaggcaccgctaactagactgcaaatctgaaggagagcaggctagctgttgtcactatgagccatagtttcagaaacgatacagaacacgttgtagttcagatttccatgaaaaatatcaaatccaaacaaatcaaatctgacaggcacaaantttgaggcacgtactcacaaaaccatggacagtctatttttttaaaagaaaaatacctcaaaatatcgaaattatagcacacatttcaaagaaattcaggaacccaatgaaatgggaagtttggagaaaccaaaactaaagagcttgaggacattaaatcaattgatgaataagaagtcttctcacacccccaagtcgcagccaaaaatgaagaataaaaatccaccaaataggtcattaatcacaataaaagaaaaaaaccagagatagcaggggggagaaaaatgctgcataaaagaaattggagaggtactcaactctctctactaatatctactcctcctcaagcatttggcatgattagggttggctggaccgcaggagacaatcacccaaccttccacatgtccatgagaaaagacgaaaatactcgtagaagctaaaactagatatacgctcccgagagacaaaacggtatagatttttttcttcttgctgttcataggacatgtacccggtgttatcgtggcttcattttattgtagatgcaaggtttaggagcatgccacgcgtcctctgattcacattctagctcgtggagtaggtgagtggggaaaaaaaacaagagaaaaaggaaggagatggtacactgctcgtagcttcgcaggtcctaccaaggcttggactacgcgccgaccctgcgatacgggccaaaagcccaaagcatagcatgcggccggaataggaaacgcggccgatcacgaccagaggtccaaacccaaaaagactccacccacgcagctggcagcgctgaagttctgggtaaccgtcaccgcctcaccggcgtggccagttgagcgggccggtggtaaactggtcggtgccccacggccacgagagctcagagatgacaagcaggaacgagcattccccaggaaattataaactcaatcaagttgacagattgtaatttgttcacgttcaaattatcactctgaaccgcccgatctcgtgctgatctgattcgatgcatgatgcttgctgtggcggacaggcattggtcagtttgtaaccgatgcccacacgagcatatcggcagcaagaattcctagcaaaccgactactagtactaggaggcacattgcacgttggttggctcatccacggcacgccccacggccacgggtgaagtcatgctcgtggcttccagttggcagccagccgcgcgcggcattcaagccggtggttggttggttggttgggcgcccggcccggcttccgccgccgctgcttcctgcgacgtctgctgtgagctgtctggtcgtccggcaccggcagtcagctagctgtacaacgcggccaaaggaacacgaccgggattcagaaaacccgcgtggccctcctttccgaagaactcatgtcccccgtgcgttcggcaccgggaccggtcgccgccctcgcatcgtatgcactgactgaccccaccgtcgtcgtctcgcgcgcgcggctgcactgcacccgcacaggcacagcagcacggcgacaggcaggcacagcagcctcgctgtcgtccgcgcatcgccagccggactccaggaacgagacgcgaacatgcgcctcagcagcctccgcgctctgctctgctctgccctgtcctacatctacatgcatgagcgcgtcgatcgattcattctttccgtcctcatcccggccattccttgcctgcccgccgcgcgggctcgatataagccttgtgccccatctcatcagcatccatcgccaccatctccgatccatctcttcggctgcctgtgctacccttcccttcacctcacacaggaatatactacacattcctgccttagatacatatatacttttttactgaaaaaaaaggctgagccggtgcgagcgaggcttgagcaatggcgagcgcgtttagctcgagggcatgcgcgctgctggcgctgctcctggggctctgcaccgccggcgcggcggcgggcagggtcgacgacgggctggaggtgacgtggggcgacggccgcgggagcgtctcgcccgatggccaggtgctgacgctgtcgctcgaccgcacctccggctccgggttccgctccaaggacacgtacctcttcgcgcgcgccgacgtgcagatcaagctcgtccccgacaactccgccggcacggtcaccaccttctacgtaagcttccttctcttctcttctttctcggccttccagtttcagttcagcaacgcatgcacgtccgagctgaccagagcgccaccagctgccaacgggtttctgacgacgggtgcatgcagttcatctcggaggggccgtgggatgtccacgacgaggtcgacctcgagttcctgggcaacgccagcgggcagccgtacacgctgcacaccaacgtgtacgccagcggcaacggcagcagggagcaacagttccacctctggttcgaccccaccgccgacttccacacctactccatccagtggacncagcagcacatcctgtaagtttcagaactactactactaccatcaccattccagcatttggccgaagccgatcagcagcgactcagcatcagtcagccaataatcctcattcttcttcgctaccctactatccgtcgcatgcagcgtgctggtggacgggacgccgatccgggagttcaagaaccacgcggaccggggcgtgccgtacccgtcgtcgcagcggatgcgcctctacggctcgctgccggacgccgaggactgggccacgcagggcggccgcgtcaagacggactggtcgcgggcccccttcgtggcgcagtaccgcaacttcacggccgcgccgccggccacggcggcggccggccagtacgggcagcagatggacgcggaggcgcagcaggccatgaagtgggcgcgggacaactacatggtctacgattactgcgccgacaccaagcgcttctcgcagggcgcgccgcctgagtgctccatggcgtagtcggcgtatagaggtgctgggctgaaccacggtgcacttcgattgcgatgtcgatcagtgcacactatatacgacgcacgggtcaattcattatttataccgaccgatcgattctttggtgtgaaagaatactctagtactataatttaattcatttgattggtcgcaagagattcgtttaaaatcaatcgtttatgtttatactacccaagtttagtttcagaggttggccaatgaagcagcaccagcagcttgttgagatttattcggccagacagaa

SEQ ID NO: 1604 - DNA, 1292 bp, Zea mays
cccggccattccttgcctgcccgccgcgcggactctatataagccttgtgccggcccggctccggatccatcaccaccatctccgatccatctcttcggctgcctgtgctacccttcccttcacctcacacaggaatatactacacattcctgccttagatacatatatacttttttactgaaaaaaaaggctgagccggtgcgagcgaggcttgagcaatggcgagcgcgtttagctcgagggcatgcgcgctgctggcgctgctcctggggctctgcaccgccggcgcggcggcgggcagggtggacgacgggctggaggtgacgtggggcgacggccgcgggagcgtctcgcccgacggccaggtgctgacgctgtcgctcgaccgcacctccggctccgggttccgctccaaggacacgtacctcttcgcgcgcgccgacgtgcagatcaagctcgtccccgacaactccgccggcacggtcaccaccttctacttcatctcggaggggccgtgggatgtccacgacgaggtcgacctcgagttcctgggcaacgccagcgggcagccgtacacgctgcacaccaacgtgtacgccagcggcaacggcagcagggagcaacagttccacctctggttcgaccccaccgccgacttccacacctactccatccagtggacgcagcagcacatcctcgtgctggtggacgggacgccgatccgggagttcaagaaccacgcggaccggggcgtgccgtacccgtcgtcgcagcggatgcgcctctacggctcgctgtgggacgccgaggactgggccacgcagggcggccgcgtcaagacggactggtcgcgggcccccttcgtggcgcagtaccgcaacttcacggccgcgccgccggccacggcggcggccggccagtacgggcagcagatggacgcggaggcgcagcaggccatgaagtgggcgcgggacaactacatggtctacgattactgcgccgacaccaagcgcttctcgcagggcgcgccgcctgagtgctccatggcgtagtcggcgtatagaggtgctgggctgaaccacggtgcacttcgattgcgatgtcgatcagtgcacactatatacgacgcacgggtcaattcattatttataccgaccaaaaaaaactttggtgtgaaagaatactctagtataatttaattcatttggttggttgcaagagattcgttaaaaattaatcgtgtatgttgcaagagattcgttaaaaattaatcgtgtatgtttatactacc

SEQ ID NO: 1605 - DNA, 4518 bp, Zea mays
  misc_feature (1369)..(1369): n is a, c, g, or t
gatttttgtcttttttgtgcggctttttttgcacttgcaattttatattatttttttcacaagagtgtcacaaaaaaatataatataagagcatagaaaaatctcgtatatctgttatggcttttctgctctaacttcaacagaatgtttgacaattttaaagacctcaaacgcaaaaactcacgacacgaaagttgtaggtctcatttttctcttctttagatatatggatcacctattttgaataaaggaagtgggagatattgaccacgaaatatagactaatccaaaatttaaggatcataaacatatttacttccaatactaataactccttgatactgatgttttctagaaatttcgcaaattaaagttgtatataattttctaatctttgcagaaagtacaagaacactaaatcatgagtttgtatgcgatatttatgctcaaaatactgaattggacataaactaatctgataaagatgagatgaaggatgaaaaagatatgatctattttggagattgaatatgtaggatcgcagcggatgaaaggattaaactgaatcaaatcaaatctaaacgagcaacctaactcaacttaggacacaaactcaggactacggcgcaaaggctaagatgatggttgtaggtcaagatacacttattgtcggtgtttcgtatctcgctccgactagtaaatttattatacacattttaggctccagagggtgcacgcagagggcgctaggtttatactggttcaggcaggatatccctacttccagtcattggtggcatgcactaccagcaccattgatgatcaaacttgtaataggggttacaaacggtcgagagagggagaggctcccaagtctttttttcgtggtgaaagtggagcttagaagctgcatggtataatcctagctaagtcttggcttggcggagcttcggcctactggtccttgtcggcgctcctcctcctcatactcgtccttgtgggtttgtgtccgcgtgaaggcgtttggttgccccaagtgctctctcatttggaccggtccatcccctttgcttggaggccagcccctcccttttatagtgatattcgtgaagtccgctgctgggagaggcctagggtgggccagcacggtagcaggagaggcctccctacgacgatggagcgccagcacaaggaggaaatagaaggcggacgcaactctcgctctccgctgagtcgaaatggagatttcgcgtccgagaggtctgcacacacaccgccacgcgtcgagacgtgaatggacgaaagttccgccgagtgcggaggtagctccaaacttgttcaggttttaaggaacaagactagagttttntagtgtagcagtgagcacaaacgttgcatgaaacattgatgttcaatagctatacgttcttaatgcaatatagggagttccaaagagctgctagaccctgcagaaaactttgttgactatcactagaattttctaacacatgtatattgttagttatcacctcatgacactacataaccatattaattaaaaactttccttctaataccaacgcatgaatatttgtcctaaatctgacccatagctctagttggctttcgaactttcaatttcatggccacacgtcccaatgtcatgatggttttgttattgacactataattataagcctgtttggatctatggtgctaaaatttagtactacacttttgtttaaactttagtatttagagatccaaagaggagtactaaaaacatgttaaaaatgaagtgttaaactttaacgcccaatatcagtttagtttctcaattcgtgctactttactaagcacattagatccaaacaagtcctatattttattcttcatggccagtgaacacacaaatcctttatgcctgcattctttttttacacaattaaatcgagtacgtcaaaacccacttcccactatctaaaatatcagcacaaaattagatttccttactgataaaatggaactttaagcgtgcctactagaagctacctttccttccgagtcgcgaaagaagaaatggccgggaagatacacagaagacccaccaactaaaaatggcgctcaccacggcctccactgaaacccaagactagccacatctttttaaaatcctcgcgcaagtaaagcacccgagcaagctataaaatataccttcccgtgaatccagatgaaacggaccgacatgtggggacacacatttcatggtcccatgtgtcatgactcatgagacacaatctacgtgaactcccccggtgcttttcccagagagagaataggacaggatggatcacattgcgcggcagagaccccgccgccgcatccgcaccgcaccctcacaccgactgcgcagccccaccgggtcctcgtccctgtggcccacgtgtcagcagtggacgccgcgtgcgcctaaggcgaggcgaacaactacgaacccgtcgaatcgaacggcgagcggaccaacaaccccacatctatgaattcgagccgcaggatgcagcccagccgcgcctccgccgtcggatggcgggtcgtctctcggatccgccgtagaatatgaatttgatttcgaaagggaagtgtgggagagaaagaaaaggggagaggtggcaagagagagaagagaagagaagagaagaggggagtcgaggtcgagagcagcagggagagggaaaatccactaatccccccaccccggctctctcgaaacccgccattcccctccgccgcaaacacgcgtcggagctcgtggcgagcgccgccaccccgcactcgggctggggggcgtccctccgcccccttcgatctagagccggcggccgcgatcccgccgcgggtcctcgcggccgccgcgaattgggtttgtactgacgttaccggtgggcggaggcgctttgatcctgtagctgccgggttgggttcagtagatggcgggcaaggagcagggcggtggaggcccgccgcagaggcctcccatgcccgcagcgtccatgcagccgccaatcaagaagctggtaaggcagctggacttcaactcggcggcgttggcggggaaccccgcgatggcggcagcggcggccgccgtgtctagggctcttcagccgagggcgttgcccgcggggttccagcatccgcagcacgtgagggctgccgtgccgatggtggtgccgcagcaactgcaccagcgggcgctgccggtgatgcgcccgcatccggtggtgggtcatgtgccgcggcacgcggtgccgctggcggtccctgtaccgcagctccgtccgatgccgccacagccagtccagcgtcccccggtcgccgttcccttgtgagtgcccccgttctgagatttagaagttttgaaacttccgcctctctgtttggtgcggggctcattttgctcgatcactgagcctgttgtcgtcttgattcatatgctgaacatgcgagcgtttctgatttccttagcgtcaccacgagggagtttccaaattttaccgtgggcttgtcaatttgtcattcctcggaaacgaagacacgtatttgcgttagatgggtttcttgatcttaaactaacaattctaggaaagtttcagtgcattctctccctgtcgatccaaatatttcaagttctctctttgaaatttgcatcttgctccgtgttctaattatgctttgggaccttgtaatgtaggaaaccagactcaccaaaaccgtgggcaagactttacgaagggaaagatagcactcccacgaaggaaaagtgctgcctctgcaggaactccacatgttggaagttgtaagtcaggttctacccttagctcgcagaagttttaaactattgcaaaggacgttttcacatgtggatagtgttctccttttatcgatatggattctttgacttgatttaaaagcgacaaggaacttcatgcacgtttatggatagtcaaaaatatgcttatcactcctagacggagggattatttaatatttatatggcattatagacgtgggtctgcttgagctatggcattatcactgaaatttctttgtgatttcaaaataaataaagttcacacttgacacttagaaaaaacctcccccctcccctccccctgcaaatgcggagatgcacttaccacttggactagaattataagctatgtaacacactcagacgagtagagcaaacaccttatgttgtttggttattcattaagtagatacatacatttaaatgtaggttagatgagtactagtaattgcaatattaataatttcagtaatctttccagcatttttcagttcttcatatcgtctccaaaaccctaatttctgactctgtgcatccatttacagatctatacagtgtgtcattgttttgacctccacattgaactattaaagtcatcccacctcactttttaagtcaaagaatgtccgtggttttgaattcttctgcag

SEQ ID NO: 1606 - DNA, 1951 bp, Zea mays
  misc_feature (1831)..(1832): n is a, c, g, or t
gtgcaaaaaattaaaaaaaaaacaggaacgaagagggcgtcttctaccctttggaccttggcggaacgaacttccgcgtgctgcgcgtgctgctcgccgggaaagacaggcgtgtggccaagcgagactccaaggaggtgtccatccctcctcacctcatgtcaggcaacgcgtcggtgagtagcgcgcattttccatctgttgtgctcatcctcatatccatggtgtcgagtgctgaatcctcctttcaggagctgtttggcttcatcgcctcggcgctagccaagtacgtcgccgcggcgggcgaaggggacggcaggcagagagagctcgggttcaccttctctttccccgtgcgccagacgtcgatcgcgtcaggcacgctcatcaagtggaccaaggcgttttcggtcgacgacgctgtatgtagagttgtagttgtagactatccgttgatcgttccatttcgtggctgtgtggactctagacagacgtatttataaataccgtttctgaaactattcaggttggtgaggatgtcgtcgccgagctgcagacggccatggagaagcaaggcgtcgacatgcgtgtggcggcactggttagtctattgatccggctgtaataagaattctcatacaaacagctagcacgtacgggtcgttgacaatttaccttgtcattcatatatatgcctcagatcaacgatacggtcgggacgctggctgcgggccggtacaacgatgaggacgtcgtcgtcggtgtgatactaggcactggctccaacgccgcgtacgtcgaagaggccagtgccatacccaagctcaagctggagggcggcgaattgcccaagtcagggaacatggtgataaacacagaatggggtaacttctactcgccctgcctccccatcacggagtatgaccaggccttggatgaggagagcttaaacccaggggagcaggtagggacgatgattctctcttgttcatgcatgttaataatactataaaaccttcgagcttacacggtttatattaaccgctgttttcagatcttcgagaagctggtttcgggcatgtatctcggcgagattgtgaggcgggtgctgcttaaaatcgcgtcgcagtcttccatcttgggcgatgtcagccacacgaacctcaaaactcgcttcagtcttaggtatttttatgtctctcttttatttcgagagttgcctgttccatatggaaaaaaaaaccccgcgtccgtgctgctctcaccgacgttgctgctgcgtttggcattcaggactccggacatctccgcgatgcaccatgacggcacgcctgacctgagagtcgtggcggagaagctggccgacaacctcagggtcagggacacgtccttggacacgaggaagatggtggtcgagatctgcgacatcgtcaccgggaggtctgcccggctggccgcggcggggatcgtcgggatcctcaggaagatcggtcgagcggcgccaggcgacgagcgccggtcggtcgtcgccatcgacggcggcctgttcgagcactacgccgagttcaggaagcgcctggaggccacgctggtggagctgctcggggaggaggcgtctaggctggtggaggtcaagctcaccaaggacgggtctggcctcggagccgccctcattgcagctgcccactcgcagtactgaacgcccaacggccgtgtgtgtcggtgtgcaactcgtgctgaattcctgtacgttttcaagaacaagtttgctcggaatctgccaacaagcaagtgctctaatggaaagttgctatgcggaaaaaaaaaaaanntcctagggcggccgcggtttccaatgtttttttttttctaaagggatgggggatgtgacttcagctttccaggcagttgagacttaattgagatggagcagctgtgcctctggttcatt

SEQ ID NO: 1607 - DNA, 1261 bp, Zea mays
cgcgcattttccatctgttgtgctcatcctcatatccatggtgtcgagtgctgaatcctcctttcaggagctgtttggcttcatcgcctccgcgctagccaagtacgtcgccccgccgggcgaaggggacggcaggcagagagagctcgggttcaccttctctttccccgtgcgccagacgtcgatcgcgtcaggcacgctcatcaagtggaccaaggcgttttcggtcgacgacgctgttggtgaggatgtcgtcgccgagctgcagacggccatggagaagcaaggcgtcgacatgcgtgtggcggcactgatcaacgatacggtcgggacgctggctgcgggccggtacaacgatgaggacgtcgtcgtcggtgtgatactaggtactggctccaacgccgcgtacgtcgaagaggccagtgcaatacccaagctcaagctggagggcggcgaattgcccaagtcagggaacatggtgataaacacagaatggggtaacttctactcgccctgcctccccatcacggagtatgaccaggccttggatgaggagagcttaaacccaggggagcagatcttcgagaagctggtttcgggcatgtatctcggcgagattgtgaggcgggtgctgcttaaaatcgcgtcgcagtcttccatcttgggcgatgtcagccacacgaacctcaaaactcgcttcagtcttaggactccggacatctccgcaatgcaccatgacggcacgcctgacctgagagtcgtggcggagaagctggccgacaacctcagggtcagggacacgtccttggacacgaggaagatggtggtcgagatctgcgacatcgtcaccgggaggtctgcccggctggccgcggcggggatcgtcgggatcctcaggaagatcggtcgagcggcgccaggcgacgagcgccggtcggtcgtcgccatcgacggcggcctgttcgagcactacgccgagttcaggaagcgcctggaggccacgctggtggagctgctcggggaggaggcgtccaggctggtggaggtcaagctcaccaaggacgggtctggcctcggagccgccctcattgcagctgcccactcgcagtactgaacgcccaacggccgtgtctgtcggtgtgcaactcgtcgtgaattcctgtacgttttcaagaacaagtttgctcggaatctgccaacaagcaagtgctctaatggaaaagttgctatgcggaaaaaaaaaaaaaaaaaaaaagggtta

SEQ ID NO: 1608 - DNA, 727 bp, Zea mays
tgggtaccgggccccccttcagttttttttttttttttttggaggaaaagcacaactctgtaagagcaagaacaaatcaacatcgaatggcaccttcgagctctaacactactaaaacagtccgtcacaatcaccgtctccacctgaggaggactggaggaccaaatcctagaattccccccaacaaaccaactaaccaaccacgaggaagaacaaacatcaggtgaccataatcaaatcatcaacggagcccacgagaacttacgagtaacaacaacagatttcatcgcgtcacgacatgcacgccgcacgcgcagagtctaggagagagctacgggggctcggcgtcgaccgcctgccgctctcgctcacaaaaggtacgcgacggcaagggcgacagaggccaccgaggccgcgaagctcacggccgctgcggcgccgccgttctttttagattcgaccttgtccgcggcgtcctccgttggcgcgtcggcgggggccatgtcgggcgagtccgccgggggcgcgggcggggagtgcgaaggggacctgggccttcttcttcttcctcttgccggcggccttgggggcgggcgccggtgcggagccttcgggagccggggccgacgcgggcacgtcggcggccggtccgggcgccggcgccggggacggcgcgccgccaaagagcacgtgcgggagcagcacgctgtcgaccgtgaggatgacc

SEQ ID NO: 1609 - DNA, 2709 bp, Zea mays
ccctgcccgtagggctagccggctagaggccatcgttccctgccccgtagggctagaggccatcgtcacagaaaactagcgaccgctggcgctccctcagctttatcgccccgggaacagagcagcaaaactgcaagcaaagggatccgagggaacttctggcaaagacgaaagacggagacagaagagaccatgccgaaccagccaacaagacgcgagcgaaggacgcgccgcgacccggacgggaaaagcatgggcatggccaaccgccatccccagccaaaacgtgagaaaaccaagacatacaaccaagccccacaccgagtagagccaatgcttgtacgcagttggagcggtcgctttccgtgtttcctcgtgcgtgcttctctcctgtacgggtgtgtagacgtgtagtcatgacaagaaaagggaccaccgcataaaaaagatcatcgcgtccagcccagcgtgcaacagtcaagagtggcgatatacacgtatacctacgggtgtagtagtcatttgtgcagtgcatgccagccagggcgcaacgcagagtcacgtgatgcaccaggagattactgccattcgtgtgtgcaggtagggagaaatgaagcagtgacacagtaactgaaggtgaaaatttgtgaagactagtgtacttcgtgaggtaaattttgcttgaatatttggcgaactagactaggcatccaagttttaatcagttgaatttataccgttcacattcttcgcatgtcttctttcaagtcgtagtacaacattgcaccagcaataactgaatccctacttcggttggcacaagaatgattcggctagaaagaatcaaaaagcatttgcaaaagaagcttcagaaaactcctcggaaaataaagaactcagaatgatccatgtgaaatgcagtcacggatggtaggtaaaatgaagctggaggaaaagcacaactctgtaagagcaagaacaaatcaacatcgaatgacaccttcgagctctaacactactaaaacagtccgtcacaatcaccgtctccacctgaggaggactggaggaccaaatcctagaattccccccaacaaaccttctttcctttttttttttttttttttttttttttgaccataatcaaatcatcaacggagcccacgagaacttacgagtaacaacaacagatttcatcgcgtcacgacatgcacgccgcacgcgcagagtctaggagagagctacgggggctcggcgtcgaccgcctgccgctctcgctcacaaaaggtacgcgacggcaagggcgacagaggccaccgaggccgcgaagctcacggccgctgcggcgccgccgttctttttagattcgaccttgtccgcggcgtcctccgttggcgcgtcggcgggggccatgtcgggcgagtccgccgggggcgcgggcggggagtgcgaaggggacctggccttcttcttcttcctcttgccggcggccttgggggcgggcgccggtgcggagccttcgggagccggggccgacgcgggcacgtcggcggccggtccgggcgccggcgccggggacggcgcgccgccaaagagcacgtgcgggagcagcacgctgtcgaccgtgaggatgaccgtgggggggtcgtcgagcacggtggacgcgacgcgggacttgtccacgccggtgtccagcgtcacttcgtcgccgctggaggcgacggcgaggtcgtacttccccgcggcggtggaggcgagggtcgggatgcggccgctggcgaccttgagcgacgccttgggcgcgtactgcggcagcgcgtggtactgcagcagcgcgacgaggtcggcgctggtgagcttgctcagatcgggcaggtccttggccttgaacgcgtcgtcgttgggcgcgaacagggtgagcgccttgtccatggcggcctggtacgtcttgaccaccccggacgacacgatgaggcgcgcgaactgcttgcacccggccttctcgaggaggtccgtgatgttggcggacgacgccgacggggcgccgaagaggccggggaaggtgatggggtcggagacctcgaggacggagaggttggacgggaagtcggcgacgcgcttggtgtaggtggactggaacttggcgccgggcgcggcggacgcgaaggcgaccttgccgccgcgtaggtcggtgatgttgacgtggcccatgtcgcccgcggcctggccggtggtctggtagagcgaggtggtgagctgggagctggagccgatggagtgcagcttcttctcgtcgaagtagtcgaggagggtgaggaggcggagtgcgttcttgatgtcggcgagggagaggttggcgacgagggaggacatggcgccgttggtgaggacgaggacggtgaccgagctccggctattgatctcgtcgcacaccttggtctccgagaggtagctgttgtacagcgtgtactcggagcgcccgtccaggatggccgtgatgttgtgggcggacgccgcggtggcggtgaggcagaggactagcaggattaggcggtgggaggcggccatggcgcggtggtggcgggcagtgccgcggcccgctgctggggtctggggaaaggaggggaacacggcgcacacgcgagaggaaggaaggcgagcgtggggaatgagtacggggagccgacgaggggttaagcggtttttacgtgc

SEQ ID NO: 1610 - DNA, 2576 bp, Zea mays
  misc_feature (1637)..(1637): n is a, c, g, or t
cactatctcgaagatacatctcgttgcggaagcataaggtagctttggaggtaaagcttagagcgacatgtgggtgcaacaaacaaacatgggggcacaacacacctcacctcatataactaatttggcttgcaaatcgagagtcccgtacgaaaagtactcgttgtctcttgacccaataaatcaaatacaccttcttacacaatttgtccattttatatttttcgtttccaataacaaactcaaagtgacttgtttttttggacctttgacacatagcctttaaagtagatttcacaatttaagcttgttatgtaaaacaaactaatttcgagagaggctgattgaggagaaagtctgcggtcgatgattcaattggacgaaatcgatgtttaaactgtcttgttgattaaatttctagcttcacacgtgcttgaacggcgtaggaagtgttggaatttcccttcttatgatttattagagtagagttttgttacagtttatttacggattcattacggtatttattagggatacgttgacatataacttcagtctttcttttttaatagtcacaagaaactttcacacacctactaggagtaacagaaaaacatggacatattgatttttgaaaaaagaaatattgacagataaggtgttggggaccgtagagactagagaggatgaggacgacgccaggcagacgagccttgccgattgccgtcgacgtcaccctggtcaggcgtcacttgacgacgtatacaggggcacagggctcaggttttccttcaaattgcgccgaaatactcgagatttcttggatttttttacttgttcggcccgtgctccttccggcgcctctctagtctattctccttcctcgtcgagtcgtcgtcttcttcgatccactctttcccccatccctatctccctactttccacgcaactgcgtttcccccggactcttcttccacgattccgttggacccctaccgctcctcagtcagtcctcgcccctcccagcaccggccaacaatccctcaccttattccctgtagctactatgctgccctcttggatccctttttcacttgtctgagatttagccgccgcccggtaggaagaagaaggggaagcaccatattttctgttcctggcctggcgcagcgccggtgagatttcagtccgggatcggcaacgctgggaggactcgcgtgtgatttacgccgacttccgtgccgctctaggaagggtcacgtcgaggaggcttttgccgacgcggatttgcctggagccagccaagcagagcgcagaattgggggtgtttggccgtgcaaagccagaaagttctcggtttggctgccgaaaccgcttgaggcgaccaccatctcatggtcgtagtggtccgggtccggcacaagtaggggctcgcgtcttgcgcttggcagttgtgggaagccatggagccgtcgtcgtccatcacgttcgcgtcgtcgtcgtcgtacctgtccaacggctccagcccctgttccgtcgcgctgccgccgccagggccgccccagactcccccgttgcctgccggcccaggggtggggtgctggagtcgctgccgcagggagcggaggcagcgtggnaaggccgtgaagcctgaaccggctcagcaaaaacctcgagcggctgctcctcgacccggacctagactgcagcgacgccgacgtcgatgtgcccgacggtgggccgcccgtacccatccaccgctgcatccttgccgcacgcagcgacttcttctacgacctcttcgccgctcgcggccgcgcaggggcagcgcgcggtgatgcggccgccggcgccggagtagccgcggagggggctgccagtggaaggccgcggtacaagatggaggatctcgttcccgccggccgcgtggggcgcgaggccttccaggcgtttctggggtacctgtacaccggcaagctccggccggcaccggtcgacgtggtgtcttgtgctgacccagtgtgccatcacgattcgtgcccgccggccatcaggtccgcggtcgagctcatgtacgcggcgtgtaccttcaagatccccgagctcacctcgctcttccaggtgagacgcaatttggttcttgctcgccccattgtcaataggattaaactctaatttctttaggaattgtttcgttctatgccaatactgtacatggcttcggtagactagaaatggatttgtgattttttttctccaatccgagtgttgactacatcactacaaaaagctatcaatagctgaactgctaaaattgctgaatgctgattctgttttctccaatccgagtgttgaccacatcactgcaaaaagttattaatagctgaatcgctacaattgctcaattgttgattttgttttttccaatccgagtggtgacactacaaaaaactattaatagttgaactactaaaattgttggctattgcttttttagttgattcaagcgaacctggtggcttgaagtctatgaattgaaatggaatcattattcattaggctgctcaacatttgta

SEQ ID NO: 1611 - DNA, 2632 bp, Zea mays
ttttttttttttttttttcttttgcacacgcgaagaattttttttcctgcattgctgcagcacttttcgctacccaaaatatctggacagtaccatctgatcatacagcacgcctactccaacgaagacaccaaaggtcacagcgaagacgacgacgtcaccgccacacagtcctgcgtcgcgaacgggcgcaggacgacctgcctctacagaagcagcgctgcaccggcgaacaagcatagggccgcacatccccgggttccccgcgaagctagagctcgggaacgtgcagaactggcctcctgccggaacaggcccgtccaagtcgttgttggagacgttgaagtaggagaggaagtggaggctctccagcgccctggggatctcgcccgtcaggcggttgctggacaggtccagcacctccaggttcgtgaggttgccgacggcctgcggaacctccccgcgcaggctgttgaagctcaggttgagctgcgtgagtcccttcaggcggccgatctccggcggcaccgcgccggtgagcccgttgtcgccgaggttcagcagcttggggcagtagttcgccctgtggtactggagcgacgcggccatgtagacgggcagcgggaacgcggcctggctcgaagacccaccgtcgtcgtcgtcgtcgtccacggtcgtctcggacctcagcatcggtagatccgccagcgctgtcgggatctcccccgcgaggctgttgttggacacgtccagaacgaacaggaggctcaggccgctgacccaggccgggatcgggccactgagccggttgctggacaggaacagctctcgcaggttctcgagccctgacacccagcgagggatttctcctgacagcgagcagtccgccagggacaggacctgcaggctccggtagccgtcgatcgtctcgtcctccggcatcgcctcgcctctgaagttgtcgccgatcagcagagtcgtgaggctcggagcgctcttgaggacctggagcgcgttcgtgacgttcgtgaacgagttgtttgtcagggacaggaacctgagcgacttgagcctgccgatccccggcgagagctgaccgtggaagccgttggaggacagtcggagcgcgatgaggtcgctgcacgagtacaggctctcagggactgtgccggtgaagttgttgtccatgaaatctagaacttttagcctgggcaaggtggagaagtcgacgctgttcaggtctccatggaaaccgttgctccggagaatgacggttctgagactcgagcacctgctcagacccggtggcagctcgccggacatgctgttgtgctctaggcgaagctcctccagcctctcgagccgcccgatagagtccgggatgccgcccgtgagttcgttctccgcgaggtcgaggacgaccagactcctgagctcggctagacgctcggcgctgagcgctccctgcagacggttgtttgggaaggagatgtgctcgagagaggtcgcgtcgtagagctcgtccggcagagtcccgtggagttcattgtggccggccttgagcactcgtagcgcggagcaacggccgaggttcacgggcacgcttccgttgagctggttgaagctgaggtcgagcgccgacaggaacggcgttctggcgcagatggtgctggggatctctccggtgaggctgttgttgctcacgttgagagtgacgagcttggtcatgcccgccagtgtgagcggcgggatttgccctgtgagctggttgcttgagacgttgagtaacttgataggctgccgtccctgtccggcgaacgtagatggcagctcggggagatcaccgttcaggttgttgaagctgacgtcgagggcgagtaagcttctggacagcagtagctccgcggggaggccgccggagagggagttgagcgacaggttgaggcgcagcaggctaggcatctcgccgagcgccggcgagatgcggccctcgaggcccagggaagccagcgagacttctgtgacggcgccgtcggcgtcgcaggtgatgcccttccacgtgcaccagtctgtgccgttcctccaagaagtggcgaggccggagtcctgcgagagcccctggagaaacttgaggagggagaccccgtcctgctccgtgctgctcgcacacccggtgggagagagcagggagagcagtggcagcagagcaagagcaagcgatcgtgccgaccatggtccacctgctgctctgctgttgttccgtgaggagtggcagtggagtggccgcatggtgtctatcttccatggaccagccggcacagagctcagaatgctttgatcagctccagtatctcgaagcaggttggttggtctttcaattattggataccttttctgaagcgtggatatcgatgtcgaatctggattgcggatgcagtctctgagctttcaccaccatggacaagttgattgttacgataaaatatctttaatatttagactcccttcagcagcacacgctaatggagtcggtatggtatatttaatgtttcttgttgtccgtcagctcactaacaagatctgctactgtgtcctctaaaatagcggatgtctctggcaactatagaggcga

SEQ ID NO: 1612 - DNA, 8663 bp, Zea mays
  misc_feature (3906)..(3906): n is a, c, g, or t
  misc_feature (5848)..(5848): n is a, c, g, or t
gataatttataaagaactagaattcttattacatgtcgagtgcttaatattaataatatcatacaatattttttaacatatagtattgatgaatttatcgactcatttatattgtaatcttggctccgcccctaactgacaatattttgggtcaggacctgggtggccagccagctcgatccttcaggtacggccctgcggaaaactgaaggttgagggacagatgtagattgagcgtcaacagtttatttatcatccttactagcagtagaaaagcgtgtgcgacactagttgcaaaaggcaccaccgcgttcctttctgttatcggaagccgcacctgtttctagattcagagattcagagacagcacgcaataagataagaaacatggtggtccaacgcaagacgcgatagccgcctgtcgccgcttggcgaaaacactgcggcttgcgttgaaaacagatggcacggtagctactagtactagctagctaacagctgctctctggcagctggcaccagtacctaagcgtagaactccgatcgatcaaggccagccagcctacaggcgtggcactgaaacttcacatcgttctgtccacgattgctcccgtgcaagaagacagcggccgcagttgagtgacgctcaatttaagagcaccgtccaaagcacgcggtgttccttgtacatgtgagcaacagtcgcccgagtaacatgcaagcagacacaagcgcgctagagaccacaacaacatgatggttgatggatcccgcgcgcgcgcctgctctgagaggaggatgagaacgaaccaacgaacaaacaaacaaacagaaccgggtcgccagaaagggttcttttcttccgaagatgcaaatgatggcctcttctttgtaggaaccccaaactccactgaactcaaggcccacgcccacacccgccgtggccaccgatcgagtccacaaccacaatacagcttgcattaacaccaatctacttctgtttcagatcgagcgtcaatgtctgtgtggcagctcatcagctactggctctccaaaggaagcttttggagccagtgaccagatccactcgtcaataaaatatttccagaatgtcgtcgtgaatactgtgtaaaggctcgtcctagcagtgtggttcaaaagcatgaggcaagagtttttttatacaaataaaaactatatatgtaggagtactaacaaagtaattattggctaaagacttgtccccagtgaaataagtatgcgtaatatactggtccgcacacacgtattttagttagtgtttggtttcagagtatagtgagatgagtcgctccgcttctaatttattgatgtttgaattagttctatggagaacaaaaagtgatcttgaaaagttatattcaaatcctaaaccatcatgctccctcaaatctttcggacggagccactcctattaatgagctgctccatcgtcccaaccgttccaacactaccttaaccattgacgatacgtaaccgctctagagctagacagacacagaacgtacgatcgatagcaccatgtgcgaaagcttcatcttggattcatgctgcagtggacaataatgtcccctgagctaaaacaccccacccagtggtggtggataacctgagctcatgcaaatatatggctactacaagtgaaagtatctcccggcggaacatgtacaaattgaatcaaacaacgcagaaagacacactttttttcataatgcgagatgcacaagagatcgagctagccaccgtggttctgctcaccgatcttcagcgttgcatactgttgcagcagctttgtaagatgacgatacttttgaactaattcaaccaaaacacatagcgacgcgcgcgcacacacacacacactctctcttctaattaagcagtggttaccacgggcacggggtaggccaggccaggccagggtgcttggatttcgaccctacctgttgtggagagcgtcgggacagcttggaatctggcgcttgtcgtctccgatccaggcggtggaacgcggtgctgagcggccggcggcggcgcctgcttgaggtctcgggcggtagcccacgacgacgggcatcccccctgcggcggccacgctgcttgttgctgctggacgccgcggcaatggaaccgcggccgctaataatttagtgtcgtcgccgtggaggcatgatgcccacgccaggaccaggcacatgacgatgggtgccacagggtatcttctctgcggtctcttattcgtcgcttgcatcgacgtttgtgctagctctttctcagccagctctgcaagggagagacagagacagagagaggagcaaggaggaaggaggaagaaggaagaaggattagctgcaaaacagcggcgccggcacgccgctgatggccattccgtttctccgcaccgatacaaaataatgtgcgcgggcagcgggaatcaaggagtaatgccgcctcaagctagcgctccaagaggacttgctcggtagtatcatatactagtacaggctactagtatgagaaagtgacgacgtggtgtcgtctgtttctttctttctttctctctctttcagagggcgtaccggcctgctgatcctggtcacgcccaactagaaaacacgcttgtaaattaagttcctacacagttaagtatctggttatataggtcaatgcatgcctgactgcgtcttaacaagatacaggaaccatccaccagtccagatctccaggaccacctcgatcttctggtgcaacgacgactcctcctttctccaaatgtaattataaataatactacctccgtttcgttttagttgtcgctggatagtgcaaaatcgaactatcagaaacggagagagtactacttactgtcttcctcttcctctgttcctaataaataaaccaattcctaaagttgtcttaaccaaaaataataataataaacgaatatttgataccaaataagtacaatatcaaaatatagtttgtggtgttttcaatggtactagctaatttggtaccataagataacttaaataactttagtaattgacttatttaggtcccgttccaaacctctagaactaattattagttacctaataagttgttagcggattttagttgggttggaacagctagcaactaatagctatttgagatatataactaccaattagctgattcgttagctcactcattctaagctgaactaataggtttggaacaggaccttagtaactaagagagaaccttatcagtggaaggtttcatgttttagtttctaaagctttatgcattgcaaacaatgtcggtacgtagtggcgtagatagggtggctagcgggcctaacaaaaaagaaaaattgttttgtagtttatatctatggctaaaataaaagagttagctcataaaaagttaatatttactatatatttagtgtatatatgtgttaattgttatgactagtgactattgcatattgtatatatacatatattctatttattcacattataactatagttacatgtcttggcccctctaaataaaaatcatgactacgtctctgaatttaggtgagttttaatcctataaaactcattttcatcccatgaaacttcattatctctctctcctcacatatcctataccgtaccatgtcaacctatttaatgacataaaactgttatgaaacgagaccggttttattgtccttccagcattagttcaatgctccttctactctcaattaagtaacaatgttttttttaatttgactgtgtatgaactacaacatcttaaatacaagatatacggacagatttataaccacataataaggaatctagctgaatactcgtttattcnttaccaactagcattattttgattgtcaacttgcttaattatctaggaaggaatagttcgaaaaggcatgtcattgctttgactaccgattataaaagacatttgtgcaaaggcatacattgatggtttaaaagatgtgcacatgttgatagagtcgaactatccagatacttcgacctttaatttgacacagatgggcacatatgacaggaagtatctaatttaggatgatgttaaaatcttagatatagcttatatttaagaacacaagaagtatatcatctagcatcatttcctatcgttccaccaatgtcatgtgttacccttttgcttccgaaaaaagctaaaattatgcagaaatgaggatttgaattgtggttattgactccaaacctacattcgcattcacctagccaacaaacacacgtctttatattttatactctacactcaatgatacatggaaattgtagcaatgtaagagcattttgaccataaattactttttatatatgtcaagcttgaatgttaaattcccttggaaagcagtttcgtaagtgtactactatttattttcgcaaactaaacttagctgagatgtttagattttccttttttaaaaaaaaaaacctgacgcggatgctgactatccagcggatccattggtccaatcttgtcgttcgtacctaggtgtacgacgtaggacggtcatgcaattaaactattggtggcgctgtttggagccgcactgcaagttgctgcacatcaacacatgcgtggctgggaatggccggtgcggccggcaccaaatcagtgtcatctagctacccaccatctcaattggtcgccacgaaaaagaaataaaaaaatcataacatgcggtcgctcggaggcgaggcgaggcgagacgcgagaggcacctgatcacgatgcatgcatagttggccttgtcaacgttgggagttgagcctcatgacgtgataaatccatggttacaaacgaaactgtcctagccgtttgtatggctttttaatcttcggactagtcgtccatgaaaatttgttaggactgggtcaatattcttatgccttaaattactctctccccctataaaacgtgatgttataaaataaaaaaaaacatattgtaaaaaatgatattttatctcttgagctgtagattagacccgtattaacttaagtactgcatttcttttaagctaatctctgcatctacaaatcgccagcatgtccattctgtattatcctctttgctttgaccataccaaaatatacaccaaaacatacagcatcataaagagcatttctccatactcggacagggttcaatgtgtctttaccttcctctgtggcgaccgcctctatatatggccaaccgggccggcacgacatgtggttggcatggtccacggtcggcacagcccgtcaggcccagctaatgaaatatgtcgtgcctgatgggtcgacgtgccgctaccgcggtctaggcacggcccgtcagtctattagtcgtgccgggccggtccagtgacactatagttcatctgagtatattgtataatttaacaaaaaatgtgtataagtgacttaaatgcatctatctaaccagtgcagctgcagttttattgtgttatatattgaattcttatacctaatatatgtaaactattatttttaaaataaaaaatataaccgtgtcatgtccataccagcactatggatcgagatgatgacccaggcacggtattatagccgtgccacactagcacgatcgtgctcttagttacggttcatgtgctaaatggccatctatatccgcctccgcctcctcgttcttcctggtgaccggagtcacagatgctcctacctcggcgctccatccccttcttctacccgattctccacatcttcctcccttggcngccggagtcgcggattggcaccgtggcggctcccgtggcctcctggtcggcttcttgcctccggtcgcggatgtatagtagagcaagtatgaagaaagcatgtgcttgtttcctacatcatattatgtatgccctccgtttctttttagttgtcgcttgatagttcaatttggcactatccagcgacaactaaaacgaaaaggagggagtattacataaaggattacatttgtttaggtatgatcttgagcctgtgggaaatatgccaagaattaattaggataccttacagattgtagagacacatgacatttttattattactccaaagaggaggtacttatttctcgtatatgagatgagaagccatttttccatactgtgatacgtgctggtgatgtcggttaaatatgttgactaatcatgcttgttattgtctgaaactgcattcttgttgttgtctgaaacaaccattcttgttgttgtctgatcatgctgttccaatttcccaaggcctgactgcacactacagctatcacatttgttttagctgatggtgtatcaaaactaccatttgtttgagcactaccctgcatacaaaaggaatggtgcatatacatcacatacaaatggcatgtattgatgcagactgcttatctgaaactgtattgatgcatattgcttatccagaagctgcatttatgcagacttcttatctgaagctgagttcggggaacatgtgtttcagaaatggacttgcatttatttggggcataaccatcagtattctcgagctgcggatactttgaagaagaaagccaggcgaataaacaacaaattctcagtagtattcactaattatgcagggattaatgtgttcactgcgttcattgattatccatggaataaacaacaagcactcattacttgaaaaaggaatgtgttcaccgtgtttacctgcagattgatcagcaatgaaaacgctagagtgtggaactaagcctgatattgagacaaaaactgtgaataagttctcccgtgagtaagtgctcgttttcaggttttggccaagagaaccgcataggtatcagctatgttgccctgatacggcgatacaaatacacgatacgtcgatactctgatacactatttctcataaaacattaatatggcgatacacaatatataatataaataaaattaaatgctgaaatacacaagcagcaaccaagacctaccctggttattggcgatgggaaaacttccttctccgccactggcctcagtagatgcatttgaactcgctgccatgggatctaacaagattagagaatgggagaagtagcagtcagagtcagcagattgagaagaaaggagtttgagaagcaagaacaaaaagggaagaacgcgaccacagatcttgcggcggcggctccaatctgtaactgatgtgctgacgaccacagatcgacggcagcggcagcggccacaaatcggcggcgacggctccaaggtacgtgagttttgtgaagtatccgcgcatcattgctgggcaccggtatggccggacttccaccagctgcgtgcccggcttgaggacgatgctgtggtcgtgggtgtgcggcggcggttgccccttgggctcggtgattacgtccccgaagcagtccaacaactcgtccagaagagatttgctggttgtcgttgtccgaatgccgggcacgattggcgtcgttgcgctcgaccaacacacggtgcgccctaggcgctagaacgacatctgtcgaacgctgaagtcccagagtaccggccctaaggttgccagccactgcgttcccaggaccaagtcatacccggcgactgacattacgaagaggttgacgtagaacatgtcattgtcgacggtgagcgtcgcttgccggttgacgcccgggcaggtgacatgttcaccattcatcactattgctatgaggcgtggacgatgctgcaggggcaacccggtgtggagaacgacatcctccacgaccaccctgacctacatggtgtcgctgatggaaacccctacgattgcgttgagggagaaatgtggggtttcttcctcgatgacttcttcgtcggcctccgtgcccgtggtggtgtcgtcctataggacgtcgtcgaggaggaacaatcgcttgcaatgatttcaagttgcctggtcgaaccctaggaccgaccaggtgactagtcgcgattaggcgatgaccagggcgattagtcgacccctagtcggtccctggccgtcctagaccttttagactagtagttgtacttatatatatatatatatatattcattatataaactagaacaaacagctaggataaacaaaataacaaactactttattgtgatttgtgacttacctgacatccactagtttagcactgccataaatacagagaaggggagaaggggggcaggaggaaccttgagatgacgagctcatctcttcaatggtgctggtctgctggagagtggtagggatgaaaacaggacgggtaccagttacaagtattaaaatgggatgaatttttcgatacggatacgagtattttttttgtcgggacggatacgggtaccattcggatatggaactcctggatacgggtaggatatagaatcactaataccctggaaatacccataaatctcgggtaggatacgggtacctacggtcgggtactcggtccatgtctgaagtggcgattggcactgtgtctgtgtcggtcctgtgtgcgatgtggctttggcagataatggccgtgcaggggg

SEQ ID NO: 1613 - DNA, 2164 bp, Zea mays
cacgattcgtgcccgccggccatcaggtccgcggtcgagctcatgtacgcggcgtgtaccttcaagatccccgagctcacctcgctcttccaggcgaacctggtggcttgaagtctatgaattgaaatggaatcattattcattaggctgctcaacatttgaatattacatttatggctgtatagtttatcaatcagtttaacatcaattgagctttgctttgtctttacggaaggcaaatggttaacatggtcttcttctacagcggcggcttcttaattttgtagacaagactctagtggaggatgttattcctattctggaagttgcttcccactcagggctgactcaagtgatcgacaaatgtattcaaaggattgctagatcagatctcgacgatatatctttggataaggagctccctccagaagcagttgatgagataaaaaatttgcgcaagaagtcacaaactgctgatggtgatacgttcatttcggaccctgtgcatgagaaaagagtcagaagaatccacagggcacttgactctgatgatgttgagcttgtgaagttgcttcttaatgagtccgacatcacattagatgatgccaacgcattacactatgctgcttcttactgtgatcctaaagttgtctcagagctgttagatttggcaatggctaacttaaatttgaagaatagccgtgggtacacagcactccacttggctgctatgaggagagaaccagctataatcatgtgtctccttaacaaaggggcaaatgtgtcacaactgacagctgatggcaggagcgcaattggtatttgtcggaggttaacaagagcaaaagactacaatacaaagatggagcagggtcaagaatcaaataaagataggctgtgtatagatattctagagagggagatgatgcggaatcctatggcggtggaagatgccgtcacctcgcctttgttggcagatgatcttcacatgaagcttctctacctggaaaacagagttgcatttgctagattgttctttcctgctgaagccaaggtcgccatgcaaatcgcacaagcagacaccacagaagaattcggcggtatagttgcagttgcagcaagcacttctggtaaactgagggaggtggaccttaatgagacgccagtgacacaaaacaaaaggctccgttcaagggtagatgcactgatgaaaacagtggagctgggccgtcggtacttcccgaactgctcgcaggtgctggacaagttcctggaggacgatctgccggaaggtctggaccagttctacctccagaggggcacagccgatgagcagaaggtgaagaggatgcgcttctgcgagctgaaagaggacgtgctgaaggcgtttagcaaggacaaggcggagggcagcgtgttctcgggcctgtcctcgtcgtcgtcgtgctcgccgccccagaagtatgcccagaggtgatcaaggcaccagtttttgccgtatagtttgttatcatggtcttcgagacttggacccggacagcatatagggacatgtacacctgtgtatgtatagtgcttacaattggcgtaagtagaactatatatatggaacataaggaaacatggcaggaacaccgcgcaaaaagatgaaaagatggccgaagtgctctatgcgagtgcgcacctgattcgatggccctattcaacggcgccctgtcagcatgctgcatgcccactgagaccttcggttgcatagggataggaggagatttctgttcaattttggctagcaagtgatataggggtgtttaggactgtttcactttatgaaaatcaacttagctcataaacacttttaacttcaataacttaggtcctgtttggagtggctgtatttttctagtcccaagaaaataatgtggtatctgagaataccatggtctagaaaccaaaatgtgtttggcagactcttttaaaccatggtatttaaaatcttggttttgacaagaccacattatttctgggtatagaatactgtcagccgagttcggctcggctcggtgcggctcgttgactgaacgagctcgactcggctcgtccattccacgagctggtgaaagaggctcggctcggctcgaccttagctcgcgagccatattcttgt

SEQ ID NO: 1614 - DNA, 3729 bp, Zea mays
gggtaggcgggggcgatgggcaatagtttacagccagaggcgccttgagcaaagcgagcggttaacgcccgcccataaacaattgcccgtgagagttggcattgtcagggatggtggtgccgtgtgtgctgtgttcgatcagcggcgcccttcctctttacgcttgctgtgcgtgagagagagcgcagtactcgtagggagtaagtaagcaaaagcaaaggtaaacagcatgattaaaagagctgtcaagaaagataaagcgaggcgagacaccccttaaaactagtaagatccatcgaggttaaacagcaccggccatggcggtggtggctaggagtaaagcggctgcatgcaactcctgcagctaatcgctgtggctcaccttgcatgcactactcagtagtggtgaaactacagcagcctactgaacaacttgctagcctttgcctacaataccatctctctctctctctctctctctctctctctctctctctctctctctctctctctctccttcccatgcttctcgccggaacatatagcataagaatctcccgtgtccgggcatctttccttttcctgccataggccgtgacgagagcttcttgcttgcgtgcttgttccgggccggctatcatattgcctgcctatgaagctctctgtctctggccaatggaggagctacttcttctcctctagcctttcccgtctctgattcgtccattgaccttgggtgacgtcggcgccacttctgcgccccgcgactcctcgcgccttgtgtgagtgagtggctgagtgctacaagcaagcgatggacatgaacgagagcggtgagacagggatggagcagggcaacgcgtcctccggcgccccggtggagtggcacactcaattcaacgccgccgcgttctcgtgcgcgccgcagcaggttccaatgatggactccgtcttcgcgtccgccggcctgtgggcgtccacctcccaagccatggcgctctccgacgtcgtcggcgccatgtcggccgcgcggggaggcgggttcttggcgccggtgcccggtttcctcccgcagggcctcggccatttcgccgtcgactccggcttcatcgagcgcgccgcgcggacgtcctgcttcagcggcggcggcgggcggggtgatgggcgctagcgcagctgccttcggtgcggctggtcagaccgtgaacaacgcgttcagtggttcgtcagaggcgctgctgctggatcaccagaagaaggacgtcgtcggcgagaagggcgagccggagctcggccgcgacgacggggtgctgagcccggaggctgctggtggtggggactgctcgtccaaggggacgtcggactccaagaagaggagaaggcccaacgaggtgagcgctcttcttgcttgtgtctgcaactacttctccactgccgtttcagaaacctgtcgacgacgtagctaagtttttgaaatggatggatacatccggcgcgtgcgtcttctgttctgcgcaatgaaaggtggtgggaagcgatcaggtccagtcggccaacctgcccagcgccgactcggcgaacgagagcgtgcacagcatggacaaaggcgaggagagcagcccggcaacaaccaccgccggcgccgggcctggcaagtcgagagggaagggagagaaagaggtccccgagtctcagaaggaggactacatccatatccgagcccgccgcggacaggcaacgaacagccacagcctagcagaacgggtacggatttggtcacccaacgttttgccgcttgctggatcgctctgaaactgacatgaccggtcctgaaaaccctggctgttgcattgcatcttccctggcaggcgtgcagggagaagattagcgagaggatggcgcgcctgcaggaccttgttcctggttgcagcaaagtaggtctatcttgccaaaaaaaaaaggaatagaacttgcttgtgtgtgctttacttcattgctgattatcagtacaaatgaacaccttcgacccttgaaatccaggtcactggcaaggcggtgatgcttgacgagatcatcaactacgttcagtccctgcaaagacaagttgaggtaataacaaacatcccccccaatatatactgagacctgaatcaagttgtcatttgcaatagaggaagtagaacagctagacactgagaccctgaatatgaacacagttcctctttctacaaaaccctcgttacatacatacataccgatggcaggcacatcaaaacactgaacgaatctcttgcagttcttgtcaatgaagctcgccacggtgaacccaaggcttgacctcaacatagaagggcttctatcgaaagacgtacgtacgcgcgatctcgtcctccatcgtccccaatctaacaaataaaggcgttcttacaatcttatcttactaccagcttctccgcttccctggtgctccttcgtcctccctcgggtttcccccagaaatgatgcacccgcagctactacagctgtcgcagccaggccgcctggtccagggagccgccgccgccgccgccggcatggccaatccggacgtgttcaggagaatcatgcaggcgcagctgagcgcgaaagacgacagcggcggcgcctctcaggttagcatatctgttcagcagtatgggctgaacgaacttgatcgtggcacggccagatctccatacggtgcccgacttttttttacagacaaacgctttgcaactctgatgcagtataagcttttgggtttctcgagcagatgctgccccacgggtcgttcggtggcgttgcgcgggcggcgtacccgtcgtcgtcgtcggccctggcgctggggtcccacgactacttgaggagcatgagcagggcgtcgcaacaggacgggtttcaaatctgagcatgccagcttgcacgtagcagcagaggcttccttctccatctggacgtctggtcgacgaacatgcaggcgcgcagggccggcgtaagtgatgctgctactgttgtgctctgctgtgctgtgctgggagcagcagcgctgcagttctagcccagcgtcacacggcggtgcgtcgcccgggtttttattgattgcgtttcagaaggaactgaggaaaagctcgtggagtccccccacccccgcggaacggaagcgctcggacggacggacggacggagggacgagcgatgcctttgcctgcctggatggctggaaattctgtctgggtggtcgcgtggtgcattcatggctggctggcgcccagtgcagtggccagtggcagtggcagtgggctgtgtgttggtagcgagcaaatgcgctgctgctgctgctgctccagctgcagcaggatgtaacgcgaggagccttggtttctgttagtagtttcagtgcctttttggctgcgtataatatagtttaagggtgcaagaaacactcgtaaatttcgggggcggcctggcgagttctccttgtgccacaaatcaaagaaaagaagggtgctacgtacgatcgatcatgcatgctcatggactctgtctcggtgtcggcttcctccctcgtagggctggaaacgagcctcggctcggctcgtccattccacgagctggtgaaagaggctcgactcgaccttggctcgcgagtctgctcggctcgcgagccatattcttatacttatcgttgcattatttgataaattaacatta

SEQ ID NO: 1615 - DNA, 3742 bp, Zea mays
tccggaggatcagttttagttttcggtcgatctgcatatatcaaatgtctgtctttcttcatgtgattagtttgtacatttgtcctaggactcatttacctgtaaagcaacggcacacaaaaacagagagggaaacgcgtgcgcgcacacacaaaaaaaattgaaaaagagaaataaagccctggtgccagcttgccaggtcagccacgaggcgccggcgtccggcgacgtgacgagccagaacagaaaccgaacgccagcgccacgcacgcagcagccactgaaatctcaaatacaaaaaatcaactcacggcccccgaaaactcccgcgctctccgcaggcgggtggacgccgcggcgcgtttgcggcctcgcgccaacactcccaatttttttaaaaagaaaaattttttccccaatctttccctcgctccctccccctccacggagtgtcgctgccaaaactcgaacgaatttccaaatcgaggccgccgcgatcgaaaccgggaacccaaagcacccgaggctcttccctccaaccggagctctcccaaatccttcgaatccaaaaataatggcggcctcctctccctcccattccccccgcccccgtccgctacttaaccgcgcgcccgccaccgcagccccaatcccctcctccgccctccgcctcctcagtgctccggcgcctagcgacctgctcctgcccccgccgccgccgtgcacgcacagccggagcaggagcagcgctgcccgcctttaccgttgcccatggagaactctgccgccgccgccgccgcccggccgcgcctcacccgcgcagccgccaagcgctcagccgtcgtcacggctgtggccgtcgccgccaagcgcaagcgcgtcgcgctcagccagctgcccacgctccccaacgccgtgctcggcgcgcacgacgacgacgacgacaagcccgtcaggaagcagcgcctcctccccgccgccaagcccaagcccaagcccaaggcagcgcccgcgcctgccgcgcccgccgccgcggatgacacggatgacgacattcagctctgcaagccctacgcttccgacatctactcctacctccgctccatggagtcgcaggccaagcgccgcctcgctgttgactacatcgcggcggtgcagatcgacgtcacgcccaacatgcgtggcatcctcatcgactggctcgtcgaggtcgccgaggagtacaagctcgtctccgacacgctctacctcaccgtctcctacatcgaccgcttcctctctgccaaagttctcaacaggcagaagctgcagctcctcggcgtctccgccatgctcatcgcatcgtaagcagccgatccgttaatctgactcacccattttgcatgaatggtgttccatttctcatttgctgggtccgattcaaatcgatgcagcaagtatgaggagatcagcccgcccaacgtggaggatttctgctacatcaccgataacacctacaccaagcaggaggtgcgtgttcctcctcctttctgtatgctatcaacgcgatttgtctctggatcttgccactggttgattactaaatgttaactggtccgtgcttggggatctgtaggtagttaagatggagagtgatatactgaatgtcctcaagtttgaggtgggcagtcctaccgccaagacgttcctgaggtagatcacaaaccaaatcaatctgaattggtcctgcaatccttgtctaccagaatgatcccatttctaaattttgtgcgccctttaccttttgtttcctaggatgttcatcagatctgcccaagaagacaacaagaaggtgagaaagatttgttgcatttcaacaatgaaatctgttcttgttccaaatgcctgctgcttgtttatgatgttgtctgatttgttatgttgtgatgcatattgcagtatcctagcctccagttggagttcctggggagctacctttctgagctgagcttgctggattatggcttgattcgctccttgccgtcacttgttgcagcctcagccgtctttgttgcaaggctgaccctggatccacacacccatccctgggtataatctcgatctgtttgatctctatacattcctgtctcatcaaatacaaaccaccaactcattttgttatgaacgggttgcagagcaagaaggtgcaaacgctaacaggctataagccatctgagttgaaggactgtgttgctgccatacataatttgcagctcaaccggacatgtcaatccatggtggcgatccgggagaaatacaggcaacaccgagtaagcttgggctttgacagctgtacatggttgttagattgtttgcataactctagtgtactaactgtggaaaaatctttgaacagttcaagggtgtatcagctttgctacctcctgttgagatccctgcatcatacttcaatacactgaaggagtaggtgttccttgataatctaggagagccaagcacacagctttcctcaagcaagatgtgcaatgctaaggttgttagggtactgaggttcttggatgctgcatctaggctcggcttggagcattcagagttgatttgtttgaagttcaagctcaatagaaagttcggtgtatcaaatcttgtacttgtgtatcataattatacattacaaccaggtgcctttatttattgggggcacaattccaaagttttcattcattgcctcttactacatattctccttttttattcatgtagttctagtacagaacacagtatttagtgttcagttatatcagagggtagcttagggatgtattagaccttgctaccttgtcttggtaaacacatgcagaaagccagaaagtgatatgttcttgacacaagaaatgtgtcctggaaagactagatacttggaacagttgtgaatgataattatagcacaatgtgcacctttaacgttaattggaaaattggccatgtgaatgatcaaaatttctaacacaatacatacatttaaaaactgttctcttttgtgtggcatggaccaataaccatttgaggctctcttcaatcattcctctcaaatccattcatactttctattcacatttaaatacccctcaactattctctttcactccaactattcttcctatttggctccacttttatcttccataggggttgtaggcatgctcctgagtgtgagggggcttggttggaggcttggagcagctagggagagggaggaacatacactgaaacatgtaaggagaagtcgatagaaggaatcgttgaagaccagactgattccaaccatttcccctcgtctccccttatttgtactttccattcaacaccccctctttcattcatccccctatttcaccgcttctctaatcattccccctattcagtcccttgtacactttaatttatctatataacttttatacatcaatttttgaagttttaaaaaatatacaatatttctaatattgtaatacacattattatcagttaattaaatttaaaataaattaatttcgcgtatataatcactaattagtgaagaggagattagagctccccctcttcaagggaatttttctctctcacgcaaaacaggggagggggagagtgaacggttgaggggaagaaagtacatacgaggcatggttggagccggccttaggctatccacacttgatataccatatttctctatcctaaaagg

SEQ ID NO: 1616 - DNA, 1620 bp, Zea mays
cattgcgttccgcgccgcggggccggaatcccctcctccgccctccgcctcctcagtgctccggcgcctagcgacctgctcctgcccccgccgccgccgtgcacgcacagccggagcaggagcagcgctgcccgcctttaccgttgcccatggagaactctgccgccgccgccgccgcccggccgcgcctcacccgcgcagccgccaagcgctcagccgtcgtcacggctgtggccgtcgccgccaagcgcaagcgcgtcgcgctcagccagctgcccacgctccccaacgccgtgctcggcgcgcacgacgacgacgacgacaagcccgtcaggaagcagcgcctcctccccgccgccaagcccaagcccaagcccaaggcagcgcccgcgcctgccgcgcccgccgccgcggatgacacggatgacgacattcagctctgcaagccctacgcttccgacatctactcctacctccgctccatggagtcgcaggccaagcgccgcctcgctgttgactacatcgcggcggtgcagatcgacgtcacgcccaacatgcgtggcatcctcatcgactggctcgtcgaggtcgccgaggagtacaagctcgtctccgacacgctctacctcaccgtctcctacatcgaccgcttcctctctgccaaagttctcaacaggcagaagctgcagctcctcggcgtctccgccatgctcatcgcatccaagtatgaggagatcagcccgcccaacgtggaggatttctgctacatcaccgataacacctacaccaagcaggaggtagttaagatggagagtgatatactgaatgtcctcaagtttgaggtgggcagtcctaccgccaagacgttcctgaggatgttcatcagatctgcccaagaagacaacaagaagtatcctagcctccagttggagttcctggggagctacctttctgagctgagcttgctggattatggcttgattcgctccttgccgtcacttgttgcagcctcagccgtctttgttgcaaggctgaccctggatccacacacccatccctggagcaagaagatgcaaacgctaacaggctataagccatctgagttgaaggactgtgttgctgccatacataatttgcagctcaaccggacatgtcaatccatggtggcgatccgggagaaatacaggcaacaccgattcaagggtgtatcagctttgctacctcctgttgagatccctgcatcatacttcaatacactgaaggagtaggtgttccttgataatctaagagagccaagcacacagctttcctcaagcaagatgtgcaatgctaaggttgttagggtactgaggttcttggatgctgcatctaggcttggcttggagcattcagagttgatttgtttgaagttcaagctcaatagaaagttcggtgtatcaaatcttgtacttgtgtatcataattatacattacaaccaggtgcctttatttattgggggcacaattccaaagttttcattcattgcctcttactacataggccccccgcttattcatgtagttctagtacagaacacagtatttagtgttcagttatatcagagggtagcttagggatgt

SEQ ID NO: 1617 - DNA, 1940 bp, Zea mays
attttatttctcaaaagtaaaaggatctaaacagccttaaaaatgatttcagaagatgccgaattcaatgaagtccgacagaaggctaaattaagaaatctgatgaaccatggagaagataacatcaagtccgcgactactgtagtctgtaggcactaggccgtccattctgcccagtgcgcacgacggccaggatcttcaaacggcacgagcacggcagcggccgtcgctggccactcaccgcgcgccacgtacaccacaaaggggcatataaagatgccaacccaaagtagcgtgagtgcgtgacgcaccagctgcttcccccctatatatatctatataaaaaaagaaagaaaaaaaaccggacaaacgtgtggcgtcggcagccgggcaggtaggaaaaggtatcagcgtcgccaatctccatggagctcacaggcgccgcgctccggcgatacgcgctgccgtcggcgtccccggtggccgcgagggtggggaggaggaggcgaccagccagggtggcctgcgtcgggggcggggggttcgcggaggaggggcacctcaggtactacgaggcggccccgcggaggaaggcggtggaggcggtggcgagggacctgggaaagctccgggccatggggctcgtcgcgggggacgcagccaaggagaaggtcctctcggaagccacggatcttctgctgcaggagctgagccagatgaaggatgcggaatacaagataaacaagatggagaaagaacagaatgctgctatgaaagcactgaagaagcaggagaggcgcaccaagaagactgccatcatgatgatgaagtgtgaagaagatgagtcatctgagtcgagcgagagcgattgtgaggacgaggcaaccatgaatgccgagcaggacatggtgatgtcaacagcggttcccgaggttgttgcatcaagcatctcagctgtcctcgcgatggagtgtgataaggctgcagtgaaggccatgaagaaaatggagaaggaacaaatgaaggccatgaagaagatggagaaggaacagaagaaggctgcgaagaaggccatgaagatggagaaggaagcaaagaagatggcaatggctacactgaatggctgcagggatgaagacgattcctcatgctcatcagagtcgagtgaaagtgaatgcgagggccaagttatgaggatgagccgctgcgctacaatcaccgcaccggaaatgccacctccaagcacgggtcttccaatcatagttcctcaaattccagcacctttggcaccacagccgtctcaatctcaaccttcagagccagcaaccgcagtgcaagccaccagagtcagcagcgttgcagtaactgagacatccacaaccagcagaattgaggtctgcatggggggcaaatgcaagaagtcaggcgcgcttgctctcctgcaggagttcgagaaggctgtgggcaccggtggcgcggtcgtcggctgcaagtgcctggggaagtgcggcctaggtcccaacgtgaggctgaggagcggtgcctctgcggaaggttctgcaaaggggaacccactctgcatcggtgtaggctttgaagatgttgacaccatcgtggctggtctctttggaggcgctgatctgggcatgacacccacctagacctggtggtactacctcgacctagtcgtacttcaagaaatcaagagcacaacttgtaatcacagatgttgcattgaacaaatgtatagtgcagctacggccttgctagtgctactgctaagtttatgtactctatgtctatatagaacacgtatggtaatcttgtttctggtatgtgatccatattggtcagtgattgttttcatggttttcagatttgagcatctgtggcaatgtagggatggttaatgctaaaaaaaaaaaaaaaaaaaaaaaaaa

SEQ ID NO: 1618 - DNA, 4071 bp, Zea mays
  misc_feature (1051)..(1051): n is a, c, g, or t
  misc_feature (1059)..(1059): n is a, c, g, or t
  misc_feature (1062)..(1062): n is a, c, g, or t
  misc_feature (1071)..(1071): n is a, c, g, or t
  misc_feature (1074)..(1074): n is a, c, g, or t
  misc_feature (2615)..(2615): n is a, c, g, or t
atttgcgcccggatttacccttaaatctgggtgtgacagcgcgcgggtaaaatgtgctcgtttccatcccttaaaaccgtagcatcatcgaacatcctgaacaatccggtctatatttggtaagtagcaaacatctttacttctgcgaatgtagttatgattagaaaaacaaacatcatcagggggtagttttttttctccaccgttccttttatgcctggcctaatcctatccgtactgtacagtggccagcgcgctatccttcctttcactccactgccaccgctgtccactgctgatgttccatccgaatgttgtgcacgcgaacgtcaaaaaaaagaccaagttgacaaaaatgcaggtcgtgtggtagccgccgctgccgcctcgacgccggtcgttctctattctctatcttttcgctagtgcgctcgtcgcgttgccgaccgctcgccccgccctgaaacgagggagctcggcgacggcaactagggggggcacggcagcgaggcgcgcacgcaggccacagaaacgggcggcgcggacgcaaagcgaaggcatcagcatccgaggtagtagcaggcaggagacctatctatcattctatccatcgcaccgagtgcgcatcgacacggcccaccagccgagcagtccagtccagtccagtctagtccaccacaagtccccacagccgcactaggaaccgaaccggccgagagggaggccggaggggggagagcagcgcagcgcagcgcgcggggtgggagtgggagtgggagccgcggcatggcgtccggcgtgtcgccgagcatggcgctggcgctggcgggcttctgcttcagcctcatcttcatcgccttcgtctgctcccgcctcgcctgcgcgctcctccgccgccaccgccgccgggcccgctcgcgcctcctcgccctcccgcgctactacaccgactactccttcgccgcccaccaccccgcgcccggcggaggcggcgggctcgggctcggccccgccgccgtcgcagccctccccacccgcgccttcgccgccngcccccgnggntccgccgcntcngacgccgagtcccagtaagtaccggtccttctcctccacgctcctgttaccccgtagcgttgcaatctcgcgcgcgatcggttcgtgtcgggctcgctccagtcggttacgcgcgggacggcgcatggtggggggcggcgcgttcgctggtcgctaccgtaccaaatcatattcaggggtgcgcactgcaactagtaggaagaagaggcttgtagttgcgagggcgccatcgggcgggcgggcggggaacgggatcgctgttatgtttagatgttccgatttggaatcctttagatgttccgatggatatcaatgtcactgtcagaaacaagatcaggctgttgtgtttgtcggccatacatacacactgttgacattactgagaggggtttggcggggagaagccctaccaaacagaatgcgacttgctcactgtgaatggggtgtttggttgctttagtcactcttctccctagaaatcctatttcaaagacctattttagtcaccatgtaagtttcgaactgaacacccctttagactatagtaatactatacaagtgaacacaagttctactgcatccacaccggtatggggaaacgatgttttcactgatgtaaacaaccggaacagatttatgggaaaaccatgaataaacttacaacctgttagtaagtgttttttttgccgtgttattaggtgtttccccaacattttgccaagcctgtgcgctgcgcgtctgtgcttgctttactgctgctgggaatcatgagagaggtgccacgacaggagacagcctgttggcaccgaaagggctgctgtcattggggggacgttgattgtgttttcagtaccaaagaagctgtccttgcggatgttggtgcctaaatacagtggcggtgcgttcttttttctttagtacaagtgtactgattgctgtgcctcgctggtgattggcgatcggatcatggtgtccctcggctggcattgttactgaacagccaaggccacttgatcaatcacattgaagtgggagcatgggtgtttaactgctcttgagtcttgaggaagatgggtcattaggcattgttattgagtaggttaacctcacttgtggtgcctgatgaagggaaacagggatcggattacaagtattctcagccgactgcatgtttcactctgcacaagttggtttgtactgtaccatgttttacgtgccttcagttttctatagcttcactgggtttacgtgaccatctgatcgtaaaacgtggaggggggaaacggtttcaacccgaggcatagagcgtcccattcttaaacaaagagagcaagagtaacagatgcgtggcatcccattcctgtggcatttgctggtttccacttctgttactactcctatcttttagcaaccgtctttgcttgcactagtcactgaaaaactgttgacgccatcttttggcaggtgcgtcatttgtctcgaagaatacgaagagagggacgtgctacgcgtccctccctcactgcggcccatgacttccnacatggcatgtatacatgtatggctggagcagaactcgacctgccccgtctgtagaatctcgttgctcgataatcccaccagcgagcacaatgcccctccgccgccgccgccgccgctacccggtgtagcagtgacgatgagctctccaggctctcctgagccgccaggctccgacccgtgccgctgcctgttcgccggtgccgggcactcgtcgagggcgtcatcagaggctcctcctaggcacgagcccgaccaggagaatcaggtggcgtctgggccatcggtggacgggggtgctaacagtaacggcatgccgctgtccgaagttaaccccactccacccgagagcaacagccagacagtgaggaagcagcagccagggccctgcaaatagcagctgcctggagtcggcgaggcgagatcgctgttctgcagcggtctgctgcaggacgagcaaacacctgtacagtggcagatggctgtctggctgctgtaggttggggtttgatgagggtatggtgtaaatatgagaaatcattcagatttgttgttggaaaccaaacacacttcatctgttcagttcagtattgatgctgaaaacagcaaccccccgtggtatgcggatacgggataccacagagagattcaaccatcggtgaattcgccaaaaggctagtaactattcatgtcattaactgttgtcatcagcaaatatgatgatcttgactggttccatttcgaaactaacaggattttctgcaacagaaatcaaaatgagcattttttatagggagtgggtaatttagatggttactccactttttagagtgttttcttaatggccgaccgtgataatttttctttcgtaactcattgaaagctaatctcactagttgtttatatgcgacctggatttgaaaacattggtttctagtattctacaatcttcgaatataattattaacagattcatcgtcctcttgttggaccgataccaaatcaactaaatctaacttgtaatctctagagaagaagtgttcatgaaacttggacggttcgcggctctgaaccggacggtccgctaccttattgcaggagcggctcctctctacgtcgctcgggacggtccgcgcacaggggtcagacggttcacgatggcgcaagagccttcttcttccttgcaggaatctagatctcgcccttgggagggaccctgttagggaggagatcttaaggtgctctgaggtcggcagataggttaggataaccacgtgtggataagtaccgtcaccctgagttaatctgattgcggaccgtcacgaaccgtccgagttacatggtcaaactgtccgcccgtgtccaagtgctaaatatgatgcttaacaatattcagttagattctctctttctttctctctattgtggcaccactacagtctatttccatatcgacca

SEQ ID NO: 1619 - DNA, 1139 bp, Zea mays
  misc_feature (184)..(184): n is a, c, g, or t
atcgacacggcccaccagccgagcagtccagtccagtccagtctagtccaccacaagtccccacagccgcactaggaaccgaaccggccgagagggaggccggaggggggagagcagcgcagcgcagcgcgcggggtgggagtgggagtgggagccgcggcatggcgtccggcgtgtcgccgancatggcgctggcgctggcgggcttctgcttcagcctcatcttcatcgccttcgtctgctcccgcctcgcctgcgcgctcctccgccgccaccgccgccgggcccgctcgcgcctcctcgccctcccgcgctactacaccgactactccttcgccgcccaccaccccgcgcccggcggaggcggcgggctcgggcccgccgccgtcgcagccctccccacccgcgccttcgccgcccgcccccgcggctccgccgcctccgacgccgactcccagtgcgtcatttgtctcgaagaatacgaagagagggacgtgctacgcgttcctccctcactgcggccatgacttccacatggcatgtatacatgtatggctggagcagaactcgacctgccccgtctgtagaatctcgttgctcgataaccccgacagcgagcacaatgcccctccgccgccgccgccgccgctacccggtgtagcagtgacgatgagctctccaggctctcctgagccgccaggctccgacccgtgccgctgcctgttcgccggtgccgggcactcgtccagggcgtcatcagaagctcctcctaggcacgaccccgaccaggagaatcaggtggcgtctgggccatcggtggacgggggtgctaacagtaacggcatgccgctgtccgaagttaaccccactccacccgagagcaacagccagacagggaggaagcagcagcagccagggccctgcaaatagcagctgcctggagtcggcgaggcgagatcgctgttctgcagcggtctgctgcagggcgagcaaacacctgtacagtggcagatggctgtctggctgctgtaggttgggagatgatgtaaatatgagaaatcattcagatttgttgttggaaaccaaacacacttcatctgttcagtattgatgctgaaaacataaaaaaaaaaaaaaaa

SEQ ID NO: 1620 - DNA, 950 bp, Zea mays
cctcgaggccggccggggtgccagctcgctcccgaccggcgcccgcgggagcttgtctaatataccgtgcgcgcgggagcagcagctggcgcctgggtcgcgcccgcgctctctctgcactccgtgatcaccaccacaccactgtcctgctagctaggtagctgaattcggagccagggtcgagcgagggggtgcggaggcgagatggaccacgcggcggacgcgcaccggacggacctgatgaccatcacgcggcacgtgctgaacgagcagagccggaaccccgagtcccgcggcgacttcaccatcctgctctcccacatcgtcctcggctgcaagttcgtcgcctccgccgtcaacaaggccgggctcgcccagctcatcgggctcgccggcgagaccaacgtgcagggagaggagcagaagaagctggacgtcctgtccaacgaggtgttcgtcaaggccctcgtcagcagcggtcgcacctgcgtccttgtgtccgaggaggacgaggaagcaacgttcgtggaccctaagctgcgtggaaggtactgcgtctgctttgatcccctcgacggctcctccaacatcgactgtggcgtctccatcggaacgatctttgggatttacatcatcaaggacaaggacaacgtcactctggaggacgtgctgcaacctggcaagaacatgctcgcggccggatactgcatgtacggcagttcctgcacgctcgttctgagcactggaactggtgtcaatggcttcacgctcgacccttcacttgggggagttcatactaacccatccagacatcaagatacctaagaaaggggaagatctattcagtcaacgaagggaacgccaagaactgggacgcgcctgttgccaagtttgtggagaagtgcaagtaccccaaagatggctcacaaaaaaaaaaaaaaaaaaggccc

SEQ ID NO: 1621 - DNA, 1722 bp, Zea mays
  misc_feature (938)..(939): n is a, c, g, or t
  misc_feature (981)..(981): n is a, c, g, or t
cattgggtacctcgaggccggccgggctcccttcctatactacgccctgccgcgcgctacgttcgcctccgcaccaccaccacaagcgctggacgcgagcggcccagcctgccgcagcgcggatagagggataggcctcgacgccgattccgttggagctccgcgacccttggctcccagcctcactttctcgctcgccgcgctaccctaccccgcagagacacgtcccgtcccaccctgtgccagccagctcccgaccggcgcccgcgggagcttgtctaatataccgtgcgcgcgggagcagcagctggttcgtcgtgcccgcgcgcgcgctctctgcactccgtgatcaccaccacacctctgtcctgctagctaggtagctgaattcggagccagggtcgagcgagggggtgcggaggcgagatggaccacgcggcggacgcgcaccggacggacctgatgaccatcacgcggcacgtgctgaacgagcagagccggaaccccgagtcccgcggcgacttcaccatcctgctctcccacatcgtcctcggctgcaagttcgtcgcctccgccgtcaacaaggcccgggctcgcccagctcatcgggctcgccggcgagaccaacgtgcagggagaggagcagaagaagctggacgtcctgtccaacgaggtgttcgtcaaggccctcgtcagcagcggtcgcacctgcgtccttgtgtccgaggaggacgaggaagcaacgttcgtggaccctaagctgcgtggaaggtactgcgtctgctttgatcccctcgacggctcctccaacatcgactgtggcgtctccatcggaacgatctttgggatttacatcatcaaggacaaggacaacgtcactccgggaggacgtgctgcaacctggcaagaacatgctcgccgccggatactgcatgacnncggcagttcctgcaccgctcgttctgagcactggaacttggntgtcaatgggcttcacgctcgacccttcacttgggggagttcatactaacccatccagacatcaagatacctaagaaggggaagatctattcagtcaacgaagggaacgccaagaactgggacgcgcctgttgccaagtttgtggagaagtgcaagtaccccaaagatggctcgccaccaagatctttgagatacattggaagtatggttgctgacgtgcaccgtaccttgctatacggcggtgtgtttttgtaccctgctgacgagaagaacccaaacggaaagctccgtatcctgtacgaagttttccccatgtcgttcctaatggagcaggcaggaggccagtccttcacaggcaaagaacgggtccccgatattcctcggaagctacgacgacgtggaggagatcaaagcgttgtacgccgagcaggcgaagtcgagctcggcttcatcctaagtgagggtgtaaatcgacttttcctggcttaatttgttgcttacctgattcagacattcgtttccgtttcccttggtgtcgtcgtaagtgtgacattcagtgcaatatgtatagcaactaagggactccgtaaaagttacatgcatctctagcacctaaagcattgcgttataaccaacctaaaaagaggtgatcaggtgtcatagatgatgaaactactggcgcaggctctgcaaaattgtattgcgcatagagatccctgcaaaaaaaaatttggccgtgtc

SEQ ID NO: 1622 - DNA, 1500 bp, Zea mays
actttctcgctcgccgcgctaccctaccccgcagagacacgtcccggcccctcgcgccccgcccggtgccagccagctcccgaccggcgcccgccccgcgggatcttgtctaataatataccgtgcgcgcgggagcagcagctggttcgtcgtgcccgcgcgctctctgcactccgtgtccgtgatcaccaccacaccgctatcctgctagctaggtagctgaattcggagccaggctcgagcgagggggggcggaggcgagatggaccacgcggcggacgcgcaccggacggacctgatgaccatcacgcggcacgtgctgaacgagcagagccggaaccccgagtcccgcggcgacttcaccatcctgctctcccacatcgtcctcggctgcaagttcgtcgcctccgccgtcaacaaggccgggctcgcccagctcatcgggctcgccggcgagaccaacgtgcagggagaggagcagaagaagctggacgtcctgtccaacgaggtgttcgtcaaggccctcgtcagcagcggtcgcacctgcgtccttgtgtccgaggaggacgaggaagcaacgttcgtggaccctaagctgcgtggaaggtactgcgtctgctttgatcccctcgacggctcctccaacatcgactgtggcgtctccatcggaacgatctttgggatttacatcatcaaggacaaggacaacgtcactctggaggacgtgctgcaacctggcaagaacatgctcgccgccggatactgcatgtacggcagttcctgcacgctcgttctgagcactggaactggtgtcaatggcttcacgctcgacccttcacttggggagttcatactaacccatccagacatcaagatacctaagaaggggaagatctattcagtcaacgaagggaacgccaagaactgggacgcgcctgttgccaagtttgtggagaagtgcaagtaccccaaagatggctcgccaccaagatctttgagatacattggaagtatggttgctgacgtgcaccgtaccttgctatacggcggtgtgtttttgtaccctgctgacgagaagaacccaaacggaaagctccgtatcctgtacgaagttttccccatgtcgttcctaatggagcaggcaggaggccagtccttcacaggcaaagaacgggctcttgatctggtcccaaccaagatccacgacaggtccccgatattcctcggaagctacgacgacgtggaggagatcaaagcgttgtacgccgagcaggcgaagtcgagctcggcttcatcctaagtgagggtgtaaatcgacttttcctggcttaatttgttgctgttacctgattcagacattccgttttcgtttcccttggtgtcgtcgtaagtgtgacattcagtgcaatatgtatagcaactaagggactccgtaaaagttacgtacgtacatacattcatgcatctctagcgcataaaaaaaaaaaaaaaaaagcggcc

SEQ ID NO: 1623 - DNA, 2053 bp, Zea mays
  misc_feature (1410)..(1410): n is a, c, g, or t
tgggggtgtaatgtcaggggagtggatgcttgaggctgggctcttgttttggctgatggtggcttatgctgcatagatgaattcgacagcatgcgagagcatgacagaacaacaatacatgaagccatggagcaacagacaattagcattgcgaaggtttgtctgtgaatacaacactttcaggacccctgttgagtagatttgatatagttcttgttcttctggatacacaaaatactggttgggatgaaatagtttcatctcatatactgaaggagaattctgatgaaaagaaagacaaggcagatgcttctgatataaagtggatgctcccccagttgagaaggtacatcaattatgtaaggaggaagtttaaaccagtgctgacaaaggaggctgaaagagttatctcaagctattatcatctacagagaaaatcaggaacacataatgcagcaaggacaacagtgcgcatgcttgaaagtttgataaggctagcacaagcacatgcacgactaatgttcagaaatgaggttagacaacttgatgccattgctgccatattatgcatggaatcctccatgacagcatctcctatagtggacatcgttggaaatgctttgcactcaaattttacagttgaccctgatgaagaatataaaacacaggagaaaaagattctcaagaaactcggaataactcaaggatccccatagttcaatacaagcatcagttgctgcatcccgtagatttattaacgtatgcacttacatgctattctgcatattgaatcagtgatacatgaaggtgaacttaatacttatttggaagtttggtaatccttccgaaattgctaggatattaaggtagtgtttggttccgaagtacggtggaatggagccgcaccgctctcaacttgttgtttggtttggttccatatatacagagtagctctacaaaagaaaaattatacttaaatgttgaaccatctagctcccaaaatctctcggactctcggatggcgccgcttcttagtatgaagccgctccatcccaattggcttcggaaccaaacactaaggatgcgtttggttgcgggacagctgagaataggtaggacagggatgtccctggctccaattttgaaggacaattatggacagcattgagatagtccttttccaacccctgaccctgaactaaacaaccttatttaagcgatcgtcctatctcattccgtcctgtcattataaccaaacacatcctacctaagattgacaatcatcgtttcctcaaatgaactactgcataaaacactgtagatacatagttgcataagattgatggttacaatgttaatttctgttcttgtggcttgtggttcatcttaaagacttggttagaaaaactncttttggaatgctaggaagcaaaaatgctaatgcatgatacatgcctagttgacgtttcatcatttactgtgacattcatttatttgctattgagttaatgtctgatcgacttcatgtggcagtctcttggtggaacaaggcctgcctttgcagttcatggtgtatatacttcttttgggcatgtaatttgtccaaatttgcaatatgtatcagattggtcttttttgtgagctctttgatgatgggaatgttgtctactgctgaaagtacaacgtcattaaatcctgtaatattcgctcccattggagtcgagtccaggacctaagatgctactaaggcttttataacccctaggctatagttccttttgctgtatcagattggctttgtaatgtgtaacaatttcttgtcacttagtttattacttatgacatctatctgttcacttagtttatatcttatggtatctatctgttcaaatagaaagaaattaagttattgaatgagtgtcgtctgtcaaaaaaaaaaaaaatttgttgtgctattgttcagtaaaacatttcgaggatgtgaagaggggactaaggaggatctggagtttcagttttgtggagtaaatataaatgataaatacacccagtg

SEQ ID NO: 1624 - DNA, 1412 bp, Zea mays
gaaactgtaaagcatcatatcgatataacatacgacgaattcgtacaagtgaagtgaagacatatgttactacttaggttacgagctaaaggcgtctcttcacatagagacagctccacattttttttttttttgcaaatgctctctttagataatctcaagagcctctatattaaacatcactgtacatgctcttacataccaaataaatctgtgttagcacagtgttcacgatttcttcagcttcctagataacagagaattactcaaccttttcctgaagaaaaaacctagggccccaagcaacggccaagaggttacaagagcaatgtaagcaagcaaccagattgacttaccctgggatcgactgagttggtttattgatttcttaacaggaccaatggcatcactgattttattcgcatatggcacttctctctgttcttgagatcctccatgggcttgaacattcccttcggagctgtttttatcatccaaccaactgtcactctcattttgtatagctctggtgttttggttctgttgtacgtgttggacaaccacgctatcattaggttcaatttcaccaagaacctcgttaagcaaggagtcaccgttgttaggaccatcatctgttaatgcagctaccattccatcttccatgaaattcacatatgggctcttgtcaattgatgattccaacgatgagtgcaaatcgtgcccttgtgccttctgccgatgcatgtaggggccatcatgcagagcacagaggaactcggaaacaggtcgtacccaccaaagctttccagcagttaggccttcaaagaaagcaagatgtccgcctttaggtgtagttgccaatacaatgtttttgtttgccctgcattcatcccagggaatggcctcccttgtgcagagggggtcatctaaggcactgatacaaagcagtggaactgacacattaccgatataatttgcactgctgcacttgcggtagaatgtgtcccctgtctcgtattttgcaacaacacaagtggcatggcggtcgaattcccggatagagtgtgacgatgtaatagcttcccagtttgcaagtcgtgccaagactgattgatgtagtttcgcatatccttttagaccactcgcaagggctctgtcataccatcgctgcacaagcttgcgtgaaataaatttgctggtcaccagcagatcccagggagaacaaatagatgcagcaccagctacaggtgtgttttcaccttcttctcctagatacttgaccacaatattggcacctatgcttgtcccaacagtgaatagtggagccttaggttactcttgatgaaggaaactaacaacttcacgcatatctgccatccacccggcattgtaaaagcagtcgtgccgaatcg

SEQ ID NO: 1625 - DNA, 1165 bp, Zea mays
cattgggtacctcgaggccggccgggggacagagatgctttggccacccgggcccccttgggcagcagttgggctcgctcggcccgcctccttcccgagcacgcacgccgcctcgcttccaattcttccccccctctcctcgtccgctccgctccgctcctgcgttgccgtggagtgccgcccggggctccattccattccacccgtagcccggtccccccgcgccgccggcgcgccggttccttcggttcccgggatcaagatgattggttcattcattaccggaatgctaacgcttgttctcggatacgcgtaccctgcatacgactgctacaagacagtggagctgaacaggcctgaggtcgagcagctgcggttctggtgtcagtactggattttactcgcgtttctcaccgtactggagagagttggggaaagtttcgtatcatggttgccaatgtatagtgaagcaaagctcgcatttatcgtgtacttgtggtatccaaagacacgggggactgcctatgtatacgagtcattcttcaagccatacattgcaaaacatgaaactgagattgatcgaaatctgcttgagttgaggacaagggccggtgacatggcagttctttatttccagagggttacaaactatgctcagacaaggtcttatgaaatcttgcagtatattgcctcacagtcaccgactcaaagacaggcacatcagcagcagcagcgcccaccaccgccacggactcggcaggtcaaccctgcacctccacctattcccgcaccctccgcgcctccgatgccaccacagcctgcccaagcccaagttcctcccactccaccaaggcccctagttccagtggttcctcctggcgcagtgcctcctgccccgccaccaactgctcctgaagccaccgccaccaacggtcttcaggacaccgaaaccatgcaggtcgacccacctcgtgcttcactgagcggcccaccgccaccactaccacctgaggagacactcatcgaggaggcgatccggctgacacggggccggctgaggcggcgcttggctgggggatctggaccaccgcaaaattagcgtcgaccaaggtttccatctcacgcgaatcgcaccacactggtttggttcttggtgattgactga

SEQ ID NO: 1626 - DNA, 1428 bp, Zea mays
gcacgagaccattacctagaacatcctaatcgaaaaataaacaagtttcggttgctgcgaacgcgggcaaccccagttcgaatgcttccccctccggtcgcgcgggtttctctgcttcgctgggatcaagatgattggttcattcattaccggaatgctaacgcttgttctcggatacgcgtaccctgcatacgactgctacaagacagtggagctgaacaggcctgaggtcgagcagctgcggttctggtgtcagtactggattttactcgcgtttctcaccgtactggagagagttggggaaactttcgtatcatggttgccaatgtatagtgaagcaaagctcgcatttatcgtgtacttgtggtatccaaagacacgggggactgcctatgtatacgagtcattcttcaagccatacattgcaaaacatgaaactgagattgatcgaaatctgctcgagttgaggacaagggccggtgacatggcagttctttatttccagagggttacaaactatgctcagacaaggtcttatgaaatcttgcagtatattgcctcacagtcaccgactcaaagacaggcacatcagcagcagcagcgcccaccaccgccacggactcggcaggtcaaccctgcacctccacctattcccgcaccctccgcgcctccgatgccaccacagcctgcccaagcccaagttcctcccactccaccaaggcccctagttccagtggttcctcctggcgcagtgcctcctgccccgccaccaactgctcctgaagccaccgccaccaacggtcttcaggacaccgaaaccatgcaggtcgacccacctcgtgcttcactgagcggcccaccgccaccactaccacctgaggagacgctcatcgaggaggcgatccggctgacacggggccggctcaggaggcgcttggctgggggatctggaccaccgcaaaattagcgtcgatcaagatttccatctcacgcgaattgcaccacactggtctggttcttggtgattgactgagaagagggggaatgctgagttggttgaacagagtttgggtttcctcgcatgcgttctccgttgtacgaactggaaccggtttggtctcgaattgtgaatagtatcccagaaacagaagtggatgatcaattcaattcacagggtagcgctaggaaatatggttgggaaccattttatgcaagacgcgcattcgcgacatgtctgtatccatgagcatttagcaacgaggatactactggtcacagtagtgtagtttggaattccaaatgcgaagaacaaaaaaggacagcgccatgtacgtgctgcatacattgggaggtaacgactactttgcaattagtccttatgtgctgataattggtaggtaacgactctatgcaattagtccttatgtg

SEQ ID NO: 1627 - DNA, 3192 bp, Zea mays
  misc_feature (3148)..(3148): n is a, c, g, or t
ccaccaggccctcgaagatttttataccgcaattacctttggccgtttaaagactgacaaggtatagtcttataaatgtggttttattcgtgttgaaacttttctctgctcatgtaagaatcattagaatgatttacatgggataaatggaactttgccagtccagtgaggtcataattgcgtatgagtgcatctgacttgtgtaccaaaatcttgccaggatttactgaatgatgccgagcaaagtatgatggagtaccaaacatctattcagaacttgaagaaagaatcaaaatacactcttgacaaagtagctatcggtgaaagcgatgtgcagcgtgggcgaactgatctgaggtatttttacatggtctcaatgggaaaaagtcttttcccatgtctgttactgtttctttaataatggtttgtcaccaacatagtgtaaaaattattgcctgtgcctctctctccagatctactgggaagcagatacaatctcttataggttccatttacaaagcagaatctacacctgcaggtactaactatatttcttcaggtcatttggttcattgtttcttgttatttgcaacttaaatttgaaacatcatctacacgaaatcagagaacacttgagattgttcacatcacatcttataactgcatgcattacttttgtgactgtaggtctgatggatagactaagaaccattccaaccaggcaatctctcgagctgcgagcagaggtgagtacatgatttgcacatagaatatctttgcccttgtgtcaagtgccgattaaaatactgtttcgtttcgtttcgtccatcaggtggcttccatggcctccgatttgaagaaccagaggtgtgccttgcaggaaaggatcaacaaaatatctgaatatggtgtccgtgtctgaactgctgcaccgtctgtacatttcccctcatagagcctcttttggtcctcccgtacaataaactgtgaatccaccgtgagggtgcgcgttttggttagacaggttccgattctaaccatattttcttgtcagcattttgaatgctaggacagacatggtaactcatcacaaccataaattgttcctatcactgtaacgttgagcattgctcgtttctgggaagcagatgggctgatggctactatcttatatatgcgattgcaaggaaaaactttgttccaccttgggtgctgtgcttcctgtatacaattctgctattccgtttcggaagaaaaaaaaaacaaatagttacagaatgcaggcgctgctacaggaggcgacagaagtgttgaagtcttgtttgatatcgtttttcaggttttttgcatcttgaagaggatcacaaatttgaagggggaaaattccatccattggtaatgaataatccttatcatttatggaaaacacgattagcatcgcgtttctcgccgaaggacgacgtgtttaccttgccatcaggcagtctcaaattggcagtacaggatacaaattcagcttgtccacacttccatttgctggtaatagtgatataacttgacaaggtgcaaaattcttgctctataaatgttcagctatacggctatacctatacctacttatatgtcgaccaagaacaccatctccaagcaaagcgatagaacacttgaacaaaattgcagcagcacagagaattttcccatttttttatagccaatgtactccatctaaagcaaagtaatcgatctcttcgtttctttctacagccaccgcactccatcgagcatttctgcacttcctccgctttgacactctgagagccatttcttggaccagatagaaaaactggaagccatttctttggccagattcgaaactgggcagggacaggctggtttggtgacagaattggaggggatcgaggactctcggttccttccaatttccttgtcatcatacattttgaatagtaaggtattttctccctcttaggccttgtttagctactctaatattcacccaatccaaatgtattgaggtggattaaagcgtaaattaaactaatttacatcccaatccatctcaataattaaggtgaatactagagtatcgaaacaagaccttaatcccacggacagagaaatggaggggctcaatggggaagaatcccctctctatttaaaattgaatagcgaaagaattcctctcccgtggatcccctctatttccctgtccaccaaaccagctctaaaggtaaccagtgggcaccagaacttgatgaacaattgaacatataccagtatgtgaaaccataaaacaagtggaggaaacaattgaacataccagtctgtgaaaccgtaaaacaagtggaggaagagaggctattatctaacttcccctatcttagtggcatatgactatccgaatgccatataccgatctcaatcctccagctaataacctacatctcccttctctccatctgcaggcccgcccctatgtgccggtagtctttttttttttttttttttttgctcagcaactgtaactggtcagtaattatattgccgcctagaatgtacagcttttcatacaaaattcattgtccttagtctgcagccaaggacattttggatgaatcttaagtaagaaaaatgaagaaaaatgatgtgccattggatatgtaattctgttatgctagagtgtttcaactttactctccgttaatgtctgcagctgtaacatctgcccccagtcatgcgattaaggtttggtcttcagtatcaactcttgtttcggcaggattgaaaacatggtgaaagctggagtttgctagtccaaaaatcaagaagcctgattctgtagccaagaaggactgggtagagtttcatctgtcctattagtatcaaaccgagaaaatctccgtagtctgttaatcttcagacggatagagggcaccttccgagcaatagccttccatatcatctgcacggcatcatcagtctgagatgggtattggtactcgaagtgcttttctacttcctttagcttgttccacatgcgtgtccactcttcttggctgatccctttgatcaggctctttggggggggggggggggcctacgcagctgaccccagggggggcccggnacccaattcgccctatagtgaggcgaattacaattcactggccc

SEQ ID NO: 1628 - DNA, 1456 bp, Zea mays
aaagcccatctcggtagccggagaacgagcagcagcggaggcgatggcgtccccggatcccggccacacgccggcgcaaggcgaggaatctgcctccccctcctcgtggcctccccgaaagctccaggtctcgttccctccttattagcacctcataggaaaaaaaaatactattggattcgtgttcgtgcccatccttcttcatctcagatgcagtatttggtatccttaatttcggttgaaatgatctgtatttcgcattacttgcgggcttggttcatacgtgttggaactacagttacgtttttctgtgttctagacttttctttaactaagttaatcctgtttgaatcatcctgtttcatttgcagtgagaaaattatagaacctatccattgatgtctcatttatctgtattgtgagaaaggtcccacaaatattcgttttagatgttgttggattagcggagaagaaacttgcagttcccctaaggccctaagatccattattttttgttcttttgttgtcacattcttcctgttgccttgtagagtttcacaccagggctgtggtcacaatacaaagcttatgaggatgcagttgtggagaacattaaaggaactattgcggatgctctggttcttgtgagagagcatcaggcggaggcaattggatgtgccactgttgcaggattcattctgttcagaggccctcgaagatttttataccgcaatacctttggccgtttaaagactgagaaggatttactgaatgatgccgagcaaagtatgatggagtaccaaacatctattcagaacttgaagaaagaatcaaaatacactcttgacaaagtagctatcggtgaaagcgatgtgcagcgtgggcgaactgatctgagatctactgggaagcagatacaatctcttataggttccatttacaaagcagaatctacagctgcaggtctgatggatagactaagaaccattccaaccaggcaatctctcgagctgcgagcagaggtggcttccatggcctccgatttgaagaaccagaggtgtgccttgcaggaaaggatcaacaaaatatctgaatatggtgtccgtgtctgaactgctgcaccgtctgtacatttcccctcatagagcctcttttggtcctcccgtacaataaactgtgaatccaccgtgagggtgcgcgttttggttagacaggttccgattctaaccatattttctgtcagcattttgaatgctaggacagacatggtaactcatcacaaccataaattgttcctatcactttaacgttgagcattgctcgtttctgggaagcagatgggctgatggctactatcttatatatgcgattgcaaggaaaaactttgtccaaaaaaaaaaaaaaaagcccggtacccaaaaacgccgttccgcttcaaaaaaacaccaagcaaaaa

SEQ ID NO: 1629 - DNA, 1043 bp, Zea mays
attgggatccgcgtggccggaaagaaggaaacagaggtccgcgagcaaacgccttcaagcccatctcggtagccggagaacgagcagcagcggaggcgatggcgtccccggatcccggccacacgccggcgcaaggcgaggaatctgcctccccctcctcgtggcctccccgaaagctccagagtttcacaccagggctgtggtcacaatacaaagcttatgaggatgcagttgtggagaacattaaaggaactattgcggatgctctggttcttgtgagagagcatcaggcggaggcaattggatgtgccactgttgcaggattcattctgttcagaggccctcgaagatttttataccgcaatacctttggccgtttaaagactgagaaggatttactgaatgatgccgagcaaagtatgatggagtaccaaacatctattcagaacttgaagaaagaatcaaaatacactcttgacaaagtagctatcggtgaaagcgatgtgcagcgtgggcgaactgatctgagatctactgggaagcagatacaatctcttataggttccatttacaaagcagaatctacagctgcaggtctgatggatagactaagaaccattccaaccaggcaatctctcgagctgcgagcagaggtggcttccatggcctccgatttgaagaaccagaggtgtgccttgcaggaaaggatcaacaaaatatctgaatatggtgtccgtgtctgaactgctgcaccgtctgtacatttcccctcatagagcctcttttggtcctcccgtacaataaactgtgaatccaccgtgagagtgcgcgttttggttagacaggttccgattctaaccatattttctgtcagcattttgaatgctaggacagacatggtaactcatcacaaccataaattgttcctatcactttaacgttgagcattgctcgtttctggggaagcagatgggctgatggctactatcttatatatgcgattgcaaggaaaaactttgttcccgagggggggcccggtaccc

SEQ ID NO: 1630 - DNA, 2723 bp, Zea mays
gattgcattctaccaatcttttgagaagagatagcaccatagcagactgctatattattgtttccgcaagaaaaccaacttttgctgaaaggttatttaggctatctccagcatcttacccattcccatctctatattcaaactccactctgtgtacagtacaatctacagtgtaaaacaatattttgggtgatcatatgggtaaactgctggagatggtcttaggagccttcatgctattaggcttagcgagtccagaaaatgagatttttcaaagaaccagaatgaaattaaatgctgctgaatcaagtctggtggatagccaattctttatggggttcacagcttctgtagttctagcatgaggtggtggaaattttttgagattaaagcagacatgaggaggaggtctaggctaaccaagtggagtcatgttcattaaggttgtgaggtgacatgtcagctagcatttttcttgattttgattgtaactagtcctgtcatgggttgttctcttgtatcttctattttttattgttttttgcttgattagttctgtgtttctgtatgattaatataccatgagtcaatattttgagtcaattcatgcttttgtctgtattatcgtgcttctagtagacctctactatttgtttcatgcactgtttatatcattagttatggatattatgaacatattgtgaatcgtagtgatgtttttaccatgcactgggcttagtgacttgagaggcacatgttatttcaattgcattgtgatctgactggtatctgtttagtgtttagaattgcaccacgtcagtttgtgttcattccattgacaaaccatgttcctttcatgattgttgccgctttgtcagctgatgtttgtgcaggactgatgtttgtcatctgtttagaatcttctttcatgattgttgccgctttgtcagctgatgtttagaattgccgcatgtggttatgcttattggtgtcttcgccatctcttcctttttgcaggcacatcagcagcagcaacgcccaccaccgccacggactcggcaggtcaaccctgcacctccacctattcccgcaccctccgcgcctccgatgccaccacagcctgcccaagcccaagttcctcccactccaccaaggcccctagttccagtggttcctcctggcgcagtgcctcctgccccgccaccaactgctcctgaagccaccgccaccaacggtcttcaggacaccgaaaccatgcaggtcgacccacctcgtgcttcactgagcggcccaccactaccacctgaggagacgctcatcgaggaggcgatccggctgacccggggccggctcaggaggcgcttggctgggggatctggaccaccgcaaaattagcgtcgatcaagatttccatctcacgcgaattgcaccacactggtctggttcttggtgattgactgagaagagggggaatgctgagttggttgaacagagtttgggtttcctcgcatgcgttctccgttgtacgaactggaaccggtttggtctcgaattgtgaatagtatcccagaaacagaagtggatgatcaattcaattcacagggtagcgctaggaaatatggttgggaaccatcttctgcaagacgcgcaggcgcgacatgtcatgagcatttagcaacgatgatactactggtcacagtagtgtagtctggaatccaaatgcgaagaacaaaaaagaacagcgccatgtatgtgctgcatacttgtagttaacgactactatgcaattagtccttatatgcaatcagcgatactatgcatttggtcgttctttgctctctccgatacccctgttttcttttaaatccttccgccaccggcttacgtatatttataaaaaatcataacaaattataattatatatatggttggatcatgattcaatcaaggattatattttagttttgcgttttttgaattctggtttgttgatcaaagtttgaattttatatctttaaattctaaaccaaaatacactaaaactcgggcctgttttcgtttcccgtcgggaaattttattgaaaatcgataaaccccaagcgagaaatttatctctagatccaatagatcatgatgctcacttacacgcttgcaaataaaatctaattgtacattagtcgttgctcataaacaaatatatgtatactagtcatttgccatgtgttgctacagtttctatatttagattattttcaatatgcgttctttgttggacacatgaatgcgagccttagtggttagaatcagagcgtgggagaggggaaagtgaccgttcgaatcctagcaccagacttacttttagacttttatttcgcttactacgttcaccagaggagacgatgcactaagaaaattctcatttaaatatagggcctgtttggggctgttttagtttcatagatttcaatatgcgttctttgttggacacatgaatgcgagccttagtggttagaatcagagcgtgggagaggggagagtgaccgttcgaatcctagcaccagacttacttttagacttttatttcgcttactatgttcaccagaggagacgatgcactaagaaaattctcatttaaatatagggcctgtttggggctgttttagtttcatagaatttggtaaaattgatgaagacgatcattaggatcttgagaaaatcggaa

SEQ ID NO: 1631 - DNA, 1056 bp, Zea mays
gggtacctcgaggccggcccggggagaaccgcacgggccatgtcccacggtcccacccagtagggcgttcctctcccgtgtggattctccccacctccgccgccgtttccccgcgtgctttctctctctctctcgatctcgagcgacgactcggttacagccgccgtcctacgccaggtcccaggtcttcgtcgggcccgtctccggcaacgagcaccaacaagatttttgtgtgtaaagatttgcgagcaccattcactttttcatcagtgtgaaattaaaacacttcaagcatgagctctcaccgtgtgaagtggaatgaggacaatttgtatgaaattgagtcaaacaaaccggtgaggcagaagataacagagccaaagacaccatatcacccaatgatagatgatgatggatcattgtcgccaacacgtcctttcgacaaatgtcttgatgagactgtccaggctgaagctatcttaacagccttaaatggtgtggcttcttcaagcattagcatttcaaaggatgatggttggggatcgtcagatgatgatacagatgccatagatcaagatgctgaccctgaagctgacacgacaaggttgagtttcaaggagcatcgccgtgcccactacgatgagtaccgcaaggttaaggagctgatgaggactggatcccttactgctgaggaggccgatgaggataacagagctgccaccagctccgaagacaaaggtgtggggaaaggagggccgaatgataacatgaagccctcgcctcaaacatgaggagttcatatgaaggttctgattcctctgttatttattgtatcattgtatgcaatacagttgttactcttgttttgttttgagatgctggtgtgccaaaatggatttgatgaccgataattttattggtgttggctacctggtcgaatggtcgtcgctccattttgttggtgacttaacaatttcaattgagaaaatatgtttcaaaccgagcaaaaaaaaaaaagctgaaatcagttattcgccaagagtgaatcttcctatc

SEQ ID NO: 1632 - DNA, 675 bp, Zea mays
cacgaccacgagcagaagagtaaacctggccaagtggtaacaccgtcgtcaggtcccacactccagtctcagtatctcccgtgctacacacgtaccccgttcctggaggactgactgcctcgacgtcttctctcccccgtcctccattgtcctttataaaggaaggtggcaatggcgtctccaccgtgaagttgcaaagctagctcgcttgcaagtcgcaacggtttttagctagctggttgcgcgtgcttttctttatttgcgagcgagaggagtttgttataacgaactgagcaatggggaggcaaccgtgctgcgataaggtggggctgaagaagggcccgtggacggcggaggaggaccagaagctcgtcaccttcctcctcatcaacggccagtgctgctggcgcgccgtgcctaagctcgccggactactgcggtgcgggaagagctgcaggctgcggtggaccaactacctgcgcccggacctcaagcgcgggctgctgtcggaggaggaggagaggacggtgatcgacctgcacgcgcagctgggcaaccggtggtccaagatcgcgtcgcacctgccggggagaacggacaacgagatcaagaaccactggaacacgcacatcaagaagaagctcaagaaaatgggcatcgaccctgtgacacaca

SEQ ID NO: 1633 - DNA, 2142 bp, Zea mays
gcacgaccagcccccgccatccatcctcctcctctgcacatgtacactcacctcaaaacccccaagcatcgtgctaaaacccggcctagccctcgaatccccccttgcccgcgcggagtagacgagcccagcccgtcccatcgaccatggcatcctcagggtccgccgctaacctctggtactgcttggcctaagcatcgcgggcgtcctcctggcagcgcggcgattgaggcaccatacgcgccctgaccacgacgctttcatggcccgcctagagctcctcccaccgccacagcctccgccgtcgcaaggaggccagcccgggcgaggtggcgcaggccatcgccatgttccccagatcctgttccacagcgtcgccttcttccaggtacacccagctctcgccttcttcaggcacagctccaagccgtcaagcgccacccagtcccgattcccttcacaccgtctctcgccctatcctatctgacggtccaagactctgagtttgccgtggtgagtgtgcttcactgcttctctaattcctcccgttgcattggttcgatggaatatggcgctgaggaggaggcggcgaccgatgaccccagtagcagcgggggcaccaggcgttgggcgactgaaggggagcccgaagctgactgtggatgcggacatgcgagatatggcgaagacggccgcgtggagcgttagttcctacagggctggcaacggtgtcacggccctgcacgacaacaaccttgacacctgccgacagtctgatggggctcaagtgtacagccgcaaatggtgaacatccagttccagaagaagttgcaggcgtgtagctgcagcctgcagctcgtcgtgatatacgtggatttcaagctcgaagaagtgctccactaaaaatgaaacgttagaattcagctgagcatcttactctacattgcagcaaactgtgacgtgctttgctgagttagattagtctggcatgcttgagtttcccatggtagggcgccgcgaagcgcgcctctttttctagtaaacaaaagcgcaaatggaagccgcttcacgtagcagcccgtgcaaagcaagcgaaagggacccgcgagcagcgaagcaaccaggccaagcgcaacacgacctacaccgtggggccggccatccaggagacacgcgtattccgtcctggacaaaggaccgcatccacttgctagctcgctagtcattacctgatttcgccgcgggcgtcgtcgtctttctccttcctcgtcctttataaaggaaggtggcaatggcctttccctctgcaccgccaagttagcttgcctagccacatcaaagcaaagctagctacggccagctttggcgatctgcttgcttctctccccgcgtccctttacaactaaaccaactgagcaatggggaggcaaccgtgctgcgacaaggtggggctgaagaagggcccgtggtcggcggaggaggacgagaagctcgtcaccttcctcctcaccaacggccagtgctgctggcgcgccgtgcccaagcttgccgggctactgcggtgcggaaagagctgcaggcttcggtggaccaactacctgcgcccggacctcaagcgcgggctgctgtcgtcggaggaggagacgacggtgatcgacctgcacgcgcagctgggcaaccggtggtccaagatcgcgtcgcacctgccgggacgcacggacaacgagatcaagaaccactggaacacgcacatcaagaagaagctgaggaagatgggcatcgaccctgccacccacaagcccctccacccacagccagcagctcctcctccgactcagcaggagcaggacacgggcgggtcgcccgaggaggagggggagaaggccgacgcggtcatgatggcagcagctacgccgattatcgggcacgagacggcgccgttctttaccgacgaggaggagatgctggcgcacctccttgacgacatcgacgacttcccacccgcggcttattctcccgacgactcttcttcgccctcctcctcctcctccgcgtcccggtcgtctcactcggcctccgtcgtcacagcgccgtcgtcgagcggagctggtggaagcagcgtcgccgacggcgagcggccgc

SEQ ID NO: 1634 - DNA, 1503 bp, Zea mays
  misc_feature (19)..(22): n is a, c, g, or t
ccggccgggtgtttctacnnnncattgggtacctcgaggccgggccgggaaattccccacacgcgcccacctcctctgctctctcctctcccccacctctgcgtccgtgcgttgtgtttgtttaggcggcaaccgcgaggcgcaatggcggccgggcgagagctggtggtgagtttcggcgagatgttgatagacttcgtgcccaccgtggcgggggtctcgctggcggaggcgccggccttcctcaaggcgcccgggggcgcgcccgccaacgtcgccatcgcggtctcgcgcctcggcggcggggccgcctttgtcggcaagctcggcgacgacgagttcggccgcatgctcgccgccatcctccgcgacaacggcgtcgacgacggcggcgtcgtcttcgactccggcgcgcgcaccgcgctcgccttcgtcaccctgcgcgccgacggggagcgcgagttcatgttctaccgcaaccccagcgctgacatgctcctcaccgccgacgagctcaacgtcgagctcatcaagagggctgcggtcttccactacggatcaataagcttgattgctgagccttgccggacagcacatctccgtgccatggagattgccaaagaggcaggtgcactgctctcttatgacccaaacctgagggaggcactatggccatcccgtgaggaggcccgcacccagatcttgagcatctgggaccaggcagacattgtcaaggtcagcgaagtcgagctcgagttcttgacaggcatcgactcggtggaggacgatgttgtcatgaagctgtggcggcctaccatgaagctgctcctagtgactcttggagatcaagggtgcaagtactatgccagggatttccatggcgctgtgccttccttcaaagtacaacaagttgatacaactggcgcaggtgacgcgttcgttggtgctctgctccaaaggatcgttaaagatccatcctcgctacaagatgagaagaagcttgtggagtcgattaaattcgctaacgcgtgcggagcgatcaccaccacgaagaagggggcgatcccgtcgctgcccaccgaagcggaggtcttgcagctaatagagaaggcttagatcatcatcgtcctgtacgccatggttttcaccagcttctacttcttcgaattgtattggattctgatatggaacagaagaagaagcggctgccccatcttaccagccctttttgtttgccctagtttccccttgtgaaaagggtgttttgttttataaactctacttgcaataagcagagcctttttttaattatgtcagggtgcatttgatacgatcgaataatcatcaatccataattgtagcaatttttttttaaaaaaagaaaagtcaattgagtttttgttccagtggtggataaaaaaaaaaaaaaaaaaaaaaaaaaaaaaaaccaaaaaaaaaaaaaaaaaaaaaaaaaaaaagggtctctgcgttgttaccactgct

SEQ ID NO: 1635 - DNA, 1400 bp, Zea mays
acggtcctctatataacccgccgcctccgcgcccgccgggaaatttccccacacgcgcccacctcctccggtcctcccctctagtcctctctcccgaccccacctctgccgtccgtgcgtccgtccggcaaccgcgacgcaacaatggcggccgggcgagagctggtggtgagtttcggcgagatgctgatagacttcgtgccgaccgtggcgggggtctcgctggccgaggcgccggccttcctcaaggcggccgggggcgcgcccgccaacgtcgccatcgcggtctcgcgcctcggtggcggggccgccttcgttggcaagctcggcgacgacgagttcggccgcatgctcgccgccatcctccgcgacaacggcgtcgacggcggcggcgtcgtcttcgacgcgggcgcgcgcaccgcgcttgccttcgtcaccctgcgcgccgacggcgagcgcgagttcatgttctaccgcaaccccagcgccgacatgctcctcactgccgacgagctcaacgtcgggctcatccggagggctgcggtctttcactacggatcaataagcttgattgctgagccttgccggacagcacatctccgtgccatggaaattgccaaagaggctggtgcactgctctcttacgacccaaacctgagggaggcactttggccatcccgtgaggaggcccgcacccagatcttgagcatctgggaccaggcagatatcgtcaaggtcagcgaagtcgagcttgagttcttgacaggcatcaactcagtggaggacgatgttgtcatgaagctgtggcgacctaccatgaagctgctcctggtgactcttggagatcaaggatgcaagtactataccagggatttccatggagctgtcccttccttcaaagtacaacaagtcgatacgactggcgcaggcgatgcgtttgttggtgcgctgctccgaaggatcgttaaagatccatcctcgctacaagacgagaagaagcttgtagagtctattaaattcgctaatgcgtgtggagcaatcaccgccacgaagaagggtgcgatcccgtctttgcccactgaaactgaggtcttgcagctaatagagaaggcatagatagatcactgtaattgctttggttttcactagcttccacttctgcaaattgcaaaatgtattgtattctgatctggaacagaagaagtgggtgctccatcttacctgccattttttgcttgccctagttcctaagggtgttttgttttagaactctacttgcaataagtagagcccttttatatttatgtatatcagcatgcgctcatttgatacggtcatcgatcaccgaacagagcacactgcaaagtgcagacttcgaaaaaaaaaaaaaaaaaaaaaaa

SEQ ID NO: 1636 - DNA, 2822 bp, Zea mays
tgcatgcctgccctgcagcagtctatatatattattcaaatttttaccgtatcgtgcatgtactgtgcttccatctggtcgcatatgcttgcttcggaataaagaaatagtgtggaaaaaaaaatggacgcgtcacatgcgctgctcacatggtgggtgggccccgcgcccggcgcgcatcatcatgcaccgcatccgagtacacatggagcccgcgctgccgtcacttgaattcagttgaaattgggggatatataaaatctccaccacctccgaccctcctgtcccgctcctcttctatctgttcgtttacagccccccagctcatcaaagatcacatttttgggcactgctatataaacaaagttggcaggagtcgtagattagcaggccgcccgtctatatttttttgttcatgttttgaaagtgaaggaggatttgggtgggcaacgtctacctctgccaaaaataatcggcgtccatatgcaggcgtcgtatctttggaataagtgaatagcaggtgcaaaataatcggcgttgccttcatttcattccatttgcgtgattaatgcatgcgtatccagcctgatttgcgtttcccgcattaatatcttattccgcgtcgggggttccccccttcaatttttactatttaattatacagatacatatccagccggcgcagccaggaggcgactgaccgaattgtattgtttgttcgatcgaagcaggcagatggcaggcggcggattcgtggaggacatgaacatgatgagggagcagagcctcctcgaggcgacgtgcggcgacctcttcgaccacatcgacgacctcctcgacttccccaacgaggactccgccgccgccgtgctcctcctggacgcgccggcgccggggagcccgctgtcggcgcgcatcatcgacgtcggccgcgccggcaatgcgctcgccccgcctgctgcccccgcgcagcacgacgcttccgctagcgccttcttcgccgccgcggggaacgatgtgttcgacaccaaggacgtcgtcggcgcacacatcggctcgtgcgacgacattgacatggacatggcgcagctggagtggctatcggggctctccgacgacgcctccatcccgcacgagccggtgttccctggcgcgacggcgggcggcgcggcgcccatcatgaagagctccgcgctggcggccggcagcgctgctgccgccggacaaaatggaggacgcgctgctgttccgcagctccagccccatctcggtgctggagcacggcagcggtggcagcggcagcgccagcgccaccggctccgcgtcctcgtcctcctcctcggcgtcctcctcctcggagtccttctccgggagtgggagtggaggagggcatgtttggtcggcgccagtgtcgccgcgcccggcgccgccgccggtgctcgtcataccggcgcgcgcgcggagcaagcgctcccgttcgtccgcgttcaccggcgccgccgcgcgcgccggggcggagacgccaaccatcctcgtgccgacgcccatgtactcgtccgggtctgcccactcggaccccgagagcatcgccgagtccagcccgcacccggcgccgcccatgaagaagaagaagaaggccaagaagcctgcgccccccgcgccagctgcctcttctgacgacaacgatggcgacgccgactacgaggaaggcggcgagcaagcggagccgcagggcggcgccgtcaggaggtgcacgcattgccagatcgagaagacgccgcagtggcgcgcggggccgctggggcccaagacgctctgcaacgcctgcggcgtgcgctacaagtccggtcgcctgttcccggagtaccgccccgcggcgagccccaccttcgtgccgtccatccactccaactcgcacaagagggtggtggagatgcgccagaaggctgtccggagcggcgacccgtcgtgcgaccttctccagttcatccgccgccgggattgacgtcccggcacggcgtcgccggactgtcggtcggtctcgtcccccatatagctatatatgtatgcatgcatggttgcttcatcagtcgtcgtcgcccatcatggtcatcatcaccgcttcaccggtcaccgccatggatcgtctcccgcccatcatcacatgcattggtttgtgtcagcatccatccaatcccaatccatcgccgggcgtcccggcgttgttagttcattaggtcttttttttcctcatcgggggctagtgttattttacctttgatccttttgtctattggttaattggttccccctggatgttttttgtttgtatagagtgaaaaagagagaggagaaatagatgaatcagagtggttgctgtattgcaattgcagttgcttgcaagctaggtaggtgagaaggagagctaaaccagcagcagagggagacagatttagagaggaaactttgcagctagtcagtcagtcagtcacttagaaaaaaacaaggagagtgcttgaagcaggtgaaagggcaatttgttggtttgctaattagaagagaggttctgtcaggtcaggtcaggtagttgctatcattattcatgaggattttcaaacttaatagggggacagccatcatccatcatagtttgtatttggaacttggtatactgaactctgaaaattctttttgcagttcatctatgcttagggattgataagtgttgtctggtttcttctatattgatagtgctaccttttagcccccaattagttatgtaaaaaaaaaaaaaaaaagtactctgcgttgttaccactgct

SEQ ID NO: 1637 - DNA, 3586 bp, Zea mays
caatcaaacgctccgatttttccaccgtcgtttgttcgtattattttactactactactactgcagtacagtagtctatatatattattcaaatttttaccgtatcgtgcatgtactgtgcttccatctggtcgcatatgcttgcttcggaataaagaaatagtgtggaaaaaaaatggacgcgtcacatgcgctgctcacatggtgggtgggccccgcgcccggcgcgcatcatcatgcaccgcatccgagtacacatggagcccgcgctgccgtcacttgaattcagttgaaattgggggatatataaaatctccccctccgaccctcctgtcccgctcctcttctatttgttcgtttacagccccccagctcatcaaagatcacattttgagcactgctatataaacaaagttggcaggagtcgtagattagcaggccgcccgtctatttttttgttcatgttttgaaagtgaaggaggatttgggtgggcaacgtctacctctgccaaaaataatcggcgtccatatgcaggcgtcgtatctttggaataagtgaatagcaggtgcaaaataatcgacgttgccttcatttcattccatttgcgtgattaatgcatgcgtatccagcctgatttgcgtttcccgcattaatatcttattccgcgtcgggggttcccccttcaatttttactatttaaattatacagatacatatccagccggcgcagccaggaggcgactgaccgaattgtattgtttgttcgatcgaagcaggcagatggcaggcggcggattcgtggaggacatgatgagggagcagagcctgctggaggcgacgtgcggcgacctcttcgaccacatcgacgacctcctcgacttccccaacgaggactccgccgccgccgtgctcctcctggacgcgccggcgcccgggagcccgctgtcggcgcgcatcatcgacgtcggccgcgccggcaatgcgctcgccccgcctgctgcccccgcgcagcacgacgcttccgctagcgccttcttcgccgccgcggggaacgatgtgttcgacaccaaggacgtcgtcggcgcacacatcggctcggtgagtctgagacccccgccccctccatgtcctgcttgtcggtagtgatggaacgcgtcttcttttatttttatttttttcttctaaatctccgctccactctattcgcactgtccgtgcgattcatcgtagaacggaacggaacggagttcaaaatagccccgggcgtcaggggacacgccacgcgggtcggtctcatcggccacgacctgggtggttggggtaaggaggagtgggcggtgtcggtcggcccgatgggcggtggccggtgagattcgtgatcggagttaccaccgcccggtgttacgtcggtcgcccggacccgtgttacgtcggtcggagggcccgtcgcttttcttggtagctcgccagcccagcaactaactgttccctctactctacgcaacctaaattacacgtggggcccggcccgttcgttcgttcatgattgttttgtttgctgcaggcataatctgatttgttactgcttgctgcagcagcaaatgtgagcagtaacatgacagatagtagcagctgcagcagcaaagctggcagtgtcggtgtcggcgtcggcgtcggtgtcggtgctgggcaacggcgcgtcgcatgattcttctgttctgacgtggcaactaatgattctgatcccatttggttgcagtgcgacgacattgacatggacatggcgcagctggagtggctgtcggggctcttcgacgacgcctccatcccgcacgagccggtgttccctggcgcgacggcgggcggcgcggcgcccatcatgaagagctccgcgctggcggccggcgcgctgctgccgcaggacaaaatggaggacgcgctgctgttccgcagctccagccccatctcggtgctggagcacggcagcggtggcagcggcagcgccagcgccaccggctccgcgtcctcgtcctcctcctcggcgtcgtcctcctcggagtccttctccgggagtgggagtgggagtggcggagggcatgtttggtcggcgccagtgtcgccgcgcccggcgccgccgccggcgctcgtcataccggcgcgcgcacggagcaagcgctcccgttcgtccgcgttcaccggcgccgccgcgcgcgccggggcggagacgcccaccatcctcgtgccgacgcccatgtactcctccgggtcggcccactcggaccccgagagcatcgccgagtccagcccgcacccggcgccgcccatgaagaagaagaagaaggccaagaagcctgcgccccccgcgccagctgcctcttctgacgacaacgatggcgacgccgactacgaggaaggtggcgagctagcggagccgcagggcggcgccgtcaggaggtgcacgcattgccagatcgagaagacgccgcagtggcgcgcggggccgctggggcccaagacgctctgcaacgcctgcggcgtgcgctacaagtccggtcgtctgttcccggagtaccgccccgcggcgagccccaccttcgtgccgtccatccactccaactcgcacaagagggtggtggagatgcgccagaaggctgtccggagcggcgacccgtcgtgcgaccttctccatttcatccgccgccgggattgacgtcccggcatggcgtcgccggactgtcggtcggtctcgtcccccatatagctatatatgtatgcatgcatggttgcttcatcagtcgtcgtcgcccatcatggtcatcatcaccgcttcaccggtcaccgccatggatcgtctcccgcccatcatcacatgcattggtttgtgtcagcatccatccaatcccaatccatcgccgggcgtcccgacgttgttagttcattaggtcttttttttcctcatcgggggctagtgttattttacctttgatccttttgtctattggttaattggttccccctggatgttttttgtttgtatagagagtgaaaaagagagaagaaatagatgagtcagagtggttgctgcattgcaattgcagttgcttgcaagctaggtaggtgagaaggagagctaaaccagcagcagagggagacagatttagagaggaaactttgcagctagtcagtcagtcacttagaaaaaaaaacaaggagagtgcttgaagcaggtgaaagggcaatttgttggtttgctaattagaagagaggttctgtcaggtcaggtcaggtagttgctatcattattcatgaggattttcaaacttaatagggggacagccatcatccatcatagtttgtatttggaacttggtatactgaactctgaaaattctttttgcagttcatctatgcttagggattgataagtgttgtctggtttcttctatattgatagtgctaccttttagccaataattagttatgtaagagttgctcttggtcttgcctccatctactccctctgttcctgcaatacagggcattctaacaaagaattaacgcaacactcaaatgacgcttgtactt

SEQ ID NO: 1638 - DNA, 839 bp, Zea mays
gaaattgtcggaatataaaatctcccccgccgccccgcctgtcccgctcctcttctatttgttcgtttacagccccccagctcatcaaagatcacattttgagcactgctatataaacaaagttggcaggagtcgtagattagcaggccgcccgtctatttttttgttcatgttttgaaagtgaaggaggatttgggtgggcaacgtctacctctgccaaaaataatcggcgtccatatgcaggcgtcgtatctttggaataagtgaatagcaggcagatggcaggcggcggattcgtggaggacatgatgagggagcagagcctgctggaggcgacgtgcggcgacctcttcgaccacatcgacgacctcctcgacttccccaacgaggactccgccgccgccgtgctcctcctggacgcgccggcgcccgggagcccgctgtcggcgcgcatcatcgacgtcggccgcgccggcaatgcgctcgccccgcctgctgcccccgcgcagcacgacgcttccgctagcgccttcttcgccgccgcggggaacgatgtgttcgacaccaaggacgtcgtcggcgcacacatcggctcgtgcgacgacattgacatggacatggcgcagctggagtggctgtcggggctcttcgacgacgcctccatcccgcacgagccggtgttcccgggcgcgacggcgggcggcgcggcgcccatcatgaagagctccgcgctggcggccggcgcgctgctgccgccggacaaaatggaggacgcgctgctgttccgcagctccagccccatctcggtgctggagcacggcagcggtggcagcgccagc

SEQ ID NO: 1639 - DNA, 837 bp, Zea mays
  misc_feature (784)..(784): n is a, c, g, or t
cattgggtacctcgaggccggccgggcagaagaggtagctgggagctagagagaaaaaaagggtgcaccgagcaacccaggccagggaggaagggaggagtgagccgtcagtcgaccgtttccggcgaactcacaggcagatggcaggcggcggattcgtggaggacatgatgagggagcagagcctcctggaggcgacgtgcggcgacctcttcgaccacatcgacgacctcctcgacttccccaacgaggactccgccgccgccgtgctcctcctggacgcgccggcgcccgggagcccgctgtcggcgcgcatcatcgacgtcggccgcgccggcaatgcgctcgccccgcctgctgcccccgcgcagcacgacgcttccgctagcgccttcttcgccgccgcggggaacgatgtgttcgacaccaaggacgtcgtcggcgcacacatcggctcgtgcgacgacattgacatggacatggcgcagctggagtggctgtcggggctcttcgacgacgcctccatcccgcacgagccggtgttccctggcgcgacggcgggcggcgcggcgcccatcatgaagagctccgcgctggcggccggcgcgctgctgccgccggacaaaatggaggacgcgctgctgttccgcagctccagccccatctcggtgctggagcacggcagcggtggcagcggcagcgccagcgccaccggctccgcgtcctcgtcctcctcctcggcgtcctcctcctcggagtccttctccgggagtgggagtggcantggcggagggcatggttggtcggcgccagtgtcgccgcgcccggcgccgccgc

SEQ ID NO: 1640 - DNA, 1826 bp, Zea mays
acacatacaactcacatagtgctaacagaacccgacgggattcaggttgacgacgtgacggcggaacccccttcgacccctgctccacggggagacgtggagatgatgaccgaggacgagaaggagaaggccagattgtttctgcctgatttgaggcgaagccccacttctagttcgcggggtccggctgtggaggagatgacttcgaatgaatctgttagcagtaatagcatctcaaactttaaatggggtgcaaccaataggcggtctcggacgcagtttagaggacaaggagacactgagatttcggctccagccttaattggaagctcagacaaaggggtttctggcctctctgctggcacctcaaaggagaagaaaggcaccgaagaaactcgtagtgcacagaacacaggagatttagggcttattagttcttcatcaagtccagtaacaagcgcacaacggccactcccaagctccagcgtaggctcgaactcaagagaatcaaaaaagagggataccgctttgcatccactgattttcaaggaagctggccttccagataatactttgttgacttacaagttgaagaacggagaggcactactgcaagggtataagcagggagcaggtattgtctgcaattgttgcaatcaagaggtttccccttcggaatttgaaaaacacgctggcatggggaaaagacgacaaccgtatcaaaacatttatacatcacaaggattaacactccatgatgtagctctgcaactgcatcatttgaatttgaatttgaattcaaatggatttagcaatgctagtgtttccagcttcagtgactacccaaaccttacttcttcaggttgtggcaaagaaccttctgtcagtggacctattgtccccctgaaacggactttacaagaaagattggtccaaacagagagttgctatttctgtgggtatggccacacagagcttggaaaaattgatccaaacatgattgtcttctgtaaccagtgtgagagaccatgccacgtgaaatgttacaatagtagagttgtaaaaaagaaggtgcctctggaaattttgaaagactatttgtgttttcacttcttgtgctgccaagaatgtcagtcacttcgtgtccgtctagaaggaatggagaagtgtgaagagattgccttccttggacggataagatccaatatttgttggcggcttttaagtagcgctgacgcaagtagggatgttaaactctacttgtctcaggtcatcgacatcttcaaagatgcatttgtggaatctactgatgcgcacagtgacatctcagatatggtttatggaaaaaatagagaaggagagaaggattttcgaggaatgtattgtgtagtgttaactgcaagtacgcatgttgtgtctgctgcgattctgaaagtgcgcatggaacaagctgcagaactggtccttattgctactcgtagcgagtgcagaaaaaagggctacttcagacttctcctagagtcaatcgagacaaatttgagagcctgtaatgtaagccttcttatggcacctgttgaccctgaaatggcacaaatctggtcagataaactcgggttcaccattttatcagccgatgagaagaagtcaatgctggagtcgcaccctttggtgatgttcaagaacctagtcttggtgcagaaaccacttgtttgagccaatttaatgaatgtttgattatactactctttccgtcctaaaatataatttgttttaggctaaacatacattcattatttaaattatacaaaaaaaaaaaaaaaatgtct

SEQ ID NO: 1641 - DNA, 1450 bp, Zea mays
cccacgcgtccgcgctgggcaaacagcgtacctcatcaacaacgtcaacgacttcagtgacggattctacaagtttgttcctcgccctgtttactggcccatgttcatcatcgcgacgctggcggcgatcgtcgcaagccaatccttgatatccgcgacgttctcagtcatcaagcaatccgttgtcctggactacttcccgcgcgttaaggtggtgcacacgtcgcagcacaaggaaggggaggtttactccccagaaaccaattacatcctcatggtgctttgcgttagcgtcgtactaggcttcggagctgggaatgcgatcgggaacgcattcggtgttgtggtcatcatggtcatgctcataaccacagtcatgctcaccctggtgatgatcattatatggagaacgccgcctgttcttgtggcgctctacttcgtgcctttcgtcgtcatggaagggtcttatgtcagtgcagtcttcaccaagatccccgaaggcggctggctcccctttgcggtgtccatcatcctggcgatggtcatgttcggctggtactacggcaagcagcggaagacggagtacgagatagcgaacaaggtgaccgtggagcgcctcggcgagctcctggcgaagccggaggtccagagggtccccgggctgtgcttcttctacagcaacatccaggacgggctcacgcccatcgtcggccactacatcaagaacatgagctcgctgcacgcggtcacggtcttcgtcaccctccggtacctgctggtggccaaggtggacgagcgggagagggtcctcgtcgagaggttgggaccggacggggtgtacggctgcactgtccagtacgggtacgcggacagcctcagcggcggcgacctcaccgcgcaggtcacgggctccctgcgccggcactttgggacgtcggaggccggggcggaagaggccgcgcgcctggaggcggcgaggaccaacggcgtcgtgcacgttcggggtaagatgaggttctacgtgggcgaggacgccgggtggttcgacaaggtcatgctcgggttctacgagttcctgcacggcatctgtcgctccgcgctgccggcgctggggacccccctgcaacagcgagtcgagatcggcatgctgtacaaggtttgatcgatcaaggttatcagtgcccaacgatcaaatgcgcccataaccaatatacgcaacatcaaaataagtcaatgagtatacccgtggcgtgtcatagagtgattgtgtacaagaaattcacgggcatgaacagaacctagtaaaaagctgcgaatgaagctgcccaaattttgttttgccggtttgtatggcatgacatggttactggcaaggacctttgtttccctttttcagttctgcagcagggcttttcgggtgccttattcaaaatagaacagtttgcctgcc

SEQ ID NO: 1642 - DNA, 1706 bp, Zea mays
tgtggtctgtgtgtgtgatgtgcatttcttgcagctatcttataaatttctttgcctcaggaacttgatcttatattgcaaacttcaagatgttctctgctccaggcaacaattatttggctcttgtagcctcacgaccagggatggagctggctaattttcaacaacaaccaaaccaggctcctggtcctggaggaaaacagcgcacatccagcctggaggcaccaataatgctacttactggtcaccagagtgctatatactgcatgaagttcaatcctgcaggaactgtgatagcatcaggttcccatgacaaggatatcttcttatggcttgcccatggtgaatgtaagaacttcatggtactgagagggcacaagaatgctattcttgatcttcagtggactactgatgggacccagatcatctctgcaagccctgacaagactctgagggtctgggacgttgagactggcaaacaagttaagaagatggctgagcactcatcattcgtcaactcatgctgcccagcgcggaagtggccacctcttgtggttagcggttcagacgatggtacagcaaagctgtgggacttgcgtcagagaggtgcaatacaaactctccccgacaaatatcagagcccacctgttagcttctcagaggcagcagataaggtattcactggtggcctggacaacgatgtcaagtggtgggatcttcgcaagaacgaagtgacagaacatctcaaagggcatcaggacatgatcactgggatgcagcttagccctgatggatcttacctcctgaccaatgcgatggataacgagctcaagatctgggatctgcgcccttacgcgccagagaaccggaacatcaaaactcttacaggtcaccagcataactttgagaagaacctgttgaagtgtagctggtcacccgataaccgcaaggtcactgccgggagcgcggaccgcatggtctacatctgggacacaacgtcaaggcgcatcctgtacaagcttcctgggcacaacggttctgtcaatgagactgcgttccatcccactgagccgatcattggatcctgcggcagcgacaaacagatcttccttggggaactttaagtgactatggcagtggctggcagacccaatgccagaggctcccacatcactgggatgttcttgtgacactttgatgaggagaaaaagaggcactgacatccccattccttcgcctgaaaatcggaatactcagtttggctgatcaggatttgtcatttgtagattgtcttagcctgtttagcccagttgttgacaaaccgctccatggctttgtactctctgactttccgaccttaaacttgatgcggtgcttgaagatcaccgattgaatgtactgtgtctagaacctcactctctggagcttgcctgctgtagttatgtacggctctgccatattgttaatctttcctagtcacctgaaactagctggagaagtgatcttttctagttgcccgaagctagctgcggccgtgataccaccttcttgtgtcacacggatttagtggacaaactcggacgtgaatcaaatctcacacatatgatgactcatgatacagaaacgaatgttacatctttaatatataataggagttctgtataaaatagctaaataattatatcatatgaaaataacgatccggc

SEQ ID NO: 1643 - DNA, 969 bp, Zea mays
  misc_feature (925)..(925): n is a, c, g, or t
cattgggtacctcgaggccggcccggcggggccctcccggccggccggggtcaacccgaccccgttccccagctcaccgcgcgcgctctctccttccttctcttgtggccacgacgagcgacattcgctactcgctaccgtcctacgccaggtgccccaggtcttcttcggttccttcgccggcgacgaacgctaccaggaacttgatcttatattgcaaacttcaagatgttctctgctccaggcaacaattatttggctcttgtagcctcacgaccagggatggagctggctaattttcaacaacaaccaaaccaggctcctggtcctggaggaaaacagcgcacatccagcctggaggcaccaataatgctacttactggtcaccagagtgctatatactgcatgaagttcaatcctgcaggaactgtgatagcatcaggttcccatgacaaggatatcttcttatggcttgcccatggtgaatgtaagaacttcatggtactgagagggcacaagaatgctattcttgatcttcagtggactactgatgggacccagatcatctctgcaagccctgacaagactctgagggtctgggacgttgagactggcaaacaagttaagaagatggctgagcactcatcattcgtcaactcatgctgcccagcgcggaagtggccacctcttgtggttagcggttcagacgatggtacagcaaagctgtgggacttgcgtcagagaggtgcaatacaaactctccccgacaaatatcagatcacagccgttagcttctcagaggcagcagataaggtattcactggtggcctggacaacgatgtcaaagtggtgggatcttcgcaagaacgaagtgacagaacatctcaaagggcatcaggacatgatcactgggatgcagcttagnccctgatggatcttacctccctgaccatgcgatggatacgagct

SEQ ID NO: 1644 - DNA, 1922 bp, Zea mays
ccggccggccgcgtggcggtttgaggtattgggccaaaatgtaagagtagaaacaaccccagccgccgccaaccccaaccccgttctccggcccgccgctctctctctcctagtccccttctatcgtggcaacgacgagcgacagtcgctgccgccctacggcaggtgcccaggtcttcttcggtcccttcgccgtcgacgagcactaccaggaacttgatcttataatacaaacttcaatatgttctctgctccaggcaacaattctatggctcttgtagccccacggccagggatggagctggctaatattcaacatcatccaaatcaggctcctgggcctggaggaaaacaacgcacatctagcctggaggcaccaataatgctacttacaggtcaccagagtgctatctactgcatgaaattcaatcctgcgggaactgtgatagcatcaggttcccatgacaaggatatcttcttatggtatgttcatggtgaatgtaagaactttatggtactgagagggcacaagaatgctattcttgaccttcagtggactactgatgggacccagatcatctctgcaagtcctgacaagactgtgagggtctgggacgttgagactggtaaacaagttaagaagatggctgagcactcatcattcgtcaactcatgctgcccagcacggaagtggccacctcttgtggttagcggttcagatgatggtacagcaaagctgtgggacttgcgtcagagaggtgcaatacaaactcttcccgacaaataccagatcacagccgttagcttctcagaggcagcagataaggtattcactggtggcctggacaacgatgtcaagtggtgggatcttcgcaagaatgaaacgacagaatatctcaaaggacatcaggacatgatcactgggatgcagcttagccctgatgggtcttacctcctgaccaatgcaatggacaatgagctcaagatctgggatctgcgcccttacgcaccagagaaccggaacatcaagactcttacaggtcaccagcataactttgagaagaacctactgaagtgtagctggtcgccagataaccgcaaggtcactgctgggagcgcagaccgcatggtctacatctgggacacaacatcaaggcgcatcctgtacaagcttcccgggcacaatggttctgtcaatgagactgctttccatcccacagagccgatcattggatcttgcggcagcgacaagcagatctatcttggggaactttaagtgactatcagttccttttcagctagatgttcttgtgacactttgatgaggagaggaggcactgacaccctgttcctttgcctgagaattggaacactcagtttggctgatctggatttgacatttgttgattgtcttgttaagcccagttggtcttgccgttcacaaactgccccatactttgcaccttgtggctttccgatattaagctagatggcatgcttgaaggtcactggttgcatgtactgtgtctagaaccttactaaaaacttgcatacggtagtactgtatgctatattgttatcttttttaatcgtatgaaactagttggagaagtgataccgccttcttcgcatggtttgaaatatccctctcaaaattctccaaaaaaaaaaaaaaaaatcctgtgcttgttgtgcctttttttttgcaacaattggcggtgctggagagtcaacagcttgttttattagtgaaggtcgtgcgcttgtgattgtgaaagctgctgcaaagtgactgttgctttatctctgcttcataaagcatcagctttcacggtcgtgcttcatcttatatgcaaaaattaaaataaaattatacataagtggagtttcaaactttagtggttggcttcacatttacaccc

SEQ ID NO: 1645 - DNA, 1589 bp, Zea mays
attgggccaaaatgtaccgggagaaacaaccccagccgccgccaacccaaaccccgttctccggcccgccgctctctctctcctagtccccttctatcgtggcaacgacgagcgacagtcgctgccgccctacggcaggtgcccaggtcttcttcggtcccttcgccgtcgacgagcactaccaggcaacaattctatggctcttgtagccccacggccagggatggagctggctaatattcaacatcatccaaatcaggctcctgggcctggaggaaaacaacgcacatctagcctggaggcaccaataatgctacttacaggtcaccagagtgctatctactgcatgaaattcaatcctgcgggaactgtgatagcatcaggttcccatgacaaggatatcttcttatggtatgttcatggtgaatgtaagaactttatggtactgagagggcacaagaatgctattcttgaccttcagtggactactgatgggacccagatcatctctgcaagtcctgacaagactgtgagggtctgggacgttgagactggtaaacaagttaagaagatggctgagcactcatcattcgtcaactcatgctgcccagcacggaagtggccacctcttgtggttagcggttcagatgatggtacagcaaagctgtgggacttgcgtcagagaggtgcaatacaaactcttcccgacaaataccagatcacagccgttagcttctcagaggcagcagataaggtattcactggtggcctggacaacgatgtcaagtggtgggatcttcgcaagaatgaaacgacagaatatctcaaaggacatcaggacatgatcactgggatgcagcttagccctgatgggtcttacctcctgaccaatgcaatggacaatgagctcaagatctgggatctgcgcccttacgcaccagagaaccggaacatcaagactcttacaggtcaccagcataactttgagaagaacctactgaagtgtagctggtcgccagataaccgcaaggtcactgctgggagcgcagaccgcatggtctacatctgggacacaacatcaaggcgcatcctgtacaagcttcccgggcacaatggttctgtcaatgagactgctttccatcccacagagccgatcattggatcttgcggcagcgacaagcagatctatcttggggaactttaagtgactatcagttccttttcagctagatgttcttgtgacactttgatgaggagaggaggcactgacaccctgttcctttgcctgagaattggaacactcagtttggctgatctggatttgacatttgttgattgtcttgttaagcccagttggtcttgccgttcacaaactgccccatactttgcaccttgtggctttccgatattaagctagatggcatgcttgaaggtcactggttgcatgtactgtgtctagaaccttactaaaaacttgcatacggtagtactgtatgctatattgttatcttttttaatcgtatgaaactagttggagaagtgataccgccttcttcgcatggtttgaaatatccctctcaaaattctcc

SEQ ID NO: 1646 - DNA, 1452 bp, Zea mays
atagaaaaaacctctaccttctatgagccaagtaaagagagaagccgataaactgtgtttcacgtcccggcgatgagcccccgtgtggtcctcctcttcctcgccgccctccgcccctgcgccgccctcgtccgccttcactccaccactttttccttcactttccttgacgccccagcgcgctttggcccccgagtgagcggcgatgggatctgcggctccctgcgtgccgctgacccggccgaggcgtgtgagaccatcaaagaccgcggcggccgccgcggcgcgggcaggaaggctttcgtgctgatcgcgaggggcaactgcagctttgaggagaaggtgcgggcggcgcagcaagcggggttcgacgcctccatcgtgtacgacgatgaggagaaggccagcctttactccatggttggtgaatctgatggcatacacatacctgcgatatttgtttccaagatggctggtgaaacactaaagaagtttgccaggggtgaagatgaagagtgctgtattaactcgtcgatggatgagactgcagggacagtgttggtaatgtcatttgtgtcacttgttgtcatcatgtcagttcttgcttcttttctatttgctcgaaactgccgacttctacgccatggagttgataatcacccaccttacgtcaagaaacaagtggtggaaaagtttccctgctcagcgtacagtgctccctgttctagtgaagataatttccaggaagcttgtgcaatttgcttagaagactacaataatggtgatatgcttagacatctcccatgcaagcatgaatttcacaagatctgtattgattcttggctcacaaaatggggcatcttctgccctatatgcaagctagaagtaacattgggcgggtaggcacacttcattactgcatccaagtgctggcagttctattgaagattgttgatcttttgatccattgcgaggttcaatattcattttaatgattgatctttgagaatgaagtacagatctcagttcctcaggttgggccttgtagtgtgctactagactactgcgttcaggttaatatttcgatcatctgtttgatatccttgtttggtgtgtggaagagctcaaggagctctgctgctgataaatgtcagcacttctgttgcagtgtattgccctgtattcctagagaaattaggtgttgtgtgcaagcaaagtgtaatcgtaagtccaatgtaaaccccttttataccaggttacgttaccttgctcattttattttgtgggcacagataaatgctcgttaattaggcaggggttgatcttactctaaaaaattgtcctaaggctcagaaataacgatgtttgaagatgcatttgttgcgaaaaaaaaaaaaaaaatcagattttgatgaatttattttcctaaataaaaaattatacatataaaat

SEQ ID NO: 1647 - DNA, 525 bp, Zea mays
tggataagattatagatggatggtgacacaacacagcagggcacatggctagcctgctagcgtgcggcacccacacaacacaacacactgctcgccaaaagcgccccaggaggccaggggaggacacgacgccgccatcagccatcatcatcatctcagactcagagcatgccatggcacgcaactgactgactgactcgaaacacacacagcgacgccgctatactttattaagctttataattagctagcttcctccggccggcctgcaggggggagcacctagctcacttgccgcagttgcaggggtcgcactggcagttgccgccgcacttgcacccgccgttctcagctccgggggccgcctcgaacccgccctcggcgtgccccttggatggggcgacacccatgatgagagcctggggggggggggtcacctgctcagccatgtccgggaacatcttgctgcaccctccgcagccgttgccgcacttgcacccggagccgcacccacagttgcctccg

SEQ ID NO: 1648 - DNA, 1272 bp, Zea mays
  misc_feature (9)..(9): n is a, c, g, or t
cgggcttanagtttggggacctcactgcaattccattccatcgccccggcctccattcccatcccattccccactctactcattcagcagatcccgtcactcgctctccacaagcagagcaccgcagcagaacgaggaaggatgctggccatcttccagaagcaggtggcgcacgcgccgcaggagctcaacagcccccgcgccggcgcgtcgcccagcaagccccggaaccccgacgagatcctgcgcgacttccacgccgcgcacccggccgccgccttctccgcctccttcggcggcggcgccgcgctcgcctgcgtcggcccctcctcctccgccaccgccaccggcaccgccacctaccagcggatgttctgcggcctggaccacatctactgcgtcttcctgggccgcctcgacaacctcagcggcctcatccgccagtacggcctgtgcggccgctccaccaacgaggcgatgctggtcatcgaggcctaccgcacgctgcgcgaccgcgggccctacccggccgaccaggtcgtcaaggacctcgccggcgccttcgccttcgtcgtcttcgacagccgctccggcgccgtcttcgccgccctcggcgccgccgacgccgggggagcgccggtgccgctgtactggggcgtcgcggccgacgggtccgcggtgatcagcgacgaccgggacctggtcaagcgcggctgcggcaagtcctacgcgcccttccccgcgggctgcatgttccacagcgacggagggctcaagagcttcgagcaccccatgaacaggctcaaggccatgccgcgcgtcgacagcgagggcgccatgtgcggcgccaccttcaaggtcgacaccttcaccaagatcaactccatgccccgtgttggcagcgccgccaactgggccgcctgggacgaagccatctagtagatctagccttgccatgtacactgcgctgcctgcaacccgttcgccggtgcccctgcccctgcccgtggtcttttatcatccttccaaccacgagactttgcttctaaaccagaggctccatctgtgtgccgccttgttttactagaaatctttttttttatcctttttcacttttcctgcctagtttttccccttatcctggcattgtacaaataatttctccagtgcttgtagcttgtggacttgggttgtccaacatgtcatgaatacaaactgagtttgcttcaaaaaaaaaaaaaaaaaagacgaccgcggccgatctaggtaccc

SEQ ID NO: 1649 - DNA, 1102 bp, Zea mays
  misc_feature (935)..(935): n is a, c, g, or t
  misc_feature (978)..(978): n is a, c, g, or t
aaaaaaattccattccatcgcgttggagtccattcccatcccattccccactctactcattcagcagatcccgtcactcgctctccacaagcagagcaccgcagcagaacgaggaaggatgctggccatcttccagaagcaggtggcgcacgcgccgcaggagctcaacagcccccgcgccggcgcgtcgcccagcaagccccggaaccccgacgagatcctgcgcgacttccacgccgcgcacccggccgccgccttctccgcctccttcggcggcggcgccgcgctcgcctgcgtcggcccctcctcctccgccaccgccacctaccagcggatgttctgcggcctggaccacatctactgcgtcttcctgggccgcctcgacaacctcagcggcctcatccgccagtacggcctgtgcggccgctccaccaacgaggcgatgctggtcatcgaggcctaccgcacgctgcgcgaccgcgggccctacccggccgaccaggtcgtcaaggacctcgccggcgccttcgccttcgtcgtcttcgacagccgctccggcgccgtcttcgccgccctcggcgccgccgacgccgggggagcgccggtgccgctgtactggggcgtcgcggccgacgggtccgcggtgatcagcgacgaccgggacctggtcaagcgcggctgcggcaagtcctacgcgcccttccccgcgggctgcatgttccacagcgacggagggctcaagagcttcgagcaccccatgaacaggctcaaggccatgccgcgcgtcgacagcgagggcgccatgtgcggcgccaccttcaaggtcgacaccttcaccaagatcaactccatgccccgtgttggcagcgccgccaactgtgccgcctgggacgaagccatctagtagatctagccttgcatgtacactgcgctgnctgcacccgttcgcggtgccctgccctgccgtgtctttatatnctgcaccacagacttgctctaacagagctcatctgggccgctgttctaaattttttatctttacttctgcagtatcctatctgatgcaatatttcatgtgactggctggtgcactgttatcact

SEQ ID NO: 1650 - DNA, 1204 bp, Zea mays
gcacgaggatcccattccccgctctactcattcagatctcgtcacaagcagagcaccgcagaacgaggaaggatgctggcccgcctccaggagcaggtggcgcacgcgccgcaggagctcaacagcccccgcgccggcgcgtcgcccagcaagccccggaaccccgacgagagcctgcgcgacttccacgccgcgcacccggccgccgccttctccgcctccttcggcggcggcgccgcgctcgcctgcgtcggcccctcctcctccgccaccgccaccgccaccggcacctaccagcggatgttctgcggcctggaccacatctactgcgtcttcctcggccgcctcgacaacctcagcggcctcatccgccagtacggcctgtgcggccgctccaccaacgaggcgatgctggtcatcgaggcctaccgcacgctgcgcgaccgcgggccctacccggccgaccaggtcgtcaaggacctcgccggcgccttcgccttcgtcgtcttcgacagccgctccggcgccgtcttcgccgccctcggcgccgccgacgccgggggagtgccggtgccggtgccgctctactggggcgtcgcggccgacggctccgccgtgatcagcgacgaccgggacctggtcaagcgcggctgcggcaagtcctacgcgcccttccccgcgggatgcatgttccacagcgacggagggctcaagagcttcgagcaccccatgaacaggctcaaggccatgccgcgcgtcgacagcgaaggcgccatgtgcggcgccaccttcaaggtcgacaccttcaccaagatcaactccatgccccgtgttggcagcgccgccaactgggccgcctgggacgaagccatatagtagatctagccatgccatgtccactgcgctgcctgcaacccgttcgccggtgcccctgcccgtggtctttatcatcttaccaaccacgagactttgcttctaaaccagaggctccatctgtgtgccgccttgttttactagaattccttttttttattttgtcctttttcacttttcctgcctagtttttatccttatcctggcattgtacaaataatttctccagtgcttgtagcttgtggacttgggttgtccaacatgtcatgaatacaaactgagtttgcttcaaaaaaaaaaaaaaaaaaggggcggccgggcccggtaccca

SEQ ID NO: 1651 - DNA, 1730 bp, Zea mays
aaaaaaaacatttctcgaaccatataaatccagaaaccacccccgtgatttcgaaaatccaatctcgagctccctttccctctccactgcgactgcagcgtgctcctgtcctcgattctcgaagcctgtatccgtctgtcgagccatggcgaagggaagggcacacccgtcgaagcgacccacccaccaacttatcctcgcggctgtcctatccgtttccgttctcctcccgctgctcgtgccggcggcggcaactgtggctgtggcggtggcggaggggggcgggaagcagttggcggtcgggaaggacgagggaaaactggtcgcggagggggatgctggtggaggcgggttagtggaggagaatgagttcgcgggtggcttcggctccctcgacagcatgctgcagtgggcgatcggaaattctgatccggagaagctgaaagagggggcggttgatgtgcagaagttatctgcagatgaactgctcgagcggcgtcaggagattaaggagttgatggagaagttaaagatgccatcagacgctgacttaatgaaaatcgcaattgatgacttaaataattcttccatttcactggaggatcgccaacgcgcactgcaggaacttttagttcttgttgagcccattgacaatgctaatgatcttgaaaaacttggagggctccttcctgtgattcaagagcttaataatgcaaatgaagaaatacggaccacctctgcatgggtccttggtacagccagtcagaataatgaacttgtacaaaaccagatccttggttatggagctttggcgaggttggtgaagatgggttattccacatctacagaagaagctgcaaaagcattgtatgctatatcatctttgatcagaaataatgtaaatggtcaagaagcattccattcagaaaatgggagtgcaatgttgcagcacatattggtcagcaacaatattgatgttaggctacagaagaaggcagtgtttttagtaacagatttggcagactttcagctaaattccggaatcgcgcaacttcctttcttgagtgaccgtctttttctgaagtcaatagtcgatatgttatcaaggtttgacctagaccttcatgaaaaagtattattggccatcaagagtctgctgaaactttcctcaactgatgtggaggattttgagttctatgatctcgatagtgtactgctcagactaggggtacagttggaggacttgacaccagaggatcaaaaggagttcgctgtggaggttgatgccctccggagagaagttcaaacactcttccaacagaagctcaagcagggtaaagcgacctcgacatgatgttcggatgaccaccagaagatttgcccgtctagatggaagtagaatggatcagcttttgcgggatgctacagctagatggcggacttgggttttcttcttgcagtattcgagaaccatcagtcggaggggtcgggtggatgcacttcggcaaggtacatgatggcatgataggttaggaagtaaggcacgtgcttatgactccattttggcaaaactatatgattctcgcaacgttctgtgatatcggcactgcaacgaaggattttttccccttgttccgttgcagctgtagcttcattttgagaatgattgaacttgatgttgatcagatcatttgcgagggagctaaattgagaatcgctgtctgcctatc

SEQ ID NO: 1652 - DNA, 2953 bp, Zea mays
  misc_feature (10)..(10): n is a, c, g, or t
  misc_feature (22)..(22): n is a, c, g, or t
  misc_feature (25)..(28): n is a, c, g, or t
  misc_feature (34)..(38): n is a, c, g, or t
  misc_feature (46)..(47): n is a, c, g, or t
  misc_feature (76)..(76): n is a, c, g, or t
  misc_feature (78)..(78): n is a, c, g, or t
  misc_feature (100)..(100): n is a, c, g, or t
  misc_feature (102)..(102): n is a, c, g, or t
  misc_feature (104)..(105): n is a, c, g, or t
  misc_feature (135)..(135): n is a, c, g, or t
  misc_feature (138)..(138): n is a, c, g, or t
  misc_feature (141)..(141): n is a, c, g, or t
aagaagacancggcgggccccnccnnnnaggggnnnnngggggtgnncccaaagtggaggttccttggaggaggangnggcttcataacgggcccccggncngnnggtatcaaacaacgcggttaccgggaacanccnaancgaaaagaggctaaacccccgtctaaccctgctgccgtgccgcttgccactactccgcttcgttctccgccgcctccccggacgtccggaaacttctagattgaagggggatagccattggcgtcaacgtgtgtgatggaggtcaggggactggggcagctcctggcggcgctggccgcggcgttcttcgtccgcgccatcgcgggacccggccccgccctccttccgccggcggaggacacggaggccgacgaggccgacgcggaggctggcgagggaggtggtggtggtgtgccgcccgtgaccatccggtgggctcgcatcacctgcgcactgaagaacaagcgcggggaagtggcaaggtttctgttgtcaaatgtgtcaggggaggcgaaaccggggaggctgcttgcactaatggggccatcgggctctggcaaaacaactttgctcaatgtgctagcagggcagctcgccgcatcgtcttccttgcacctttccgggtttctgtatatcaatggtcggcctatctcgaagggcggatataagattgcttttgtcaggcaggaagacctgttcttctcacagctcactgtgcgggagacgctctcacttgctgctgagctccagcttcctgacttgtgggctcctgagagaaaggagagctatgtcaatgatcttttgttacgtatggggttggtcaattgtgctgattctattgttggtgatgcaaaagttcgtggaataagtgggggtgagaagaagcgcctctcacttgcatgtgagttgattgctagcccttcagtcatctttgcagacgaaccaacaacaggccttgatgccttccaagctgagaaggtcatggagactcttcgtcaacttgctcaggatgggcacactgttatctgttcgatacaccagccaagaggttcagtctatggcaaatttgatgacatcgtactactgtcagatggagaaactgtatacatgggacctgcaaaagaagaacctctaacatacttctcatcattagggtaccagtgtccagatcatatgaaccctgccgagttcttggctgatctcatttccattgattatggctcaactgaaagtgtacagtcatcacagaaaaggatcgagaatctcattgaggcgttttctaacaaatctgtggtcactgaaggtaacaatttaattgcaattccagaggatcctgaattgtctgccaaacttgttcggaagactacagtgaagaaaagacatggttggtggaggcaatttcgtttgctttttaagcgagcatggatgcaggcttttcgtgatggaccaacaaacaaagtgagatcacgaatgtctgttgcttcagcagttatatttggatctgtgttttggcgaatgggaaaatctcaaacatccatacaagacaggatgggactacttcaggtggctgccataaacacagcaatggctgcattgacaaagactgtgggagttttcccaaaagaacggagtatagttgacagagaacgagcaaaaggttcctatgcacttggaccatatctttcatctaagttgttggctgagattcccattggagcagcatttccattgatatttggatcaattctctatccaatggctaaacttcacccaacattttctagatttgccaaattctgtggtattgtgactgttgagtcatttgctgcatcagcaatgggtctcactgttggagcaatggctcctacaactgaagctgcaatggctcttgggccatcccttatgacagtgtttattgtatttggaggatactatgttaaccctgacaatactccagtcatatttcgttggatcccaagaatatctctcattagatgggcctttcaagggctttgcattaacgagttcaagggtctgcaatttgagcaacaacattcatatgacattcaaacgggtgaacaggccttggaaaggttttcattgggaggaattcgaattgcagatactctggttgcacagggtaggattctgatgttctggtactggtcaacctaccttcttctgtagaaaaacagaccgaagtatcagcagctccttccaccattggaacaagataaaaataagccgcaggtggaataagcttttcatttgcagacttcgaaagaataaattaagtatatctggagtcaaagcgaggccgcgttttctgcataatatctggttatgggagaccccagcattatggacgagccgaggcagtatacgatccgccgcccagaagttttcttttttattttttagatcctactagttgtgaagtcagctcaatgattgcctggggctgtgggctgtggccatgccgctgcaaataaactatctccaaatcgccgtccaaagtacgaccactggcagagtgccagtagtactagtttcttatggttttctctctgtacgtgccagtagtactagtttcttaatcacgggtgtagtgcctataaacgcgtgcccatttcggctcaaaattctcatcagcctccattggattaaaaaaaactttcaaccaatcgacagggtggtcgtgcagtgttctctttcttgcctgagatacgaagatcagcccctgagccgatcccatggctgcttcttccctctcccgtccagcaacgccggccgcgctccggcacggggcgtgccacgggctggggctggcgctaccgaggagtttgccgctgtcggcggcaacgcgatgcgccgcgctacgccgggacgcgagcggcggccgggaccagtacggaggcgcgctggggacgag

SEQ ID NO: 1653 - DNA, 1030 bp, Zea mays
ctgcttatccccttcgccgcggcgcccgccagcaatagcgcccgctcgcccatcagcccacgcggccacgccgaagtatggcgctctccgtctcctccctcgccgccgccctctcccacctctccctcccatcgacctccacccccaagcctcacccggccccgctcctgcgcctgcgctccacctaccgccgcgctgttagcctcgcgctccgcgcctccgcagccgaagccgccgaatcgttcgaggcggacctgcccgccgaggaggtgatggctgtcgaggaggaggcggaggaggatgcgctgtcgggaatcgcgctgcgaaagtatgtgaagcagcggctgccgggcgggttcgcggcgcagcggatcaccgccacgggccgtcgcaagacggccatcgcccgcgtcgtgctccaggagggcaccggcaaggtcttcatcaacttccgcgacgctaaggagtatctgcagggaaatccaatgtggatggagtactgcaaggtacccttgatgactctagggtttgagaagaactatgacgtctttgtgaaagtacacgggggtggtctctcaggccaggcccaggcaatttgccttggtgttgcccgtgcgctggtgaagatcagcaatgccaacagggttcctctgaagtcggaaggtttgctgacaagggacacccgtatcgttgaaaggaagaaggctggtctcaagaaggcacgcaagcggccccagttctcaaagcgttgaggacgttcacttgttgcattgccacttccagaggcccctttttttttctgtcaactgctgtgcaaaatctgtaatggacacgatatatctgtagtgttattttcctgaagcaaatttcatgaggtggctatctgattctgctggtcaagtgtattctgcattggactaacttatggccctgtttagcacaacttatttcacaacttttgaaaagatttaagcagaagttggttggttttaactgctaaaaaaagaaaaaaaaaaaaaaaaaagcggcc

SEQ ID NO: 1654 - DNA, 979 bp, Zea mays
gccggccgggttcgggtcggtcccccccgggcccggccgggatagcgcccgctcgcccatcagcccacgcggccacgccgaagcatggcgctctccgtctcctccctcgccgccgccctctcccacctctccctcccatcgacctccacccccaagcctcacccggccccgctcctgcgcctgcgctccacctaccgccgcgctgttagcctcgcgctccgcgcctccgccgccgaatcgttcgaggcggacctgcccgcggaggaggtgatggctgtcgaggaggaggcggaggaggatgcgctgtcgggaatcgcgctgcgaaagtatgtgaagcagcggctgccgggcgggttcgcggcgcagcggatcaccgccacgggccgtcgcaagactgccatcgcccgcgtcgtgctccaggagggcaccggcaaggtcttcatcaacttccgcgacgctaaggagtatctgcagggaaatccaatgtggatggagtactgcaaggtgcccttgatgactctagggtttgagaacaactatgacgtctttgtgaaagtacacgggggtggtctctcaggccaggcccaggccatttgccttggtgttgcccgtgcgctggtgaagatcagcaatgccaacagggttcctctgaagtcggaaggtttgctgacaagggacacccgtatcgttgaaaggaagaaggctggtctcaagaaggcacgcaagcggccccagttctcaaagcgttgaggatgttcacttgttgcattgccacttccagaggccctttttttatgtcaactgctgtgcaaaatctgtaatggacgcgatatatctgtagtattcttttcctgaagcaaatttcatgaggtggctatctgattctgctggttaagtgtattctgcattggacgaacttatggccttatggccctgtttagcacaacttatttcacaactttttaaaagatttaaccgg

SEQ ID NO: 1655 - DNA, 1934 bp, Zea mays
  misc_feature (1893)..(1893): n is a, c, g, or t
cttcttcccctcctcctccacacgtccaaaggccgggtccttcccacttcctacccatcatatctccatccgcggttccgcccagctgctccacatctcaattctcaccacacacacgcacacacactatcgtccagcaagctcgctgttgcttgccacccaccgcctcagctcgatcgcaacgcgcttggcatggcgtccgaggtgtggctatcgccggcgtctcgcctcccatccctctccaacgcaccacctcgcttacgctccaagcctgccaccacaaccgcctctttgctctctccctgtccccgccctgcccgcgccctgcctgtgctgcgtgtccgtcgccgccgccgacttcgcgccaccgagcagcaaggccaggttcaggagcaagatgacgaggtggtggacaggaacatcctcccctactgcagcatcgacaggaagcagaagaagacgctgggagagatggagcaggagttcctgcaagccctccaggccttctactatgaccagaaggccatcatgtccaacgaggagttcgacaacctcaaggaggagctcatgtgggaggggagcagcgtcgtcatgctaaacgaagatgagcaaaagcttttggaagcttccttggcctatacctccggcaacccaatcatgtctgatgctgagttcgacgaactgaaacttaaattaaagacagacggcagtgtcattgtgaaggagggtcccaggtgcagtctaaggactcataaggtgtacagtgacttgaatgttgactacctaaagatgttcctcctaaatgttccagccaccaccgtagctctgggactgttctttttcattgatgaattgactggttttgagatcaatgtgttccagctgccagagcctttcggattcattttcacatggtttgctgctttgcccctaatattgttcttagcgcagtcattgactaaggctatagtccaggattttttaatccttaaggggccatgtcctaattgtggtactgaaaacctttccttctttgggactatactgtcagtctccagtggcggtacaacaaacaaagtgaaatgtgcaaattgcagtaccgagctggaatatgactcaaaatctcgggtgatcacacttccagaagcatcaaatgcataaacataggtgactctacatttacgccagtaactataaatggatgctctttggtctatattccaaatgtgggagacatcacaccagctttgaagtattgcccgtctccattgtgaacactctgcagcatatgtagcagataaatgagtgaaactatttgtactgcctgctctgcaaattagtatgaacacccctcaaaaagatttggcccacactctggtctctctgtttgcagctgggaacagggagctccagagcttgtgaattctatagaataaaggtggctgtccgcacagtatagcaaactgcgaagcctgcaactactagagtttggtctgtagcaggctcagttgggaatgtgtagcagagcatgatccatggtgtggatgaattgcagagtactgtgctgtgtgtgtaggaaggaaaagctgccgcctgccgattgtgcagtcagtccagtacgttggtatgcgaccatctcaagtctgggctttgattttaagcaatgatttttggcaatgaatgaacaagctatctactgtacactgtttttgtacaattatgtttgtaaggcccaagtctattgaacggccacggccaggctgactgatgacctcaagcccggcccacggcccaaactcaaaaggagtaaccttagtagcgcgatgcttagatattctgagcctgtaaggccccatacaaaactttgtgccaatgcccaggattatcatatanttttcttcttaaaaaaagaaaaaaaaaaaaaaaaagcggcc

SEQ ID NO: 1656 - DNA, 863 bp, Zea mays
taccctccgggttcgccgggcctcccgcggggccgcccggatgttccagccaccaccgttgctctggggactgttctttttcattgatgaattgactggttttgagatcaatgtgttccagctgccagagcctttcggattcattttcacatggtttgctgctttgcccctaatattgttcttagcgcagtcattgactaaggctatagtccaggattttttaatccttaaggggccatgtcctaattgtggtactgaaaacctttccttctttgggactatactgtcagtctccagtggcggtacaacaaacaaagtgaaatgtgcaaattgcagtaccgagctggaatatgactcaaaatctcgggtgatcacacttccagaagcatcaaatgcataaacataggtgactctacatttacgccagtaactataaatggatgctctttggtctatattccaaatgtgggagatatcacaccagctttgaagtattgcccgtctccattgtgaacactctgcagcatatgtagcagataaatgagtgaaactatttgtactgcctgctctgcaaattagtatgaacacccctcaaaaagatttggcccacactctggtctctctgtttgcagctgggtatgaaaaaaatgcacaatcttataccattgatgtttagctgttgctttgtagtcaatccagtaaataggctgtgggcatgtacaaatagagttacctgttaatttgttgttcctaaaatgtatgatacatagactgcatttcagttgggacatataacaccaaagcaattacaatgaagtgtctgttatatacaaaaaaaaaagggcggccgccaccgcggtgga

SEQ ID NO: 1657 - DNA, 1494 bp, Zea mays
agtaagcccaccccaaacccatcatatctccatcccgcggttccgcccagctgctccacatctgaattctcaccacacacacgcacacactatcgccacccaccgcctcagctcgatcgcaacgcgcttggcatggcgtccgagcctccgaggtgtggctatcgccggcgtctcgcctcccatccctctccaacgcaccacctcgcttccgctccaagcctgccactacaaccgcctccttgctctctccctgcccccgcccccgccctgcccgcgccctgcctgtgttgcgcgtccgccgccgccgccgacttcgtgccaccgagcagcaaggttcaggagcaagatgacgaggtggtggacaggaacatcctcccctactgcagcatcgacaggaagcagaagaagacgctgggagagatggagcaggagttcctgcaagccctccaggccttctactatgaccagaaggccatcatgtccaacgaggagtttgacaacctcaaggaggagctcatgtgggaggggagcagcgtcgtcatgctaaacgaagatgagcaaaagcttttggaagcttccatggcctatgcctccggcaacccgatcatgtctgatgctgagttcgacgagttgaaactcaaattaaagacagacggcagtgtcattgtgaaggagggtcccaggtgcagtctaaggactcataaggtgtacagtgacttgaatgttgactacctaaagatgttcctcctaaatgttccagccaccaccgtagctctgggactgttctttttcattgatgaattgactggttttgagatcaatgtattccagctgccagagcctttcggattcattttcacatggtttgctgctttgcccctaatattgttcttagcgcagtcattgactaaggctatagtccaggattttttaatccttaaggggccatgtcctaattgtggtactgaaaacctttccttctttgggactatactgtcagtctccagtggcggtacaacaaacaaagtgaaatgtgcaaattgcagtaccgagctggaatatgactcaaaatctcgggtgatcacacttccagaagcatcaaatgcataaacataggaacagggagctccagagcttgtgaattctatagaataaaggtggctgtccgcacagtatagcaaactgcgaagcctgcaactactagagtttggtctgtagcaggctcagttgggaatgtgtagcagagcatgccccggggtgatccatggtgtgggtgaattgcagagtactgtgctgtgtgtgtaggaaggaaaagctgccgcctgccgattgtgcagtcagtctagtacgttggtatgcgaccatctcaagtctgggctttgattttaagcaatgatttttggcaatgaatgaacaagctatctactgtaaaaaaaaaaaaaaaaaaaaaaagaaaaaaaaaaaaaaagggcggcggctcgcgcccaccgtccg

SEQ ID NO: 1658 - DNA, 1357 bp, Zea mays
gactcatgacctaatcaccaagatccaatccctcccccttcgagcaagaacaggcgacaaggctggacctgctgccaattcacaagtgcagcagcagaagcttgtcgttgcacaatggctactactgctgctgcagcccccgacctctcgctgcatatcagccctccctcgccgcccgatgatgctaggagcagtgacatgctcttctccaagcagacgctgtgcctcggactcgttcagacgacgacggcggcggcagcgcatgatcaggatggccaatgcgacgacgtccagcagcagcagcggctgcaccagcctagccagatccagaggttcaagaaaacctcgtcatcgtccgcgtcgttgttatctgccggaggaggcacgacgagatctgggaacggcaacagcgggggcgggaagaggagctccagagcgccgaggatgaggtggaccacggctcttcatgcacacttcgtccatgccgtagagctccttggcggccatgagagtacgctctcgtcgacacgacgtccttgttgcttgccttccatatatacattctcacccatgttctgttcaattgttagtcaatcgattaattgtgcttcagttcgttggtcctacgcttttgccgttaatatataacgacatgatgatccggtttcttgtgcatatatagctcatatagtggggaaatattgttaccttgcattgcttttgtttgtttttcttgctttccacttaattaaattgtagcgtttgcacacacttcactgaactgccagtctcgaggtttcagtttcattttttgttacaaattcagaattattgtacctttctttctaggagcaacgccaaagtcagtgctggagctgatgaacgttaaggacctcacattggctcatgttaagagccacttgcaggcaagttacaagaacctcaatatacaatttctctctctctctctctctctctctctctctccagtagattttggtactcaatagtatttcccatgtcgagactcaagaaccaaacaaaaagatatcacagtttgacgatctcttgagcagcccccattcacctttctcttcttggcattgcttgtagttgtcgccaaatacttgtctcttccatccgaatcatcatttaaccagtactatatatatatcaaccacaacgaactaatgtttcctttccttagcgcgttgcaagagtaaaccaattaattaaatggcagcacacaaggatcagtctaatcttttgcatggcgtccttttcttatctgctttacttgttgatgcagatgtatcgaacagtgaagggaacgacggcagacagatcatgtgctgca

SEQ ID NO: 1659 - DNA, 1034 bp, Zea mays
atcatcagtagctagctgttcgaagctttcagccgatcgagcaccatcgtcacagtcagtagtagccaagcatatttctttctccgagtgatttgcgctgagcgatcagttcatccagagcgagcggagctgagctgagctgagcgagcttgcgttgcttgagagaccctgctgccatggcttcccaccaggacaaggctagctaccaggccggcgagaccaaggcccgcaccgaggagaagaccgggcaggcggtgggggcgaccaaggacacggcgcagcacgccaaggaccgggcggcggacgcggcggggcacgcggcgggcaagggccaggacgccaaggaggccaccaagcagaaggcgtccgacaccggcagctacctgggcaagaagaccgacgaggccaagcacaaggccggcgagacgacggaggccaccaagcagaaggccggcgagacgacggaggccgccaagcagaaggcagccgacgccatggaggccgccaagcagaaggccgccgaggccgggcagtacgccaaggacaccgctgtctccggcaaggacaagtccggcggcgtcatccagcaggccactgagcaggtgaagagcgcggcggcgggcgccaaggacgcggtgatgagcacgctggggatgggcggggacgacaagcagggcgacgccaacaccaacaaggactcctctaccatcaccagggatcactagacgcgtgtatgcacacgcacttggtccgatcctgtcgtccgtgaccctgtttgcttgttcgcgagtccagtatgggtttgtgcacgttttcagtgtcatggtttccttctctacgaaatttggtgttgtaagtttgattcgcaggtacgttgctgtgttttttctgcgtcatcatgtctgtaaacgagtcgggcgggtttgagtgtcctttgttgtgataataaagttggtaaatcgtaattaatatatagcatgcgactgtcttgctaaaaaaaaaaaaaaaaaaaaaaaaaaaaaaaaaaaaaaaaa

SEQ ID NO: 1660 - DNA, 1028 bp, Zea mays
  misc_feature (759)..(759): n is a, c, g, or t
atcagtagctagctgttcgaagctttcagccgagcaccatcgtcacagtcagtagtagctaagcatatttctttctccgagtgatttgcgctgagcgatcagttcatccagagcgagcggagctgagctgagctgagcgagcttgcgtcgttgcttgagagaccctgccatggcttcccaccaggacaaggctagctaccaggccggcgaaaccaaggcccgcaccgaggagaagaccgggcaggcggtgggggcgaccaaggacacggcgcagcacgccaaggaccgggcggcggacgcggcggggcacgcggcgggcaagggccaggacgccaaggaggccaccaagcagaaggcgtccgacaccggcagctacctgggcaagaagaccgacgaggccaagcacaaggccggcgagacgacggaggccaccaagcagaaggccggcgagacgacggaggcgaccaagcagaaggccggcgagacgacggaggccgccaggcagaaggcagccgacgccatggaggcagccaagcagaaggccgccgaggccgggcagtacgccaaggacaccgccgtctccggcaaggacaagtccggcggcgtcatccagcaggccactgagcaggtgaagagcgcggcggcgggcgccaaggacgcggtgatgagcacgctggggatgggcggggacgacaagcagggcgacgccaacaccaacaccaacactaacaccaacaccaacaccaacaaggacacctntaccatcaccagggatcactagacgcatgtatgcacacgcacttggtccgatcctgtcgtccgtgaccctgtttgcttgtttcgcgagtccagtatgggttttgtgcatgtttttcagtgtcatggttttccttttctacgaatttggtgttgtaattttgatttgcaggtacgttgctgtgttttttctgcgtcatcaagtgtctgtaaacgagtcgggcgggtttgagtgtcctttgttgtgataataaagttggtaaatcgtaatt

SEQ ID NO: 1661 - DNA, 1064 bp, Zea mays
aattcggcacggctgttcgaagctttcagccgagcaccatcgtcacagtcagtagccaagcatatttctttctccgagtgatttgcgctgagcgatcagttcatccagagcgagcggagctgagctgagctgagctgagcgagcttgcgttgcttgagagaccctgctgccatggcttcccaccaggacaaggctagctaccaggccggcgagaccaaggcccgcaccgaggagaagaccgggcaggcggtgggggcgaccaaggacacggcgcagcacgccaaggaccgggcggcggacgcggcggggcacgcggcgggcaagggccaggacgccaaggaggccaccaagcagaaggcgtccgacaccggcggctacctgggaaagaagaccgacgaggccaagcacaaggccggcgagacgacggaggccaccaagcagaaggccagcgagacgacggaggcgaccaagcagaaggccggcgagacgacggaggccgccaggcagaaggcagccgacgccatggaggcagccaagcagaaggccgccgaggccgggcagtacgccaaggacaccgccgtctccggcaaggacaagtccagcggcgtcatccagcaggccactgagcaggtgaagagcgcggcggcgggcgccaaggacgcggtgatgagcacgctggggatgggcggggacgacaagcagggcgacgccaacaccaacaccaacaaggactcctctaccatcaccagggatcactagacgcgtgtatgcacacgcacttggtccgatcctgtcgtccgtgaccctgtttgcttgttcgcgagtccagtatgggtttgtgcatgttttcagtgtcatggtttccttttctacgaatttggcgttgtaagttcgattcgcaggtacgttgctgtgttttttttctgcgccatcaggtgtctgtaaacgagtcgggcgggtttgagtgtcctttgttgtgataataaagttggtaaatcgtaattaatatatagcatgcgactgtcttgctatggcctagtatgtgtttggtagttttcataaaa

SEQ ID NO: 1662 - DNA, 1108 bp, Zea mays
atcagtagctagctgttcgaagctttcagccgagcaccatcgtcacagtcagtagtagctaagcatatttctttctccgagtgatttgcgctgagcgatcagttcatccagagcgagcggagctgagctgagctgagcgagcttgcgtcgttgcttgagagaccctgccatggcttcccaccaggacaaggctagctaccaggccggcgaaaccaaggcccgcaccgaggagaagaccgggcaggcggtgggggcgaccaaggacacggcgcagcacgccaaggaccgggcggcggacgcggcggggcacgcggcgggcaagggccaggacgccaaggaggccaccaagcagaaggcgtccgacaccggcagctacctgggcaagaagaccgacgaggccaagcacaaggccggcgagacgacggaggccaccaagcacaaggccggcgagacgacggaggccgccaagcagaaggccggcgagacgacggaggccgccaagcagaaggccggcgagacgacggagacgaccaagcagaaggccggcgagacgacggaggccgccaggcagaaggcagccgacgccatggaggccgccaagcagaaggccgccgaggccgggcagtacgccaaggacaccgccgtctccggcaaggacaagtccggcggcgtcatccagcaggccactgagcaggtgaagagcgcggcggcggggcgcaaggacgcggtgatgagcacgctggggatgggcggggacaacaagcagggcgacgccaacaccaacaccaacaccaacaccaccaaggactcctctaccatcaccagggatcactagacgcgtgtatgcacacgcagcacttggtccgatcctgtcgtccgtgaccctgtttgcttgttcgcgagtccagtatgggtttgtgcatgttttcagtgtcatggtttccttttctacgaatttggtgttgtaattttgatttgcaggtacgttgctgtgttttttctgcgtcatcaagtgtctgtaaacgagtcgggcgggtttgagtgtcctttgttgtgataataaagttggtaaatcctaattaatatatagcatgcgactgtcttgcta

SEQ ID NO: 1663 - DNA, 1815 bp, Zea mays
aaatctgcttcaagctcgaatccgagagatccgacggccttgtttcttttgcgatgtctgtctatctatgacacacgtacgatgtgtaggagaagaccgggcaggcggtgggggcgaccaaggacacggcgcagcacgccaaggaccgggcggcggacgcggcggggcacgcggcgggcaagggccaggacgccaaggaggccaccaagcagaaggcgtccgacaccggcagctacctgggcaagaagaccgacgaggccaagcacaaggccggcgagacgacggaggccaccaagcagaaggccggcgagacgacggaggccgccaagcagaaggcagccgacgccatggaggccgccaagcagaaggccgccgaggccgggcagtacgccaaggacaccgctgtctccggcaaggacaagtccggcggcgtcatccagcaggtacgtatttgtggttgtggctggctggtcgaccagtcactcaaacctattccacgcacgtgcctacggattggaccccacagcgtgcaggtcgctcatgacagctttccgattctctgcttgcgtgcttggatctcggttccaggccactgagcaggtgaagagcgcggcggcgggcgccaaggacgcggtgatgagcacgctggggatgggcggggacgacaagcagggcgacgccaacaccaacaccaacaaggactcctctaccatcaccagggatcactagacgcgtgtatgcacacgcacttggtccgatcctgtcgtccgtgaccctgtttgcttgttcgcgagtccagtatgggtttgtgcatgttttcagtgtcatggtttccttctctacgaatttggcgttgtaagtttgattcgcaggtacgttgctgtgttttttctgcgtcatcaagtgtctgtaaacgagtcgggcgggtttgagtgtcctttgttgtgataataaagttggtaaatcctaattaatatatagcatgcgactgtcttgctatggcctagtatgtgtgttttgtagttttcatcagtgtgtgttgtgttagatataatcttaactttcgaagacaagtacgggacccaaaaaaaatgcttagtgaacaagaatgatgtgtatgcagtttacactctggaaagctactcacaaatgatactatgatgttgggaaaatcaatagcatctcaaacgtacctagtcagaggccgacatttgggccccgaaagaccaaaaagaaaatgggactcgaaatctgcgagctcttaaatctggcgttaatgcaacagaaccaggggaaaaaaaacggaggaacaaaaatattccaacgtgagataaaaaacaaactaaaaaattgtaggctatggtccatgcatcttgcaaaacagttcgctatattcattgcaagtttgctggatgcagtagttcagaaacatggttctgttgtaggctttgcatacgtccatttgccaatgggctcatgagcttacagttacaggaaatgtagccaagatttcttcttgtctgtgagatgcttgagtggcctaacctgtcataaaggctaaagcgccgatgcaatctgaaataatcggttgctaattcaatatgagtaagtaacttaaccctgatcaagttgtttcagtaattagctacaaaacccaatcactgtttataattctggtaagatctaaaaacaacttccaatctttcattcagtttttcagtaatgccacatacatgtgcacgtccattggttttggcattaaataattgttgaactttatttgtggtactgagtacggttgagtacggttggacg

SEQ ID NO: 1664 - DNA, 987 bp, Zea mays
ttggcacgacgtggagaagccccgggaggtgtcctttcgggagcgtaggcagcaggaggagatggcggtagagctaagggcgcggaagagcacgcagtggaagggccagagggtggtgtgggactaccgcaaggccgagagggcactcgcgcagctggagaaccgggaggtggagccacaggcaccggagggggaggacaaggagaaaggggcagaggaggaagaggatgtgatcactgaagaggatttgcagcaaatactgtctaagttgcgtgatcagtaccagtattgcctttattgtggatgcaaatatgaatcactagaagtgctgtcaaaggaatgccctggtcctgatgaggatgaccattgatttgttgtgtgaaggtgacaaataattgtctttgatacaaacaggtgcttcgatgcttctagacttcccaagtcactaggatgattagggtattggtacccttcacattcttgagaagcttattgcagtgataaatatatcgatatgaaaattgaatagtatttgttcttcgtcggcctggaaaggtgggagtggatggaaagccacaaggagcgtctgcatatgacatgctatgcagcaaaactgaagtggagctacatcttcagaaatgcctcatcgaggcaccaatgcacttcagagccagaagtgaaatgttgccggtggtgaacaagcaaactttgattttgatctgtgataatcagataacaattttgtatctgctttccaactgagcgagagagggggctatacttgtggacatctgctcaattttgttgtcagaagagaagtaagtctattttatgaaacttccactgtacgatgttggaatggaatatctgtacattactgtcagtcctgtgtgtcgtctaaggatccatgattgctgaataaatgcctggaaagggccacgatcactggtgaacatcacaagaaggtcctcatctgtatgctctttg

SEQ ID NO: 1665 - DNA, 3572 bp, Zea mays
cagtaaatgaggttatgagaagtttctaaggacaactgtggtagttgtctaaaaatctatcggcgcaaactcttgaaatataatgtgtgtttgtgaatataggtatgtatttgtcattttctctattttataaagcattacttttcacagtttccaccttcatcacgccccctacatttaaatagtagaaaatctaaaattatatacaattaaggattcaaaccatgattgttggctctaagcccgtattcacatccacctaaccaacaaaatatacatacatttgtgttttatatttcatactcaaacataaatagaaatcatagcaacgtacatacactttgctagtgtttttaaataaactgaaaaaactttaggtcatgtttgttttcttttagaattatataatacaacttatggattatgtaaacacctaatgacctaattatagattattataatctagatatctagattatataagcaatctaataatttatgatgtttatttatcttttaacttatttaagttggattatataatttagaggttaaatacttcgtttacaatggaccgaattatctaccaagtagagagaaaaattcaaaagagagagaaaagcacccctatggttcaccgctccccctatttgacagctcgcgagtcgagtcagccggccgacgacagggagcctcgcctccggcgccgcggcggcgatcacccaattccacccccactgccttctcctatctccccacactaccgctctgtttcctccaccatccgcttgcgtccacgcgctctctcgttaagccatcgcttgcgtcaacggccgcgccctctagtcgttcgacgaaacgccaccgagccactgacgcgtccgctgcacgcgtagtcgcgcttccatcttgctccgccgccccgcagctcctagccggagggaggccaccgatccatgtctgtcgccaagcgctacgtgctgcgcctcttcatctcgctcaagtacgtgacggcgaacgtggtggaccggcagagcggtcgcatcgtgacgaccgcctcgaccgcggagcggcccctgcgagacgggctggagtgcggccgcgcctgcaacgcaaaggcggcggcagccgtcggcgaggtgctcgccatgcgcctcaaggtggacggcctcgcgcgggagcccatatacgccaacgcggagaaagaggtcgcgaagaaagggttcaagaaccagaccaaggtctgggccatcctcaatgcgttgcgcagtcacggggtcaacctccacatcgacgacgatggcgaccacaggccgcacgtctgaagcaaccataagttcaggagtttgctcctccaactaacaaaagtatgagctttgagcatgttgattgttgcgtgctgttttatgttgcttcagtaaccttgcccttgactctcattcaatgaacactatgactttctgtgtgtagcaatatcactgctggatctactactttgaggtcatataagtcatgtataaccctaggaccacgaatcgattttcaaagtataatatgatacaactctaagctcttagatcataagtatagttaagagacaatatatatagagaatcgtgtagagacaggttattggcgaagagctcatctttttgtatttttttcaaatagtcccatagagactcctcaagggactccataataattgagattgtacatgccctaacaattgtcacaaaaaggaggattgaaccagttattcacaaaaaatatcacgcaggataatttctctactgggaaggaaattgacgccccatggtgctttggtaaattggtagtgaaaagcggtgcacatgtttgatacatgcaaaagacctaatgcctgataacttttacctggtagcaaaacacaattaaattacagagcaccttcacaaaacatggtgctacggcagtaactaccaaattcctcacaaatagatttgctggcataattttactgaccaagtgcctttaggttcatgtatgctttgagctgattcaaagcactatccaacaaaaccttcttactgccattgataactctcactgactgtttgagctcgctcttggctgcaatcagctcgttttgcagccccttgatcttcatctcatccctgatcttctcgaggcccctgatcttctcctcgatgacatgtaggctctcatggtctggttgaactcctgatggtaccaaagcccagggcatgtcatcttgtaatggtggagcagagggcgtagggtgcccaccttgtgaactgcttccgagaaccaatatcattttctgcaagcaagtagaggtgtcagtttcagtattggaaaacattctgaatgaggaatcctggactgttagacatagttaactgttaagtatcgatgtctgtcatgcgtcttagtcaggtttcgacatggtgttgcagcctaacaccttctacttctgataatgtgctttgatttgtgccaaagcacgcttcttcttttcagcacactgtgcacggcatcgtccaatggatatcaaagtaatcatactgaaagatattcatctagaaaattgacatcatattgccattcattctactctattagcgtacagcaaatacctgtttatggtcctcaattggagcatccgggtacacaattttgacacttttcttcgtcttcctcttcagccagcggcaaatctctgttgagttcacctttccaaccaccgtgacaatcccgctattaacatcccccaccgaagtttcaactcctgtgatgtcacaaagaaaaatccttatcgttatttgcagaatatatatagcaagagagaaggggaaaaaatataggagatgaacagccggtaaagctgtaccaccgaaacttccaatggacaccatggccttctccaccttcctgacacagccaatgcagcggcagcgcatctcaacctggaacctgaatcgcctgggcgcctcctgtgaatggaagaaccaaatccatctgtcactcctggtgatggcgagaaaaggatctgcagaggaataagaaggcgaagccctcactgtccccatggtagaatcttgagctgcttctgtgacgctgtttgccggcggaagcgatcagagtctagaggctggatgtggcaaggcactctcgcttaaataggcctgactggtgcgtagttaatgggagggagcggagttccatgcagttttgtgaaacagaggagccaccggattgcatgcttgattgactgacctgatcgttcattcacagtttcacactagctgctgtttcattcagtcctttcctgttgcattttttttatcgagacgagcacggctaaacgtaatactaatacaatactcaaagtcgaaacccattaacccaatagagaagggtgccatagagaagatcgcaaaggggatttcgtgcagggtgggaggaagaagatgggtagaaaagtaaaaggctagaaggctgcgagtttgcctgaaaaagagcaagatcttgcgtagagccatatttaaggcacgtttggttcgttacct

SEQ ID NO: 1666 - DNA, 895 bp, Zea mays
atcggccgtatatggccttctacatcaaggccctcgcgcgtcgcgtccagatatctatctttgtggtcgtggtcctcccgtcgtcgtcgactcgtcgtcgtcggtgttgctccgatgggcaaggactcgaagccgaaggacgccaaggggaagggcaagcaggcggccggctcctctggcggcgacgacggcggcggcaagggaggcaagggcaagggcaagggcaagggcggcaagtccgctgacggactcggcacttgcacctacgtcaaagctaggcacgtattgtgtgagaagcaggggaagatcaatgaagcttataagaagttgcaggatggatggctgaataatggggacaaagttcctcctgctgagtttgctaaggtagcacaagagtattctgaatgcccatcagggaagaaaggtggagatcttggttggttcccgcgtggcaagatggctggtcctttccaggaggttgctttcaacacacctgagggaactgttagcgcaccattcaagtccacgcacgggtatcactttatcctctgcgaaggaaggaagaactgatctggaaatgtcggttggggagactgcatcatcaggttgtatgagacgcaatgcaaactactcaccttctctaataagcgctggacatgtgtactttgtgttgggctattcgcattctgttccaaacaagttgccaaaacaaaagaatgtgtgattcgctgtaattaacatattgtactgataatctgatatggcatacctatctgggtcagttaacaggtgggttttagcaaaaaaaaaaaaaaaaaaaaaaagggccaaaaccttccagggggggggcccggtacccattcgccctaaataggagtcgattacaattctcctg

SEQ ID NO: 1667 - DNA, 1915 bp, Zea mays
gcacgagaccattacctagaacatcctaatcgaaaaatctatctttgtggtcgtggtcctcccgtcgtcgtcgactcgtcgtcgtcggtgttgctccgatgggcaaggactcgaagccgaaggacgccaaggggaagggcaagcaggcggccggctcctctggcggcgacgacggcggcggcaagggaggcaagggcaagggcaagggcaagggcggcaagtccgctgacggactcggcacttgcacctacgtcaaagctaggcacgtattgtgtgagaagcaggggaagatcaatgaagcttataagaagttgcaggatggatggctgaataatggggacaaagttcctcctgctgagtttgctaaggtaaggacccgaatgacgggcagtcctccactcttctaggctcaaggatagttaggtttgcttagacgaaaagggtagtgatgcactatgcgcattgatactgacgagacttcatcgttttgcgactttgaaagttttatttacattttagtgacatttccccatcttctatttggccttgtagagaatgaataaaggctatataggttaagttactgatcttgtacttattcatgaggtacagtttgtggtctgcatcacgatcttcttgtactgatagtatcctttgattttgaatgagcttgatctttggttgcactttgatgatatcctgactgccattaatccatttgtttcatggcaagtgcagagaatggatgctgtgtatgggcagttactagttaaagacggttgctttagctggcatatgaataatgcatctatgtgtattgactatcgagaaaaaggttttgtatgattttgttgcagctggcaaggcttctggtagcttagtcttagaaattagtacttggctgtttgcttttggtttagcctttttctgacagggaactggtctgggtactactcgccaaaggaccatatatcataattggaaaggagcaaggcaagctgtagggaagatcactgcacaattatttttatattatcgttcctataaggttttgagaatctgtggttaagttgtattgtaaagctagttagtagcaaaattgtttataaggctatttgagctcttatatcttcatacacatttaatttttcgcagcttgtgaacattgggaagcccaattaaatatttgaatctgcatagagtattggaaatagtcaatagtggtgaacttttgaatgattcagttttgagactctggttggagcatgtgtagctactatttagtggggtgcatgtgacatcaaatttcgattgttgacctcatatatgttactggacttcaaaatttgttcttccattttcaatctgactaactacttcgtcgaagtttttctcatattttttgtgccattattagataccatgatgataatagatcctgactttattttttgtactacaggtagcacaagagtattctgaatgcccatcagggaagaaaggtggagatcttggttggttcccgcgtggcaagatggctggtcctttccaggaggttgctttcaacacacctgagggaactgttagcgcaccattcaagtccacgcacgggtatcactttatcctctgcgaaggaaggaagaactgatctggaaatgtcggttggggagactgcatcatcaggttgtatgagacgcaatgcaaactactcaccttctctaataagcgctggacatgtgtactttgtgttgggctattcgcattctgttccaaacaagttgccaaaacaaaagaatgtgtgattcgctgtaattaacatattgtactgataatctgatatggcatacctatctgggtcagttaacaggtgggttttagcaaaaaaaaaaaaaaaaaaaacgaaaaaaaaaaaaaa

SEQ ID NO: 1668 - DNA, 816 bp, Zea mays
gccggccggtttgtcgactcgtcgtcgtcggtggtagtatctgagccaaatcttacttggaagtagggttttggcctgtgtaatccgatcgaccttgcgcagttgctccgatgggcaaggactcgaagccgaaggacgccaaggggaagggcaagcaggcggccggctcctctggcggcgacgacggcggcggcaagggaggcaagggcaagggcaagggcaagggcggcaagtccgctgacggactcggcacttgcacctacgtcaaagctaggcacgtattgtgtgagaagcaggggaagatcaatgaagcttataagaagttgcaggatggatggctgaataatggggacaaagttcctcctgctgagtttgctaaggtagcacaagagtattctgaatgcccatcagggaagaaaggtggagatcttggttggttcccgcgtggcaagatggctggtcctttccaggaggttgctttcaacacacctgagggaactgttagcgcaccattcaagtccacgcacgggtatcactttatcctctgcgaaggaaggaagaactgatctggaaatgtcggttggggagactgcatcatcaggttgtatgagacgcaatgcaaactactcaccttctctaataagcgctggacatgtgtactttgtgttgggctattcgcattctgttccaaacaagttgccaaaacaaaagaatgtgtgattcgctgtaattaacatattgtactgataatctgatatggcatacctatctgggtcagttaacaggtgggttttagcaaaaaaaaaaaaaaaaaaa

SEQ ID NO: 1669 - DNA, 1923 bp, Zea mays
cctagaagaggttaacatctagaagaaatgctttcaatgatagaaaatgttttgagtgtggggaacccggtcacattgccatgaattgtccaagcaagaagaagaagggcaaagatgaaagtgacaagaagaaaaagaaatactataacaagaagaaagatggcaaagcctacttagttgaatgggactcggatgatagctcggatgatgatgatgatgacacctcatccaagcttaatgccggaattgccatcaaggaagctccctcactcttctcatccccccattgcctcatggcaaagggagatgctaaggtaaactacaaggcgggagggaatcattgggtgttggatagtggatgtactcaacacatgaccggggatatgaagatgtttacccaaatgagtgaggaagattgctcaaattatgatagtatcacatttggagataatcgtaaaggaaaggttaaaggtttgggtaaaattgctatctcaaatgatcattctatatcaaatgtgctattggttgagtctttgaattttaatttactttccgtagctcaattatgtgatttaggattttgttgcaatttcacggttgaagatgttattatctctagtgttgatggtagcaatcttaaatttaaaggttttagacatgaaaatctttatcttgttgatttctcatctaatgaggcaaagctcacaacttgcttattttcaaaagcttcactaggttggttatggcatagaagacttggtcatgttgggatgaagcaactcaatcggttaaccaagcatgacttagttcgaggcttaaaagatgtgaagtttgaaaagaacaaattgtgtagctcttgtcaagccggtaagcaagtggcaaatactcatccaaataaaagtcaaatgtccactcatcgacctttggaattacttcacatggatttatttgggcccacatcttttgtaagtattggtggtaattcttattgtcttgtgattgtggatgactattcaagatttacttgggtttattttctacgagacaaatccaatgtgtttgaaacattcaagtcatttgctatattggctcaaaatcaatttgatttcgacatcaaaaaggttagaagtgataatgggtcggaattcaaaaatgcaagaattgatcaatattgtgatgacaagggtatcaaacatgaattctcttccaaatataccccagaacaaaacggtattgttgaaagaaagaatagaactcttattgatatggcaaggtctatgttagcggaatataatatatcggattcttattgggccgaggcaataaataccgcttgtcattcatcaaatagactatattgtcacaagctcttgaagaaaactccatatgaattgctcattggtagaaagccaaatatctcatattttagggtattcggttgcaaatgttatattttgagaaagggaagccggctttctaaatttgagaagaaatgtgatgagggttttcttcttggatattcatcaaatagtaaggcttatagagtcttcaacaaatctcatggtattattgaggaagcatatgatgttgaattcgatgaaacaaatgggtctcaagatgagagtgataatctcgatgatgttgggggaactcaattgataaatgcaatgaaaacgatggccattggtgaaataaaacctaaggaagatgatgatgaagatagtgtggttgtcattccttcatcctcaactataaatgaggaagatcaccaaagccaacaactcgatgaaaccttggacactcatgatcaaggtacttcaagaccttcggttcctcccaatgcttcaacaagcaactatcaaaccgtatcaagaattcatcattccattgtgaaggatcacccggttgaccaaattgtgggtg

SEQ ID NO: 1670 - DNA, 2834 bp, Zea mays
ttgtttgtgaaagaatgtgacaaagtgtgtcacaagtgtcacaaaaagggacatgttaagaaaaattgtcccaagttcaaaaatgtatcctccacttgttttgagcattgttatgttctttctcataatgcaaaaggtgttcatgctaaatttgttggtacttcaattgttggaaacaaaaagaaagctatttgggtgccaaagaccttggtcactaacatccaaggacccaagcaagtttgggtacctaaaagagattgatttccttttgtaggtaaactacaaggcgggagggaatcattgggtgttggatagtggatgtactcaacacatgaccggggatatgaagatgtttacccaaatgagtgaggaagattgctcaaattatgatagtatcacatttggagataatcgtaaaggaaaggttaaaggtttgggtaaaattgctatctcaaatgatcattctatatcaaatgtgctattggttgagtctttgaattttaatttactttccgtagctcaattatgtgatttaggattttgttgcaatttcacggttgaagatgttattatctctagtgttgatggtagcaatcttaagtttaaaggttttagacatgaaaatctttatcttgttgatttctcatctaatgaggcaaagctcacaacttgcctattctcaaaagcttcactaggttggttatggcatagaagacttggtcatgttggaatgaagcaactcaatcggttaaccaagcatgacttagttcgtggcttaaaagatgtgaagtttgagaagaacaaattgtgtagctcttgtcaagccggtaagcaagtggcaaatactcatccaaataaaagtcaaatgtccactcatcgacctttggaattacttcacatggatttatttgggcccacatcttttgtaagtattggtggtaattcttattgtcttgtgattgtggatgactattcaagatttacttgggtttattttcttcgagacaaatccaatgtgtttgaaacattcaagtcatttgctatattggctcaaaatcaatttgatttcgacatcaaaaaggttagaagtgataatgggtcggaattcaaaaatgcgagaattgatgaatattgtgatgacaagggtattaaacatgaattctcttccaaatataccccggaacaaaacggtattgttgaaagaaagaatagaactctcattgatatggctaggtctatgttagcggaatatagtatatcagattcttattgggccgaggcaataaataccgcttgtcattcatcaaatagactatattgtcacaagcttttgaagaaaactccatatgaattgctcattggtagaaagccaaatatctcatattttagggtattcggttgcaaatgttatattttgagaaagggaagccggctttctaaatttgagaagaaatgtgatgagggttttcttcttggatattcatcaaatagtaaggcttatagagtcttcaacaaaactcatggtattattgaggaagcatatgatgttgaattcgatgaaacaaatgggtctcaagatgagagtgataatctcgatgatgttgggggaactcaattgataaatgcaatgaaaacaatggccattggtgaaataaaaccaaaggaagatgatgatgaaaatagtgtggttgtcattccttcatcctcaactataaatgaggaagatcaccaaagccaacaactcaatgaaaccatggatactcatgatcaaggtacttcaagaccttcggttcctcctaatgcttcaacaagcaattatcaaacggtatcaagaattcatcattccattgtgaaggatcacccggttgatcaaattgtgggtgatattagtaagggtgttcaaactcgctctcgcatagcttcgttttgtgaacatttctcttttgtatcttgtatggaacctaaccgtgtagatgaagctctacttgatgttgattgggtgaatgcaatgcatgaagaattaaataacttcgctcgaaatgaagtttgggagcttgttgagagaccaaagaaccacaatgttattggtacaaaatgggtgtttcgcaacaagcacaatgaagatggtgtggtagtaagaaacaaggcaagattagttgcacaaggatatactcaaattgaaggattggattttggggagacatttgctcccgtggcaagattagaagcaatccggattctacttgcttatgcttgtgcacataatatcaagctctaccaaatggatgtaaagagtgcctttctaaatggtaagattagtgaactagtgtatgttgaacaacctcccggttttgaggaccccaaaagacctaaccatgtgttcaagctttctaaagctctctatgggcttaagcaagctccacgcgcttggtatgaaaggcttagggatttcttgctttccaaagacttcaaaattgggaaggttgacactactctattcactaaaagaattggcaaagacttatttgtttgtcaaatctacgttgatgatattatttttggatctactaatgaattattttgtgaggagttcggaaaaatgatgtcaaaagaatttgaaatgtctatgataggagaattgagcttctttcttggccttcaaatcaaacaattgaaagatggaatttttataagtcaatcaaaatatttgaaggacatgctcaagaagtttggtttagaaaatgctaagcctatcaagactccaatggcaacaaatggtcatctagacttagatgaaggaggtacatggtgatcagacgtatcatagctgaatc

SEQ ID NO: 1671 - DNA, 1518 bp, Zea mays
  misc_feature (1493)..(1493): n is a, c, g, or t
  misc_feature (1503)..(1503): n is a, c, g, or t
  misc_feature (1505)..(1506): n is a, c, g, or t
  misc_feature (1509)..(1509): n is a, c, g, or t
ccacgcgtccggactcctacaatcagcttaggatgcgatctcctcaggatttgaagggtaggctcactgtccaatttcaaggagaagaaggaattgatgctggtgggctgacaagggaatggtaccagtcgatatcacgagtcattgttgacaagagtgcccttctgtttacgacagtcgggaatgatttgacgtttcaaccgaatcctaattctgtgtatcaaactgagcacctctcatacttcaaatttgttggacgagtggttggcaaagctctcttcgatggtcagcttttagatgcccacttcactacctcctgcccctcccgcatacttggtgtcaaggttacataccatgacattgaagccatcgatccttcgtactacaaaaacttgaaatggatgcttgagaatgacataagtgatgttttggatctcacctttagcatggatgcagacgaagagaaactgatattgtacgagaaggcagaggtcactgattgtgagttgattcctggagggcgtaacatcagggttactgaggagaataagcatgaatatgtcgaccgggtagcagagcatcgattgaccactgccatcaggcctcagattaatgccttcctggaagggtttaatgaactcattccacgggagctgatatctatcttcaacgacaaagagcttgagcttctgattagtggtcttccagatattgacttggacgatttgaaaacaaatacagaatattctggctacagcatagcctctccagtcgtccagtggttctgggaaatcgttcaggggttcagcaaggaagacaaagctcggttcctccagttcgtcactggcacttcaaaggtaccgttggaaggttttagtgaacttcaagggatctctgggccacaaaggtttcagatacacaaggcatacggcagcacgaaccatctgccttcagctcatacttgctttaaccaactagacttgcctgagtacacgtccaaagagcagctccaggagaggttactgttggcaatccacgaagcaaatgaaggtttcggatttggctaatcagtcatgctcgtttgtccgtgagagtctgtacagatactgagcattgcaatgggcgagcagcacgtgtgtgctgatccttaccacattctgaactccacgtgtttgatggccggggagaacatagaagaatctccgtgggagaggtactgatgagagagagcgactattttgtgttcataatattcattaccttttttttagcttttttcggtcgttgccccgttcgtagtttttgccttacattggacttcgctccgattttttttctctgcttttccttcatagactggtgtaagctgtaaccgaacactgtcaaatgcaaatcatcttagggccccttcggttattactgaatggaggcatggaataatttctagccgtactgtttctctactatattaaagcatcagttttagtcccccncctctccccncnnccncaaaaatcc

SEQ ID NO: 1672 - DNA, 1269 bp, Zea mays
  misc_feature (48)..(48): n is a, c, g, or t
acgtataatagcggtctttccttgcttcttcctgatttcttccaaatntacaatttggcatcaaaggagggtgaaatgtacaaatcaaggaaataatatctatcccttctcatgaaatgaaataaaaaagaataacaagactgacacctgaccggacttcacaagcagccagctccagcttaaaccagcaacggaactccccaactctcatcaagcagattacttgctgctcatcaactggccattcaacacgcccttgaaccctgttgctacgactcttcaaactgatcctgtacagttttagtcacttgctgacttgcctctacctacactcttgatatagacagctccactccgggagtatggtcgtattgcaaatcatggtcagaggtgctgcagcaatgaaccgacatgtcctgaacctccatccaccaaggctacctagaactgcttggctgctgtgtctccccaactctttcaatttcaactgccatgtcagcgggctccttaggtttgctcccgttggaggttcctcttctagttggttttcttatcttgtggaaggatccatggatggaatccatcaccgagccttcaggccactttccacttctatcggttggaatccaagttgcttggaccccatgtgtacatgacaaacttccgaaccttgttccaatttcgttgagcgcgttgtttgctcaggattttcagcattctggtatcctcgtcacgaagcttctttattctgccttcacattgagccatgagacagagaaaaaatgcaacactgaaggcatacaggccaccaatactcgcaagaatactgactgggccaagcacattctcattgctgatctccacgatatagtcagaaagataacttatgaagagtgtagtatttataactccatctctagggttgtgcaaggaagcattcaagctgctcagatctgataaggtagaaccttgagtgaagtcctgaacaagtggctgcaagagcttcaggccatgaaggtggctgtatatctgaggaaacaattggattttgagcacattggaatccggccctctgaatgttttccccggcccgcctccagggtcccctgagcttaaagtaccgttggaaggttttagtgcacttcaagggatctctgggccacaaaggtttcagatacataaggcctacggcagcacgaaccatctgccttcagctcatacttgctttaaccaactagacttgcctgagtacctcggccgcgaccacgc

SEQ ID NO: 1673 - DNA, 2517 bp, Zea mays
ccacgcgtccgggtaaaaataactccgacatttctgtatcatatggatcagagttgaatcctgaggatggcagcaaagcccctgctgttgacaacagaagtaacttgcgagctgttctgcgaagtcttccccaatcagagcttagattgctatgttcattgcttgcgcatgatggattgtcggacagcgcttatctccttgtaggtgaagtgttgaaaaagattgtggctctggcccctttcttctgttgccatttcataaatgagcttgcacgatcaatgcaaagcttgacattttgtgcaatgaaggagcttcgtttgtacgagaattctgaaaaggctcttcttagttctacatcagccaatggaactgcgattcttagagttgtgcaggctttgagttctcttgtcagtactcttcaagatagaaaggatccagaacagcctgctgagaaggaccattcagatgcagtttcccagatttctgaaattaacacagcattggatgctttgtggttggaattgagcaactgcataagcaaaatagaaagctcttcagagtatgcatcaaatctaactcctgcttctgcaagtgcagctacattaacagcaggagtagcacctccattgcctgcaggaactcaaaacatattaccatatatagagtcattttttgtgacatgtgagaagttgcgtcctgggcaacctgatgctgtacaagaggcttcgacttctgatatggaagatgcttcaacatctagtggtgggcagagatcatattcctgtcaagctagtcttgacgagaagcaaaatgcttttgtgaaattctcagagaagcacagaagattgctgaatgcattcatccatcaaaaccctggattactggagaagtcattctcgctgatgttaaaaattcctcgcctgattgattttgacaacaaacgtgcatatttccggtctaaaatcaagcatcagtatgatcatcatcatcataatcctgttagaatttctgtgcgtcgttcatatattcttgaggactcctacaatcagcttaggatgcgctctcctcaggacttgaagggtagactcactgttcattttcaaggagaagaaggaattgatgctggtgggctgacaagggaatggtaccaatcgctttcacgagtcatttttgacaagagtgcccttctatttacaacagtcgggaatgatttgacgtttcaaccgaatcctaattctgtatatcaaactgagcacctctcatactttaaatttgctggacgagtggttggcaaagctctcttcgatggtcagcttttagatgctcattttactagatctttctacaaacacatacttggtgtcagggttacgtaccatgacattgaagctatcgatcctgcatactacaagaatttgaaatggatgctcgagaatgacataagtgatgttttggatctcaccttcagcatggatgcagacgaagagaaactgatattgtacgagaaggcagaggtcactgattgtgagttgattcctggagggcgtaacatcagggttactgaggagaataaacatcaatatgtagatcgggtagcagagcatcgcctgacgactgcaatcaggcctcaaattaatgccttcctggaagggtttaatgaactcattccacgggagctgatatctatcttcaacgacaaagagcttgaacttctgattagcggtcttccagatattgacttggacgatttgaaagcaaatacagaatattctggctacagcatagcctctccagtcatccagtggttctgggaaatcgttcaggggttcagcaaggaagacaaagcccggttcctccagttcgtcactggcacttcaaaggtaccgttggaaggttttagtgcacttcaagggatctctgggccacaaaggtttcagatacataaggcctacggcagcacgaaccatctgccttcagctcatacttgctttaaccaactagacttgcctgagtacacatccaaagagcagctccaggagcggttactattggcaatccacgaagcaaatgaaggtttcggatttggctaatcagttatactcgtttgtccgtgccctgagaactgcaataggcgagcagcacgtgtgtggctgatcacattatgaactccacgtgtgtgatgagagatggccggagagaacatgtccaggatagacgaatgcccgtgggagaggtactactgttaagagagagagcgactattttgtgtttataatctttgtctgtttgtagtttttgccttacattggtcgttgctccgaagtttttccccttcttttcgttcatagactggtgtaagttgtaaccgaacattatgtcaaatgcaggtcatcttacgctggaatgttatacctcccctaatctgttaaaacaactgtaaattccgaaggactatttattctaatattattagagcgaaaattctctctttcgctctcccaaaaaacgcaaaaaaaa

SEQ ID NO: 1674 - DNA, 1698 bp, Zea mays
aattcggcacgaggatgatggtgaccggcatggaacttcaggcacctcagaacgattacctttgggtgatattcaagcagctgctcgatcacggaggccatctggaaatgctgtgccagtaagcagtagagatatgtctctggagagtgttagtgaggttcctcaaaatccagaccaagaacctgatcagaatgctagtgaggggaatcaggagcctaccagagcggcaggtgctgactcaattgatcctacatttttggaggctcttcctgaggacttgcgagctgaagttctttcttcacgtcaaaatcaagtgactcagacttctaatgaccaacctcagaatgatggtgatattgatcctgaattccttgctgcactcccccttgatataagagaggaggtgctagctcaacaacgtagtcaaaggatacaacaacaatacaagaattagaaggacaaccagttgaaatggatgctgtttcaattattgcaacattcccttcagaaattcgggaagaggtccttttgacatctcctgacaccctcctagctacactcacacctgcactagttgctgaggccaacatgttaagggagagatttgctcatcggtatcacagtagctctctttttggtatgaactccaggaacaggagaggtgagtcctcccgacgtgacataatggcagcaggacttgataggaacacaggtgatccctccagatcaactagcaaaccaattgagattgaaggtgctcctcttgttgatgaagatggccttaaagctcttattcggttacttcgagttgttcagcccctatacaagggtcagctgcagaggcttcttgtgaacctttgcacgcatcgggataacagacaggccttggttcagattctggtggacatgcttatgcttgatctgcaggggttttcaaagaaatcagtagatgcatctgagccaccatttaggttgtatggatgccatgcaaatatcacatattcacgtcctcaatcttcaaatggtaattaagtttttccatcttcaatccttttagcaggttgcactgcctaattttctggtcttctgatttgcaatgtatattaatgcgtggattctctttgttgctttaagtaggtgttcctccattggtttcacgtcgtgtgctcgaaacactgacaaacttggcaagaagccatccaaatgttgctaaactcttgctctttcttgagttcccttgcccatcaagatgtcgctctgaagcacatgatcataggcatggcaaggctgttctagaagatggtgaagaacggaaagcctttgcggttgttcttttgttaactctgttgaatcagccactttatatgagaagtgtagctcatcttgaacaggtgaactatattttcttttgggtatttcatttaacattttggctcgcgttttcttatcattttgtaacatgtgcagttactaaacctccttgaagttgtcatgcataacgctgagaatgaaattaatcaagctaagctagaagcgtcatctgagaagccatctgagaatgcagtgaaagatgtcaaagataacaccagcatttctgattcatatggatcaaagtcgaatcctgaggatggtagcaaagcccttgctgttgacaataaaagtaacttgcgagctgttctgcgaagtcttccccaatca

SEQ ID NO: 1675 - DNA, 2427 bp, Zea mays
ccccgcggttggccgggcgctctagaaactagtggatcccccccggctttcagggagagagaggggggcgcccgagctctcccccccccccccccccccctagtgcaactgaaataaaggaggggcaaaatgtggaatttatatggtttagtcccctttagtcaccccttgagggactagagactaaaacaatttagtccatgttttagtcccgccgtttggcaatttagagactaaatatgactaaaatgaagggactaatctttagtccctcaaaccaaacgggacctaaaaaactaaagagttcctagtgttttacgtagtcaactttgatcatgaattatgtgggatcacatgtaatctcccccatttctattttttttagaattttgggaagtatgtggaaagtgcataggtttaaaccaggtggaacagccaataaactgctcaatttaaaaggctaattctattgcagcttaaaagcattcgagtttgtgggcctagatattggcctcaggtgataaaacttgcacctgaaggtatagtacttatcctgaatacttcacaacttgtcaaaaaaagttgcattatattcttatcataattctcaaatagacaagccatggtggagatctggagacaagacaaatccattcaatgggggagtactctacataaagcgaaaagttggatcttgctcctactctgacgatccaattggatgtcaatcgttaatttcacgggcaatgcatgaggtttatgtttttttacaactgttgttatatcttagtttattgactatgtgttatattgacttataattttacttttcttacatgaaacttcaggtctgtgatgcaccatctgctagttgcagtaatcaaccaaacagcactaatggtagctacttcagagttgatcagctagtaagcactttctcggccaatccaagcttgattgcttttgcaaaactctgctccgtgtcatggaagagcagatgcaatagcaattttcaggagttctgttctcaagtgctatatgaatgtatgagcaaagatagaccatcactgttacaggcctatatcagtttttacacaacaatagagttaatgtgggagcatttgaagactgggaattttcctttttataattcccttttccttcccaacttgaaggtcgctttggcctacaacgaagcattagttgattctagaatcacaaatggaggaattattcattcgacattcttggagtcacttatgaagcgagtgggagacatctttgcggagctgccaaacctcaaggacaacctccaccgatacttgagcacgggcacatggcctgacacacaaaacgacgtggtggttctctcgtggtacctccaatggtacaatataccacctgcccatgttgtggcttctgcagttgagaaggtcagaccgagagtccctgccggtgtatctatgctcccactgcttcgcatcctgctgccaaccacacaccttgtgggactgatggagatcgagaaggtacagattgtcatggaatgctaaaggatgagcgtggaaaattcaatcaaccttctctgcatgcgggttacttgtgatgaacggtagcaagtattgcttagtgcacttgtgatgaaatctgccagggactaagctgttctgaattaagtttgagacaaaagaatcccataatttttattgtgctttgctttagattcatattttctgcatgaattgtttcgattctacccacgagaagtactccctctgtccttatcagaggtcaaacactctaagtttgacaagtttatagaaaagagcaacctaaaaaaaaaaaaaaaaaaaaaaaaaaaaaaaaaaaaaaaaaaaaaaaaaaaaaaaaaaaaaaaaaaaaaaaaaaaaaaaacccgggggggggcccgggacccaattccccctaaaagggggcgaaataaaatttcaggggcggggttttaaaaaggggggaagggaaaaaacctggggttacccaaattaaaccccttggaaaaaatcccccttttcccaagtggggaaaaaaaaaaaaagccccaaacaaatcccctttccaaaaatttgccaaccttaaagggaaaagggaaatttgaaaggttaaaattttggtaaaaatcccggtaaatttttggtaaaacaacttattttttaaccaaaaaggccaaatcgggaaaatcccttaataatccaaaaaataaacccgaaaaagggttgagagggttgtccacatttgaaacaaagaacccataataaaggaaaggggaacccaacggcaaaagggggaaaaacccgccattaagggctatgggccccctacgggaaaccttcccccaaatcaattttttggggggccaagggccccaaaagcctaaaatcgggaacctaa

SEQ ID NO: 1676 - DNA, 1996 bp, Zea mays
gcacgaggacttgctctagccttgatatttttgaaggccgagtctgaggagattgcagctagactcaatatccccaacacttacttcgatttgcagtatgtgaggcctgattttgttatgcttcgcattatagccaggaatttaatattggggagcagaatacaacctaccaaaggatgggttgattctcaaattcctgaaacagtcaggtgtggtatttccaacatgagtgaagggactattgacagtgatgaattggatgctgaagctctttttcaagcttatgttaacatagtgactggcgcatgtattgcacttggactcaagtatgctggcagcagaaatggtgatgcccaagagctactctacgcttacaccgtctattttctaaatgagattaagcacatacctgttcgaacatcaaatatactaccaaagggattactacaatatgttgaccgtggaactcttgaactctgcttgcatcttattggtctctccctctctctggtaatggcaggatctggaaatttgcagactttccgcttactgcgctatcttagaggaagaatttctgcagaaggccaagtgaattatggattgcagatggcagtaagcttggcaataggattcttattccttggaggtgggacacacacattttcaactcagaatagtgcaattgctgcattactaatctcactttacccacgtttacccactggaccagatgacaatcgctgccatctccaggcattcaggcacctatatgtaatagctacagagcctcgatggattcagacagtggacattgacacagaacttccagtgtattgtccattggaagtgacagttgctgaaacggattattatgatgagaccaactattgtgaggtgacaccttgtcttctgccagaacgctcagtgcttaaaagcattcgagtttgtgggcctagatattggcctcaggtgataaaacttgcacctgaagacaagccatggtggagatctggagacaagacaaatccattcaatgggggagtactctacataaagcgaaaagttggatcttgctcctactctgacgatccaattggatgtcaatcgttaatttcacgggcaatgcatgaggtctgtgatgcaccatctgctagttgcagtaatcaaccaaacagcactaatggtagctacttcagagttgatcagctagtaagcactttctcggccaatccaagcttgattgcttttgcaaaactctgctccgtgtcatggaagagcagatgcaatagcaattttcaggagttctgttctcaagtgctatatgaatgtatgagcaaagatagaccatcactgttacaggcctatatcagtttttacacaacaatagagttaatgtgggagcatttgaagactgggaattttcctttttataattcccttttccttcccaacttgaaggtcgctttggcctacaacgaagcattagttgattctagaatcacaaatggaggaattattcattcgacattcttggagtcacttatgaagcgagtgggagacatctttgcggagctgccaaacctcaaggacaacctccaccgatacttgagcacgggcacatggcctgacacacaaaacgacgtggtggttctctcgtggtacctccggcgggaccacgctccacctgcccatgttgtggcttctgcagttgagaaggtcagaccgagagtccctgccggtgtatctatgctcccactgcttcgcatcctgctgccaaccacacaccttgtgggactgatggagatcgagaaggtacagattgtcatggaatgctaaaggatgagcgtggaaaattcaatcaaccttctctgcatgcgggttacttgtgatgaacggtagcaagtattgcttagtgcacttgtgatgaaatctgccagggactaagctgttctgaattaagtttgagacaaaagaatcccataatttttattgtgct

SEQ ID NO: 1677 - DNA, 893 bp, Zea mays
gggttcccccgcggccggcgctcaggctgcccgccgtgatggcgcgtctcttcttcttcctcctcctcctctttccgctcctctactcctccgtcaccggcctcaaccgcagtgacttcccgccgtccttcctcttcggcgccagcacgtcgtcttaccaggtggaaggcgcatacctagacgacagcaagggcctaagcaattgggatgtcttctcccatgttccaggaaatattgacgatggaagcaatggcgacgtggctgctgaccattatcatcgatacaaggacgacatagaaatgatgcattcgattggcctcggctcttacagattctcattgtcatggtcgagaattcttccaaagggtcgcttcggaggtgttaatcaggcaggcgttaaattctacaatagcctcatcaacggactgctagaaaaagggatacaaccatttgtgacgatcaaccactatgacatacctgaagaactccaagaaagatacaattcttggttgaacccagagattcaggaggactttacctacttcgctgagctttgcttcaagatgtttggtgaccgagtaaagcattgggtcacattcaatgagccaaatcttattgtaaagcttgcatactccagtggggcatttccacccaaccgttgttccgagccatatgggaaatgtgattcagggaattcatcaactgagccctacattgcagcgcataacatgatattagctcatgcaaagacggtcaacatctacagaaataattacaaggaaaggagcagatgtgagaggttattttgtgtggtctttgatggataacttcgaatggatctctggttacaccgtaagtatggtctttgtcatgtgaaaattcagtcactaaag

SEQ ID NO: 1678 - DNA, 1841 bp, Zea mays
cattgggtacctcgaggccggccgggatgctcaggctgcccgccgtgatggcgcgtctcttcttcctcctcctcctctttccgctcctctactcctccgtcaccggcctcaaccgcagcgacttcccgccgtccttcctcttcggcgccagcacgtcgtcttaccaggtcgaaggcgcatacctagacgacagcaagggcctaagcaattgggatgtcttctcccatgttccaggaaatattgacgatggaagcaatggcgacgtagctgctgaccattatcatcgatacaaggacgacatagaaatgatgcattcgattggtctcagctcctacagattctcattgtcgtggtcgagaattcttccaaagggtcgcttcggaggtgttaatcaggcaggcgttaaattctacaatagcctcatcaacggactgctagaaaaagggatacaaccatttgtgacgatcaaccactatgacatacctgaagaactccaagaaagatacaattcttggttgaacccagagattcaggaggacttcacctacttcgttgagctttgcttcaagatgtttggtgaccgagtaaagcactgggtcacattcaatgagccaaatcttattgtaaagcttgcatactccattggggcatttccacccaaccgttgttccgagccatatgggaaatgtgattcagggaattcatcaactgagccctacattgcagcgcataacatgatattagctcatgcaaagacggtcaacatctacagaaagaattacaagtccaagcaaggtggctttgtaggaatttcattacatctaagatggtatgaaccactaaggaatatcacagaggaccacttggcagtaagccgagctctgtccgtctcagctacggaggcccccccccccttgttctttggtgactatcctcaccagatgcgccaaatcttaggtccaaatttgccaaaatttacagaaggagagaagaaactattgaagaaccaaattgacttcatcggggtaaatcactaccaaacattctacgtcaaggattgcatatattctctatgtgatatgaacgcctacccttctgaagctttagtttctatgtcaacagaacgaaatgggatacccattggaaaaccgacacctgttgcaaacacctatgtcgttccaagctccatggagaagttggtcatgtatttaaagcagagatataaaagcatacctttgtacatcacagagaacggttatgcccaaatagccaatattagcactacagcagaagaaataattaatgatattgaaagatcaacttacattcgtgactacctcacttacttgagctttgcaataaggaaaggagcagatgtgagaggttattttgtgtggtctttgatggataacttcgaatggatctctggttacaccgtaaagtatggtctttgtcatgtgaatttcaagtcactaaagcgaacaccaaaattgtctgctaaatggtatagcaagtttatcaagggctatgaacagatagagatggcctctgaagaattgcctaagcatatggtttcctagtacagaaatacagaattctcaaagtccttgtttctacattactcaatgatttgttaaaaatgtttacaccgtaatttttctcatgcccatgtatgccagtgccataataaaatctaagcttatttttttccaaaaaaaaaaaaaagggcggccgcccttttttttttttttttaaaaaaaccgaatgcactgttgaatccgtctcatacatacagatggcatgaaatgaaatttacacattcacgcattaaacactgtttt

SEQ ID NO: 1679 - DNA, 7825 bp, Zea mays
  misc_feature (7113)..(7113): n is a, c, g, or t
caatctaaatttaatcccaaatttaatttagtcaaggttttatgtctcatgcgtattcaatctaaacaacctgcaagctagtgacacaaaaccgtacgtggaggtgaataccttggtatcattagagctaatttgttctaatctttgtgagatgattagactaaagatgagaaaagatatttcatggctttttgtatgaccgtaatagatactactatgcatgattctatgttccacacaaaattatatagccatctcataaatttaatgtttattctcatatagtcatcaattaacatctaagcataggtccctctataggatataatgttctctttaaatttatccaataatcaatatatttttatatatgcatttgctaagtttatgagtagtaaatatgtacatatatatccttacaaatataatattatatttttagattatatttaacatgaaattacctaaatttctaacgcaactactactagtaactatgttactcatcagaacactacgtattttgttgtaattagaaaaggcaccatgtatctaggctaggtccaacggtgaacgttatcaaataatataatgacatgtgatcggtatcgactgcgtcttatagtttatttaattaagtcaaataaatcttaagcacgatattgacacgtatcaatagagtaactaatatctgagcatgtttccttcgacattatataattttttctttaaaattatgtgatgtaattagtttatttttcatatatggttactaaattcaagagcagtaatattatatatactatcctatatttagattatatttaacataaaactacctttaggatcgaactctattactattcatttgtcaactaaaattattataggccaaaacagacaattgtaaaaaaaaatatttagaccccctttagaacgcaggattagtaagtttagacctctttagaacgcaggaataaaaaaaaggaatagaaaaaacgtaggaatggagttgcatggcaattataatcctaaaagatttaaaaatacgggaaaactattaaatagagtgtttggatgcaacataggaattaaagggtagagatagacacatacaaaggaaagttttcaagaggttggacctcttgtaagaaatgctctaaaatctcattacaataagcaattttttgttccaaagagttgtataggaaaattttctatatgcatgattctaatcctccaaaattcctctacttttcctttgttacatagatggccttagatgttgatccattacacactcatatcataggcactgtgctgtggtcacaggaggcaccgtgtacttatctggtagctttgaagttgtcgccgctggcggctggccggtaccatctgtgccgtgcgggcgggacacgccattctttgggacctctcgcaagcatgattgttcagaaccagacgagctttgctcccatgcgtctcgtacgtagttctgctccgatccgaaaggaggttatccacgcctacgtgattcatgtagcggcaacaatgttctccttgtcacgctcgcaaaaaaagagaaggggggaaaacagtggcctcggtcgcggtcgtgtagctttggttgttgtttaccaatcgccgtcaccagtcctgtggataacatcgcccctctcaactcaaaattatgggcttctgttcttattaacactgtaagtagaaaatgctgccaacttgtctgtagtaatctctggataaggacggtgcgaaagggcaactcatccgcctgtgcatatccatacgcggcgaggaacagtattttgatcatcacttacgagcaagtataataaaagctgttggtagattgtatgatagggtggaaaggaaaggaagagagagaaagaggttggcgtgagtttacagccagctgaggctgagcctttgtttggtcactctagtatgatctaatccacgtgtgttaaggtagattaaggtgtaaattagtttaaattatatcttaatccacctcaacacatgtatattaaggtcaatacaaaagtatctaaactaacactaaggaataataaccaagaaaatctatacgacgaaatttataagagaagcaggtgagttgtaaatgatgttccctctatcccaaattaaaattcgtttcaagtaattaatggattcgtataatacttgatgtatatgttttatatgtgtgtctagattcaccaccatctattttgaatatagacaaagaaacaaggctaaaacgaatagtattgcgagacggatggagtatatgattttgctgataaagtggatccatataggtagctgaaggctatagattgatcttagaccaaatccagcaacgtgcctgtgggcgtgtataacaccctgtaaatgcactgtttataaagagaagtttaaaatagagaactagatagagagcctgttgaagatagttttattgtatgatagtactcatctgccataaaatttatatcctctctaatcccacacccctgtcacaatcattgatccattgtgtgcgcccactgccagcccatccctagagtactggaccgtccctctccgctctggccagtttgctctgggacagtgcggacggtccattgccagtaggcccgccggccttcacgtggccaccggcggcgttacgtggcgagcgtgagggggcaacaccgcctgtcaccgtcgcagacccatggacaggacgcagacgctagcgagggccctgctgccatcgtgcgtgcagcgacaaactcgaggccctggaacatcatttgttccctactacaatacgtcccgaactattactcttccgccagattattgttgccattggacagtaacgtaattaacagagccaatccggtaccatgcgagaaactaaccatttcaaataagacctcttccccggtgattggtgatgtctttgatgcctacgtaaaatatttttttagttaattttatttaaaataatgtggtaattattgccacaaccctctcatgtgtttgtgtttgggtgtggatgatgagacagtggacgtgcatcgcggagcatggagacgagcttcgcattcttgcactgctgctcaagcgcgccaacctgtcctattaattgcttactaacagatgcaactaggtttgtaagcagcaataggaccttagcagtagaaaagatcccaaagcgattgaaccatcaaaggatagtgagcttccctaaaatcgcgacgtaagcagtcagctgtgtttggaaacggacaaaataaattcatggtggcaggtcatgtacgaaggtagtacagcacccatcacctttattttaaagaaaggtgtttttggcaattctgtctaaataatgatgcgtccagcacatttattagactagaagtgacaaattctcttttttatatatatgaaagaaagacgtaccacaagtgacaaaaccagtgtgtccggtgggaggtcagcacactaccagtgtgtttggtggtccggtggggttacgtttttgcatcatcgcatggcttgcactgttcctatcacaaggttaatcagcgcagccagatcgctcgtgacgaagcgaaactgtttgtgttatccaacgttggcgtggccgtatgcttcaggagtcccagactacgggtaccgtcctcccagtcccaaggccgcacaggcgcccaccgttccccgaacgcacctgctagcaacccgtggcgcgcggcgcgccaaagtctccaaaccgccggagggcagtgccgtcattccggaaacagccttatccgcttccggtcccccggtctcagtagtcagccttcctatgtctcgctctgcaaagcagcaagcaaactgcaaacccacccacccactgctttcagctttccatcttccatttccaccctcttcctcacgcatccgacgctataaaatccaatccaaccccgtgcaagctccaaataccatagccctcctagtcctggcagcaccacactctcgcgctcctctcgggcaggaaaaaaaagaagaagatcggtgtggttgcgcctagcttcccgcgaagcgagacgtcacgggcgtagcgtagtagagctagcaagccataccataccatacatatcccaccgattccgatcggcatggccgggagcgcgaggtcggcggccgcgaagcacgcgtaccggatgttcgtcgcgccgtccaggggcggcgccgcggcgaggggccccggggccggcgccgcggaggagttcgacgagtcggacgtctggggctcgttcggcgcggactcccagtactccagccccggggccgagctgggcgccggctgggcgcgcccgatccccggctccggcgccaggcggaagaagcccgtggacggcggcggcggcgcggcggggtcgctgccgatgaacataccggactggcagaagatcctcggggtggagtaccgggaccaccaccgcgcgggcgagtgggagcctggcgcggacgacgacgacgacgacgacggcagcagctacggcagggcgcgcggcggggcggagatggtgccgccgcacgagctggcgtggcgcagccgggcggcgtcgctgtcggtgcacgaggggatcggcaggacgctcaaggggcgcgacctcagccgggtccgggacgccgtctggaagaagaccggattcgaggactgagctagcgctgatccaccgccatgatcgggtgtaggtatcggtaggttagaaaaacgagcagtgctgctaagtgctactaattgctttatctctcgatcgacttctctttttttttcttgctatcacttttcctttttcccccttttgcgttgcatgcttaaaaggggagaaagtcgaggtagtaagcttttttttcttcttcctgtttttcgttcgtgttggtgcgagctggagggtgggggtgtgtgttcattcatggtgtgacagttttaagggcacctggaaaagagagagagagagaggacgaacagtacgatcgatcagatggttgatccattatattatgtttttttcttctttcgataatggaaaaattttcaattctatctaccatgttcacgcgatccgtaccctactttcgctactgcgtcgtccaacgccaaaccgcaaaggattggttcaacagctgcgcatacagcgacaccgcggaggttgctatacaaatccctctccatttctttttggacgagtgctactgctacgcctactgtatgtagaccagtaccaataaaaatcggcgcatagcaccaaacgatcgatgtgagtggcgatgcaacggcccactcaacagtatgaggacaccgaataatctcaggttcagtacgttagtaccttcaaatagcttcgataccaatctgctggcagccaaacaaacgttcggttggatcaggctggattaatatattattaaagaaaacacacacacaggcatagtagagcttcaataattgatcgatggaattagaaagtaataatactgcatttgcggatggccagtgagatctataatggcgtggcgcggtgtcgttttcccggcgctgcagccggataaggtcacgtaggcggtaggccccgcgccggtcgcggaccctatctttgccatcttgctgctgcacacgggaaaagcggaagccatcgggattcaggacaaggtggggtggggtttcccgtccgacccaccgccgagtcgtgaccctcactcgctgaccccatccggcgattttacgcgagaaacggacaagggagttccgtgctggctgacgggacgggacgggacgcccttggacgctgcggctggatgatccagagctctgttcccggtcgatcgagtcgagtgcgttcagttttggacgggacgcgggggttggtggcatgtgcggctcctgatcagagatctcggcaggcatgcagcagcagctgaaggccgcaggtgcaccacgtccccccggctcagcatccgcggtggcgcctccgccggaggcccgctccccaggtccaaatcttgtcgggtccgagcagctgcctgttggccatgcacagcgcgacccgccggcgcagggcagcagatcgtgcctgccgcgacctgcgatgtgcacgcgccatgatcgatctggattctcgagtggaggccgtcccacgtgagcgaccgggcagcggctccccttacgaaaaaagatgaactatgggggtctgtcgaccgcgctcactggaaaccacctccggtccgcgccgcggttgccgactggaagtctagaacacacggacgcgcgctgggcagagcatcaccgcaccggcagcaagtacactgcgctgcggatccaagtcgcgtgggtcgctagggcgtgcgtgttacctcaaccctggagcggacccggtttacgttcgccgagtagtgggatcggcacgactacccactttcctatggctgatctctttactattgatggggtatggatcggcattagtgtaccctaatattgttgcacatccgatcttctccaaaaattctttgtcaagtaggtaggtccatatgctttgccaaacagtcctttgtgataggctttgttttcgtccaccaaattaataagcatgatatttcgttcttgttcactttaaactcgtggtttaatacatctgctcaatctagattaaattcttgtagttagatgcatgctatagattaaatttctatggttattttcttgctgcatattgatatgtgtaatccgatgtattaaatcttgtcaatttgcttgttaataattgataaatagatccaatctattactttctattttgtaaaaaaaagagaacgacgaccactcacttgcatctcgtgcatcgtcatttgggtgagattggagagctccaattataatgcatatatttctcacaccttgtggcactagttgcgcaacaattggaacaaccggtctcaaataatttgcaaattataatagactacatgatttcattgaaaaaaatcaccataaactatgtagaatcaggagagttatatatccaaaatactacaaatgctgacaataatttnatctctatgatcgtgttgcaattgatgggaggatatcaaaagtccatggcatgattgccaaaaatattcagatttgggtcaaatgaaaagaagtaatagagacataattgtgttcgctttcaaagaggcaagtattcgagtctgtcgcccacacgccccctggagtttaccccatttgagtttaagtgggtgtttgttcgaaagagggatgcataaaaatggtggtgatgagatacaagacacaagggttcacgtagatacccaacaattattatgataaaaattactcccatttatgagtggcatgacgttctgatattactaatagtaggtttaaactaaaaaatagatgttggatgtattgattgcatacttttatggttcattgtaataaaatttttacatgaaggtcttagatggtctgagaattctggattctaagttaaatctcaacttgtacagtattaagttatagaggatgttatatgggcttaaacaatataagcggatatggtacaatcgactcagtgaattcctcatgaagaatgtatatgtaaacaatccaggttccccttgtgtgttctgtagaaaatatcagaagggtttgtgtatcgtttcagtgttgatgacctaaatatcatataatagacggagaatgttaaggaggctagcgtctaactcgagatagaggttgaaatgaaatactggggga

SEQ ID NO: 1680 - DNA, 1325 bp, Zea mays
gcacgagaccattacctagaacatcctaatcgaaaaaacgacaccatagccctcctagtcccgctcccgcactcctcgtacgtagcgtcacggccgtacgtagaggcgctagcacgtcagagagcgccactggttctgttctgaccgatcggcatggccgggagcgcgaggtcggcggccgcgaagcacgcgtaccggatgttcgcgccgccgtccatgggcgccagcgccggcgccggcgcgggcgttggcggcgcggaggagctcgacgaggcggacgtactggggctcgttcggcgcggcctgccactccagcgccgtgtcgtccgacgacctggccggcgccgccggctgggcgcgcccggtccacggcccccgcgcggggcggaagaagcccgtggacggcggcggcggcgcggtggggtcgctgccgatgaacataccggactggcagaagatcctcggggtcgagtaccgcgaccaccagcacgcgggcgagtgggaggccgacgcggacgacggcggcggcggcggcggcagctacggcggggcggagatggtgccgccgcacgagctggcgtggcgcagccgcgcggcgtcgctgtccgtgcacgagggggtcgggcggacgctcaaggggcgcgacctcagccgggtaagggacgccgtctggaagaggaccggcttcgaggactgagccgatgctgatcccccgccgcgcaggccgccggtatgtgtagtgtaggggccagggtagtagtaagctctttttttttgtttcgttcatgttgatgtgagccaacagtgcgggggtgtgtcattcatatggtgtgatgattttaaggacaccttgagaaaaaagccgaattctgtacagccgatgaaacgttcgatgcagcgcatgcttcgagtctcggcgccagaggctagagagcttcaatgatcgatccgtcgaattactataatggcgtggcgcggtgtcgtaatgtcgttttcccgtcgctgcaggcctgcgcagagcatcgatggcagccagccagtactccttgcgctgcggatccaagtgctgtttccgcgggggcgtgcatgtcacctgccggataaatagatcaaaggcaagcgcggcgcggacgggaccggctagctagttcctgtgggcggtgcgcgcccaggagcgaacgaccacgagcgagtcagtgggcgtggttggcgtcaggttaggatcgtctgttcggaatttggggggggggggggggggggtgcgtgttgcggttgcggcgagcttattggaaccaagatattaccaacacagggcttctaaaaat

SEQ ID NO: 1681 - DNA, 3862 bp, Zea mays
  misc_feature (3690)..(3690): n is a, c, g, or t
tcacgggttattgtagagactctgatgccgaggccccttgtagcggagcttgattgttccaacaaggcagagtcgggagacattaagggcagtacatggtgatgcctcgtcatgtttacagagactccccgtcacttcttcaacgtgtcgtgtcgttggtctagacggtgtttgatgacgaggtgccttatcgtggctgacgtgggccaatagtgtctgcctcgttttcataccgggtaggtacaggcgcatgacgaggagtcatgggactagggtccatagacgtattggtccttgtcgcgggcccttacttctccgactcgtagagttgctcggtagagggttgctcgatctatctgtcttgtagggttgctcgacgtgtccgcctcacaaagttgctcgactatcgacccgttcgccaagaagagttgatcgaggtggcctagtcttttcatccttatgaatttctgcctagctaggccgttattagtggacctactttctcgtcagtgcggttgatccattttcatcccatgacatgaatgtatttgtatttctagtgatttttggagaattttcaaaaagatgaaaatatgtttattgtttataaaaaaaggtgttttccagcggaagtctgtttattgtgctcggttgggtgccctgattgatttatcggccggaaaaaccgatttctcggtataaaaatctcgttcccgctcgtgctcaagcggtatttctcgctacggattttgctgctttccgattctaaattaaagaatacaaaagtcaatatttttagtcaaaactaaatttagtaaaaacgaaaaggtaatccgtggttgggtaatgggtctctgagctcaaggagatgcagcaaacacacaattggaaagcaaaggccaaaacatgttttggccaaatgcctaattcaaaaactatgtgcggtaatagttccactatactgtaataaactataataaactagttagatactcgtactattgttttcatatttcacacagccagactttattttataaaatacaaaaatatgtataaaatacaaacaagtttcgaactttgactcatcatgtatattctttttcatacaactggaaggagaagcgtgaccgtgaaatcgttgaactgcagcggtaaatgcttaatatagtggagattaaagctggttgtttgcttcggattaaggtcatgtttgtttcaatactaaattatataagttagattttggtataagagcaggagactaaaatattactttgtaatcacaaataagttgaaataagctacttaatgctaacttattttagcttatttgtggttctaaagtgatattttactctattattttttccaccataatccaacttatataatttagtagagaaacaaacatcctaaagcggattatttagactacaactataatctatagaaataaaaacaatgtataaacaatagaagtcggtaggaattaagggcctgtttggatccttgtggcaaacaattgctggctaagtttagcacattggcctcaaaacaagcggattagtaaattgttaagagtaggacagtaaaatattactttggaatcacaaataagttgaaataagctacttaatgctaacttattttagcttatttgtggttgtaaagtgatattttacttggtatctttacaccataattcaacttatataatttaggagagaaacaaacacaccctaaaacgagttgtttagactacaactataatctatagaaataaaaatacggtagaaacaatagaagccgataagaattaagggcatgtttggatccttgtggcaaacaatttgccggctaagtttagcacattggcctcgaaataggctgattaataaatttactaattgttagctggagggctggcaaactatttattcattaaccacttgatcttgctatttggtgttaatagatcgtataaagataaaaaaacatctattagctagaactccaaacatactctcgttaactattgctagctaattatttgtaggctaattattagccacctaggacccaaacgaacatgacctaaagccaagcgaaacatgcgtcaaacgatcgccaccgtacaaatccaaatcggatggcctgggacaccccagcatcccgaacccaatcgccttatccactagcgctgccccccggcacgcccccgacgctgggtcgtgttcgctccacacgcgccaccaccagagacctcccgctggttacaccaatggaggccgtcctacggcatccatcgctctcgcgcaccaggcctccgaacctgaaccctcccacaacgccatctccatcccttcatgcaccatctcttctccgcctccgcgcgcgccggctcatcgccgccgcggtgttccaggaccagaagccgaaggagccagcaagcaagggaggtgatgacgaggaggaggcgtacggcgaggtggaccgcatcgtctccagccgcacagtcagcagcccggtgttcgcggaggacggctcggccaccgccgccgtcgccacggagttcctggtggagtggaaggacgggcacgagccgtcgtgggtgcccgcggaggccatagccgcggacgtggtggccgagtacgagacgccgtggtggacggcggccaagaaggcggactcggaggcgctggcggcgctgctcgcggacgagacgttgcggcgggaccccgacgcggaggacgcgcaggggcgcaccgcggcgcacttcgccgcggggctggggtccgaggagtgcctgcgcgcgctcggcgcggctggagcggacgtgggccgtcgggagcgcgcggggggcgggctcacgccgctacacatggcggtcgggtacggccgcgcgggcgccgtgcgcgcgctgctggagctgggcgccgacccggaggcccccgacgggcagggccgcacgccgctggagctggtccaggaggtgctcgccagggcgcccaagggcaacccggcgacgttccagcttcggcaggggctggaggcggcgcagaaggagctggagaaggccgtgtacgagtgggccgaggtggagaaggtgatcgacggccgcggcgaaggcaagtggcgggagtacctggtggagtggcgcgacggcggcgagagggagtgggtgaaggcggcgtgggtggcggaggacctggtgagcgacttcgaggccgggctggagtacgccgtggccgaggccgtgctcgacaagaggcaggcggcgacagcgacggcggaaggggaggacagctgggagtaccttgtcaaatgggtcgacattgaggaggccacgtgggagcccgccgagaacgtggacaccgagctcgtgcagaagttcgagcagcagcagtcggggtctgcaggcggtgattgatggcggcagcactgcaccaccgtcgccgcaggtgatagagattacttgatgaaggtgattgcgttttattcgtcgggtattcaaagcactgcccgggttgtattttaggatgaaacttttgtgagtatcatattttcaccggaattgcagtttcaagccttcccgcttggaaactctcttttttaaaaaaaaaaaaaaaaaactcgagcccggtatgagaattttacatccatctgctagtttggaaatcacctttnatttcaaaggagatttgagtttccaaactagacataactctataaggtatgatggttcttttaaaataatcgtcgacttctagtaatggttcaacaccatagttagattccgtcggttcaacaccattttttttctcaatccacctttaatttcgtatagaagttgacgaag

SEQ ID NO: 1682 - DNA, 1798 bp, Zea mays
atgcctcaaggcctccactgtccactcctctcctctcgtacaaccataccagtgctgttcgttgctctgtacgtagctcttctccaactacgtaacgtaactagctagtacgtgtacgtccagcacttggattggatggctcccctgcgactgcgagcgggagcggcggcgccaatggcggcggccgccgccacggtcgtgctggccgccatacttgcgctgttcggctgctgtgccgctgccgcgtccgccgccgccaccgacgtgacggccgcggcagagctggaccgcatcgacaggctgccgggccagcccccggtcaacttctccatgtactccggctacgtcaccgtcgacgccgccgcggggcgggcgctcttctactggctcatggaggcctccggcgtgccggcgggctccgctccgctcgtgctctggctcaacggcgggcccgggtgctcctctcttggctacggcgctatggaggagctcggcgccttccgcgtcaaccccgacggcgccacgctctccttgaatccctacgcctggaacaatgtggcgaatgtgctgttcttggactcgccggccggcgttggctactcctacaccaacaccaccgacgacctgtacgctgctggtgacaacaagacagctcatgactcatatgctttcttgataaattggttggaacggttcccacagtacaagcatcgtgatttctacatcactggagagagctatggaggccactatgtccctcaattgtcttggttagtgtaccaaaacaacaaaggaattaagaatccaaccttaaacttcaaaggcttcatggttggaaatgcggtaattgacgattaccatgactacatgggcacatttgagtattggtggacacatgggcttatctccgatgaaacttatgcaaagttgtgggaggattgtaaaaatgatgtgtctgagaacccctccgaggaatgccaaaagatttatgaggttgctgaggctgagcaagggaatattgatttgtatagcatctacacacctacttgtaagaagacttcattgcaaaagcgcagactaataaggggaagaatgccctggctgccgagaggatacgatccttgcaccgagctgtacatcacgaagtactgcaacttgcccgaggtgcaggacgccttccatgccaatgttactggaataccatacgcctgggtgggctgcagtgacccaatatatgagtactggaaggattcgccgaggtccatgcttccgatctaccgtgaactcatctcggcaggcctaaggatatgggtcttcagcggcgacaccgactccgtcgtgcccctcacggcgacgaggtactccatcgacgcgctgtctctgccaacgatcaccaagtggtacccttggtactacgacgaagaggttggtggatggtgccaggtgtacgagggcctgacgctggtgacggtccgaggcgcggggcacgaggtccccctccaccgtccgccgcagggcctcaagctgttcgagcacttcctgcggggcgagcccatgcccaagcctgtcgagagcgtccagtcgttctagatgagcttgctgccgcgcttggctagttggctttgatgaatagtaaggccggacatgtggcaagccatctccactccacatttcttcaccacgttttcaataactggcgctggccgaaataataagagcagaacgaataaaatgccgctcgctagaatgatctggctgtgcgtgtttgctttcgagttatttttatataccaaaaaaa

SEQ ID NO: 1683 - DNA, 1852 bp, Zea mays
catatgtccgtgactgggagtaccagacatcaggccctggctccatagagaagtctttctttgtaagttctacttcatcatttctttctttgcaagttctacttcatttctttatgctaagaggtgtaccaaaaggggttcactgaacactattcagtaattattactgacgagcttcaaattcctaatccttgttaggtgaaatgtggagtaagaggtgacaccagcccaggctgcaacgcggttggcatgatcgaccgtagaatcttgggtatccagcatctctacgggcggccagtttatgcacgatccaaggttcttttaatagcatttctgtttcttttcgtcaggagatttctgcctcttgtctatgcgagctctgatttctttttctcctgtggcagcaatgcagcatcgactcgccacaaaatggcccccttcctcctgatgctccctcttggtgccaggcccccttcgaccctgaagggcttcttaggtcagtaaactcttcgtcatttcttgaagtcctccttttgtagatttaatgcaagtcctgcagccatggaaaatgctgactgttgtttttgtttctgctctcatcagttccgtgatggccattgtcacatgcttgattgggctccaatacggacacgtcatcgtacattttcaggtatagtacttgtaaattgcaatcagtttgatcagcaaacctttgaccagtgcaacagcacttaattttgccctctcctgaatctgttttgcagaaacacagggagaggataatgaactggctaatcccttccttcagcatgctggtcctagccttcgccatggacttccttggtaagcactaagcactactagagcgagccaacccgccatgcacacttctgtttcctggtcagcaagaacattaccattgacctgctcgtgttctttgccaggactgcgcatgaacaagccattatacaccctaagctacaccttagccaccgctggcgccgcagggctcctcttctgcggaatctacacgctggtcgacatctacgggtatcggcggccgaccgtcgccatggaatggatggggatgcacgcgctgatgatatacgtcctgatcgcttgcaacatcttgcccatattcatccacggcttctattggaaggagccccaaaacaaccttgtgagttttgaccgatgcatgcagtaaccttcctttcagccagattccagttgatttagtgcaactgaaagtcgggacccggccgattttgtcggcatctaacgagcttcgcttgatggttttgtgttgcagctgaagttcatcggaattggaccatgaggtgatgaactgatgacggacggtacatcgaatgcggatattaggagtctactccgacagagatagagaaacacgtgcattcaggccaagttttgctatacggccaatgcatcattgctgcgcacagagtgcgtctcttgtatatgataaaaagcctgctgtatataatgacgataccgtttggaaggaagaatatagtagtatagagatcttacgtgaatgacggcggaaattctcaccgaagtcgcaaaattgtcacgatagtccgcgcaggggggcgagcgcgcagctccatactgggatagagccactcggctcataatttgttgtgtttagattgattatatgtagaacggagtggttttaagatagaaaattatatttaaatgttcaaccatttagctgctcaaaatctcttgaacggagccgctcccggaacggagccgctccattccaaccggcgccggaaccaaatgctacctacaaaacagttaccagggggatcctctggag

SEQ ID NO: 1684 - DNA, 792 bp, Zea mays
ggatatatatctcggcctcgcacatatcccgttcgccaatctcgcggcgaccctacaaagctgcggtcaggtgtagtcgtgtagagcggcggcggcgtcgtccgcggatcgctgtggtgaagggcgaactgagaacactaggcagccagaggcactagccgagccgcgagtcgacaggaggatcggaggccggcgagtggttggcgcaagttgtcaggggcgtcgccggagtcgagcggcagcgggcggcctggagcgggggcgatggggcgctacgagctcgtccgcagcgacgacacgcctgccatcgccgtggatctggaggctggcaccgccgcgccacgcgacgactaccccaaacgccgcgggtccgcgccgtctccggcgccggcgccgactcggcagcgcctcgtctcgctcgacgtgttccgtgggatcaccgtgctgctgatgatcatcgtggatgacgccgggtcattcattccggcgatgaaccactccccctgggatggcgtaacagtggccgacttcgtcatgcctttcttcctcttcatcgtcggagtcgccctggcgctcgcgtacaagagagtcccggacaagttggacgccacgaaaaaggcagtgctccgtgcactgaagctggtttgtcttggtcttgtcctgcaaggtggttttttttcatggtgttcccactctaactttttggtgtccaccttcaagaaatacgtctgatgggtatacttcagagaattgcaatagcttatctgttgactgccctatgtgaattttgct

SEQ ID NO: 1685 - DNA, 1030 bp, Zea mays
gccaatctcgcggcagcctgcaaagctgcgatcaggactcaggaggtgcagaacagcggtgaagggtcgaaaccgagaacactaggcagaggcactagccgagccgagccgcgccgcgccaccacgaccacgagtcgaccggcgagtggttggcgcaagttgtcaggtgaggggggcaccgcaccttccgcgccgcatcttgtcacgcacttgttgtagctgctgtatcctgtatgtattgcctgccgcccctggcttgtgctcatgggcgctgctgctgcggccaatgaaggggcgttgccggagccgtgcggcggccggcggccgggagcggggccgatggggcgctacgagctcgtccgcagcgacgacgcgcctgccgtcgccgcggatctggaggccggcaccgccgcgccgtgcgacggctaccccaagcgccgcgtgcccacgccctctccgtctccggcgccggcgccgacccggcagcgcctcgtctcgctcgacgtgttccgcgggatcaccgtcctgctgatgatcatcgtggatgacgccggggcattcgttccggcgatgaaccactccccctgggatggcgtaacggtggccgactttgtcatgcctttcttcctcttcatcgtcggagtcgccctggcgctcgcgtacaagagagtccctgacaagttggacgcctcgagaaaggcattgctccgtgcgctgaagctgttttgtcttggtcttgttctacaaggtgtgatggcagctgagctatgtttcttcaactaaccaaaaatacatttgtggaaatgaaaatgtgtttgatgcctttttttttgctgcactacgctctgcgcaggtggattctttcatggtgttcgtagtctaagttttggggttgaccttcaagaaatacggttgatgggtgtgctgcaggtatatgtagtaatgcgtgtttctgttatgagctatgtattttgtccatatggacaacataaaactggtgcttggtaagtatgtaaaaaaaaaaaaaaaa

SEQ ID NO: 1686 - DNA, 4172 bp, Zea mays
gggctcatctcggagccgacatttagtagaagcttgtttcatgtcatgttctatgggagtttaccaataagttagtgtgttgactttttattcaacgcagtggattgtcggatcatgcatgttagtttgtcattgttatcaaataagttagtgtgttgtgtctctattgtttcaagtgtattgtcggatcgtgcatgttagtttgtcatcgtaaggcaataagttggaatgtagcaatcagacgagtgagatcgtacaaacacaatttataacatgaagtttgaacaaaacagtagattgatgctacataggataactagtatattttaccaataacaacattttgtataagatctatcagaagtaaggtgatacactatgttgtcttgatgcgttgtactaaagaccacatcaggacaacatgacgcttaccttagaaaaccattgaaaaggggtgacaatatatcaaaaagggatgagaaacacgcgctgcatggtgaacatctatcttttgattgttgataatgaaaactgtatattttatagtccataagctctaagaggcatacacttcctaactaacctaacggattgatacttatctatagatacatagcccattaggccattttgtcgtacatgttgattgactcctaaataatgttgtagattgaattctcatgatcagattgatttcgtgcacgtgcactatcaccattatcaatcgtgctttatcgtggtaccaatcacacccgttgcgcgtgtctacccactatactaggttgtgtcctaataggctgccaccgtgagccctgctatactgtcacctaaatatgttgggatgtgtccgccctctatgttgggtcacgtcttgatggactatcactgcgactctgcgagccctgctaggtcgccaatcagtcattgtggggcacgcctaagtcatcaatttttctctctctctctatgatatgaaatttactctttttagattgttttaacctttttacgttgacctaattatttttatgctacaactattgcacttaaaataaatttctattgaatctgtttaataaatatttagtatatattcaaattgtttgtatgctccctagtattaaatattcattgttttcctactaaaaataataaatagaacaatatatgcttaaaatcatttttacgtacgaccatttaaggtattgtatggataatttgcatgtctaattgatccgaagttaatttttatgtgataggctatgatcaaaggtagcaaaattggcttcgtagagcttatactaaattgcaagaactacctaatctgagttgacgtcatctagatgtgatatcactcgaaaagtcaattgaaaagtcaatcgttcggctgggaccgatgacacgggtctgtctgtagcttcatgataaagtgaaagctaccacctttctcgggtattacttccatccaagcctaaatatggtgtatttagaatgccccgaataaccaatttttagagaaattttttttggagttgctcttgaaacctcgaggtgaggtggaattgaggttttgaagcccataaactctctggtgatgggcccaggcgtggaagccacaagcccctccaacgttgagcgcaaaactgatccatttgacatgaagcctcacattaggcaggcttaaacttatcttagctccaacaggcctccatgtggccttttcgtgcccacccacacacagcctcagcggctgaggcgagcgtgccgtcgggatttctgcctcccatcccgatcccatatatatgccagttatgatagccaagccaagacattggatcccgaactgtgcatttctttcgtctaagacccgcgcgcattttcgattcgtggccgtttgtttgatgatgaaaccgtaccgtggcccaagtatgaataacggggctgttgcttgcagtacatgatgatctggtgtaccggtagcctgatcgacccatagcaagcagttgcagactctgtttgatgatgaaacagagtgtttgtcacgtgatcgatccaagggcccagacggcgcgacgcgtgcgtacctgccgtgtgcgcaattgtagccaccacggccacgggacggcacgcacaaaaactgtcacgaggaagccagatgcggcggacaagggatcgagtccggagcacgcccgcccggatataaatttatatcgcacacatcccccgttcgccaatctcgcggcggccctgcaaagctgcgatcaggaggtgcagaacagcggtgaagggtggaaaccgagaacactaggcagaggcactagccgagccgagccgcgccaccacgaccacgagtcgaccggcgagtggttggcgcaagttgtcaggggcgttgccggagccgtgcggcggccggcggccgggagcggggccgatggggcgctacgagctcgtccgcagcgacgacgcgcctgccgtcgccgcggatctggaggccggcaccgccgcgccgtgcgacggctaccccaagcgccgcgtgttcacgccctctccgtctccgtctccggcgccggcgtcgacccggtaccggcagcgcctcgtctcgctcgacgtgttccgcgggatcaccgtcctgctgatgatcatcgtggatgacgccggggcattcattccggcgatgaaccactccccctgggatggcgtaacggtggccgactttgtcatgcctttcttcctcttcatcgtcggagtcgccctggcgctcgcgtacaagagagtccctgacaagttggacgcctcgagaaaggcattgctccgtgcgctgaagctgttttgtcttggtcttgttctacaaggtggattctttcatggtgttcgcagtctaagtttcggggttgaccttcaagaaatacggctgatgggtgtactgcagagaattgcaatagcttatctgctgaccgccctctgtgagatttggatcagaggagatgaagatgtagactatggatacgatttgctcaagcgataccgctaccaactgttcgtaggcgcagtcgtggcgatcacatacatgtccctgttgtacggtacctatgttcctgactgggagtaccagacatcagctcctggctccacagagaagcatttctttgtgaaatgtggagtaagaggtggcaccagcccaggctgcaatgcggttggcatgatcgatcgtaaaatcctaggcatccagcatctctacggccgacctgtttatgcacgatccaagcaatgcagcatcgactcgccacaaaatgggccccttcctcctgatgctccatcttggtgcgaggccccttttgaccctgaagggcttcttagttccgtgatggccatcgtcacatgcttgattgggctccaatacggacacgtcatagtgcattttcagaaacacagggagaggatgatgaactggctaatcccttccttcagcatgctggtcctagccttcgccatggacttctttggactacacatgaacaagccactgtacaccctgagctacaccttaggcaccgccggcgccgcggggctcctcttctccggaatctacacgctggtcgacatctacgggtaccggcggccgaccgtcgccatggaatggatggggatgcacgcgctgatgatatacgtcctgatcgcttgcaacgtcctgcccatattcatccacggcttctactggaaggagcccaagaacaacctgctgaagttcatcgggattggagcgtgaggcgatggactgacgacggtacacgagtacggatattgtttaggagtctatttggacagagatagagaagcgcgtgcgttcagcaggccaagttttgctacacggccagtgctgcagctgcagcgcatcattgttgctgcacagagcgcctttctctgtgagctcttgtatatatgataaaaaagagtgttgcatataatgacgacacgatttgaaagaaaaaatatatacataatacagtagtatagagatcttacgtgaatgacggtggaaattgtcaccgaactagcaaaattagatgacattttaacaggtttagtattacagaacagttactagctatttaaatcctttgctctttataatatatatctatatctgtcaaaaaaaaaaaaaaaaagcggcc

SEQ ID NO: 1687 - DNA, 916 bp, Zea mays
  misc_feature (806)..(806): n is a, c, g, or t
  misc_feature (817)..(817): n is a, c, g, or t
  misc_feature (825)..(826): n is a, c, g, or t
  misc_feature (858)..(858): n is a, c, g, or t
  misc_feature (915)..(915): n is a, c, g, or t
ctctcccacagtcccacccggcccccagtgcagaagccggcgaaacttccaagcccaaggaagaaaaaaaaagctgtcacctttaactcgatcccctcttccccgcccgtgtccgagcggcggcgccggagccgacagcttccggcaagcgggggctacttggtgcggcggactatttccgcggttttgtgccacagcgggactgaactgcccgcccaggctgccctgtcagggtcaccaaggttgaacaagactgaactgccgcgcttcagccttcaggatactgaactgccatctcagttaaatgatacactgcacaacagtgggcagcgatagtttgagacacattaacaatgagttgtttttctcactttttcaagagaaaaagggggccacaacaacaagacgatccatctgacaattatttcactggttctgagaatataacaagattcagctacagggaactggttagagccacatcaaattttgaccaaggcaataagattggtgagggcggctatggacctgtctacaagggaacactcaaggatgggacagttattgccgtaaaggttctgtctttacattctagacaaggggcaaaggagtttcttaatgagcctcttgcaatctctgatgtaacacatgagaatcttgtcaaactctatggctgctgtgtagaaggaaaccacaggatccttgtctacaattatcttgaaaataatagtcttgcacatacccctctagattcgcgacacagcaacatccagttcaactggagaactcgggtaaatatcttcatnggtgttgcccnatgattanntttcctccatggcagtttcaacccccacattnttcaccgttacaacaaggcgagcaataaacttcttgataaggatattacgccaaaana

SEQ ID NO: 1688 - DNA, 2012 bp, Zea mays
  misc_feature (1123)..(1123): n is a, c, g, or t
ccgcggtaccccgcggtgacgcgtcccggccccttcggccggcgggtctgggtggggggaccgggcccgctcgctcgcccagtcaacggcttgactgcgcccgcccgccacgttcgtagtactatacaagtacatgcctttgccttccctttcctctcctctcctcctctcccacaggccacagtcccacccgttttgcagtgcggaagccggcgaaacttccaagcccaagggaaaaaaaaagctgtcacctttaactcgatcccctcttccccgcccgagtcagagcggcggcgccagagccggtgccggagctgacagcttccggcaagcgggggctacttggtgcggcgggctatttccgcggttttgtgccacagcggactgaactgcccgcccaggcttccctgtcagggtcaccaagattgaacaagactgaactgccgcgcttcaggatactgaactgccatctcagttaaatgatacactgcacaacagtgggcagcgatagtttgagacacattaacaatgagttgtttttctcactttttcaagagaaaaagggggccacaacaacaagacgatccatctgacaattatttcactggttctgagaatataacaagattcagctacagggaactggttagagccacatcaaattttgaccaaggcaataagattggtgagggcggctatggacctgtctacaagggaacactcaaggatgggacacttattgccgtgaaggttctgtctttacattctagacaaggggcaaaggagtttcttaatgagcttcttgcaatctctgatgtaacacatgagaatcttgtcaaactctatggctgctgtgtagaaggaaaccacaggatccttgtctacaattatcttgaaaataatagtcttgcacatacccttctagattcgcgacacagcaacatccagttcaactggagaactcgggtaaatatctgcatcggtgttgcccaaggattagctttcctccatggcagtgtcagccctcacattgttcaccgtgacatcaaggcgagcaatatacttcttgataaggatatgacgccaaaaatatctgattttggtctggcaaagcttctacctnccggatgtatcacatgttagcacaagagtcgcagggaccctaggttacttggctcctgaatatgcaattcgaggacatgttacacggaaggcagatgtctacagctatggcgttctgcttatcgaaattgtgagcggaagatgcaacactgatacgaaattgccctatgatgaccagattctccttgagaagacatggagatactatggtcgcgggaatctggagaagatcatagacagctcccttggcgacgacctggacgttgacgaagcctgcaggtttctgaagatcgggctcctctgcacccaagacggcacgaaacgccggccgggcatgtctgcggtggtggccatgctgagaggcgaggcggacgtggacacggagacgatcagcaagcccgacgtgatcagggatttcggagacctgaagctgcggagcagggccacgtcgtccacgctgctgacctcgatcatggcgcggtcgtccccgctgtcgtctgaggagacgacgcgcacctccatcaccttcaccgagatatcggagcgcgactgactgacgatcgccgttaattcgccgacaagaagtgggctgtgagcctgtgaccgtgtagctggaggagcggaaagtgtacgtagcataggccggggagaattctttttgctggttttatgtgatctgtgtgcgtatttctatattacaatcgcggtaggaaacggcgcttcaaagactatccacgtcagcttctaatttatcatccgttggatactacatcaacggcaaagcgcagcagccaaaaaaccaagtgctgaccatcagtctggagacttccacaagctccacgaaacaaaccttcggacccttcatcctcgccttttcacgcgctcagatc

SEQ ID NO: 1689 - DNA, 5060 bp, Zea mays
ctgcagcagcagcagcagcagctgaaggcgacgttacgttactacacggtgcgtgcggaggcgagcccgccggatcgcccgcccggcattgaagtgtctcgtgccccctacagtaaccacgtgtcttgcttcttgcctgcgcgttctgccggcggcacaccacaactgcatgcacgtcgattggcacggacgtcaatggcgcggcgcccacgggtttctttttttcctttttgctccatgacccatcagagcgtcgtaatatgtgacgacgatggtgcatgaaacaaacaaggcaggcaggcaaggcacgctgcacgcctggcggcaacagccatccctgccatcgtcgtcgtggacgggaaagagagcaacacaggcaacgcacgctggttcccccggcagcaagaaatacaaaaaggcagcagaccagagcatgtcgtgcttgccatggctccagcctccaagcagcaccccgaaagtgcccatcactttgcttgctttcctgtccctttttttcccagaagaaatatataaaaaatttcgtccacctgcaactctcctgtcctgcaagagagtgagtgagcactactctatctctatgctgcgcgcctgcgacgagaggagaggaggatgggctgttgctgttctgtttgttttactactactatactactagtacaaccacccctgcctcccgtctcgttttccattccttgtcttccccgcaccgcacccgcatccgcatgcaccaatcgccaccagcgaccgccccgcggctgtgcctgtgggtgcgcgcgttcgttgtcccctccacgtccaccggaaagctacgcctcccccaccgcctcctctagcgtctcggcccgtctccctctcactctctctcgctctcgctctctctctccgtgggtgatgcgctcagccgacctcttctgaccggcggagtggctgcgctcgccggtcacccatggctatggcgggcgccggcgcggcggcggcggcggccaagaggtgcatgaacccggcctgcggcgcgctgccggcgtcatctgtggtggtcggggcgggaggggactggaggaagggctggccgctgcgatccggaggcttcgccctgctctgcgacaagtgtgggtacggccttcctcctcctccctgcccactctgctgcttatccgactcctatgcgccgtcggcgcctcctgcggctagactcccgaatgggggggcacctcgattggatggatggatcgcttcatgccgttcggcttctcatccccttttgcgtctcgatgctttgccctcccccctcctttccacttccttttttttagacaatatatacagaggaaaagaggacgtgatttcgtacgagtacctacctggctacctgctaataaaggcgcggcgatttgcgcatcattcgtcgccgtggattccctagcgaaacgccgaaacccaacaacatactacaagcggatttatgcggaaattcggaaaacgtgccgtactccggaaagctgcgttgactctgcctcgtttgctggagtgtctgggtgggtcgtggaattctgaccgagcgatttggtgccagttgttggttcacggccctcgagctgcaatcgacaattccgtcagtagcccaaggatccggttcatcgttgctgctttgcttcatccttctctctctcagtaaagccttgttgtttaattcctactagattggcccgtaatttatattgtgtggtttctggtgcacctaggttggcatatgaacagttcgtgttttgtgatatatttcaccaaaaggaatcaggatggagagactgctcattttgtggcaaggtgaggtggcgactcaagcctgcaaattctgctatgagatcctctgcaggtcggcgctggcggagcccgtggtgactttgtcactcatgcggtcgactgcagaggaatcgattctgcaaattcttgtgatgccacagtgttcttatgaaactctactgtttcagcgcctccattgtggatgtgttgcttcaaagaactcttatgatctacttgacagtggaggaattcaatgtgtcacttgcatgaaaaattcagcagctcagtctgtaagtcccttttttgtcacattattcacctttacttttcaaatattctgattatatttttctacaggcttctggacaagtggttccaaagctctttccatgtccaaacaatctgctgttttttggtaaaagcgacgagttattgtcaagcagaaaatttgaacaaccaccctctcttatgttggattccagaaatgatgatattgctattgtaaataagagtagtcacctgttcatggtaagcggcatagaggctggacagagcagtaacatcttgagacaaaaagagatagagaatggtccaaggcagattaaatgggaacaaccaacccttaatattggggacatgccggcccctccgcgaactaggtctcaaagtgcattagagtcacctcagtgtactcgaagagatgacaataaggatccaactacagatagcacaacaagtgaatcgtttccagaggcatgtctgagcatgaacctaggtattgcaaacaatggaaacaggatggaggctacttcaacagcggaaagacctatgctatcgccaacgacagccattgctgaaggaagagaacttgccactgcactgtccccctttcagcacgcacaaagggctcggcatttcctgaccagaccaccaagggttggtgagggtgcagcttttgatccaactagagacatgtttccgcatcttcgtgttgctaggccacctgctgaaggaaggggccgcaatcaattacttcctcggtattggccaagaataacagaccaagagctgcaacaaatatctggagattcaaattccacaatcgttccattgttcgagaaggtcctgagtgcgagtgatgcaggccgcatagggcgccttgttcttccaaaagcttgtgccgaggcatattttcccccaatttctcaaccagaaggacgccccttgacaattcaagatgcaagaggaaaagaatggcattttcagtttaggttttggccaaataataacagcagaatgtatgtcttggagggtgttacaccatgcatacaatcattgcaattacaagctggcgatacagtgacctttagtcgtatagatcctggagggaaacttgttatgggctttcggaaggccacaaatactgtcagtctgccagactcacagatttcagctattgcgaatggttcccttctcagtgagacactcttttctactgcaaatgagagcataggagtagtaagtggttatcctggatttcttcactcaataaagggagctgcagatttccatccaagctctctatatgatcatcatatgaactcagctgacggggatgtcagttggaataaggcagataaatttggcagcaggccagatgaggggtctttgcaatttctacaaaaacgaagtcgcaatattggttccaaaagcaggaggttcttaatcgacgctgaagatgccatggaactaaagcttacctgggaagaagctcaagagttgttgcgccctgctcccactgcaaaaccaactgttgtgatgattgaggactatgaatttgaagaatatgatgaaccccctgtctttgcaaagagatcaatttttaccatccgtgcaacaggggaacaagaccagtggattcaatgtgacgagtgctcaaaatggcgccggttgcctcttaatgttattgttgcatccaaatggacatgcaccgacaactcatgggacccaaaatgctgctcctgctctgcgcctgaagagttgaccccaaaagagttgcaaagtgttatgcagcagtatgaagaaatgaggaggcgaaagggcagctatggtctgaagacgtaccccgcggggctcggcccggccagctttgacgccttggccacgggtgcagtattcggtgaagtcgggaaccaaggtacggcttcagtcgcgacgaccacaaggcaccccaggcatcgccccggctgcacatgcatcgtgtgcatccagccacccagtggcaagggcccgaagcacaaccctgcgtgcacctgcaacgtgtgcatgacggtgaggcgccggttcaagacactgatgatgaggaagaagcagcggcagtcggagcgagaggaggcggaggcaagcaagaagatcgcgtgggtgaacagagacgagcccgaggggagcagcctgtcgagatccccgcagacgctggacacgacccgagacagcagcgatgtcaccatgttcgacaaggtggccgccgacgtgaacaaggggcacatcgacctcaacttccaccctgcagcccctgccgtccgtggcgctggcgaccagggacagaatggcgcgcagcagccccgggcggtgagcatgatgggcctcctggaagtggcgaaccggccccttgataactacatgaagcagaacggcctgacgagcctggcgggggagcaaggaggtggcagctccagcacggccacggtcccgccggctccagtggagagtgaggaccggacgtccgatgagggccgtgtcgcgtcagcagagcgggaagcagacgccatggccatcgacgaggccggcgagaaccagcaggacaagcctgccgactctgccgctgccgctgctacttgacggcgtgcgtctgttgtgaaagtgactgatgggtgttgtcagcgtgctttgatgtgcgtatcttatcggctcctcttggtttttttttcttttctttcaggaatagctggtgagtttttgatgtgaaagttctaaactaaatttctgtagggtttcaaggtgttgctcctggaggctggagttacttacgtgtacgtcgtgtacgtatgaggctgtgcaaccaacccccaggttgtatgttgtagaagttctgtaaaccacgatgctcttgtgttggttgctgctgtaatctaaaaacgcttagacctttggattcaataactcaccacatacttgatctg

SEQ ID NO: 1690 - DNA, 1119 bp, Zea mays
aagggcagttatggtctgaagctgaatgtcgctgaaatggttttctttttctttgacgccttgggcacggggggggtagggggtgaagtcgggaaccaaggtacggcttcagtcgcgacgaccacaaggcacccccggcatcgccccggctgcacatgcatcgtgtgcatccagccacccagtggcaagggcccgaagcacaaccctgcgtgcacctgcaacgtgtgcatgacggtgaggcgccggttcaagacactgatgatgaggaagaagcagcggcagtcggagcgagaggaggcggaggcaagcaagaagatcgcgtgggtgaacagagacgagcccgaggggagcagcctgtcgagatccccgcagacgctggacacgacccgagacagcggcgatgtcaccatgttcgacaaggtggccgccgacgtgaacaaggggcacattgacctcaacttccaccctgcagcccctgccgtccgtggcgctggcgaccagggacagaatggcgcgcagcagccccgggcggtgagcatgatgggcctcctggaagtggcgaaccggccccttgataactacatgaagcagaacggcctgacgagcctggcgggggagcaaggaggtggcagctccagcacggccacggtcccgccggctccagtggagagtgaggaccggacgtccgatgagggccgtgtcgcgtcagcagagcgggaagcagacgccatggccatcgacgaggccggcgagaaccagcaggacaagcctgccgactctgccgctgccgctgctacttgacggcgtgcgtctgttgtgaaagtgactgatgggtgttgtcagcgtgctttgatggtttcaaggtgttgctcctggaggctggagttacttacgtgtacgtatgaggctgtgcaaccaacccccaggttgtatgttgtagaagttctgtaaaccacgatgctcttgtgttggttgctgctgtaatctaaaaacgcttagacctttggattcaataactcaccacatacttgatctgtactgtacatctcatctaagacatcttttggaaaacaggaatttcacaggagtcaaaaacaaacaaaaaaaaaaaaaaaaaaa

SEQ ID NO: 1691 - DNA, 945 bp, Zea mays
cttgcctcggctgctcctctccctccccctgcttggcttcgctcgccttctcagccacgccgccggagcgagaggaggcggaggcaagcaagaagatcgcgtgggtgaacagagacgagcccgaggggagcagcctgtcgagatccccgcagacgctggacacgacccgagacagcggcgatgtcaccatgttcgacaaggtggccgccgacgtgaacaaggggcacattgacctcaacttccaccctgcagcccctgccgtccgtggcgctggcgaccagggacagaatggcgcgcagcagccccgggcggtgagcatgatgggcctcctggaagtggcgaaccggccccttgataactacatgaagcagaacggcctgacgagcctggcgggggagcaaggaggtggcagctccagcacggccacggtcccgccggctccagtggagagtgaggaccggacgtccgatgagggccgtgtcgcgtcagcagagcgggaagcagacgccatggccatcgacgaggccggcgagaaccagcaggacaagcctgccgactctgccgctgccgctgctacttgacggcgtgcgtctgttgtgaatgttgggtgttgtcagcgtgctttgatgtgcgtatcttatcggctcctcttggtttttttcttcttttctttcaggaatagctggtgagtttttgatgtgaaagttctaaactaaatttctgtagggtttcaaggtgttgctcctcctagaggctggagttacttacttacgtgtacgtatgaggctgtgcaaccaacccccaggttgtatgttgtagaagttctgtaaaccacgatgctcttgtgttggttgctgctgtaatctaaaaacgcttagacctttggattcaataactcaccacatacttgatctgtactgtacatctcatctaagactcttttgg

SEQ ID NO: 1692 - DNA, 3451 bp, Zea mays
cgaatactgagaccaaacaacttttagcagtcttccagcgtcacagtcatctcgctgcaaggaaggtaaaaagtgtgagtcttttgccaccacttatgagaacacaaacaaataataaaacataagtatgaaaataaaccagtaactgtattgaaaacaaattatggatgacgttatctgtcgactaaagccgtcaacgttgcaggattgaatgtcggtaatccacaacaaacctgaaacgatacgacgtttaaactagccttctatatgagaagagtgtactctggaaccggtgggtccgggtccggtaatgggatcgggaggcttgcttctagacagacctactgtatacttatcttctgttatcgaacttttagagaacgctttatcaacatcggagaatatgacttcctcaaatgttagtatatggatgggtatttgttagctcaatcaatacgtcatattagtcctatgaagaagacgtcttaaatgctctcttctatattcctcaaataaatattgcttgtttcttttttgtaagaaaagactcttcttcgttcgtcatcagcgacgacggtatcaggggtgcagggacgaaacgaacggctgtggtgagatggcagcagcggccgttgaccgaacccccgagtcttttagaccattgcattggcatcccacgatgcatgccatcatgtgcttacttaagagccaagtttcgatatttttttacactgtatttatttatacatgcaaattcatgtcatcatattttttatttgtttgttatcagatcctaaaacgatttcgattttcgattttttttttttttttccggccgaaacgtccgatggattaccactatccaccagtacatatcaacggaccagaacgctgttagagaaggatgtagtccaaatccctcgccaagaaaccgcggctcggcggcatggcgtctggcggcggcgctgtctccaacaagaggtaccgacaggtcagcagctgcacgggccacgacgacgacagctgcgggacgagccgccgcggcaagacatgcgaagcagcccctagatccggccgcgaccacgacgacgacggagagagcgccgatggcgatggctctcgcgggcatgcccaggaaacggctgacgacggcagcagctccggcgacgaggattacatgttcgagtacgacgacgacgacgacgacgactgcgaaggaggagccgagcagacacaggccgacgccgcggcgtgcgacggggagcagaggtacgccgttctgaccgaggacgacgtccgcgcgcggcaagaggcggacaccgccagggtcgccgaggtgctgtccatcccgccgggcttcgcggccgtcctgctgcgccacttcaagtggcgcgtcgggcgggtccaggaggagtggttcgcggacgagcggcgcgtgcgcggcgccgccggccttcccccgggccagctcgtccccgcggcgcgcggcttgcggccgcgcgtctgcgccatctgcttcgacgagcagcccgcggggcagacggcgtccgcgggctgctcccactactactgcaacgggtgctggcgcgggtacgtccgcgcggcggtgggcgacggcccgcgctgcctgtcgctgcggtgcccggacccgcgctgctcggcgcccgtcgtccgggagctcgtggacgaggtgctggcggcggacgacgtgggccggtacgcgcggttctggctccggtcgtacgtggaggagagcggcgggagggtgcggtggtgcggcggccccgggtgcgcccgcgcgctggagtcgtcgggcggcggtgacgcggcggcggacgtgttctgcgtgtacggtacggagtctgctgggcctgcggcgaggaggcgcaccggccggtgtcgtgcgccacggtgcacgcgtggctgctcaagaacagctccgactcggcggagacggccaactgggtgatggcgcacaccaagccgtgccccagatgcggccgccccatcgagaagaaccagggctgcaaccacatgcggtgctcgccgccgtgcggccaccgcttctgctggctctgcctgcagccggcgggaggggagaaccactacgcctgcaacgacctccgcccacatccgccggccgagacgggcgtcgccggcgccggcgccgaggagaaggaggcgaggcggttggccagggcgtcgctggagaggtacctgtaccactacgagcggtgggtgtcgaaccgcgcggcgctggagagcgtggccagggacacggcgacgctggagcgcggggagctggagtggatggcgagggcggcggacgtcccggccacggagctcgggttcgtggccgaggcctaccggcaggtggccgaagggcggcggatcctgcggtgggcgcacgcgtacggctacttcctggacccggagcgcgacgtcaccaagcgcgggctgttcgacgacctgcagaaccaggccaaccgctggctcgagtgcctgcacgcctccgccgagctggagaggaaggaactcttcggcgccggcggggaggccgcgcccgtcgacggcgatgcgttcagggcgtacaggcagaaggtggccaacctcaccggagtcacccgcaagttcatagggaacctcgtgagggctttcgagaccgacctgtcggaggtggtggcggtcattccggccaactagctagagatactagactgtattccggttaccatccatgttcgtgtttcttgcattgatcggaagaagaagaaccttgcatattgattgatctgaacaacatcgcaccagcctgccgattactttactagtatttataaaacttcataaatataaaattatctttactacattcatttattttgagactgattaaacaatgctcgtggacggagtttcctcagcgtatactccatgctgccaggcttccactggtgccagtgtcaggtctcgcctgcacgtggcggatccaacgtgcccgcgtgtcacgctagggcagagccagtgtggtgcggccccatgcctctgcgtctcactgggccaaatgtaggtggaatggtggagcgacacgtggcagatggaggtacgcgatcataaaacgcaaactgatgatggcatcttaataaggatagatagagagagatttctttagaggacatacaattttctcaaaatttgatatgggctctataatctctctcttgggctgccattcccaaccctcaccccattcaagttgccaaggaaaaaaaagaaagcggccttcaccattttacatgaaaaaaatgattaagttgtgagatttaacttgtctcatatatttcctcacagtctcggaaccttcggaaggaagggataaaggaggtaaaggagaggaaggaaaaaaacgaggagaaaaaaaatgagaaagaatagaagggaaaaaaagaag

SEQ ID NO: 1693 - DNA, 2365 bp, Zea mays
  misc_feature (845)..(845): n is a, c, g, or t
gctggctcgagtgcctgcacggctgcgccgagctggagaggaagcacctattcggcgctgccgacgccgacgccgaggacgagcccaccgtcgccgccgccgcgttcatggcgtacaaggagaggctcgccaacctcaccggagtcacgcgcaggttcatcgggaacctcgtcagagcgttcaagaccaacctgccggaagtggtggtgacgctgacgccgccggcatccgacttgcaacacatagtgaagagtggaccaacgacggaaagacaaacggttggcattggaggcatcctttctacagcaactgtgacaccacctgtttccaacgtgtcttctttacaagggacatcagcactgcgaccttcatcgccgtctctactagtctcacaggaaacggacattgcaaatgatagcgtgcaggaacgacacgagccctacaagaaaccttgcccaggcccagcatccagttcgtcctggcggtcatggcggcttcctcagcaatccatacccgagtttctttggagaggctacctcaaccgcgggaccattgcaactctacatgccaaacatgcgtggtgtcaggtggcacgacatcgacgccctctctcgccttctctctgtctgcgcctggacagcctattacgagcacagctcttggcggctcctttggctcaaacactcgcactgcatggggcaattcagatatggctgctgcgtcgtcctctcagcctgaccgcatgggcatggatcaacaagcaggaaccggttctgccatgaatctgacaattgggctgcatcccaatgcccagcagccaccaccaaaatatgtcaaaatctggngagggtgacttatacgggcaaaggcaagggcagcctgtgtttattagtaaactcgaaagttggggtggaacagtgtccagaaaagttgcagaggattggccagaaactatgcagattgttcgcctcatagcccaggagcatatgaacaagaaatattctgaaagtcaatacgttggaaacacagactttctaatatttcgggctttaaatcagcatgggtttcttggacaactacaagagaggaaactgtgtggtgtgatacagttaccgtcgcaaactctactactttcaatgtatgacaaaacaagccgtatggttggcatgctcttccctaagaacatgctgatgttcaggccagaggccttaactcagccatcaccagtgcagcaggaagaacttatacaccaccaacaacaacaactacagcagcaacagagaaacatacatcgtcttcaacgacaactcatacagaagcagcagcagcaacatatgcagaagctactaccacaacgacttcaataccaagagcagctacatttacagcaacagatgacgcaacaaatacaacagcaacaacaatctctataccagcaacatcaacaaatgcagcatcaacagcaactgtggcaacaaatacaacaacagaagcatcagttgcaacacatggatccccaacaacaacagctgttgtctcagatggtgggtacagaattaggcagtgatgatgacacaagggaagattgggtcacaggggctgggccgcatgcctagggaatcagggagggttaatgagggcttacactcactcacttgagggttaagatgtttcctagtgtttgtcgttaaatcattaactgataacttcaaaaaaataaaccagtcatttgtatagttatacggatggggtaagagtttaaataacaccgttatgttatcgaatagctagtatattgtatagagctgggagaaagaaaaaagaaacctccccatgtttcttcaccaaaatctttaatcatcgatcaaagatcggtaatccagtgatgcactggctcaggacacgcttaacgcacaccaccttcttggaagctgcagcctgcagatgagctacaaaacgggcaggtcgtcgatgttggtccagtgaaggaaactgagcaatttaaagttacaaaccatttttttattcaaattaattcacttcttttgaaacaatacaaactccaaacaacgcaaatagagagagagagaaaagggaaaagaaataacatctgcaacttgcgcgagcattgttgggcttccacgagcataacagcacggcatctctgttcgttctagaaacacaagaccacatcaggcttctcctgcttccacgtcacatcgaccagcagcttcccgccacttccccattcaaatccagcctcgcagccatccaacaagcaattatgcgttgctaatcaggaaggcactgatgaggagcacagtttttactcttactatactctctttttgcactttatactttt

SEQ ID NO: 1694 - DNA, 6378 bp, Zea mays
gttgttgcattatctataaagtttcaaagttaaatccgttatactttagctgtaatacaaaatatgtaataataatttgaacttgaatttttttatataattggatcaagttggaaaaaatatgtataattttttagattttgtcagtttatgtacaacatatatgcaccaaagtctatacgatatgttcttttaaataaaacatctctaatgatagaaacccctgggcgctctggttttctttttcggatcttcgctctcccggcgcaccgcccatcatcagttcgtcgccgcggtttaaaaccttttcatttcacggcttcccctcccactaggccactactgctactgccccacccttgggtgagctccgcctataaatgacagccccgcctccctccaagttcaaacgcacgctgcacgctcgcaggcggccgaccgtggcccccaccaccgcctgccgccgccactgcccccctctccactcgggatcccgtcctatcgcggccgccgcaagccataatggtgagggggctggggtcgaagcggagggtggcggaggaggagtcctcggaggaggagtacgaggtggaggtggtccgcgaccacatcgcctcctcccgcggcagccgcctcgcgctcttcggctccgagctccgcctcggccgcttccgcccgcgccgccgcaggcgcctcccgctcgccggggaaggcgccgccgagggcttcttccacggcctcgtcatccaccccgacaacaagtacgtgatcgacgccgttcccaccccgcgacctcgttaataatttgctttcgaagcttccggtttcgcgcgcgcgatgcctgttgcttgttctggaagctgccgccggcgaggtccgacgcggcgcgctagatcggtcggcgtaggtccgatcgtatggctcccgcgaatcgccagaactgatcgtgtgatcgatcacgaccacaaaaacccaatactactattttatataaaaacttcgtcgtcatctgcgtgtactatgtttttggtaggtaattaccacccactaatgccccgggcagcaggggaatgtgaatctcccggccggaaatattccttattttttttctatttgaagcttttggtctgatcgatctgacgttcgtgttgtggatcactacgcgcgcgacatgaagctgacggtgaacagatcgagagcgtgcatcatatcagcatcccagtcccagccgcgaatttctcgctacgctttagttgtagttgataatgagctcgccagctacgcaaagctactagttggacagccacccccggtcacggggtaggctttgacggccacacgaatattatccttgctttaattcaatcactgcacgctgctagctattttttcggcacgaaattactttcttttttttcaccctttttcgtttctgaacgcagagtttaattttgccacctatatagtcactacatatagccaaataaggatcagcaaatatgcttcctaggatccacacggcacaagaataatgtttgctagattgtacatattattagaattgattaatgcaaccatgtcaacctgtgctttacaatatcggggctatcagcatcggttttacatgcgtgcttagatgttaccaggaaaagatcaaccattatttataactctaatacataatgaaacgctcagtctgcatgcttatcacaatcaataggatacctatagtacgtagcttataaaagcacccttcctcatatatgaaggccaaccaggtgtacgggcaacaactgcggaggctaagcactccgagtttgatttggttacctggctgatctggacggatgggtttaaagaatccatcttcatcagcatgccaggagctgtttcggactcttaccccggtagtttatccttggctgatgacgaagcatctgggttatagctgtcttgatgcacagatgttccttgacagctacgctattccggttgattgattgggacttccgcggttccggggttagcggcgacccgcccacataataatcaaatccgagttagcgcgcatattttggagtttcaccacccaccccatcatcagcgtgacatatgttatatgaatatatgaggccaattgtttgtggattcgtttcttctttatatattcaggctacttactaattagctcagtacttgttagaattactcaggctacttaccatcagcatgacaccaatttttttatctgaatataatcggcatgacaacatcaaaatgtaattttctgttcaacggtaaattcgattccttgcttctttggctccttatcccccccccccaccccccacccccttttgtttttgctaatggttacgagagacaatatatattttgtcaactgggagcctgctttacctaaatatcagaaatggcgaggcactatatatccagttacctaaatcgattggtccattggtgtggctatcaccttgagctcctccatggatatagcactgaaacttaccttgtacaatgttattgatgctaactcatatacaatcgtatggtgaaatcttgttactgccttcatcataagtatgatacacgttactgaatctgtgaaaaaaattaaattactttggagtttccttcaggtggtaccggttatggaccaagttcatactggtttgggcggtgtacagctccttcttcacgcccctggaattcggcttcttcagaggcctccccaagaacctcttcttcctggacgtagctgggcagactgcattcctcatcgacatcgtcgtcaggtttttcgtggcgtaccgtgacccagacacgtaccgggtcgtctacagccccgccgccattgcgctccgctactgcaaatcgagcttcgttttcgaccttccttggttgcctcccgtggggacgctatctacaaggtcacatgatgcacactctcccttccttgccccccagctagaaaacctccatctcctaaattaactatcccattcccatgatggattccgttccgtcacacaggcttgtgggagcaaagaggaagtaaggtacctgctgtggattcgcttgacacgggtcaccaaggtcacggagttcttctggcgtttagagaaggacatacgcgtcaactacctcttcaccaggatagtgaagctcatagtcgtggagctctactgcacgcacacagcggcctgcatcttctattacctggctacgacgcttcccgaatccatggaagggcacacgtggatcgggagcttgcagctgggggactacaggttcacacatttcagggagatcgatctcgccaagcgctacataacgtccttatatttcgccatcgtcaccatggcaaccgttggtgagaaactatgaataatcggcatcctggttttctttctttctccactacaggtcgccagctgttaattttttcccctcttcaggctacggggacatccatgccgtcaacatcagggagatgatattcatcatgatctacgtgtccttcgacatgattctaggagcctacctgatcggcaacatgaccgcgctcatcgtcaagggctccaggaccgagcggtttagggacaagatgaaggaggtgatcaggtacatgaacagaaacaaacttgggaaggaaataagggagcagatcaagggacacctgaggttgcagtatgagagcagctacaccgaagcatccgtccttcaggatatcccgatttctatccgtgcaaaggtacagtttttcttatgcttttttccatcctcctgtacgttgcagctggtgcgtgatgaattgtttcgcgcctgcagatttctcaaacgctgtataagccatatatcgaaagcattccactgttcaagggatgttccgcagagttcattcaacagattgtaagtgtcatctctttcatcccaactagctatgtgtgctgaatgaactacaaggtaggaagaactccagcagggtaccttgttgtgatattgttctcaatcccaagatttatcgtctgacatgttctgctgtaaaggtgatcaggttgcaagaggagttcttcctaccaggagaagttatattggagcagggaagtgcagtcgatcagctgtacttcgtctgccacggtgcactggtgagctcccatgaaaaacagctgctcttctgtaaccatcttatcttatgcttgggacatgttcttcttgtctgcaggaaggtgtaggcatcggtgaagacgggcaagaggagactctgctaatgctggagccagagagctccttcggcgagatctcaatcctctgcaacatcccgcagccctacacggtccgcgtctgcgagctctgccggctcctgcgtctcgacaagcagtccttcaccaatatcctggagatctacttcgtcgacgggaggaggatcctgagcaatctctccgaggtacatacatacatagcctcagacggccccattgaatcgaatcctctgcagtggagtggatgatgtcccctgacgtgacgcgttgatttgtgactggctgggctgggtgcagagcgagtatggcggacgggtgaagcagctggaatcggacatcacgttccacatcgggaagcaggaggcggagctcacactgcgggtcaacagcgccgccttctatggcgacctgcaccagctgaaaagcctgatccgggcaggggctgatcccaagaacaccgactacgacggccgctcccctctggtacgagcgaaatgcctcttgtcatccgcagacagtaagcttcaagattgtgatgtgatccgcgttttcctcgcagcatctcgcggcttccagagggtacgaggacgtcgtgcagttcctcatcaacgaaggcgtcgacatcgaccttaccggtacgagcgaaatgcctttgccatcatctccccgttatccagtttctttcttttctagaattcattattgctaccagtttgattatgctgacattttttcttcttcaccagaccagttcgggaacacgccgttgctggaggcggtgaagcaggggcacgaacgggtggcagcgctgctgttcgccaagggtgcgaagctgagcctcaagaacgccggcagccacctgtgcacggcagttgccaagggggactcggacttcatccggcgcgccctggcctacggcgccgacccaaactgcagggactacgaccaccgcacgccgctccacgtcgccgccgccgagggcctctacctcatcgccaagatgctcgtcgaggccggcgccagcgtgttcaccacggacaggtaataatagcatcaaagcccccaagctcgtactcgtactagtttatagattataatgcgttttttttttttgcggtgtaacaacgcggccgatgtgtagtgcagatggggcaccactccgctcgacgaagcgcgcaagtgcggcggccgcacgctgggggcgctgctggaggaggcgcgggccagcgagctgtccatgttcccggagcgcggcgaggaagtcagggacaaggtgccacccgcgacggtgctcggtgttcccgtaccacccgtggcgggcgagcgcaggcgaagagcggcgcgcggagggggtggtgctgtggatcccgcacaccatcgagagcctggtcgcgtcggcgcaggagaagctcggcttgcctggcccggcggcgtcgcggctgcggctgctgtgcgaggacggcgccagggtgctcgacgtcgacatggtcaatgacggccagaagctctacctggtcggaggcgaggacggcgatcaggaaggtggtcagtagattgggcatccctgtgtggcatttgcatgctgcttttttttcaaccttgtatgccggttgttgtttttttggctatatatacgtgtgcagtagaagaaaatgtaatcaagtccatcatccgtgctggacactgtacagaactacaaattgggaataatgtaagatgtgaaatgaaaatgcgaaaaaaaaaaaaaaaaaaaaaaaacgtcgacgcggccgcccacctctatctgcctcactgccgtcggagctagccagtgggatgctcgcgcggctcgcggtgaaggcgagacgattcggccggctatgggctcctgcgcggcgtcttcgccagcatccgtgttgctcgaatgttgttggctggcggaggccttgggcgaggtggtcgtgctagggctttggaaggccctgttggaagtggacggtcctagcctctgcgtgccgttcgggttgggcctagccgtcttctccagcctcaacttgggtagggaggtggctgccgtcgtcgaaaaaggggtctgtggcagccatggccacgtctgcag

SEQ ID NO: 1695 - DNA, 1278 bp, Zea mays
attcggctcgaggacaagatgaaggaggtgatcaggtacatgaacagaaacaaacttgggaaggaaataagggagcagatcaagggacacctgaggttgcagtatgagagcagctacaccgaagcatccgtccttcaggatatcccgatttctatccgtgcaaagatttctcaaacgctgtataagccatatatcgaaagcattccactgttcaagggatgttccgcagagttcattcaacagattgtgatcaggttgcaagaggagttcttcctaccaggagaagttatattggagcagggaagtgcagtcgatcagctgtacttcgtctgccacggtgcactggaaggtgtaggcatcggtgaagacgggcaagaggagactctgctaatgctggagccagagagctccttcggcgagatctcaatcctctgcaacatcccgcagccctacacggtccgcgtctgcgagctctgccggctcctgcgtctcgacaagcagtccttcaccaatatcctggagatctacttcgtcgacgggaggaggatcctgagcaatctctccgagagcgagtatggcggacgggtgaagcagctggaatcggacatcacgttccacatcgggaagcaggaggcggagctcacactgcgggtcaacagcgccgccttctatggcgacctgcaccagctgaaaagcctgatccgggcaggtgctgatcccaagaacaccgactacgacgaccgctcccctctgcatctcgcggcttccagagggtacgaggacgtcgtgcagttcctcatcaacgaaggcgtcgacatcgaccttaccgaccagttcgggaacacgccgttgctggaggcggtgaagcaggggcacgaacgggtggcagcgctgctgttcgccaagggtgcgaagctgagcctcaagaacgccggcagccacctgtgcacggcggttgccaagggggactcggacttcatccggcgcgccctggcctacggcgccgacccaaactgcagggactacgaccaccgcacgccgctccacatcgccgccgccgagggcctctacctcatcgccaagatgctcgtcgaggccggcgccagcgtgttcaccacggacagatggggcaccactccgctcgacgaagcgcgcaagtgcggcggccgcacgctgggggcgctgctggaggaggcgcgggccagcgagctgtccatgttcccggagcgcggcgaggaagtcagggacaaggtgcacccgcgacggtgctcggtgttc

SEQ ID NO: 1696 - DNA, 749 bp, Zea mays
gtggagtcatacttcgttgctgaaacgacgatgcccgaaagatctgggttcgatttcaacgggtcatccccgccggcccccgcgcggccgtcatatttattcggtaagaatactgccttctgagcaaatggaaatgacaacacctgtttttactcggaagggtgagtcaaacggccaatcaatggacatgacgaccccagtgataacaaaaaagtcagctggtacaaataaatggaaaatgtcatttgtgatgccagcgaagtatggttccaatttgcctcgcccaaaagatccttctgtgactatcaaggaggtgcccagcaaaatagttgccgttgcagccttttcaggtttggttactgatgatgatataaaccagagggagtctaaattgcgcgaatctctccgtaaagataccacatttagagtgaaagatgattcggtggtggaagtcgcacagtacaatccacctttcacacttccattcacaaggagaaatgaaatagcattggaggttgagaggaacgatatagccttatgatgtcctagattaacaaataaattattggcatttgagagtgtatgcaaatgcccatcgtccctaatgcatatatgtataatttctatctggcatgttctgtatatatgtagacatgttaattatcgcatgcatatattattgtattggaaattaaataataagagcaaaaaaaaaaaaaaaaaagaccccccgcagggtcgggctggag

SEQ ID NO: 1697 - DNA, 4139 bp, Zea mays
aaggaggggactaggggagagagagagagagagagggggaaggccaagaagaggcttcctctccccccattctccaatccgtgccctagtcgagccagccgcgaggaaggaggcgtctcgcctagcgcccgccctcggccgaccttctgctgcaccttcgaactctggaaagttcatagatttttgggcaatagcaagtggacatggaaccatcctctcagcctcagcctgcgatgggtgttgccgccggtgggtcacaagtgtatcctgcctctgcctacccgcctgcagcaacagtagctcctcctgctgttgcatctgctggtttacagtcagtgcaaccattcccagccaaccctgcccatatgagtgctcagcaccagattgtctaccagcaagctcaacagttccaccaacagctccagcagcagcaacagcagcagcttcaccagttctgggtcgaacgcatgactgaaatcgaggcaacagctgatttcaggaaccacaacttgccacttgcgaggataaagaagatcatgaaggccgacgaagatgtccgcatgatctcagccgaagctcccgtggtcttcgcaaaagcttgcgagatattcatactggagctgacgctgaggtcgtggatgcacaccgaggagaacaagcgccgcaccttgcagaagaacgacattgccgcagccatcaccaggaccgacatttacgacttcttggtcgacattgttcccagggatgagatgaaggacgacggaatcgggcttcctaggcccgggctgccacccatgggagccccagctgacgcatatccatactactacatgccacagcagcaggtgcctggtcctgggatggtttatggcgcccagcaaggccacccggtgacgtatctgtggcaggatcctcaggaacagcaggagcaagctcctgaagagcagcagtctctgcatgaaagggactgaggatgtcgctcaagctatcacctgatttttcagagctctcattttaggttctctaaactgcaggttttcgttggctaatatcgttgggtatcaaactgaaacaggtagggtgtagcatcatggtagtttgatttctgctgtggtgttagttggagggataatgattagcggctagtggattaaagttacccataccgtttcctttcgttccaaaagttcgccttcatgaggcctctgatatgaaaaatgctgggtgttaatgcttcaaaaaaaaaaaaaaaatgtgcagttcatgcttctctcttttctccattgctcttgattcgtagcgtggaaggtgttctgttaattcatggaaattctgttccagacttgtgtctagttgaattctgggacccagtagagctgggccatggccattcacctcccaagaccaaaccagtcaaattcttgaagaagctgggtgtgcccttaactgcatttctgaatacaacaggtaactactctcatggcacagcgcgtcatgtcgtcgcccagatttggctggagttggaaatgtttgcaattaaggactgttccttgctgctgaggctttctactcgtgtcttcgcgggcgggcgcgtgtacacggcactgcatgaaacagttcgctgaagagagatggtcaggacaaaccaggggcctgtcaatcttccgggaccgggaaggtgcttgtcttcgtgacaagctatctcccttttcgaagtctcggtttgatccaagtcttacccactagggattcagatgatcctagctaaaacacagcgaaactttaaccaaaatatataccatctctttggccgtttcagcctagctaaaatatatacgtttagctagaatccaaatagtcccagctaaattttagctagccagattaggcaattaactgaccaaagttcagttaagatggacctaaacaggacataagtagatggggaccactacttttgacttggctattcgatcttttgattagggtatttgtgctcacatctttttcatgttttagatcgatgtgcgtaaacaaaaagaccacgccaattttaggcatggggaagattttttttaattttcttatcggcaactcacgtttccgacttaacattctcaggtgggtacagtagcttccgggcattttcctctccatttccgcaccgctctttggctttttatataagctctctggcacggctcctcgttcacgctctctgatcgcttcagctcagctgctctcgctcgcctcgcagatcgcaacccacccttagcctgcaaggaactcccctcttgcgttgcgccctcgcccgccctcctctgtaagttgtgcactgcattgttgtcgcgctggcaatctggggccgaaaagcaaaagcgggtgggtttgagctagctagggcaggctcagctcaggcggcgcgcaacgcaatggggcgtgggaaggtggagatgaggagggtcgagaaccgggtgagccgccaggtgaccttctccaagcgccgcaaggggctgctgaagaaggccgacgagctcgccgtgctctgcggcgtggacgtcggcgtcgtcgtcttctccgagcgcggcaagctgttcgagtactcctcgccgaccaggtccgcgggtgatcaaaatcgatcggtgtgggttttggttgtgtgttggtttttttggggtttggttaagtatgcgtgatcgcggaaacctttatttcgggtccctatcaagttgctgctggattggagttcactatcgagttgattttcttcgacacacgcgtgcgtgactatgtgttccgccttgcgcagcctttcactccctctcaaatgttggcttgggagtcagcacacgccgatcagttcttccaagtttgcataagaagtagcccatgatcgattagcgaaagataggaatattccagagtcttgcaatctgcagatccctaacaccaacactctccaccgttaccatttttgcgaagcttggtggatctgattcgccggtacgaggcggccaccagcacgcgactcttgcatcaggacgcacgctgctgcaccgatcaccagtctgatcatcaggtacgcatctaccagatcgacgtccagacccaacgcagcagcttcagtatcttcgtcagcctgttcatgcgccatctctattcttgcctcgtttttctctctctctctctctccaatgctgctgcagcagcagcagcagatggccgctgagatcagccagctgcggagtgagtgcgagcagctggaggccagcctgaatgcgtacacgggagaagacctgtcgtccgtgacttcggtggtcgagctcctcgagctcgagcagcggctggagtcggccatcggcaaagtccgtgcaaggaaggtataggtatctactgctcgaaaaaaaatttgttgcagccaggctgcaacaaatttttttccctgctgctaggtgatcctggttcctctgcatgtcgaggcggtttttattgcgtgccttgttttttttccttggcaggatgagctgctcgtcaacctgaccgaggagcttcaggtcaaggtaaactgtgacggccggccggcttcgcgtgagcagtagttgtagcacgtcgtcgtaaaagcagctgtgtgaagtgatcgtgccgctgccgctgtgatgtgacgcacgcagaccgaagagcacgggcgccacgacggcccaccagccgccgcgggcgtggaggcgacagtggcggagccgccgctgccacagtcgccgtcgttcgcgtacctcctggccctggaggagaagtccgcggcgagcacaatgctgcgtctgtggccgccgacggacgaggacgccgacggcggcgggagctccagcccacgcgatctacacctgtggtaacagaacgtgtacgcgtacgtccgaagcttagcagactagcttaaccctttatgctgaaaaaaaaaactgaacggtaatttcttcttgcagaatgcagatcgaaggcacagtagactggttgccccgcctggccggccatggacgtgtgtcgatcagctgggtggacttgatgacatgacagatttacttagtttgctaaagtacataactaaaacaaacaagttagttaaagaaaggaagtagcatgctaag

SEQ ID NO: 1698 - DNA, 4483 bp, Zea mays
  misc_feature (1804)..(1804): n is a, c, g, or t
ccggccgaaaaagagagagggggaggtcgacgagacagagagagaaggccaagaggcttcctctccccattcctcccttccgtgccctagccgagccagccgcgaggaaggaggcatcccgccgtctcgcctggcgcccgcccgtcggccgaccttctgccgcagcttccaattgtaaaaagatcatagatttttgtgcaagagcgagtggatatggaaccatcccctcagcctatgggtgtcgctgccggtgggtcacaagtgtatcctgcctctgcctatccgcctgcagcaacagtagctcctgcttctgttgtatctgctggtttacagtcagggcagccattcccagccaatcctggtcatatgagtgctcagcaccagattgtctaccaacaagctcaacaattccaccaacagctccagcagcaacaacaacagcagcttcagcagttctgggttgaacgcatgactgaaattgaggcgacgactgatttcaagaaccacaacttgccacttgcgaggataaagaagatcatgaaggccgatgaagatgttcgcatgatctcagctgaagctcctgtagtctttgcaaaagcttgtgagatattcatactggagctgacacttaggtcgtggatgcacactgaggagaacaagcgccgcaccttgcaaaagaatgacattgcagcagcgatcactaggactgacatttatgacttcttggtcgacattgttcccagggatgagatgaaggaggacggaattgggcttcctagggctggtctgccacccatgggagccccagctgatgcatatccatactactacatgccacagcagcaggtgcctggttctggaatggtttatggtgcccagcaagggcacccagtgacttatttgtggcaggagcctcagcaacagcaggagcaagctcctgaagagcagcaatctgcatgaaagtggctgagaatattgctcagaagctatcacctgattcagagttctcattttaggttgtccaaactgcaggttttcttagtaatatcgttggttatcaaactgaaacaggcgattctaagtagggtgtagcatcatggtagtttcatttctgcttgtgatgttagttgaaaggataatgattagtggctagtggattaaagttaccataccatttccttctattccgaaagtttgcctccatgaggcctctgatatgaaaaaaaaaaaaaaaatgcttctatgctctgcttgtgctgtacagttcaagctgtttttttggttgctcttgatttgtagcatgtaaggtgctgttaattcttgggaaattcgttcgagacctcaatatagttgaattctgagatccagtagagttggggcttggataagaccaagtcagtcatttccactgaatttcctcgagaagctggacgcgcctttgttacatatttgaaaaatccgaagtacccttaacagcatttctgaatacaacagataacttctctcatggcataatgtgtcaatgtcgtcgcccaaatttgactggagttggcagtgtttgcaattaaggattgttccttgctgctgaggttttctacttctgtttttgtctcgcgggcactatcgcaatcagtgcgcgagtccaaatggcccgctgtgcgctgaacaagggtttctccgtgcactgaactccagaagcagaagaaatctgcaggagcttatggccgtgtttatttcagctttttttttactgtggtcatgacaagctgttgtaaattgtcaaatgcctaacttttcagccatngttttggtgaaaatcgtaaaaaatcaacgtgaacacacaatcagccgagtcgtcacgatagtagaaatccatcactctttagatcctaaatcctgaaactctttcatctttctccatatgtaatccccatgatactcagattcttctcacagtcagattcttctcataaacaaattctcaaaaaagactgtcagaaaaaactgaaccaaataggccctatgaatcgtctagaaagtcggaaggtacttgtctcattggtaagtagtgctaggaattcggtcggcccgggccggtctagacccattgtgcttcgggccgaatagactcgagctatgaaggcccaaataactgagtcgtattgtgccagtccaaagagtataaacagtgggctagtctagtcccaaagcatatcgtgccttcatcgggtcgtgtccacccaagctcgtcccatatatttgaaccacataaagtccaaatattacaaccaaataaagtccatagcttactaaattaaagatattaaataatacgagtatcatttgaccacataaagtctaaatattaaaaccacataaagtctatagcttactaaattgaagaaattaaacaatacgagcttcattggaccgggtggcccaagctcgacccaatcgtgcgggccgtgtcgggccccgataggctagaatttgagatccggctcagacccgcttttgagccatgctagctcgactcataccatttcatgctgggatgtacttcggctcatgtttttgggctgtgctcgtgctgccaaaaaacccggtatatattcccaacactagtggcaagcaccttttcaacaataaggaccaccgcttacttttgattttgctatccaatattttaactagcttatttgatatactatttatgctttataccattttcttgtttttgatctgcgtacataaaaaatcaaataaccacaacattaatataaaatagttttaaatgaactttgctatttcagtattaggaagaagtgttttggccttgtatgtttttatcgacaattaacattttagaccgaaggtgggtgcttagttggtagggaccaaattgattacagagaagcgtgcccatgttgagaaggccacggcttttcgcaacaagatcgatggcatgctcatcgcggctcaagctacaaaaaaaggatgttgcaagcgcaagcgctcacatacaggaaaccagtcttcttgaacaggagaaggacgtcgccgctctcaaggagaaggtcatcccgcctcgtagggtttggttctacaacaccccacgatcgctgacccctaccctagggtgcccccataggacgaccctattgtagcctatgaggctactatcgtcgctagcatccaaatctagatagttcttatttccaatatctgattgttggtgatgatagtcctacgacaattacgcacgctgtcatgaacatgtgacgcttgctctctagatgtacgctctcatcgactacgtcttttttgatccttcgtcaatacactgattcatgttagaattggatggatatgtcatgatcttttggatcgctaacatggtctcccccaagcttcaccagattggcagggagcacaatggcatgggaagcagctctggctcgctcttgagaagcaatttatcgggaatcatgggacccacactctcgaattcgacgcaggacattcttgagcacgcgaagatgacattctgcaagccttgcaccacacgtgtggatcttcaggccaagctcgctatcgactccagcccttttgtggcgtatgccacataattttagagtctcatcaatgctcttcagtacctaactttcactaagcctaacattgtttatgttatttagcaggtctgtttccaaggttgcatcaatcttaaagaagtttgccaagaaagctcaaaatgaatttgattgcaaaatcaagaaaatcaaaagtgacaatgggaaagagtttgacaacaccaacattcatgaatatttgtgatgaaattgggatcaagcatgatgtgtctataacatatacacctcaacaaaatggagttgtagaaagaaagaatagaaccttgattactcttgcaagaataatgatagatgagtataacacaccggagaggttttgggccgaggttgtcaatactacatgctatgcatcaaacatgatgtttcttcatcggttacttgagaagactccctatgaactgctaaatggaaaaaagctagatgtctcattcttccgggtgtttggatgcaaatgctacatctacaagaaacatcatcacctagggaagtttcaaagacgatgtgatattggtttcttatttggttattgatcaaaatccaaagcatatcaagtattcaatcatgccattggcgtggtggaagaaacatatgatatggagtttgatgagactaatggctcccaaggagcacttgaaaatcttgatgatgtaggtgatgaaccactcagggaagctatgaagaatatgccaattggagccatcaaaccaaaagaaatgaagatgaggtgcaagacatcaacatgccctcttcatcaaatgtaccacaagaagatgagaaagatgagaggcatgaaaatgaagacacatttgtctctcatgaacaagtaatgg

SEQ ID NO: 1699 - DNA, 980 bp, Zea mays
cctcgaggccggccgggacaagccttcaagaaaaaatctgccgcaatagaacggacccccgagccccaccgcagaacgcaaccgccttagccttctcccatcccacggacgagcgccacacggcaccccactgcgaggcaatcgccaacccgcactgcaccactcgcgcctcgcgatcaccgctccgaactggaaatcaaatggcgccgtcgccgctgtgttccgcttccccacggccgcttcgagccccaggccagcctccccgagacgtccgctcgccgcggacggtcgtcgtggccgcgggcacccgtgtgagcggagcggaggcccgcgcgtcgctggtgctggccttggcctcgcatgcgctctccgcctcgcagcgccgcttcgccgagctcgccgatgaggccgccaagtacgccttcccgtctggccgcttcgagccccgcaccctcgaggaggccctcatgtccgtgcctgatctcgagacagttccgtttcgcgtactgaagcgcgaggcagagtacgagatcagagaagtggagtcatacttcgttgctgaaacgacgatgcccggaagatctgggttcgatttcaacgggtcatctcagtcgttcaacgtgctggcatcatatttattcggtaagaatactgcctctgagcaaatggaaatgacaacacctgtttttactcggaagggtgagtcaaacggccaatcaatggacatgacgaccccagtgataacaaaaaagtcagctggtacaaataaatggaaaatgtcatttgtgatgccagcgaagtatggttccaatttgcctcgcccaaaagatccttctgtgactatcaaggaggtgcccagcaaaatagttgccgttgcagccttttcaggtttggttactgatgatgatataaaccagagggagtctaaattgcgcgaatctctccgtaaagataccacatttagagtgaaagatgattcg

SEQ ID NO: 1700 - DNA, 1260 bp, Zea mays
ttaagaaccgagtaggcagacacggaagggtaggaggggactaggggagagagagagggggaaggccaagaagaggcttcctctccccccattctccaatccgtgccctagtcgagccagccgcgaggaaggaggcgtctcgcctagcgcccgcccgtcggccgaccttctgctgcaccttcgaactctggaaagatcatagatttttgggcaatagcaagtggacatggaaccatcctctcagcctcagcctgcgatgggtgtcgccgccggtgggtcacaagtgtatcctgcgtctgcctacccgcctgcagcaacagtagctcctcctgctgttgcatctgctggtttacagtcagtgcaaccattcccagccaaccctgcccatatgagtgctcagcaccagattgtctaccaacaagctcaacagttccaccaacagctccagcagcagcaacagcagcagcttcagcagttctgggtcgaacgcatgactgaaatcgaggcaacagctgatttcaggaaccacaacttgccacttgcgaggataaagaagatcatgaaggccgacgaagatgtccgcatgatctcagccgaagctcccgtggtcttcgcaaaagcttgcgagatattcatactggagctgacgctgaggtcgtggatgcacaccgaggagaacaagcgccgcaccttgcagaagaacgacattgccgcagccatcaccaggaccgacatttacgactttttggtcgacattgttcccagggatgagatgaaggacgacggaatcgggcttcctaggcccgggctgccacccatgggagccccagctgacgcatatccatactactacatgccacagcagcaggtgcctggtcctgggatggtttatggcgcccagcaaggccacccggtgacgtatctgtggcaggatcctcaggaacagcaggagcaagctcctgaagagcagcagtctctgcatgaaagggactgaggatgtcgctcaagctatcacctgatttttcagagctctcattttaggttctctaaactgcaggttttcgttggctaatatcggtgggtatcaacctgaaacaggtagggtggagcaccagggtagtttgatttctgctgtggtgttagtgggagggataattattaccggctagtggattaaagttacccatcccgttccctttggttccaaaagttcgccttcatgaggcctttgatatgaaaaatgttgggtgttaatgcttc

SEQ ID NO: 1701 - DNA, 4485 bp, Zea mays
  misc_feature (2260)..(2260): n is a, c, g, or t
  misc_feature (2893)..(2893): n is a, c, g, or t
gaccagtgggacctacatgtcaccttcgccgaaatgaagcagcactcctccggaacatcgctctaccatctagtctagcggcagagaccaaagtgcccatcgcaccatgtcggccgccgaaaccgctgtttctccgacgacgccgccgcagccgcagctgcaatcggatccgaacgccgccgccgacgcggccagttccaattctctctgggtggccgacgagacgcaaaccctaaccgaggtcctgctccaaccccaaccaaaccacctgtcgcctcctccttctggtgaaggggacgacgggatcactgcctccggtgctcctgttggtggggacgccgcggcatccgcttctgctgcggcggcggctaacgcgacgatagaagagcgggtgagggggccgtggtccccagaggaggacgcggtgctgagcaacctcgtggagaagttcggggcgcggaactggacgctgatcgcgcgtggcatcccgggccgctccggcaagtcctgccgcctgcgctggtgcaatcagctcgacccccaagtcaagcgcaagcctttcactgaagaggaggaccgcattataatggcagctcatgctgtccatgggaacaagtgggcatctatcgcaaagcttttggatgggagaacagacaatgccatcaagaatcactggaattccaccctgaggcgtcgctactgcaatgatggccaatgcaagcatggtggttctgtggagcgaagtatctcaaaggtgtccagggaagtttcagaagaaccttggcctttaaacgatcttaattccttcaccgctatggatgtaaaggatgatcctgtgcaaacagctccagatacttctcctcgggcaaggcacatcacagatcattgttctattactcaagtcgttgatccaccatacctgtcccgaccagcggcaaagattggtgctttcagaccatattatctaggacacacggaacctacccaacaagaaatgccaggtgctgtcgtcatgtttgactcaactcataaagtctcgactcctgaaagcgaggtattcaagtttgttgatcctatatgctttgctgctgaggtgccagacaaatgtgggtatggttgctgcggtgctcatgagcagcatcgtaagaactcattgctgggtcctgagttcagtgagtttgaaggtcatccacctgttttaaatattagctttgcttcattggtatcagaaattagcagcattgcctggatgagaagtggtatgcaaagcagtgattccagcaacttgatgcaatcaattccaccaacctgacaaagtaggaatcttttgtcagtggcggatccagaaacagatcaaatgaggggctaaattatggattggggaggctggagatggctgcaatgcgaatgaatggaaccaccatgtaaataatgtgcgaattacaaacgcgtgtgggttgctgtgtgccgtgcacatgggtgatgaactgatggacctgcattgtgctgttatgcgcctgcatcttgtaatcgtgggccttcttcgtattactatgctgaaatcactacatggtactaagtgttacttaggctgctggaccggggctgcagccccgccagccctggtcctggatccacccctgcttatgaacttgcatgctggagtattctgtagttgtttgctatattcagacatagtgatgtcaggtcattaattacaatcctggggctcactgtcaataggtgacgatgcattttcttttgcaagcattaatttatatttatttcggtgtttccaccttaatataattctatgttagcctaaagtagatattgtactgtaccgtgtgtagctgtgctgcttaaggtattggccgtgtttatttcattgtagaaaaacacatgctatctatttgatgtttgtagttgtcttcagttcatcacaggcattgacgtaaaagaagcctctaaaatatagacttgttgtctaaggaaccatatctttgaaaacaaaattaggagatccatgcttagcacgtttggtggaagcagtcggggaacagtccacctgtgggttttgatccctggtgcccgaaatcaggtagtgtaaaagatccacggtccctttctaaaaacagagattatttgctaatttatggctgttatactttgctgacgatcgagctgtgctgctgcagataaagtagtaactgaataatgttttgataatgctcttcctgtgatgtctgcttctgcaatnagtttgttcctcaagtcatttccatgctgttttattgcttgtttgttactttcttcaccgggtcatgattatctagatagcttatgcatggtaattcaagttttcatacaacatatgacttacttttccttataacagcatatggtttactcgaatgtgttttatggattctcgtacagattgtcttttatattagttctgtctatcatttgtgatagtgtgatacacactatagtttaaggcaacgacaaatctcgcaatgccatttgtgtaatccacaattccacatgccttctgaattagaaacatattatgctattgtcaatgaagatatgttctgttccttcacttagtatctgatgtagctatacatgctattcacacctttttagtggcattttgtttggtatagcttacgattacctaatcctgaaaggtgatatggaaaaatagctcttgagatattttaatatatgcattcacatgcctccaagttcattttttgtttgtcaaaaagtataacttgttatatatgtttatgtaatgtttggcatcttttcacaacattgctgaatttgtgttacttaatccatgactatactcagtcacaattggtgattctgagagtatgtncgtgttttttttgcggtggggcaggatctctagtggctctttttctttgcctttttggtgaacatgacgttctgtttaccttctagctgggttatgttcactaaagaaaatctggcttcgatgctatatgcttcaggacatgtgcgagtttcttcgctttgcactttgctttctctggaaataaaaatgttgccttttgttttctcataccttggaacaaaataagcagattgccttttctatgcactcatgacccatagcatcatttcttatccagcactattatcgctgtatttgcattgattcagagtatcatgttaaatcatgcattctgttatctcctgatgccataaagttagcgagcattccatattctacaaagttattttaatggtgatcttatacgagtatatgctatctccgtctcaaaaaaagaaaacaattctagatgtgaaccaagtcaggttttgttaagtttgactaagtttatagaaaacaatatcaatatttatgtattcaaatagttttactatgaaaacatattctatgattaactaatcatatttattcatcatcatagctattagtactttttgtatgtatttggtcaaacttaaaattgtctgattcactaatgatatcttttttatatagatttgggcaaacgtaagattgtttgactccttgaaaaaaaagagagaattgcacttttttaggacggagggaataaatcctaaacgataggggtggcagctactgtagtttgatcctcttttatgttccttcacaaattatcttttccagagatcagatttctctgtgtcaacattgcttgtgctgtctgtcttcgtagctgaggcctctgaaaaagcaggattcctgtcttcgtagctcctaataacgcttgctgcagacagccaggaacacgactctcgtcgttatcaggttgaagtgctctttttcagtgaaatataatgaaatgctctggttgtctgtgcgtggtaattggttagagcaatcatgtttggttggttgctgattagccctgctttgattaggcagcatatattctgctttgtaattactagaatagatcaaaaaatcgtcctgcttttgaaggagtagtcttgctttcaagtttcaatgcgtctgccgcaagggtttgggtcctgagttcctgactagtgaatgtgtcatgtactgcaagactgctctttggcctttgctaacgccgcctgagttttgtcaatttctttaacttttacatgtctgcgttcatcaggtggaggtcagtttaggcacaatgttccttcaacctttttttttgccgataacaaacagacatacatcgagtcattttttgccgatagcaaacaggacagacagacagggatgaaaccaccagataagggcttgttcggttctaccccaatccatatggattgagggggattgaggggtttcaatccctagcaagtcaaaatctctcccaatccatatcaatctcctccaatccatatggattcaaaataaccgaacaagcccttaggcatatctgtccatcctctgaacccagccatcaattgagtcgg

SEQ ID NO: 1702 - DNA, 1048 bp, Zea mays
ggccgcttttttttttttttttttctaatgttgaactggcacatctcaagttgaagtatacttcacaaccagcaaaatagatttaactgaagctaagtatctactatgaagctcaaggtaaggaaatacatctaacaacttcagtttcactgttgttcctacacggcctctaagcctctgagctgcagcctctccatccaaaccagaaacacttttgccgtctatctcgactagctcatcgccttcatgtatgcctgctcgatctgctgggcctccctgaatgcagtccataacaagcaatcgtccagagcttggctccttgtttataaacaccccgaccccttgcacattcccatcacttcctatcctaaaactctggtactccttggggctgatgatccttgtaaatgggtcgccgagtgtggacagcatcccactaatcttactgtaggcggcatccgctgatttcagtggaaatatctctaccatggtttgctgtagtttctgatcccaatcttggtggttgaaggtgggatcaacaaaggtctcacggatcagcccccacgtctccaccagcgtcctctgcactctgttcacttcgcgcgccttggagacggggaacgcgacggtgagcgactcggcccgggcaggcggcgtcggcagcggggacacatccccggagaacccggttagtgacacaacggcagcggcggcgaaccccaccgcagcctgccccagcgcccggcttccgtgatccgacccggaagcccggactgccgtctgctgcggatgcagaggctcctctcggcccacggaccgcacgcggagtctcgctctcgccccaaaagccgccggccggggcaaggccttccgaacctgtccgggcagcgggcgcggagcaagtgtagcaacgagggagcactctaccatttccatgacacgacgccggcagcgatggcgcgctagcttctcgctagagcgcgcgggctactatacaattgggcgccggagacgtccacccgcccggccggcctcgaggtacccaatg

SEQ ID NO: 1703 - DNA, 2440 bp, Zea mays
  misc_feature (330)..(330): n is a, c, g, or t
  misc_feature (488)..(488): n is a, c, g, or t
gcagtgcgccgctgccgtgggttttatttgctgccgacaggggcggcgcattggcggcgagcgcaggattaccccttctcgcggccagcttgaatccccggcgccaatggacagttccggtggccggataggctgtaggaaaaccgactgcgcctcacgacgaccccgcctcttacaatcaggtcagatgatccctacaatttctcggcatggggtcggtatctctacatatttcacgtccttcgatctcgctgaaccgagttaagtttagggaccgttttttattttccgatgaggcttgctcatacctttttctctgtaaaattttgntagatttaggatagtttttgttagaactatcgtgaaacgtccaagtttctttgtttgacggaggtaggatcaacaacagcaaaaaaagtaagcagtgctcattgtaaccgaagcatttccaaaacgtcaatcagtaatagcatctagcagcgcctccnattttttccttgcaagctggaacacaacatgatcattgatcaagtaaccagatttttttctaggcacaaggataaaatacccaggatcatcatcaattccatttccagaaagaggcaacaaaccttagtccttttccaggctgaggaaacaaacattgcaaggatcgggatcaggattaggtatccatccctcctcaaagagtccacaaatgtatacccttcccttatgtacatcaccacacaaaggagctagtacaatactagagtataccagttcaccaccctcctgcccaattctccccaggacgtataccatccccgaccccctcaattataaaataccttacccctctcaccatttacctccaccaccccagatcaaatttacaccattacatccccttgtacccacacaaactataccctggtcccgtcctcccgccacaaaactaagaatttagagggcgctactacgcccatcggcaagcaaattaggcttcaggcaaatccttggtgacaccaaatagcagttaccttggctgcgggcgtgccgggaatgacttagcgtgcctcatctgtggcgttggtcgaggagtcgatgagcggctcattgtctgcgagcgaagcagcatgtccaccatggacgaagtctggtaggcttggatcaggctctcgctgtccgtcgagtccccgcgggcggttgccctctgccatgagtgcgagctcaagcctgagagcacatatgctcgaccggacgcctcgtacctctgccggttggccatccgatcctgcatctccttcagctcggcatccagtgcctggcacagacggtcaccagactgtcctgacgccgaccccatgatcatcctccggcagtcctcgagtagagaaacagcggtggtcaggtcaccgcgctctgcagaaaaccttgcttcagccatcacctcggctgcatggaggcggttcttctggcggtccacctcgatcgacacgctttgtaccgagacgaatgctggcctggagatcttcacttgcacatcagccatattcacggtctccttcatcagtgggtctttgtagacgcagccaaccttgaggagtgctgtttccccgtagcctggtgggacgtttacagacacaagaaaatccctttcttcttcagcatacaggtccccaacatctatggacccattcctcttatcatctgaaaccctgctagaatagctgcctgatctgatggagccaaagtgcacgtcggggtggaggctctccacctttacatgcagaccttgtgcaaccacactcaaaagtccaccaatgcactgagcaaatgcatcttggatagcggcctctgtctcgatgaatgagaaggtgccaccagaagtttgtgagatggagtgcagcgagacggagtcatggtcagcaccgaatccaaagacatgaacaggtacctgctggttaccgttagtggacggcaagagcgcacaatactctggtgctcctttgtgtacgccagcagttggtgagaccgtgtaggtatcttgaccatctgacaagaggatgatgctgcagactggattcttggcctgtcgctcttcgatcaccttggagcccttcctgagggcctctgcaatattggtccctccatttgacgtcagtgaattaacagccagcaagctctgctgccgaccagactcagtcatcctacggagtgggaagagcctacgtgcggatgatgagaaggcgatgacggaaagccggtcagaggagccaagattctgaatgacaaatcccatagccctcttcaacaatgcaagtttggtaccagccatacttccactgacatcaagaactgtgatgagatcaacaggggcacgggctgtacttagcccgttgccatctcccagattgctggatggctgcaggtgctgagcaaccggtgcaataaggca

SEQ ID NO: 1704 - DNA, 1425 bp, Zea mays
  misc_feature (1249)..(1249): n is a, c, g, or t
  misc_feature (1254)..(1255): n is a, c, g, or t
  misc_feature (1258)..(1258): n is a, c, g, or t
  misc_feature (1284)..(1284): n is a, c, g, or t
  misc_feature (1289)..(1289): n is a, c, g, or t
  misc_feature (1293)..(1293): n is a, c, g, or t
  misc_feature (1321)..(1322): n is a, c, g, or t
  misc_feature (1328)..(1328): n is a, c, g, or t
  misc_feature (1330)..(1330): n is a, c, g, or t
  misc_feature (1340)..(1340): n is a, c, g, or t
  misc_feature (1343)..(1343): n is a, c, g, or t
  misc_feature (1357)..(1357): n is a, c, g, or t
  misc_feature (1360)..(1361): n is a, c, g, or t
  misc_feature (1364)..(1364): n is a, c, g, or t
  misc_feature (1366)..(1366): n is a, c, g, or t
  misc_feature (1377)..(1377): n is a, c, g, or t
  misc_feature (1379)..(1379): n is a, c, g, or t
  misc_feature (1387)..(1387): n is a, c, g, or t
  misc_feature (1389)..(1389): n is a, c, g, or t
  misc_feature (1392)..(1392): n is a, c, g, or t
  misc_feature (1395)..(1396): n is a, c, g, or t
  misc_feature (1402)..(1402): n is a, c, g, or t
  misc_feature (1404)..(1404): n is a, c, g, or t
  misc_feature (1406)..(1406): n is a, c, g, or t
  misc_feature (1413)..(1413): n is a, c, g, or t
  misc_feature (1415)..(1415): n is a, c, g, or t
  misc_feature (1419)..(1419): n is a, c, g, or t
gaactccctccccagctttttccccagaggaagcaaccgcagaggaggagaagctgcgcagaaggggaagcggcggcggcggcggcggcggcgtgtaggctgcgcagagagagagagagagagagaggccggcagggagggagcgtaagctttttggcagtggtggttctggaatgcagcagcaacacctgatgcagatgaaccagaacatgatggggggctacacctctcctgccgccgtgaccacgatctcatccagcagtacctggacgagaacaagcagctgatcctggccatcctcgacaaccagaacaatggcaaggcggaggagtgcgaaacggccacgcgtcccggacgcggcgcggcggaggagtgcgaacggcaccaagctaagctccagcacaacctcatgtacctggccgccatcgctgacagccagccgccacagaccgcgccactatcacagtacccgtccaacctgatgatgcagccgggccctcggtacatgccaccgcagtccgggcagatgatgaacccgcagtcgctgatggcggcgcggtcctccatgatgtacgcgcacccgtccctgtcgccactccagcagcagcaggcggcgcacggacagctgggtatggctccagggggcggcggtggcggcacgaccagcgggttcagcatcctccacggcgaggccagcatgggcggtggtggtgctggcgcaggcgccggcaacaacatgatgaacgccggcatgttctcgggctttggccgcagcggcagtggcgccaaggaagggtcgacctctctgtcggttgacgtccggggtggaaccagctccggcgcgcagagcggggacggcgagtacctcaaagtcggcaccgaggaagaaggcagttagttaagacgctgtaagactggcatcggctcgggcacaccggcatgtcatagcagcaggattagcaggtagctttgaggaacgaggagggtagtagtgtagtgtaatggtagcactagctagctagtatgtggccggtaaggaggtaggtttgttccatggaacctggaggtggtagtgaccagcatgcatgcatgcgtgcatggtcacttgttttggatgtatttgcaggttctctcccaaatgtagtatgaaacgttgctggtgacctgtttgcgcgaacactctatgcagtgttgatgatctttaacaaaaaaaaaaaatcactcattcctcattaaacctcccccgaantaatnnaanaaaaaacctcgtgggggggcccggtnccccnattncccttttatgagtcgtttaacaattacnnggccgncnttttacaacntcntgactgggaaaaanctnncgntncccaacttaanancctggagnanatnccnnttttcncnantatgggngnatanctaaat

SEQ ID NO: 1705 - DNA, 1312 bp, Zea mays
cattgggtacctcgaggcccgctccggcgccgggcagcagcagcggcctgacctgcgcaaaaccccgccgctctcatctcgccaaaaccccaagaagccgcagggggacggaactccctccccagctttttccccagaggaagcaaccgcagaggaggagaagctgcgcagaaggggaagcggcggcggcggcggcggcggcgtgtaggctgcgcagagagagagagagagagaggccggcagggagggagcgtaagctttttggcagtggtggttctggaatgcagcagcaacacctgatgcagatgaaccagaacatgatggggggctacacctctcctgccgccgtgaccaccgatctcatccagcagtacctggacgagaacaagcagctgatcctggccatcctcgacaaccagaacaatggcaaggcggaggagtgcgaacggcaccaagctaagctccagcacaacctcatgtacctggccgccatcgctgacagccagccgccacagaccgcgccactatcacagtacccgtccaacctgatgatgcagccgggccctcggtacatgccaccgcagtccgggcagatgatgaacccgcagtcgctgatggcggcgcggtcctccatgatgtacgcgcacccgtccctgtcgccgctccagcagcagcaggcggcgcacggacagctgggtatggctccagggggcggcggtggcggcacgaccagcgggttcagcatcctccacggcgaggccagcatgggcggtggtggtgctggcgcaggcgccggcaacaacatgatgaacgccggcatgttctcgggctttggccgcagcggcagtggcgccaaggaagggtcgacctctctgtcggttgacgtccggggtggccccagctccggcgcgcagagcggggacggcgagtccctcaaagtcggccccgaggaagaaggcacgttagttaagaccctgtaaggctggcatcggctcgggccccccggcactgtcatagcagcacggattagcagatagctttgaggaacgaggagggtagtagtgtagtgtaatggtagccctagctagctagtatgtggccgcgtaaggaggtaggtttgttcactggaaccctggaggtggtagtgaccacgcactgcactgcttgcgtgccactggtcccttgttttggatgtatttgcaggttctctcccaaatgtagtatgaaacgttgctggtgacatgtttgcgcgaaccctctatgcagtgttgatgatctttaacaaaaaaaaaaaaaaaaaactcgagcccgg

SEQ ID NO: 1706 - DNA, 1061 bp, Zea mays
cccaatcccgaaaccgcgcgtgtcgccagcccatatagatcagagcctagccagagccagagctgagagccgaggagggaaacgaagaagcggccatggcgatgaagcggccggcgcgcagcgacccacacctgccacccgaggaggcggcacgggtggaggccgaggttcggagctacttcgacagcgtcgcgccgaggcgcccggccaagccgccgcgcagcgacccgtcggtggacaccttcgcggaacccgccgccgtcgacgccggggaccacgacttgccggagctccgcaagctgcgcgacctcgaggcgaagccccagaagctggtgttggacggagggggaggggacgtggatggcggggaggattacgtggagacgcgatactacgatggcctcataggcatcgacaagcagcatcacacgactgggacaggctttatcaaagtggagagatccaatggcagcaccttcagtgtgatgactaacggctacccacctgccagctctgtccgctgcacgagcaatcctgcgacaaatgattggataccatcttctgaatcgatcatccctgcttcgaacaagcccagcaggagcgactcctgaccagccttgccttgccttgaagtgccgtgaattgcttacctgcaaagataataaaatgcactgcttctgtgtggtagtaccgtacgcgccagagatcgtgcctcgacactcgagagagagaagggaagcatactgccggagtgccgggcgcgtgggtgggggacacgagatgtgactacttcaacgaagaatgtgtacgggtacgggtgcgtcagcacatgttacttgttgctgcacctgcatactactgttcgagtgttgataatgaactacagaccctgaatgaatgtgcctatgtgatggtttggtacttaaaaaaaaaaaaattcttttccagcaaaccttgatgaccaggtgtgcggcgtgtgccccgtcctgatcatgatatgaatgtgtgcaagatgcgtctgtgtaagagcaagtttaataatatagtttatagtgagtttt

SEQ ID NO: 1707 - DNA, 1117 bp, Zea mays
agccagcccatagatcagagcctagccagagccagagctgagagccgagaggagggaaacgaagaagcggccatggcgatgaagcggccggcgcgcagcgacccacacctgccacccgaggaggcggcacgggtggaggccgaggttcggagctacttcgacagcgtcgcgccgaggcgcccggccaagccgccgcgcagcgacccgtcggtggacaccttcgcggaacccgccgccgtcgacgccggggaccacgacttgccggagctccgcaagctgcgcgacctcgaggcgaagccccagaagctggtgttggacggagggggaggggacgtggatggcggggaggattacgtggagacgcgatactacgatggcctcataggcatcgacaagcagcatcacacgactgggacaggctttatcaaagtggagagatccaatggcagcaccttcagtgtgatgactaacggctacccacctgccagctctgtccgctgcacgagcaatcctgcgacaaatgattggataccatcttctgaatcgatcatccctgcttcgaacaagcccagcaggagcgactcctgaccagcctttccttgccttgaagtgccgtggattgcttacctgcaaagataataaaatgcactgcttctgtgtggtagtaccgtagtagtgcagcacgcggcagagatcctgacttgacactcgagagagagagaagggaagcatactgccggagtgccgggcgcacgggttggggacacgagatgtgactacttcaacgaagaatgtgtacgggcacgggtgcgtcagcacatgttacttgttgctgcacctgcacactactgttcgagtgttgataatgaactacagaccctgaatgaatgtgcctatgtgatggtttggtactttgatgaccggtttttcttttccagcaaaccttgatgaccaggtgtgcggcgtgtgccccgtcctgatcatgatatgaatttgtgtgcaagatgcgtctgtgtaagagcaagtttaataatatagtttatagtgagtttttataaagttgacatataacatcctgccaattaaaagctcggtcatataataaccccgttataat

SEQ ID NO: 1708 - DNA, 2466 bp, Zea mays
ctctactactctataagacagtagtgtagacgtacacacaatttggtgcacggttctgcctccagtccgccgcccgcgcgactgctccaacgaaggaaagtctgatcccgccatggcgccatctccacccccgcttacctctctcggccgccatcatggaaggtccgaccccgccatcgctgtccccacgcggttgctccaaggaaggaaactctgatcccgctatccccgcccccgctctctctcgccatctccgtgcggctgctccaaggaaggaaggtccgaccccgccatcgccatccccgcgtggctgccttcccctctcgccatccccgcgcggctgctccaaggaaggaaggtccgaccccgccatcgccatccccgcgcgcccggtcgagcgccaccagccgcataagtctgggctagcgccgccggccaccattggctcggtcgagcacctcatgcccacgacggtcagtcgccgccttcatggctcagagtcgtcggtccctgcccaccaaggtcaccatgggctcgacgacgatggcaacaaggtcaaggtcgtcatcacaacccaaggtagtagctcttcagttcccccgccattccccaccacccctccaccgtctccaccgcacacagcatgcccgactctattctcctccccgaaatccccgtggcgcgcagatctagccccggctcctcgccggcacaaaccacgtgcgcgccctcgacccatggcatccccaaatcccgcccccggttcctctcccttcccgttcgcggacgacgcttccgcgcgttgacgtacgcgtccccaaatccccggttcccctcccttcctgttcgcggatggcgcttccgagccctcgacccatggcgtccccaaatcccaggttcctctcccttcccgttcgcggacggcgcttccgcgcgtcgacgttcgtgtccccaattcctgccccggttcggcgcttccccacatcgaggcaccacaccatcgccacggggtaccgacaacgtcgacagcgcgtggccccatcgttcgcagaccaacccggccacggttgccctgctgctgacggataaggacctggagtcggaggagagcatgtacgagcggtggagcagcgtgcacaccgtgtcgcgggacctcacggagaagcagagcaggttcgaggcgttcaaggcgaactctaggcacatcggcgagttcaacaagatgaaagacgttccctacaagctcggcctcaacaaggttgataatactgttggtctgtccagttagaataatcaatttaatatctattttggcatgtattcataatcagaaaccccaaatataaaagaaaaattggtgctatttttatagccgtgacgtttcagtctattagcaacagttgccatcacagtaaactaaccactaaccagtaactcgaactgatgatggtgcatacttgttgaagaacaaaaggaaagttgagaagattgaaaatgactatcccaaatgcaagttcgttgcccaatgttttatatatggtaatatttgtgattctttgttggctatatcaccatcagttatggcctagggtgttctaattctcttgtttcggtcgcaggtgatagtttcagctctggaatttagctgaagttgaatgcttcatatgttcagactgacattttggtactaaactggtagattattgttatttaaatatataagtaagggagatgccaatgtgctaattgtttgtgtctttttctgccttttttatatgtccgggctaggtgtagaatataatttttaacgccccactcttgttgcagaaaaaatcatcttctacgattcagagaaattatgtgaagcttcaatttgactccatgcaacagtaatgagcataaatttataatgcactggtttgttgtagcttacaagcactaatccttctgttagcatgtgctttgtgtttatctttcttcaatgcaattgttgcttgtgaaattctatatagatatagatgttgctgagtccatcattgaatatcctgcagggtttagctattgacaacctcgattacattttcacagtgggagctccttcgattattaaccacaggtcgtatgctaaactattagctatatattcgtttatctattatctttaccagattagatcaattaatatatcaccaccttctctattcatccatttttttgggtatatttagttgtgtaccaaatgcagttttgatatttgatggtaggacagcatatgttcgtgcattgcaaccgataaataaagatgaagaggtaaggaatctataccttgcatcctgatcatataatccttaaattgcatgtcacgctttcattctttctccatttccattgttatctttctggttaatattgtttgtgtatctgactgtctgttgtcacttgtcaggtatctataagctacatgag

SEQ ID NO: 1709 - DNA, 581 bp, Zea mays
gagagagagctcagtccccccccccccccccgacccatggcgtccccaaatcccaggttcctctcccttcccgttcgcggacggcgcttccgcgcgtcgacgttcgtgtccccaattcctgccccggttcggcgcttccccacatcgaggcaccacaccatcgccatggggtatcgacaacgtcgacagcgtgtggccccatcgttcgcagaccaacccggccacggttgccctgctgctgacggataaggacctggagtcggaggagagcatgtacgagcggtggagcagcgtgcacaccgtgtcgcgggacctcacggagaagcagagcaggttcgaggcgttcaaggcgaactctaggcacatcggcgagttcaacaagatgaaagacgttccctacaagctcggcctcaacaagaaaaaatcatcttctacgattcagagaaattatgtgaagcttcaatttgactccatgcaacagggtttagctattgacaacctcgattacattttcacagtgggagctccttcgattattaaccacagttgtgtaccaaatgcagttttgatatttgatggta

SEQ ID NO: 1710 - DNA, 1760 bp, Zea mays
ccgggagagctgagaaaggaaacttctggttttctctgcgcgggaggaagaatggcgtcgtggttggagcagctgcagcgcgagctcgccggccgcggcctcacagtcgcctccatccccggcaagggaaggggtctcatcgctactttcaccttcttcccaggggatgtcattctcaatcaggaaccttacgcttctacacctaacaagattttagttggttcgagctgtgaccattgtttcacctctggcaacctgaggaagtgctctatgtgtcgagttacttggtactgcagcagcaactgtcagaaagaagaatggaaactacatcagctcgagtgtagagcaatggcagcacttacagagaatagaaagaagatgcttactcctacaattcggttgatggttcggctggcactcaaaaggaaattacaaaatgagaaggtcattccatcctcaagtatagataactacaatctggttgatgccttggagtctcatatatcgaaggttgatgaaaatcaacttgtgctctatgctcagatggccaatcttgtgagcctgattcttccttttattgagcttgaccttaaggaaattgcacaaactttttctaagtttgcctgcaatgcgcataccatatgtgaccctgaacttaggcctcttgggactggactgtaccctgtcatatccattattaaccacagttgtgtaccaaatgcagttttgatatttgatggtaggacagcatatgttcgtgcattgcaaccgataaataaagatgaagaggtatctataagctacattgagactgcggcagtcaccaagaagagaaacaatgatctgaaacagtacttcttcacctgcacatgtccacgctgtgtaaagggttttgatgaggatgcactacttgaggggttcaggtgcaagaaccaagcatgtgatggctttctgctgcccaactcaggtaaaaaggcttatacatgccaaaaatgtggtgcttctagagatgtggaagagataaaaaatatgagaagcgaaatactacagttatcggataaagcatcttcatttctttcatcaggaaataaggctgaagcaggttctatctacaagataatcgaacagttagagagaaatctgtaccatgctttctcaactactttgctgcacacgtgcgaaacactattgaagatatatctggaattacaagattggtggactgcattgacatactgtagattgacaattcctgtttatgaaagagtttatccaccttttcatccgatgattggattacaattctatacttgtggaaagcttgaatggttgcttgagttcacagaggatgcactaaaatctttaaccagagcagcagatatacttaaagtaacacatggcgtaaaatcccagttcatgaaagagctctttggcaagttagaggaagcaagagctgaagtttcgtttagactatcctccagacatggacatgatgagtaattttcataactgcaggccagttatgatggaaaataatatattgaaatatgcttctactgttgagatcatatttcaaggtacgataaaaaatgtggagactttgtaggcaaagaattagcactgttgtaaaacgattatgtgccgacacaaaataggccctaatttgttgtataaaaaatacaattttgaatttaatggtatatcatgtggtaggttgaactccaaaaaaaaaaaaaaaaaaaaaaaaaaaaaaaaaaaaa

SEQ ID NO: 1711 - DNA, 1568 bp, Zea mays
ataggccataggttgccctgcgggttttacaaaacaagaagaaaaaaaatcacctgctcaacggcggcatcatcggcaagacggcgggtttctgtaccaatctcagccttcgtgtctatctgattccaggaatcaagcgtattgtggtgaacatgaactccacatcttctcagcgtggttaccctgccaagaggtggtgtgcagcgaacatgagctccacatctatgcgtcactctgcatggaagtctgagccctggactcaccttacccacaaacagagacgaccacaatggattgcttataatccaaggacaatgaggcctccaccacttagcactgataccaattctatgaagattctgtcctggaacgttaatggactgcaagctattgtacagtcagggttttctgcagatgaattggttgccagagagaactttgacgtcttatgtcttcaagagacacacttggaggagcgcaatgttgacctttttaaaaacctggtacatgaatatgattacacctgttggtcatgcagtgttgcaaggcttggttattcaggaactgctgttatatcacgggtacaaccaatctcagttcaatatgggcttggcataccagagcatgatcaggaaggcaggcttattaccttggagtttgatgatttttacttggtcaatgcttatgtcccaaattctggccgtggtttacgtagactgaattacaggatcaatgattgggatccatgctttagcgacttcataaagaaactggaatgttctaaaccagtaattgttgctggggatctaaactgtgctcgtcaaagtattgacattcacaatcctcaagcaaaaaccgaggctgcaggtttcacaattgaagagagagagtcatttgaggtcaacttctcaagaaaaggcctcgttgatacattccgtaaacaacacccgaatgcagtggcctacactttctggggtgaaaaccagcgcattaccaacaaaggctggagactggattactttcttgcgtcagagtctattgccgacaaggtccatgattcttacactctgccagatgtagcgctcagcgatcacagtccaattggccttttgctgaagttgtaggcacttatacatctctcagctatttgacaactaaagcaggaagttttaacatcgtcctagataaaagacttgtagaaagattttgcttatgtaggctgaaaactattcaaactcgggtggtacttcgcgtggtctcctgtcgtctgtggaggttgtggatagactattcacgttgtgttcgagaagttaaaacatagcctagaacaattagctgatgttctatagcttgtgaatacatctgtttagtcggcgtaaccggcgaaagagcatctagccgaggagcatctagtcaagttagttaggtggtctaagtagcacctcttaagtgttgagtttgactctccgtggcaacaaattttaggcttggggtaaaaaaacctcttgtttatcccacgctaaagcatatgtctaagacccggtttccggtcaaaaaaaaaaaaaaaa

SEQ ID NO: 1712 - DNA, 2062 bp, Zea mays
gtcggtaggggagccggccgcggcccgcctgcatgcgttgtgcgtcgcttgctgcttccagtcagagaagcagcaggcgccggcccccaccggcagcaagccagcaagtgagatagacgaccccaacaaagcctgtaaacctaccacaaaacgaccacctcttctttcgcgaaccctgcccttggtggcttggtttttttattttcctcttcctctccgcctcggcgcctcccttgcagttccaggctcccgcatccacctgaccatctcggcagctcatcctccccgccccgtcgacccacaccgcttcccctacctccgtcccaagcaccgcagtctcgccaggggcggcgggacatcgcatcgagcccatcgccgcaaaccgagagccaacaacctaggggcagaaagccagaatgcccgcaaagaagcgccggttcccatcgctgtcttcgaaaccccacggcgacgtggcggctcccacctctgatgccacctccggtggaggcgtagaaggaagaggagggcgcccgccgctgccgagcaggggcgcctgcaggccgaggttgactgacccggagccacagggcggactcgaagacgattcggacacggagggtgacggcggcgcggacggcgacagtgaatcctcgcagagcgacggcggcggcaccgacgagtttatgctagtgaaattagcagagatacggaaggaggttcagtgccctatctgcttaggcattatccggaagacaaggacagttatggaatgtttgcaccggttctgtagagactgcatcgacaaatctatgcgactaggaaataacgaatgcccagcgtgtcgcacccattgtgcaagcagacgttctttgagggatgatcccaattatgatgcactgattgcagccctgtatccagatattgataagtacgaggaagaggaatttgctttcagtgagcaggagaggattcgggataaaaagatacaagaaaccattggggaaacattcagaagacagtctgacgcaattggtaagaaacgttccatggcaaaagcaactgcaaccgcctttgcaaggaagtacaggagaacacgggggagagttagaaccattccccctgatattgcccctactggctcttctgaggaggaaagtggagaaggaaattccaaagagacaatcagagagcaatcttctgctgatgatcattctccagatttaagacagaaaagatgcaggaagaggtctggaccacaaggatcacctgctggaaccattggcagtatcgactacagctttgaggagaatgatgaattagttggtggaaaagaaattttagccacctctccgttgcagggagaaatgcttgcttgggggaaaaatggtgcacggagccaaaatcgacatggcagtgttggttcaaatggcaggactggaaggagtgggcgcattgcaaaattggttgattacctccatactgctgatgaaatggataaagagtttcagttgtttcttcttctccttcctgtcgatggacaaaccatacctaacttggaaaagccttatctaagctgtcgaccaaccttgtccattaaacatcttgcacagttcgttgctcttcagttgtcttgtgaagtcgaagaacttgagatgtacataaggatggaccgccaccgtgtaagtgttggctcgaggccttccagtacaggtgaggcaaaatcacgtccatttgatgacttggaaagactgaacgaagaaaaacttgtttcggagcttcatccttcatttgtctctagcaacggtgatatggagttacgatatgctttgagaactcgagagtagatcagtttttatcctcagctatcaatttatgaagtcatactgtccttgtgtaaaaaaaatgttcgatgtgaacaatgttgacgctgtttttctcattggtcatgctaagttaatttaccatctttgtaatatacataatgaactgattagcaaatgacctcagtaggtgaacccagttgtatgctatgtactgttcatttatgcgagtcgatggcagg

SEQ ID NO: 1713 - DNA, 1815 bp, Zea mays
gcacgagaccattacctagaacatcctaatcaaaaaaccctttcctcacgctctcgtctctctccacgaaaccaacgtcccctccttccccagcgccccgggggaggaacgccgctgcagccgccgggaggagtcggtgggcgtcctcctggacgcgaaatgcccgcccagaagctcctgatctcgtcgcccaccccggacgactccgacggccgcgttgcagtgcgtcacgccgccgccacccgccagcgggtgtcggaactcggaagcagggacggagcctcacgtgagatggatgggaaaaaaaaagtccgtgcgtcaggagagatcgtctcatcgggagcctcgcgacggtgtttcgcagatcgcgacgacgagcaggtgggtggccgcggcagacgagactgaaccgacacctacatcgagtcgttcctatcatcctatgcgcgccggcaccatggatgagtttatgctagtgaaattagcagagatacggaaggaggttcagtgccctatctgcttaggcattatccggaagacaaggacagttatggaatgtttgcaccggttctgtagagactgcatcgacaaatctatgcgactaggaaataacgaatgcccagcgtgtcgcacccattgtgcaagcagacgttctttgagggatgatcccaattatgatgcactgattgcagccctgtatccagatattgataagtacgaggaagaggaatttgctttcagtgagcaggagaggattcggaataaaaagatacaagaaaccattgaggaaacattcagaagacagtctgacgcaattggtaagaaacgttccatggcaaaagcaactgcaaccgcctttgcaaggaagtacaggagaacacgggggagagttagaaccattccccctgatattgcccctactggctcttctgaggaggaaagtggagaaggaaattccaaagagacaatcagagagcaatcttctgctgatgatcattctccagatttaagacagaaaagatgcaggaagaggtctggaccacaaggatcacctgctggaaccattggcagtatcgactacagctttgaggagaatgatgaattagttggtggaaaagaaattttagccacctctccgttgcagggagaaatgcttgcttgggggaaaaatggtgcacggagccaaaatcgacatggcagtgttggttcaaatggcaggactggaaggagtgggcgcattgcaaaattggttgattacctccatactgctgatgaaatggataaagagtttcagttgtttcttcttctccttcctgtcgatggacaaaccatacctaacttggaaaagccttatctaagctgtcgaccaaccttgtccattaaacatcttgcacagttcgttgctcttcagttgtcttgtgaagtcgaagaacttgagatgtacataaggatggaccgccaccgtgtaagtgttggctcgaggccttccagtacaggtgaggcaaaatcacgtccatttgatgacttggaaagactgaacgaagaaaaacttgtttcggagcttcatccttcatttgtctctagcaacggtgatatggagttacgatatgctttgagaactcgagagtagatcagtttttatcctcagctatcaatttatgaagtcatactgtccttgtgtaaaaaaaatgttcgatgtgaacaatgttgacgctgtttttctcattggtcatgctaagttaatttaccatctttgtaatatgcataatgaactgattagcaaatgacctcagtaggtgaacccagttgtatgct

SEQ ID NO: 1714 - DNA, 3198 bp, Zea mays
  misc_feature (1488)..(1488): n is a, c, g, or t
  misc_feature (2321)..(2321): n is a, c, g, or t
ctattctgtttactcaccaacaaatttattattcctgcggtaagttccccagattaatttaaagcccccactatgtaataccatcatgttctgggttatgtttgcttgtgggtgttattttgagggagttattgagggatgcatagtattgcataccgctttctcaagctaccattatttacagtttttctttcacaggctaaaacttttgttttcttgcatctcacacataattatctttcattctttatgtgatggtcacatgtagtcaataatcaatgtatagcagtgtgtcgtaatttgtaaattaataagccaatttttctgttacaattttccagtctaggcagctaagtatcgttcacagtattggtaagcagtcaaacttcttatatatatgttcttggacaagtgtccctgctagattacatctatttctcatatacttccatcccaactagatttcattcgtttctcctgtaattttgcagattagcaattatgctggggcgttcttcatcctgctttttgcttccatcttcgccactggtattttggagcttcgatggagtggtgttggcattgaggattggtggagaaatgagcagttttgggtcattggtggcacctctgcacatctctttgctgtgttccaaggtctcttaaaagtgctagcagggatcgacacaaacttcacggtcacatcaaaggcaaccgatgatgatggtgattttgctgagctgtatgtgttcaagtggacaactcttctgatcccccccaccactgtgcttgtgattaacctggttggtatagtggctggagtgtcgtatgctatcaacagtggctaccaatcatggggtccactattcgggaagctgttctttgcaatctgggtgatcctccacctctaccctttcctgaagggtctcatggggaagcagaaccgcacaccgaccatcgtcatcgtttggtccgtccttcttgcttccatattctcgctgctgtgggtgaagatcgaccccttcatatcccctacccagaaggctctttcccgtgggcagtgtggtgtaaactgctgaaatgatccgaactgcctgctgaataacattgctccggcacaatcatgatctaccccttcgtgtaaataccagaggttaggcaagacttttcttggtaggtggcgaagatgtgtcgtttaagttcactctactgcatttggggtgggcagcatgaaactttgtcaacttatgtcgtgctacttatttgtagctaagtagcagtaagtagtgcctgtttcatgttgactgtcgtgactacctgttcaccgtgggctctggactgtcgtgatgtaacctgtatgttggaacttcaagtactgattgagctgtttggtcaatgacattgagggattctctctcttgaaatttatatatgtatttctaatattcatgccatgtcattattgaaattaatagtccattctacggnacggattgatggaatggtgttcaagaaaccatacacgatctcttttgcagtttagaggagaccatggaaactttatgacaggctgtcaggagcgcattttccgcggcatcttgaagcagaggttgttccactcagttttgaagctgctctaaagtggagcagaggttgtttgaaacaaaaagtggcacagcggcgttttatatggatggataatcatggatatgtatgtcttctaaagagattacatcggggagtatctatagagcaatcagtggatcgatctcatcagtttgcgttttgcctgcaatggtcagttggtcactaccagatggccgctacccactaacctctgcaggcctgcaagctacaacagttcgcgtcaggacaccaacaatcgaacaaaactaattaacgaacggacaagacgcacccggccggtacacatatacagcttcgtcaacgacgaattgaggggaacatggcaacgaaattctccaatctccactggatcttcaaaatgcgagcgttccggtcgatcttggtctctcgacgaccagtcagactgtcagacccacgcaccgctacacgcacgcgtgctccgggcaagacctcatcgcgcaaccagggatgctcgccgcctcgagctcgacctcgccgacgcagctgccgccgctggccttcgccggggttgggacggccacgggaacaggaagcgcctgctgctgctgctgcggcggcgcttgcttcagggcggcggctggccgccgcttgcaggctggcgctgcaggctgctgcaggccgaggatggcatggtcgtcctcgggaacgagggncacgatggggaggttgtcgcaggtgcacacctcgaccatgaagccgtcggggtcgtggaagaagagctggtccacgtagatgccgccctcctccacgcgccgctgcacgtaccggatgcccagctccgtgagccgccgctgcactgcctccatgctctcgcactgcgcatagaccatcaccagttcacctttccgtcacgatgattttgtgttcatggtaagaagcacgtttacgtactgcatgcttttaactttatttgtcgttatttaaagtgcaacagtatatatatgcacgcatggctagttgtgcatgcatgcagatacgtcatacgtacttcttttggtccttgccagatgagcatatgcacgctgtctgagtgaagacaaactctatgtgcaacacaaaatcaataacctattgccatttttctaaaatcaaaatcacgtgcttttatcccaaattgatccaggactttagccgatactagttttctgccactgcctgatgcacatgcaatgatcctacccacagagcattaggaattcttcatcaattcgatctagctactagtagtcctatttctattatgttaaccgtcattgcgtaccgatcatgaatgccaaccaccagcgtccatttcttaaattaattgagatgcagatctatcagatggagccaacttaagataagatagttccatgcttcgtggatcagtcaccaactcaccaccagtcaccatgcatcttggcatgcatgaacacttgataacttggtagctaaataagatgtgttagctagatcagtcttagtaactgaattgtttcatatcctagtttctaatacgtctatattcagaaacgacaatgcagaaaagtg

SEQ ID NO: 1715 - DNA, 2893 bp, Zea mays
  misc_feature (690)..(690): n is a, c, g, or t
  misc_feature (720)..(720): n is a, c, g, or t
  misc_feature (2871)..(2871): n is a, c, g, or t
cctctaagtcgcatagttccgatatctccaaacgagcttaacctttatcggatcgtgattgttctccggcttatcatcctatgtttcttctttcaatatcgtataactcatccagtggaagatgcttatgggttgtggcttgtatctgttatttgtgaagtttggtttgccttgtcttggcttctagatcagttcccaaagtggtatcctatcaaccgtgaaacttacctcgatagacttgcattgagatatgatagggagggtgagccatcccagttggctccaatcgatgtctttgttagtacagtggatccacttaaggaacctcctctaattactggcaacactgtcctgtccattcttgctgtggattaccctgttgacaaagtatcatgttatgtttctgatgacggttcagctatgttgacttttgaagcgctatctgaaaccgcagagtttgcaaggaaatgggttcccttttgcaagaaacacaacattgaacctagggctccagagttttactttgctcgaaagatagattacctaaaggacaaaatacaaccttcttttgtgaaagaaaggcgggctatgaagagggagtgtgaagagttcaaagtacggatcgatgcccttgttgcaaaagcgcaaaaaatacctgaggagggctggaccatggctgatggcactccntggcctgggaataaccctagagatcatccnggaatgatccaagtattcttgggccacagtggtgggcttgacacggatgggaatgagttgccacggcttgtttatgtttctcgtgaaaagaggccaggcttccagcaccacaagaaggctggtgccatgaatgctttgattcgcgtatcagctgtcctgacgaatggtgcttatcttcttaatgtggattgtgatcactacttcaatagcagcaaagctcttagagaggctatgtgtttcatgatggatccagcactaggaaggaaaacttgctatgttcagtttccacaaagatttgatggtatagacttgcatgatcgatatgcaaaccggaacattgtcttctttgatattaatatgaagggtctagatggcattcaaggacctgtttatgtgggaacaggatgctgtttcaataggcaggccttgtatggctatgatcctgtattgacagaagctgatttggagcctaacattatcattaaaagttgctgtggcggaagaaaaaagaaggacaagagctatattgattccaaaaaccgtgatatgaagagaacagaatcttcggctcccatcttcaacatggaagatatagaagagggatttgaaggttacgaggatgaaaggtcactgcttatgtctcagaagagcttggagaaacgctttggccagtctccaatttttattgcatccacctttatgactcaaggtggcatacccccttcaacaaacccaggttccctgctaaaggaagctatacatgtcattagttgtggatatgaggataaaacagaatgggggaaagagatcggatggatatatggctctgttactgaagatattttaactggtttcaagatgcatgcaagaggttggatatccatctactgcatgccacttcggccttgcttcaagggttctgctccaattaatctttctgatcgtctcaaccaagtgttacgctgggctcttggttcagttgaaattctacttagcagacactgtcctatctggtatggttacaatggaaggctaaagcttctggagagactggcatacatcaacaccattgtttatccaattacatctatcccactagtagcatactgcgtccttcctgctatctgtttactcaccaacaaatttattattcctgcgattagcaattatgctggggcgttcttcatcctgctttttgcttccatcttcgccactggtattttggagcttcgatggagtggtgttggcattgaggattggtggagaaatgagcagttttgggtcattggtggcacctctgcacatctctttgctgtgttccaaggtctcttaaaagtgctagcagggatcgacacaaacttcacggtcacgtcaaaggcaaccgatgatgatggtgattttgctgagctgtatgtgttcaagtggacaactcttctgatcccccccaccactgtgcttgtgattaacctggttggtatagtggctggagtgtcgtatgctatcaacagtggctaccaatcatggggtccactattcgggaagctgttctttgcaatctgggtgatcctccacctctaccctttcctgaagggtctcatggggaagcagaaccgcacaccgaccatcgtcatcgtttggtccgtccttcttgcttccatattctcgctgctgtgggtgaagatcgaccccttcatatcccctacccagaaggctctttcccgtgggcagtgtggtgtaaactgctgaaatgatccgaactgcctgctgaataacattgctccggcacaatcatgatctaccccttcgtgtaaataccagaggttaggcaagacttttcttggtaggtggcgaagatgtgtcgtttaagttcactctactgcatttggggtgggcagcatgaaactttgtcaacttatgtcgtgctacttatttgtagctaagtagcagtaagtagtgcctgtttcatgttgactgtcgtgactacctgttcaccgtgggctctggactgtcgtgatgtaacctgtatgttggaacttcaagtactgattgagctgtttggtcaatgacattgagggattctctctcttgaaatttatacaaaataggataaaaaaaaaaaaaaaaaaaaaaaaaaaaaaaaaaaaaaaaaanaaaaaaaaaaaggggcggggcc

SEQ ID NO: 1716 - DNA, 1694 bp, Zea mays
gtctaactttcagttcctgaagggatgataatgagccaattacggaacacaagcaaggtcgctgccagtgatggtattggcaaggatgatatggcgaactttgcgcttatgggtggtggagcagaccacctgaggggaaacagcgtgaacacgttcagccaggctcacaacatttggaggcctcaaagagggcttcctgagcgtgcagtgtctgttcttcgctcatggctgttcgagcacttcctacatccgtacccaactgatagtgacaagcagatgctggctaaacagacaggcctaactaggaaccaggtgtcaaactggtttatcaacgcaagggtgcggctctggaagcccatggtggaagagatccacaacctggagatgcggcagcagctgcagaagaacacgtcggcggtggacaagacccaactcggcatgcagcagctgatccagcactcgtcggcaaactcccggcagcgggggcaaagcagcggcggcacgacgagaaaccaagacgagctgcccccgcggatgccccacgacatggcaggccagggccagcagcagcagcagcaggtgagcttcgcttacgctgggctccccgcgcaccaccacggcctcgcgctgtcgcacccccagcagcaagcggaagcggtcagcgccgtcggcggtggcgtttcgctcacgctgggccttcaccagaacaacaaccggacctacgtcgccgagcctctcccggccgcgctcccgcaccgtttcgggctggaggacgtgagcgacgcctacgtgatgcaggggacgacgtcgttcggcggccaggaccgccatttcggcaaggggatgggcggccaccattttgtgcatgacttggtcggctgatctcgttcttgcgactgttgtcggcatgcattgtatcatactattgttaggggcagcacaggcacgcacagtggaagagaccagaatatttgacagtgtggatgagggctatagagggcatgcacgcatggcccgtagcgttgaagatctgttccagttgtatgtagagttgatgagccctatttgttctaatcccagctggccaagtcgtgtgttgacacatgtaccactatttttctctgacatgaaattgtgaagtggaggttggaaacagtggctagttcttgctcctgtaggctgtaatgctttcttttgtcttcaaattatgaccgcgcgccttatctttcttgatgttggatatatgtggttagcctttccgtgcactccattaaactagaaaaggaggaggttggtggcagtattaaacccttcctgtttgttagggctgagctgttcctgttggtaacctagatttcgcgctaaacaaccagccaattagcctgtactggtgacatgggctactacgccatgatctggggttgtcgtcctgtcagttattttttttttctctctcttctccccagggtaaaaggcccatgttacctgggatccagttttgaaacaaaagaaaatttgaaagaattaccttggatcagttatctatccatgcacgcccttttttgcgtggaggggatccatgcacgtcactgactgtctactgctcagctcctccacggcagaaagcagccggtgttcttttgtttaaaaagggcactgttgcgaggctttctttcctaggcactgcactgcag

SEQ ID NO: 1717 - DNA, 7052 bp, Zea mays
  misc_feature (5176)..(5176): n is a, c, g, or t
attcatattcaaactacattatataaacggtacaacatacaatataaaacgatgtaaaataatatttttagtgattatatagtatattgtataatagttcatctatatagtcactaaaaatatcttttatactattttgcacggtaaattatattgtttataaagtatagtgtaaataagggacctttgcactctctcctctcctggccagcgtcgtctatagtctatacacgctctgacgcgcgcccgcggcctcgccctagctcgcttcgcggcctcgcgccctcccctccgagtcgcagggtcgcacgagcagacaatcaccaacaccctttctgtctttcgctttcactgctcaccatttcgcgtccttgcctcgccctctcgccgtagcgagcagctctttttcgtctccctccctcatctgctacgcacctttgcagaaagaaaggcgcccggaggtaggggtagaggtagagcccgagagcccaacacctccacccgcagcaaagcaccaccaccagtagccgagcgcacaaaagcgcgcggccgagacgcgggacaaagcaacgggcagcctgtactgcccgcttctagctgcagctaccctccagtcccagttccagccccggccaggcgctcgcaaagtgcggagccgccctctcttcgagtcttcgctcgtggtctctctctccaggtcgtgcagtacgatccatatcccggagctcttgcgcgagcgacatgtcctcggcggcgggcggtggatacggggctgcgggcggcgccgagcaccagcacctgttgctggggcaggcctcggggcagctctaccacgtgccgcagcacagccgccgcgagaagctgcggttcccgcccgacccggccgactcgcccccgcccactgcctggccggcgcctccacccttctactcctacgcgtcctcgtcgacgtcgtcctactcgccgcatagcccaacgctggcgcacacgcagctagtggcgcacgcgctacctgccggcgccggggcccaaatcccgagccagaactttgcgctctcgctctcttcggcgtcctcgaaccctccgcccgcgccgcggaggcagctcgccgcgggggtagccgctgggccgtacggcccgttcacgggctacgcggccgtcctcgggcggtccaggttcctgggccccgcgcagaagctactcgaggagatctgcgacgtgggcggacggcccccgcacctggaccggcgctccgacgacgagggtatgctcgacatggacgcggcggggggcgtggaccacgagatggacggcggtgactgcgctaccgctgaggcggtcgccgtctcgggcgccgagcagcagtggaggaagacaaggctcatctccctcatggatgacgtgagttaatcactacgatccgcctcccagcttcttgatccttcagcgaaaagcacgtcttttctgctcttgtttcatgtcgcaattatttcttcttcggcgagaagaatctaacgaacaccgctcatggtcacgtcacggagcctacatctcggttgaatctttatttactgttctggcacagattatttcttgtgcttgcgatatgatgatagtacatatggattgcgattcgacctctttcggatatgttggttcggttattatatgcatcaaatcattgtattgcaaacgttgggaggtttccattccctttcattttcccttgcgaaaactaggcaacttgctgtgaagttcttgctgaacagaattgcccagcagatcaaagcatgaaattgggacatcgaaatatatcagggttctctagttttgtcccgaagatttttcttcttcaaaattgctacccgataagattcctggagtttttgtcttctttcgacaaggatgcccatatgcagccgcgtaacctgcagccgtgcgattctgtttatctactcactatcttttgctaaaataatttctgttgttcacggttgtaatttctccatgcgaagtacaatattgttcacggttgcatcctgattccttgaacatacatgcctttggtgcagtcttgtcaagcggcaggaaaataaattcttgctatgtcctatgctcaacttcctgagtttattggctgcactaagtagttgttagttaagttctacattttgggtgtgttctacatttagactctttgagtacacgaaccttgcaggtctgcaggcgatacaagcagtactaccagcagctgcaatccgtgatctcctcgttcgagactgttgcagggctgagcaacgcggcccccttcgctttcatggctcttcggacgatgtcgaagcacttcaagtgtctgaaggggatggtgatgagccagctacggaacacgagcaaggtcatcgccaaccatgggattattgccaaggacgatatggcgaacttcgcgctcatgggtggtggagcaggcctcctgaggggaaacagcgtgaacgcgttcagccagcctcacaacatttggaggcctcaaagagggcttcctgagcgtgcagtgtctgttcttcgctcatggctgtttgagcacttcttgcatccgtaagtacatgaatgccatgtcttctgatcttgtttgctatgtttgaagtatttcagctttggtatatgtagtcagctactgaattcgggtgtggagcagtagtactacatatttgccattttgaaactactatgctatgatgataaggtgaatctgataatggctaaattctttgttgtatcggaagttttttttttcaaattgtgcatgcacttttttttttggctaatgataagtgcacaatggccactgctagtgataagtccagagttatgttttggaagatgagaataattaatgctagtattttttttctttagtcacaaattgtgaaatataattggtgttgattcattactatatatctggttacatgttctttcactgtcaacagtagcgcattgtttcagattttctcatggtgcccacatgttagctcatccctttgtacatcagcttgcaacctttgtatacagcgaccttagacatcaacaagaagtctagtgtattgttgtcattatacttgttttgatatcgccatctagggcacgtgctcccggtggatgcatagggggcacattgtgttgctatccctgcagtgagtttgttcgatggttgtttgattacttgctttgctttcacgtgctcattgtgttgctatccctgcttgcttggttctctatgtatcctaattctcatgtttggtgtccaggtatccaactgatagtgacaagcagatgctggctaaacagacagggttaacaaggaaccaggtaattaagttgcattgaatgtaaaagtaaaactaagaataccactagaattttaccaccagaaatgtttccaaatgtcaaatgaagacaaatctgctgtattgaaacgccattctgtccctaatatataaaagctcgtgaattcaccgagcaggtgtccaattggttcatcaacgcaagggtgcgtctctggaagccgatggtggaagagatccacaacctggagatgcggcagctgcacaagaccacatcggtggaccagaatcaactcggcatgcagcagcagaaccaccactcgtcggacggcagcgggaggccttcctccgacccttcgaactcccagcggggccaaagcagcggcatgacaagaaacctcagctctcgggcaccacgccacatccaggacgacgagctctcccagatgccccacgacatggcaggacaggtgagctttgcgtacagtgggctcccccccgcgcaccacggtctcgcgctgtcacaccaccaccacccccagcaagcgcaagctgaggcggttggtgttggcggcgtggccgccagcagcggcggcggcgtttccctcacgcttggccttcaccagaacaacaacaacaacagggcatatatcgccgagcccctcccggccgcgctcccgctcagcctcccgcaccggttcgggctggaggacgtgagcgacgcctacgtgatggggccgttcggcggccaggaccgccatttcagcaaggggatcggtggtgggcacaacttgctccatgactttgtcggttgatcaaattcgtccctggaagtgtttgtcggcatgtattgtattgttaggggtagtagggcagtggaagagagacgaccgtttggtccatctgcatccaagaacgctgtcgatatttgccaactcgaggtctatagagtggttgacgacataccgttgaagatgtgttccagttgtatgttgtagagttgaacgaaccctatctgttctaatcccagctggtgtggcgttaacacatgtaccgctgttccggccttcgacatgcaagtatgcaactgaaggtgaaggttgaaaactgtgtggttattagttcttgctccatgttgattgatctttttttcttcaacaattgtgattacagtatagcttcattgcgtagccctaaaatatgactgctggatggttagtgggcaggtggtagactggtagccagccttatcttgatgttggatagatgtggttagcctttgcatgtactcccattaaaataagaaagcagggtggtggtggtggcagtattaacctgtggcagatcttgcatccttagatgggagtacgcctcctaaagcttggacaggccatgcatgatccggccatctgctacatgaccagcacacgcgttggcgttgtcatcagaccaggacctagctagtactaacagctacgtactactaacaaatccaaatcctgttagtagggctgagctgtgcctattggtaacctagcttccgccttgatttacgcactaaacaaccagccaattaggcagcggcgacatgggctacgccatgatctggcttgccccggggggctggctgtcctggcaaatgtttgtttttttcacctttgcccagggtaaaaagcccatgttacctgggatgaggccctcggtgctgcagcgccccttttgacgtacgctttggcgagtagaaaaacagctggagggctccatgcacgcccttttttgcgtggagggaatccatgcacgtcatcactgactgcctgctgctcaggctcaggcgntcagctcctccctcgcgcgcgcggcagcagaaagcaaccggcgttctttgtttaaaaagggcactgttgcgagctcctttcttttctaggctccagcgagcggtgcctgcatctgcatgggcaggcagattattgctctctgatcctgcgtgcccgccgagcaaaacatgatgcgctgccttttccctatgccttcgatcgtcttcatggataaagcagagggaggtgatcattgccactcatggagtagggggccggggaactggatttgccaagctgcttcagtattcagcagcggacggacgggctagcttcatggagcatgcatgggagctagagggaggaaaggctgccgggcacattccagcttctatgttgttgtaggacagtaggggagcagtacgctccacactccggtagtgtcgtcgttcggcgtgaaaaggagctagaacaacgacgctctctcgtcaagtcaggatcacgttaactcatgtcagcagttcatgagctgtaagcatcttttaaccagagactactggccgtaggaatggatggagacgtaggtgtttttgattttggtgtgtacctgtgtgctcttctctaacttatgatgggaccaggagggccagttttggtgcttttgttccttctgtcggcaatttcgttgctttttcccccctgagaatagactggtatcataaacattttctacgctttgtctaaggttaaatatcttttcactaaacactgatgctaactagctagcatactggtgcccagtagacaacatctatttcactctggctggatggcatggcagctgagagcaactaactgataacaccggaggacagcacatcaggttcgaatggagcaaattctctgaaatttaattttgtctcctagctaccatatatatatgcctgcaaaaaaagacgctatctggtacgtagtagtataaattgtcgtgtgtctattttaaatctcgacttttcggacaaagtattattataatctacaaatgaactatatggactttgtcaagattgaaattgaagctttttaataccagctgctgatatgtttttaaggtgatttaatttgtaccggccgcggcacctgataatgatcagtagtgcaactgccacgcccacgctgctagctgcaacgcttctgctttgaacgcgaagcgaagacctttccttgttttgtttcctttcccccttgtcactaacatttctcatcaatcaagtgatcgacaggatatcaaagcatttgcagcggcaacaggtgtaggtgcaggtgcatgcatggcatggggccatggggggcacacaactgcggtgcgaaagcaagcgcccaaagctaaaggccaacggcctttcgacgaccctaagcctaatccgcgtcaggtagtgggggttctcgttaagcatatgttcctcttccacccccctttaagatatggccgatctgacgatcagtccctggatttgccacttccaaagggaaaaggggggatgccgtgcaatgcctgccttttgtttgtctagtccgagtggccatctctgttcactccggccggacgcggccgctgtcacacaccaccaccaccgccgcctcctcctcctcccgcagcagcagcagcagtggcgcaacgcaacgtgctttccctcggaaatgacaagcggcactgtgccgaatagaataattgcttttcttgggaaatgcaggcaggcaggcaggcactggcgctctgaaccagagctggagtgcaagtaagcgttcagcaggattggatggcttttgcatcatgaatccctgccctagatttctgcctgcggcgcactgctgctgctgctgctgccgcctgcag

SEQ ID NO: 1718 - DNA, 2404 bp, Zea mays
ccggccgggaatgatcttgccggccgggccgcgacctttgcagaaagaaaggcgcccggtggtaggggtagaggtagagcccgagagcccaacacctccaccagcagcaaagcaccaccaccagagccgagcgcacaaaagcgcgcggccgagacgcgggacaaagcaacgggcagcctgtactgcccgcttctagctgcagctaccctccagtcccagttccagccccggccaggcgctcgcaaagtgcggagccgccctctcttcgagtcttcgctcgtggtctctctctccaggtcgtgcagcacgagaccattacctagaacatcctaatcgaaaaatgtcctcggcggcgggcggtggatacggggctgcgggcggcgccgagcaccagcacctgttgctggggcaggcctcggggcagctctaccacgtgccgcagcacagccgccgcgagaagctgcggttcccgcccgacccggccgactcgcccccgcccactgcctggccggcgcctccacccttctactcctacgcgtcctcgtcgacgtcgtcctactcgccgcatagcccaacgctggcgcacacgcagctagtggcgcacgcgctacctgccggcgccggggcccaaatcccgagccagaactttgcgctctcgctctcttcggcgtcctcgaaccctccgcccgcgccgcggaggcagctcgccgcgggggtagccgctgggccgtacggcccgttcacgggctacgcggccgtcctcgggcggtccaggttcctgggccccgcgcagaagctactcgaggagatctgcgacgtgggcggacggcccccgcacctggaccggcgctccgacgacgagggtatgctcgacatggacgcggcggggggcgtggaccacgagatggacggcggtgactgcgctaccgctgaggcggtcgccgtctcgggcgccgagcagcagtggaggaagacaaggctcatctccctcatggatgacgtctgcaggcgatacaagcagtactaccagcagctgcaatccgtgatctcctcgttcgagactgttgcagggctgagcaacgcggcccccttcgctttcatggctcttcggacgatgtcgaagcacttcaagtgtctgaaggggatggtgatgagccagctacggaacacgagcaaggtcatcgccaaccatgggattattgccaaggacgatatggcgaacttcgcgctcatgggtggtggagcaggcctcctgaggggaaacagcgtgaacgcgttcagccagcctcacaacatttggaggcctcaaagagggcttcctgagcgtgcagtgtctgttcttcgctcatggctgtttgagcacttcttgcatccgtatccaactgatagtgacaagcagatgctggctaaacagacagggttaacaaggaaccaggtgtccaattggttcatcaacgcaagggtgcgtctctggaagccgatggtggaagagatccacaacctggagatgcggcagctgcacaagaccacatcggtggaccagaatcaactcggcatgcagcagcagaaccaccactcgtcggacggcagcgggaggccttcctccgacccttcgaactcccagcggggccaaagcagcggcatgacaagaaacctcagctctcgggcaccacgccacatccaggacgacgagctctcccagatgccccacgacatggcaggacaggtgagctttgcgtacagtgggctcccccccgcgcaccacggtctcgcgctgtcacaccaccaccacccccagcaagcgcaagctgaggcggttggtgttggcggcgtggccgccagcagcggcggcggcgtttccctcacgcttggccttcaccagaacaacaacaacaacagggcctatatcgccgagcccctcccggccgcgctcccgctcagcctcccgcaccggttcgggctggaggacgtgagcgacgcctacgtgatggggccgttcggcggccaggaccgccatttcagcaaggggatcggtggtgggcacaacttgctccatgactttgtcggttgatcaaattcgtccctggaagtgtttgtcggcatgtattgtattgttaggggtagtagggcagtggaagagagacgaccgtttggtccatctgcatccaagaacgctgtcgatatttgccaactcgaggtctatagagtggttgacgacataccgttgaagatgtgttccagttgtatgttgtagagttgaacgaaccctatctgttctaatcccagctggtgtggcgttaacccaagtaccgctgttccatcccctcgcccctgcaggggatgcttctgaaggtgaaggttcacaactgtgtggttatgaaaaaaaaaaaaaagaaagcggccc

SEQ ID NO: 1719 - DNA, 1890 bp, Zea mays
attcggctcgaggcggcgacacgccagggcggagagcacacaccgaagcgggccgcggcggcggcgcaggcgcaggcgcttacatgggagtagaggcgggcgggtgcgggcggagggcggtcgtgaccgggttctacgtctggggctgggagttcctcaccgccctcctgctcttctcggccgccgccgccgccgcagactcttactagctagctagccaccttcttcctcctcctccttgtaggtagtagtagtagtaggctacacaacaacgaccacatatatatatacatactaggtactactagcaggcgagcgagattcgtgcagtaattaaggccgcagccagttaataataattagtcgtcggcgagcgagagagatggtggaggaaggcgccaccgcggcggcgtcgaggagcgggccggcgccgttcctgagcaagacgcaccagatggtggaggagccgggcacggacgaggtgatctcgtgggcggagcagggccgctccttcgtggtgtggaagcccgtggagctggcgcgcgacctcctcccgctccacttcaagcactgcaacttctcatccttcgtccgccagctcaacacctacggtttccggaaggtggtgccggaccggtgggagttcgcgaacgagaatttccggcgaggcgagcaaggcctcctgtccggcatccgtcgccgcaagtcaacgacgccgcagccatccaagtacggcggcggcagcgtcgtgaacaccgcgttccctccgccgttgccctttccgcctcccgcgtcggtcaccacgtctggcggtggcggtggtgctggcgctggcaacgagcgcagctcctcgtcggcatcgtcgccgccacggaccgacgacctgaccagcgagaacgagcagctcaagaaggacaaccgcacgctgtccaccgagctggcgcaggcgcgtcggcactgcgaggagctcctgggcttcctctcgcgcttcctcgacgtccggcagctcgaccttgggctgctcatgcaggaagacgtgcgagcgggtgccggtgacgacgccgcgccgcgccgcgcaatggtcagccagctggagcgcggcggcgaggaggggaagagcgtgaagctgttcggcgtactcctcaaggacgccgcaaggaagagggccaggtgcgaggaggcggcggccagcgagcggcccattaagatgatcagaatcggcgagccgtggatcggcgtcccgtcgtcgggcccggggcggtgcggcggcgggaattaagtaaggtatggttggaactgatgcgccacggccggccgtgtgacagctttattacagcgagcgcatgttcgagtcgtggatgctttttgtgcgtgtttgtatttgtcatccaaggtgaggttgatggcaaggataattccagtgctgtggtaaaactgtgaaggcagaacacagggcacaggagataaccgtaacgcatgttaaaagttaattatgggatgctttggaggtagcaagattgaaagtagggaactagggatgaccggatgagtagacggtctagaaagacaagcccatatgtttggaatggaatattatcgtttttatatgttttgttaatctgttagtatttgtttggctgcactctaatacatcatatatttcatccgtctcacaaaaaaaaaaaaaaaaacaaaaaaaaaaaaaaaaaaaaaaaaaaaaaaaaaaaaaaaaaaaaaaaaacaaaaaaaaaaaaaaaaaaaaaaaaacaaactaataacaaaaaaaaaaacaaaaaaaaaaacgcctgcccttttaaagaacccaagctaacgaccccgaccatgcaacttataacgttttacatggggcccccaaaattaaatcacctg

SEQ ID NO: 1720 - DNA, 858 bp, Zea mays
cgcccccgattaaagaatagtgcagaatctgaaaatatgaactggattttggctatttctaagccctgtccgaagtgcaaaggaccaggagagaaaaaccagggatgcatgcatatgacatgcacccctccttgtaaattcgaattttgctggttatgtctgggcgcatggtcagatcatggagagagaacaggtggcttttatgcttgcaatcgttatgaatcagcaaagaaagagggagtttatgatgagactgaatcaaggagggaaagagctaaaaactctctggagagatatatgcattactatgagcgctgggcatccaatcagacatcgaggcagaaggcccaagcagatctgctaaaagcggaaaaggatcagcttgcaaatctaacatacatttacgggataccagagacccaacttaagttcataattgaagcttggtcacagattatagaatgcaggcgagtgctgaaatggacatatgcttatggctactatctggatgataaggtcaagagtgatttttttgagtatctgcaaggtgaggctgagtctggtttggaacgtctgcatcagtgcgctgagaaagacttgcacaattttttgactcctgtgaaatttgagagcactgaaacgacgacccctacagtggctgaatttggtgaattccgggtgaagcttgctgggctcacaagcgttactcggaattactttgagaaccttgttcaagctttggaagctgggttggaggatgtccacgccactgcccaggctgctggtacatccatcgccggcaccagctccaagaaaggaggaactaaatccaagaagaaacagcacactaagccatcg

SEQ ID NO: 1721 - DNA, 2688 bp, Zea mays
  misc_feature (2675)..(2675): n is a, c, g, or t
gccggccgggcctgggttaactctaccgacctccgctcaccgccccctttcctcctatccctcccccagagccccgacccggccggccggccggccggaaccctagccttatcgcccctccctttcccgcctcgcctccgcgcgatctcccgatcgccggattcgtgccgcggctggatggactccgacgtggagatgaacaccgccagcgatgaggaggtgatggacaacgatgactactacgactactgctacagcgacgtgggcgacgacggtgggagcaacagcgggagcgaggagctggtggccggggactacgacgagggcctcgaggccgaggggaccgacgaggtggtctctaggcgcgagcagacatttgtggttttaaacgaacaagttatatctgaacgtcaagccgaagatgtgagcaaggtatctgccgtcacactgattacaagggaggaggcgtgtgccctcctccatcactataaatggaacatcagcaagctgagtgacgaatggtttgcagatgaagaaaaagtccgccatactgttggcttacttttgaatggaaatcatgacccccgctctaggaagctagtctgtggaatatgttttgaggggtgttcttctgatatgatgagctctgctggttgtgctcatttttattgccatgaatgttgggaaggctacattagcgctgcaattggtgatggtccaggatgtttgtcattgcgatgccctgatccatcttgtagtgctatggttcttcaagggatgattaatgaattagctaaagatgaggatagaaaaaaatatgcacgatttctcttacgcgcatatgttgaaggtagcaagaagactaaatggtgtccagctcctgactgcacatgtgctgtggagttccttggtgatgaaaactatgatgtttcatgcaattgcatgttcagcttttgttggaattgcactgaggaagctcatcgaccagtgaactgtgagactgtttctaagtggatattaaaaaacagtgcagaatctgaaaacatgaactggatactggctaattctaagccctgtccaaagtgcaaacggccaatagagaaaaaccagggatgcatgcatatgacatgcacccctccttgtaaattcgaattttgctggttatgtctgggtgcatggtcagatcacggagagagaacaggtggcttttatgcttgcaatcgttatgaatcagcaaagaaagagggagtttacgacgagactgatgcaaggagggaaagagctaaaaactctcttgagagatatatgcattactatgagcgctgggcatccaatcagacatcgaggcagaaggcccaagcagatctgctaaaagcggaaaaggaccagattgcaaatttaactgacattttcgggataccagagacccagcttaagttcataatcgaagcttggtcacagattatagaatgcaggcgagtgttgaaatggacatatgcttatggctactatctggatgataagatcaagagtgaattttttgagtatctgcaaggtgaggctgagtctggtttggaacgcctgcatcagtgcgctgagaaagacttgcaaaattttttgccgtctgtgaaatctgacagcactgaaacaacgacacctacagtggctgaatttggtgaattccgcgtgaagcttgctggacttacaagcgtgactcggaattactttgagaaccttgttcaagctttggaagctgggttggaggatgtccgtgccacaggccaggctgctggtacatccagcactgccaccagctccaagaaaggaggaactaaatccaagaagaagcagcacactgcaccatcatctgaccacactgatgatgggtggccctgcgagcgctgcacatttcttaaccctcctacagtggatgcatgcagcgtctgcgaaaagagtaggtactagatgatggaatagctcaaagggagccagggaggcatcccaagaaaacctcaaagctcgtgagaagcatgcatgcatcggatgctgagaagaagagcttccagctgccgcaatgttgtacagagagttattttagggcctcggttggaaacggtgtggaggctcaagtggtcacatgtttgtgggggtcatttggttttctagttcttttctgttgttccttgtaaatatatttgttgtgatgtggtgacctgtgtttatgtgatgagtttttgtttctgacaaactgtgaaattaaactttaacaaaactgatgagaggtagctctgtttattccctcctaattgcgggcagggtctttgtctattcttccaacattatttatctacggttacttgccaagttaccagcggcggctgctggtcaatgttacttcaaagccgatcatcgcgtgatctgttttcccatatagatagaattgttgagcatagttagggtttcggggctagtccctgtataattatttgtatatcctcagcgtaatgagcttggctattcagcctatatatatgcacagggttagggttttcccttcaacttggtactagagctagattttctcttttttttcttctccctgcccaccaccagcctctgtccctagttaggtccctgcccagtggttgtgcttcggtggccgcgctcctcccctngcaggcatgcaag

SEQ ID NO: 1722 - DNA, 1293 bp, Zea mays
cgggaaggccacattgctcaggctgctcccaactcccatcctccccctcccggagtacgaagtactagaaagagagcggctttcctctaagaatggcgggtggcggcgccggcgacgacgacgtggtggtggtgagctgcggcggcagaggcggcggcgaccccggcgcatacgccgcggtgctcaagaggaagctcgacctgtactgcgccgccgtcgccaaatccatggaagctaaatcacaagaacattcgttgggctaccccaactcacaagcttcagatgcttcgcaattgatttctcaagcttcctttgatggtgacatagatggggcaagcctagttacaaactctaatgtcatagaagatgatgattttcaaggcaagccaaccaacagtggcacatcaaaggaactgtcagacgatgatggtgaccttgaagagaatactgaccccgctaacgccaagaagatgaggagaatggtgtcaaaccgggaatcggctaggcgatcaagaaagaggaagcaagcacacttgaccgatcttgaatcacaggtttccaggttaacgtctgagaatgcatctttgctgaagcgactggctgatatgactcagaaatacaaggacgcttccgttgacaataaaaatctaacagttgatgttgagactatgaggagaaaggtgaacatagccgaggaagctgtcaggaggctaactgggatcaccctcatgctaccgaccgcgtttgagaagcacgcgagcagcgcgcccctgtcatcatgcccatctgatgcagcttctgcttctgcttctgccgccgccgccattgaagatagcctgaagcatttcctccaggcgccacttgaaaacagtgggatcatcccaaacgcagcagtttttcagaccaagccagcttctctgcaccgtgttgctagcctggagaacctgcagaagaggatcgtcggggatgcaatgtattccgagaccgcgtcaacgacattctcagatcctgaagctcttgccgataggtaaaggttgctcctgttctgtcctgtgatgaacagccgtgtgatgctctagcggcctaagtgcttctggtaatggaagttgtagcacccatgcgcctgggtggggtctacacagtgatttgtacactattttgaaggttaataataattgttgagaaatgatctcatccctttgtacctatataagtaaagtattccattaataaagagaatagagttttcactcttcaaaaaaaaaaaaaaaaaaaaaaaaaaaaaaaaaaaaa

SEQ ID NO: 1723 - DNA, 2186 bp, Zea mays
  misc_feature (2182)..(2182): n is a, c, g, or t
ggccggggctcaggctgctcccaactcccatcctccccctcccggagtacgaagtactagaaagagagcggctttcctctaagaatggcgggtggcggcgccggcgacgacgacgtggtggtggtgagctgcggcggcagaggcggcggcgaccccggcgcatacgccgcggtgctcaagaggaagctcgacctgtactgcgccgccgtcgccaaatccatggtgacatagatggggcaagcctagttacaaactctaatgtcatagaagatgatgattttcaaggcaagccaaccaacagtggcacatcaaaggaactgtcagacgatgatggtgaccttgaagagaatactgaccccgctaacgccaagaagatgaggagaatggtgtcaaaccgggaatcggctaggcgatcaagaaagaggaagcaagcacacttgaccgggctcgacgcacagcgtccgttccaggttaacgtctgagaatgcatctttgctgaagcgactggctgatatgactcagaaatacaaggacgcttccgttgacaataaaaatctaacagttgatgttgagactatgaggagaaaggttcgttcgtcttgaatgcatcacagacctttttcttctttttgttgtacgagagctcttaactgcatccatttatcgatcataacatttttactgggctctgcgtatactcaccgtaatcaacgtttacatctctctagatggctgcaaagggcagtgaaagtaatatgattgctcatagttcttattttagaacctgcaagtacagttttagtttctaatggtttttaactgcacccaaaaggtatggcagcattttcatttgattctctgacattctgcataccttctacaagtgtgataggaataatttagtttcttggtgataggaataatttagttccttggttttgttttcttgcagtatcatttcagatattttatttccttgtattatatatatatatattttaaagaataacagtgttctcttacaggtgtgaggagttgtaaaacgaaacaaaacattaaggggctgtttggtattatgcctaaactaccaactcccgccagacttttgctgccgcaggtgtggcggccgattcggccgccgcagcctaggcgcggcgtggcgtcgggcgtaagacaccaaactggccctaaaagcgcacataccatgccgcaatgcgccaagtgtgtgtcccattaagcctgtggggtgttgcccttgccttgcctggtggatgggctgctctatctcaaatgataccgagaggagtccaaacagaatactaccatacaaacatttcttaatgcttgtgtgtgagtatatgcacaactctgtactcttgtatcattagtaaaactgtgtttttttaaatatccatgctgaagggttctaacataatcatgttaagtttttatgaaaaaaatttgcttaaactatgactgttccaatcagttttttacctaaagaaggtattcacaagaatcttggcatttaacagacctgcacaccttgactttatgaaaagggacatgtcttcaggaacacagtactgttttaattccaggtgaacatagccgaggaagctgtcaggaggctaactgggatcaccctcatgctaccgaccgcttttgagaagcccacgagcagcgcgcccctgtcatcatgtccatctgatgcagcttctgcttctgcttctgccgccattgaagacagcgtgaagcatttcctccaggcgccacttgaaaacagtgggatcatcccaaacgcagcagtttttcagaccaagccagcttctctgcaccgtgttgctagcctggagaacctgcagaagaggatcgtcggggatgcaatgtattccgagaccgcgtcaacgacattctcagatcctgaagctcttgccgataggtaaaggttgctcctgtcctgtgatgaacagccgtgtgatgctctagcggcctaagtgcttctggtaatggaagttgtagcacccatgcgcctgggtggggtctacacagtgatttgtacactattttgaaggttaataataattgttgagaaatgatctcatccctttgtacctatataagtaaagtattccattaataaagagaatagagttttcactcttcgaaaaaaaaaaaaaanaaaa

SEQ ID NO: 1724 - DNA, 1865 bp, Zea mays
tcttcagaaaccgtgtgctccccgaagcaggggagatatcttcctcccagcgcgggcctgccaaatcgcggtcactgctccgaagtccgaaccttcatacacatcgtctcgtttccgatttccccaaattcaggccacaggcgctacaggacccaggcaccactcggtcggcggccaccgcgtcgccccgcctgctcgattggggtcgcgtgtgcgataggaagtattgtgttgtgtttgcaacgtgatagcttgtactgggaacaaaggtcaagatgggcgccttggacctacaccttgactttgcttctgctcaacatggacaagccaagttaaaggaatatgccaagagctctctgttgtctgatggaaactacaatacagacaagatcaatggttcaaaccctgatgactatgagaaatttgagaaagggataatgcactatgggtgtccacattatagaaggagatgccgcataagagctccttgctgcaatgaaatttttgattgccgacactgccacaatgaaactaagaattccattaaaattgataaaatgaagaggcatgaacttccacgccatgaagtgcagcaggttgtatgctcattgtgtggcactgaacaggaggtgcgacaagtatgtatcaattgcggtgtttgcatggggaagtacttctgtggtttgtgcaaactcttcgacgatgatgtctctaaacagcagtatcactgcaacggatgtggaatatgtagaatcggagggagggagaatttcttccactgttcaaaatgtggatgttgctattcaattgcgctgaagaatagtcatgcatgtgttgaaggggcgatgcatcatgactgtccaatctgcttcgagtacttgttcgattcgacaaatgatgtttccgtcctgccttgtggtcataccattcatgtaaagtgcctgaaagaaatggaagagcactgccagtttgcatgccccctttgctccaagtcggtttgtgacatgtcgaaggcatgggaaaggctcgacatggagctggcaactctgtctgactcctgtgatcacaaaatggtccgcatattatgcaacgactgcggggcaatatcagatgtgcagttccatttgattgcgcacaagtgccagaattgcaagtcatacaacacccgccagatttgaagtaagaatcgcaagtcacacaacaccgtcagatctgaaatagcaaatcctgtgggggtttctgcatttcttcaagaagcgtgatggactgatggccccttcccgtgagctgctgagcaccgggatgtctggcaagacactcatcactgtatccactccactgggtcctgcggaggcaaacagctcgagattgtatatctgctgctagctgccgcccttcgttatgcataagcctactcttgccgttttactcctgtcgctccgtgattctagtgtaataatgttatatttagtgctgcttcaagcgtacggctgcggttgaacggcggcggcggctgctgagccacagtaccttgctgttgctgagactgcacccagccacagtgcgccgccgccgcagcagcttgtagctggactttatgaaggtgcctttgttccgcaaggaagagttcttggttgcgggtagctattaaggccatctccaatagatgtcctattatatcccttatttcatcctctatttcaaactttatataaatagtattaaatatctcatctaaaaacaaaaaaaaaacgcgcgggggggccagtctttagttaggaaaatgtgaacggtgtgcacctgtggttgtacgtcaaatccggatcccattttctatgcatagataattatagtgttgtgttccc

SEQ ID NO: 1725 - DNA, 560 bp, Zea mays
ggagctcactagtccccccccccccccccccattccgctatatgccccagctatacccagatgagaacaggaagggacagtttgtggactacttgcaggctattgatttatgtattctttggtaaagaatcgggaagggcatttttcttatgcaggttgcataaccactggtgatatgagatgatctctattcgcttggaaagtagagataggttaaatttcggtctgaacggtgaaaccttaaataaaatcttaggatgctgtgtgagagaagcatgctggctccctcaaaggtatgtttgattgaagaatcaacggattgaaaatctcttatggatagaagtgcttattaactaaagattttgaagaagaagctgctgtctgctggaggtaggcttccttgaaatctaacgtcttaatgaacctttaagatcataacaacgtgcacgagtggtacatgctaacacgtcgaaacccttgtcacgaaagaatcatgtttctttcttccttccatttcctggcatttgatgcctatgatgtgttcctcttgccagagaatg

SEQ ID NO: 1726 - DNA, 4586 bp, Zea mays
tggaatggtcacattctaaaaaattagcatattcaattagtaagattccaattccttaaaatgaaagaaacaaacgggaccttatagtttttttccaatctcatccaatctacatgagatagtaatagccgaacaaggccttacatgtttgacgacatatctttctatcacaacatgatatagaaaactcctttctattgtctctcgcccatatttataagctatgtagtactagttcatattgttgggatttgggagcactctacgtgtgctcatcacactaggattaggattgcaaagggagcatttaggtaatgtttggttatagagttaggtagaaccgagttgttccgttccagcctatagcatgtttaatttgattataggtggaatcgtgctgctcccgaagtaaaatattcatctaatatgttgcatctctgagtccctaaaaacaatcgaacatgtgcgctcgcgagccaagcacccctctccctatttttgtcggtagcctcttttctgttctacttatctataaaaccaaacataaaataaagtcgttttgttttgctttattttggaaccaaacaaaaacataatgttttcgttttaactagaacagaactattctatccttagaattgaaatagagccactatctaactaaggttatatccagtggccttcatatcacattctatattccactctctatttcaatctctactttataaacagtactacatctgttctcgaatatttatcgatcgttagtctatttttgtactaaatcgtgataaataaaaaagaatagaaaaaatacaaaatattgttttgcacgccaatttataggctattgttagaaaaacacagagcttatccacccgctccggcctctgttctaccaaatggcgacagctccgcccggcacgacgcacgaaaccatgaaaaacgcactctcacaagtgtgagatatttgggattttgcccacctcagggcttgttcggttattcccaatacaccctcagggcttgttcggttattcccaatacacatggattggatgggattgaaaaaattatgaagaagtttgagttgtttaggattcaaacccatccaatcccgctcaatccacatggattgagagctaaccgaacaagccctcaacgttgcttgattgctaaaaatgtcaattgagtgtatgattggtgggcccgttagcgttttcgtcgtcgtcttctcaccgtcgcaatgataagggcctttcagtcgcggtccactaggccctaattcggcacgaggcccgaatcctccagaaaccgtgtgctccccgaagcagtttaaatatcttcctcccaaccttccctgccaaatcgcggtcactgctccgaagtccgaaccttcatacacatcgtctcgtttccgatttccccaaattcaggccacaggcgctacaggacccaggcaccactcggtcggcggccaccgcgtcgccccgcctgctcgattggggtcgcgtgtgcgataggaagttcgtcatacgcctcgcggtttttctagtttccgttttgatttctatgcgcccaatgttttgtccgattgattgatctgcttaggtacgtgagactgtctctattgttcgtgagtgcgtagatggtgggtgagtctggttgtttagatttgtgactggttgctcgacttgattgtgctgactgattgtttcatctatcgtgtaagctgtattaatgtctaatcccttaattgctttgaaaccactgcatgtgcttgattagtttggtttgtaccgacagcttttggtgcctatttgtgatgagattgaacatcctgctgcttgtgtttaatcttctaggttcgtgttcttgctgtatgcgtggttaatggttgactagtacttctctgatgctgaggatgattgctattgattgactagaatttaacatttccctgtggggaagtaatctcctatgttctgtcgaaagcagcacactctggcaactgtattgctgcatatattttccgtcaaaaaaatatttgctaaacatgaaaaccacacttattttgccttttcatctctccttgtggcacaatactatggcccagttttgaacctatggcccaacactcttagctaataactcaactaattgttaactaactcgcagctaacaattagttcattagctgcctcaatccagctaacaatttgttagctggctaactattagatttaggggttccaaacatgactgtatcaattgacttcctctgttggccgacctttgcatatatcatcaatgagcagaaaaaaaacaggttttgtttttgctaaattaaggagaagtatcgctcgaatttagcatcgtaatgggggaacacatcatcttctcgatgaattccgctatatgccccagctatacccagatgagaacaggaagggacagtttgtggactacttgcaggctattgatttatgtattctttggtaaagaatcgggaagggcatttttcttatgcaggttgcataaccactggtgatatgagatgatctctattcgcttggaaagtagagataggttaaatttcggtctgaacggtgaaaccttaaataaaatcttaggatgctgtgtgagagaagcatgctggctccctcaaaggtatgtttgattgaagaatcaacggattgaaaatctcttatggatagaagtgcttattaactaaagattttgaagaagaagctgctgtctgctggagagaatggtgtggacaacgcggtaaatttggtgcagatggatggtgtgttcaaattgatcggagttctctggatggatacctatcgagtagtataattcctctctcagctcactgtccagacaattagtgctatctgtgactgttgggcaatcaggttatcgagattttgctggttggagctgtccggcattgctttcatcttttatcaatatgccgggtctttggcagcatatggcgattcagaactgtgcgcagtggtttcctcgaatttaggaccccccaactgcattctgtattgagaacattcctgctaaatacatgatacttgcaggtattgtgttgtgtttgcaacgtgatagcttgtactgggaacaaaggtcaagatgggcgccttggacctacaccttgactttgcttctgctcaacatggacaagccaagttaaaggaatatgccaagagctctttgttgtctgatggaaactacaatacagacaagatcaatggttcaaaccctgatgactatgagaaatttgagaaagggataatgcactatgggtgtccacattatagaaggagatgccgcataagagctccttgctgcaatgaaatttttgattgccgacactgccacaatgaaactaagaattccattaaaattgataaaatgaagaggcatgaacttccacgccatgaagtgcagcaggttgtatgctcattgtgtggcactgaacaggaggtgcgacaagtatgtatcaattgcggtgtttgcatggggaaatacttctgtggtttgtgcaaactcttcgacgatgatgtctctaaacagcagtatcactgcaacggatgtggaatatgtagaatcggagggagggagaatttcttccactgttcaaaatgtggatgttgctattcaattgcgctgaagaatagtcatgcatgtgttgaaggggcgatgcatcatgactgtccaatctgcttcgagtacttgttcgattcgacaaatgatgtttccgtcctgccttgtggtcataccattcatgtaaagtgcctgaaagaaatggaagagcactgccagtttgcatgccccctttgctccaagtcggtttgtgacatgtcgaaggcatgggaaaggctcgacatggagctggcaactctgtctgactcctgtgatcacaaaatggtccgcatattatgcaacgactgcggggcaatatcagatgtgcagttccatttgattgcgcacaagtgccagaattgcaagtcatacaacacccgccagatttgaagtaagaatcgcaagtcacacaacaccgtcagatctgaaatagcaaatcctgtgggggtttctgcatttcttcaagaagcgtgatggactgatggccccttcccgtgagctgctgagcaccgggatatctggcaagacactcatcactgtatccactccactgggtcctgcggaggcaaacagctcgagattgtatatctgctgctagctgccgcccttcgttatgcataagcctactcttgccgttttactcctgtcgctccgtgattctagtgtaataatgtcatatttactgttgcttcaagtatggcccgtacggctgcggttgaacggcggcggcggctgctgagccacagtaccttgctgttgctgagactgcacccagccacagtgcgccgccgccgccgcagcttgtagctggacttgatttatgaaggtgccggaagagttcttggttgcgggtaaaaaaaaaaaaaaaaaaaaaaaaaaaaagaggagaaaaaaaaactcgaggggggggcccgggtacc

SEQ ID NO: 1727 - DNA, 1837 bp, Zea mays
ccagaaaccgtgtgctccccgaagcccggccgggatctcccccccgacccccgccggcaaatcgcggtcactgctccgaagtccgaaccttcatacacatcgtctcgtttccgatttccccaaattcaggccacaggcgctacaggacccaggcaccactcggtcggcggccaccgcgtcgccccgcctgctcgattggggtcgcgtgtgcgataggaagtattgtgttgtgtttgcaacgtgatagcttgtactgggaacaaaggtcaagatgggcgccttggacctacaccttgactttgcttctgctcaacatggacaagccaagttaaaggaatatgccaagagctctttgttgtctgatggaaactacaatacagacaagatcaatggttcaaaccctgatgactatgagaaatttgagaaagggataatgcactatgggtgtccacattatagaaggagatgccgcataagagctccttgctgcaatgaaatttttgattgccgacactgccacaatgaaactaagaattccattaaaattgataaaatgaagaggcatgaacttccacgccatgaagtgcagcaggttgtatgctcattgtgtggcactgaacaggaggtgcgacaagtatgtatcaattgcggtgtttgcatggggaagtacttctgtggtttgtgcaaactcttcgacgatgatgtctctaaacagcagtatcactgcaacggatgtggaatatgtagaatcggagggagggagaatttcttccactgttcaaaatgtggatgttgctattcaattgcgctgaagaatagtcatgcatgtgttgaaggggcgatgcatcatgactgtccaatctgcttcgagtacttgttcgattcgacaaatgatgtttccgtcctgccttgtggtcataccattcatgtaaagtgcctgaaagaaatggaagagcactgccagtttgcatgccccctttgctccaagtcggtttgtgacatgtcgaaggcatgggaaaggctcgacatggagctggcaactctgtctgactcctgtgatcacaaaatggtccgcatattatgcaacgactgcggggcaatatcagatgtgcagttccatttgattgcgcacaagtgccagaattgcaagtcatacaacacccgccagatttgaagtaagaatcgcaagtcacacaacaccgtcagatctgaaatagcaaatcctgtgggggtttctgcatttcttcaagaagcgtgatggactgatggccccttcccgtgagctgctgagcaccgggatatctggcaagacactcatcactgtatccactccactgggtcctgcggaggcaaacagctcgagattgtatatctgctgctagctgccgcccttcgttatgcataagcctactcttgccgttttactcctgtcgctccgtgattctagtgtaataatgtcatatttactgttgcttcaagtatggcccgtacggctgcggttgaacggcggcggcggctgctgagccacagtaccttgctgttgctgagactgcacccagccacagtgcgccgccgccgccgcagcttgtagctggacttgatttatgaaggtgccggaagagttcttggttgcgggtagctattaaggccatctcgagtagatgtcctattacatcccttatttcatcctctatttcaaactttatataaatagtattaaatatctcaaaaaaaaaaaaaaaaaaaaaaatcttttaagacagtctttagttaggaaaatgtgaacggtgtgcacatgtggttgtacgtcaaatccggatcccattttctatgctta

SEQ ID NO: 1728 - DNA, 1796 bp, Zea mays
gaaccaagcatctgtttctgtgccaacaagaaatgtaccatcaggtgcaccaggtatcactagcaggtccctgacaaggagggcttactatcctgtggttggaagtagcaactcaagcgttgatgtcgttccaactatctgtggatcatctggcgcagcaatatttgctaatggtggctatgctcttaatgctgatgctggaactgtttctatctaccctaatccagctcctgctacttcatctggctctataaccatgcccatgcccatgctccatcagatggtcattcagagccatccacctgctacccctgcagcaacctctacatccatgtggatcgctcaaccattacctgccagaactgctgcggcttctagacatgcaagacgcgtatcagcagggcttgccaacaatggaaggtacagaagggctaggagctcttactacagccttcatccactgatgatggtagaggcagaggtagatagcttttcttcccccgtctcaatgaagttaagctagcgttgtagagcctgaaactgatgttgctgctgctttgtgaagcggttcatgatggaccagttggtcttttacgaatcaagagcagcagccgctgacccccacagggacatgagactggacatcgacaacatgagctacgaggtaaggagtgctgcatcttgctccaactgccttgctccggaaatctgaagattttcttccaactaatacagtatttcgttgtcctcaggacctgttggctttgggagaatctatgggcaatgtcaacacaggcttggccgatgagaaaatttcgaagtgcgtgaaagaagtggtctgctgcaggcccgcccggatgcaaaccgatcaagatgaccaggatgacgacggaagctgcgtcatctgcctggtatacatactttcgcaacatgttcctgttaaagatgcctaatactattcaaccatggctcaaagctgttggattctgttgctgaccgatgggtgcattctggcaggagggttacagagacaaggatatgctggggatactgaaatgcaggcacgacttccacgccggctgcatcaagaagtggctgcagacgaagaactcgtgcccggtgtgcaaagccgccgccgcctaggacgacaccagaggagcgagcaactattttgtgctcctcctcgatccattcattttttaggctcaggtcgaattatatatgccgttccattcttttgattcctggcagtcgtgtaaataaatgctctgtgttggttattttagttatcacttgggttacattagcccaaattctcctgttgcattgtaaacaatccagtggtgaaggcaattgatcaagtggttgcaagcgcatgtcgtgaatggttttcggattcaccggcacttgaaattagttgcgaggtatttctccgccatccttatcttttggatgataagttacaatcgatggtgaagttggcgcttgtgtttttagacggtcaccgggggtaccatccccatctgaattgtattgatatatttgtatggcgaagctatacatcaacaactttgtttttagggaacgaggcaaaacccacatcgctcctaaattgtattgatatttgtatggcgaaactacacatcaacaacttagattttagggaacgaggcaaaaccctatacggctcggttaattcggaaaacccgggctaaaccagctaaactagatactcacccaagctgactaagtatgtatttggttgcaggatagctcgggacagacaatatacaaaa

SEQ ID NO: 1729 - DNA, 1552 bp, Zea mays
agaaacactatagcatttccaaccacaacatcttttttccctttttttctgttcttgggcccattaacttagctgcatcaattatgaatatctaataaaatcacaagtttacaacatgcaattgactctaaaactaatcaacttcagttgtaagtctgcaataactctgatttgaacacagactgtcacaaatctgggacagggacaccatgtaccccagaatcagctaaagcagcttacccatactcatatttaaactacactctacaaataatacaatctacagtgcaaaatgtgttttttgtgaccatacgggtgaattactgtacattgcacctatatgatcactaaaaacaacgttttgcatcgttttatattgtagattgcactgtttatagagtatagtttgaatatgagtatggttataggtaagctgccggagatggcctaaatttaacagctttgggacaagaactaccatcacatacatatacatacctaactaagagctcgcattacccttattcttcttcttggacgcagcgcccttgctctccatgaggcgccacatgtaccacgcgccgactgaccggtatggcctccaccgctcgcacaatgctgccatctcctccggattgggcagcgacttgagcttgtacagctcctgcacgcccttgcgcacaccgaggtcgccacacggcagaatgtcggggcggtgcagcgagaagatcatgaacatgtggacagtccactcgccgacgcctctgaccttggtgagctccgcgaggagcgcagcctcatccatcgcggcgactgcggagtcagagagctccccggctgcgaatctggccgcgaggtcgtggaggtaggatgccttgcggccggatacgccgatggtacgcaggtcagcggcggcgagggcaaggacggcggcaggtgtgaccgcgtcagcggctacggctgcggccgccgccgaagcagaggggaggagcgcaaggaagcgtgcgtagatggcgtccgcagcggaggtcgcgagctgctggtataggatggagcgcgcgagggagtggaacgcggggagggagggtgtggcggtgaaggtgggcgcctcagtgttggcaatgaccgcggtgaggagagggtccgcggcttggaggtggcgcagcgcggccgcaagctctccgggggacgacagcgcaggaagcactggaggcggaggcgcctgcggcgctagtgccagggcggtcgtggccaaaggtttcgcggatgctgtcttgacgatcttacgggagcgaaaggagatcttggaggagcgaaggccggtgaccgccggaggcggctctgtggctggagaacgggagcgcgccggtcgccccatgtaggtatttccgggtggcgtgcggctgcgacgtacggcgccgccggagttggtggtcaaaggaggagccgccgaggacgaggggagaaatttgccattatgagtgggaccgtgggagacaccggcccggtattagactcaagtttggttgacggatcggttttggcccagcta

SEQ ID NO: 1730 - DNA, 4962 bp, Zea mays
  misc_feature (4091)..(4091): n is a, c, g, or t
attccattcccccacgccgcctgcctgccccctcgcctcgggggcgaaccacgagaaggggattccggctagggtttcgcggatcgagaagagtcagggaagaagcggggggagagaagagggcggcacctagggtttccgcgggcggcccccccgcatggcctcgccagctgcagcggcggcggcggcgccaccgccggccgccaaggagaaggagaaggacgcggaggaggcaccggccacgggggacatggtcagcgccggcttcgcagagctcgagcgccagcagcagctgctggccacctgcacgcgcctctaccagcagctgtccgaccacttcggctcgctcgagcggggcctcgcggcgcgctccgacgcgctccgcgtccgccgcagggccttcgacgcgcgcacccaccgcgcgctcgactcgctccaccgccgggaggcctccatcgacgcctccgtctcgcgcgcgctcgaccacctccactccatctccgcctccgcctccggcgccgccgccgcttcctccaaggcccccgccacctccgactccgactccgagggcctcgccgagagcctgcgcgcgctgtgcgcgcggatggactccgccgcgttcctgggcttcgtggtggcccgccgcaaggaggcggacgcgctgcgggccgagatgccgccggcgctcaagctctgcgtggatccggccaagttcgtcatggacgccgtcgccgacgtcttccccgtcgaccgccgcgaggtccggaaccccgccgacctggcctgggcctgcgtgctcatcctcgaggccgccgtgcccgcgctcgccgacacggacccggacatcggccccgcgcgcccgctcgtgccccgggccgcgcgcgaccgcgcgcggggcatggccagggactggaaggaggccgccgagaagaaggggggcgtcgagggcgccaagccgcccgacgcgcacgccttcctgcagctcgtcgccacgtttgccgtcgccgagagggaggacaggccgctgtaccgcaggattgtcgtcagcttctcctggcgccgccagatgccacgcctcgcgctcaccctcggactcgaggaacaaatggccggtatatgcgcttctttcatgttttgctgttgcctgcatttccattttgttctacaatttttttctttgggaactaccatagatagttctttgaggtagatgtttgggcgccatgtgctgaagtggtgaaccttaggggttcagatggttgatttggggataaccaagtgtgcagtgggtgcaaattgccctagatccgtcgttgaattgtcactaggattaagtggacgccatcattaattgtggatcagaacagcagctgtagtatttcaataggctctgaaggagggtaaaaagaaaatcacctaggcaaaatgagttgaaaagttccttatttattttccactgctaattactctactgtgcaagggtatgatagtagtagtagtagtagtatgattagatttttttgtatgtctttttagagcaaggcccgccttcctggtggtctctttcatagccatgtgcaagaaaaggttgtctagtgttttatcaagtggtcaggataactgtcttctgtacatgatgccatcatgcccttctcttgggggccattgctttagccttcagatgtcggcagattcttgtgtctacagtactgttgccttagagtgaaaggcaattctggggtgcagtgtcgttaacagcaagtttctggactctcttgttccaatgctgcacaccctcactgcaatgttaggaagtgccaaacggccttcttttctattccaaattccaatgtacaccactacattatcttattataaactatgctgctacaacaagcggcaatctcgtgcctttttgctgccaaattcatggcagtttggttttatcttccagagtaccctcactgctgcatggatgatgcctctgtatgtgctatttctatttcttggtcatatatttgcgtgctctctgagtgacagatagtctttcatgtgctcgttcggacttaggcagattagtcagtacatgttaataccttttcttttgcagatatcattgaggaactaattgctaagaggcagcagcttgatgctgtaaatttcgcttatgaggctgggcttcaggagaagttcccaccagttcctcttttgaagtcctacctggaagactctaagaagacatcaaccgctgcttcagataattcaagcactagcagcggccaatcaggggttcgtataatataacagcaattctaaagtatctcttgaatctgttcaacatagaaaaatatctcttgaactcaggattgacttttgagtttaatatatgtgtctagtgctgctattatcctcttttagctacatgtaatgtcagttatgtatcatctcccttgttgggctggttccattttaatgtctctttgtttgtatgggttctgatgttttattatactgcagagcaatgtgaacaagaaagaacagtctgcactgcgagctgtcatcaagtgtgttgaggatcgtaaactagaagctgagtttccactggagggtcttcggaagcaacttgaagaactagagaaagccaagaccgagaagaagaaggcagcatcaagcgctaccagtggcggcagcggcggccctgcaaccaagcgcatccgtgcgagcactggaggcccaatgcctcctgccaaggcaggtcgtctcactaacaatgcttgcgtgtcttctctcccagctcccaccacattgacccagtctccctcccacgcgtcatacgccaacacctccccgtcccgcacctcatacgccaatacctccccatcccacgcctcatacgccacagtctccccaacccatgcatcatacgccacacccttcccctccccacgcatcatacgccacaccctccccttacccttacgacaggccggttggacacggcgtgtactgcacccggagcccgccggtgatcagggagccatatgtttacccagctgaggaggtagccaccgtcaacgtcggcattcccatggcctactccaccccgcccatgagctaccctgctgccccctacggcggctatggcaacgggatgccagcttacaccaatggaatggctcctgccttccaccaggcttactaccggtaggttcagtcaggaaacgaagaagtcgctgatgaatgacatgacaacaactgatgatgccaacgactcgaaaccccgctcaatggccctgttttgtagcgactgactacaacggtaggttgggtaccccatcttccatgtccttaccaccgctactactagatgtgttgtctttagctcctcgtctcatcttagtccgctaccgtaattttttttactactactaaggaacctggatgtaaattatgtatggtatcagcgagactgtcgtcgcagccttatgtaattctgttcagaacttttgaaaaacgaaaaaaaaagaagaaaccagcatgtaatcctgaagtaccggtctaccggatgtaccgtggacttaattagaagtgtttttttttatagtttacttgtttggtgttgatgtgtgtgggatggatggtctcggtgcctcgtttcttgagatttgattgtgcatgctcattgtttgtttgttttgcctgtcttatgtccgtccaaggcgtgaagggtttgccagtgaactggaatgtgatggtcattttagatcataataatgatgtggggctgtagtggtcacatgcccctgcctggccgatttggtaccagtgtagtgtcaagagcccggcatgctagcagataaatcatgcatgcatgcttggatgtccttgatgtagcttttgttgttttgctaatggaatgtccttgatgctagggtgtgtgtttggaagtaaattattttaaaactgtggttttagaatactcggttttaatggttttagaatacaacggttttaaaacacaactgtagtatttttttatattatttttagcaatatgtgtttggagacagagtatctcaaaccatggtatntagtatacatgtagaaggctagttattaaaaaaaaagctttgggatagaggggagtttcaaataatctaaaaacattatagtatctacaaaaccatagtattcaaaacaaagttttttacagttaaacacctcttgacaaaaaaaatactatggtattctgcaacactctaaaattactttgtttccaaacaccctataagttctattatgctcatttacatgtctatgaaagatgataatgcaggtgctttgctgatgacgattgtcgttcctgatctcatggtcatatgatcactacttatgtgctgtttgattcatatatttataatataatgtgtatctgataacgataaatcatatttgtgtaagtccagcgtaatcatatttgtgtaagtccaacgtaattagataccacactagaaagtgaaagtaatataagtctattcaaacttattacggctagtatccgaatgtgaattattattattattactatcatttacgttacatttcgtgaatcaaacagcatgttagtccttagtacgagttggttggctccctttgttttgctggagacatctctaaaaatcttatacataagcatggttgtgcttatatgaattgtctggccttacaatcttcttcccatcgacatgattctgttcataaatatgctaacaatatattgcaaagttgctttagctcctcacaggtcatcaccccccacagccccacccaacacatgcttcgtggcatcatgaacgacctgctctctttgattcatgtcccctagtggccgagccttgcactgttgagttggcaggctcgtaccggcgtacatcagaacatgtgtgcaagaaaacccagggt

SEQ ID NO: 1731 - DNA, 2097 bp, Zea mays
cctgaccaccccctcgcctcgctttccccctcctctcattccattccacccacgccgcctgcctgcccctcgcctcgggggcgaaccaggagaaggggattccggctagggtttcgcggatcgagaagagtcagggaagaagcggggggagagaagagggcggcacctagggtttccgcgggcggctccccccgcatggccgccgccgcttcctccaaggcccccgccacctccgactccgactccgagggcctcgccgagagcctgcgcgcgctgtgcgcgcggatggactccgccgcgttcctgggcttcgtggtggcgcgccgcaaggaggcggacgcgctgcgggccgagatgccgccggcgctcaagctctgcgtggatccggccaagttcgtcatggacgccgtcgccgacgtcttccccgtcgaccgccgcgaggtccggaaccccgccgacctggcctgggcctgcgtgctcatcctcgaggccgccgtgcccgcgctcgccgacacggacccggacatcggccccgcgcgcccgctcgtgccgcgggccgcgcgcgaccgcgcgcggggcatggccagggactggaaggaggccgccgagaagaaggggggcgtcgagggcgccaagccgcccgacgcgcacgccttcctgcagctcgtcgccacgtttgccgtcgccgagagggaggacaggccgctgtaccgcaggattgtcgtcagcttctcctggcgccgccagatgccacgcctcgcgctcaccctcggactcgaggaacaaatggccgatatcattgaggaactgattgctaagaggcagcagcttgatgctgtaaatttcgcttatgaggctgggcttcaggagaagttcccaccagttcctcttttgaagtcctacctggaagactctaagaagacatcaaccgctgcttcagataattcaagcactagcagcggccaatcagggagcaatgtgaacaagaaagaacagtctgcactgcgagctgtcatcaagtgtgttgaggatcgtaaactagaagctgagtttccactggagggtcttcggaagcaacttgaagaactagagaaagccaagaccgagaagaagaaggcagcatcaagcgctaccagtggcggcagcggcggccctgcaaccaagcgcatccgtgcgagcactggaggcccaatgcctcctgccaaggcaggtcgtctcactaacaatgcttgcgtgtcttctctcccagctcccaccacattgacccagtctccctcccacgcgtcatacgccaacacctccccgtcccgcacctcatacgccaatacctccccatcccacgcctcatacgccacagtctccccaacccatgcatcatacgccacaccctcccctccccatgcatcatacgccacagcctccccttacccttacgacaggccggttggacacggcgtgtactgcacccggagcccgccggtgatcagggagccatatgtttacccagctgaggaggtagccaccgtcaacgtcggcattcccatggcctactccaccccgcccatgagctaccctgctgccccctacggcggctatggcaacgggatgccagcttacaccaatggaatggctcctgccttccaccaggcttactaccggtaggttcagtcaggaaacgaagaagtcgctgatgaatgacatgacaacaactgatgatgccaacgactcgaaaccccgctcaatggccctgttttgtagcgactgactacaacggtaggttgggtaccccatcttccatgtccttaccaccgctactactagatgtgttgtctttagctcctcgtctcatcttagtccgctaccgtaattttttttactactactaaggaacctggatgtaaattatgtatggtatcagcgagactgtcgtcgcagccttatgtaattctgttcagaacttttaaaaacgaaaaaaaaaaaaaaaaccagcatgtaatcctgaagtaccggtctaccggatgtaccgtggacttaattagaagtgttttttttatagtttaaaaaaaaaaaaaaaaacgccccccgactagtagactc

SEQ ID NO: 1732 - DNA, 1923 bp, Zea mays
ggacccacctctttattcacccccgacaccggggctcccttcggtggtggcgggctcgcctcgggggtgcgcgaatttcgactagggtttcgcggaccgagagggaagcggggagaggagagggcgggtagggtttccgcgggcgggccccgcatggcctcggcggcagcggcggcggtggcgccggccgcggaggagaagaagggcgcgggcgggccggtcacgggggacatggtcagcgcgggcttcgcggagctggagcggcagcagcggctgctcgccacctgcacgcgcctctaccagcacctgtccgaccacatcggctcgctcgagcgcgggctcgccgcgcgctccgacgcgctccgcgtccgccgcagggcattcgccgcgcgcacccaccgcgcgctcgactcgctccaccgccgcgaggcctccatcgacgcctccgtctcgcgcgcgctcgaccacctccactccatctccgccaaggggtcaccgccggctccggatccggcacacgccgccggcgccggcgcggccgagggcctgcgcgccctctgcgcgcggatggactccgccgcgttcctgggcttcgtggtggcccgccgcaaggaggccgacgcgctgcgggcggagatgccggcggcgctcaagctctgcgtggatccggccaagttcgtcatggacgccgtcgccgacgtcttccccgtcgaccgccgcgaggcccggagccccgccgacctggcctgggcctgcgtgctcatcctcgaggccgccgtgcccgcgctcaccgacccggacccggacatcggccccgcgcgcccgctcgtgccgcgggcggcgtgcgagcgcgcgcggggcatggccagggagtggaaggacgccgccgagaagaaggggggcgtggagggggccaagccgcccgacgcgcacgccttcctgcagcacgtcgccacgttcgccgttgcggagaaggaggacaggccgctgtaccgcaggattgttgtcagcttctcctggcgccgacagatgccacgactcgccctcactctcggccttgaggaagaaatggctgatatcattgaggaactaattgctaagaggcagcagcttgatgctgtgaattttgcttacgaggctgggcttcaggagaagttccctccagttcctcttctgaagtcctacctggaggactctaagaagacgtcgaccgccgcttcagataattcaagcactagcagcagcgggcaatcagggagcaacgcgaacaagaaagagcagtctgcactgcgagctgtcatcaagtgtgtcgaggaccgtaatcttgaagccgagtttccactggagggtctccggaagcaactcgaagagctggagaaagccaagaccgagaagaagaaggcggcatcaagcgctaccagtggcggcagcagcagcggccctgcaaccaagcgcatccgcgcgagcaacggaggcccaatgcctcccgccaaggcaggtcgtctcgctaccaatgcctgcgcgtcttctttcccaggtcccaccacattcacccagtctccctcccacgcaccacacgccaatacctcctccccttcccatgcatcacacgccgccacagcctccccttcccacacatcctatgccacgccgcctccttacccggttggacatggcctgtactgcagccggagcccgccggtgatcaggggggagccatacgcttacccaccagccgaggaggtagtcggtttccacgtcggcatcaccatgccatactccaccccacccatgagctacccccctgccccctatggcgggcacggcagtggcatggcagcttacgccaacggaatacccgctgctttccaccagacttactaccgctggtcacactcatgcacccagacgaatactgttcac

SEQ ID NO: 1733 - DNA, 846 bp, Zea mays
  misc_feature (14)..(14): n is a, c, g, or t
  misc_feature (16)..(16): n is a, c, g, or t
  misc_feature (25)..(25): n is a, c, g, or t
  misc_feature (31)..(31): n is a, c, g, or t
gctcgaaaactggnanaaagccaanaccganaagaagaagcggcatcaagcgctaccagtggcggcagcagcagcggccctgcaaccaagcgcatccgcgcgagcaacggaggcccaatgcctcccgccaaggcaggtcgtctcgctaccaatgcctgcgcgtcttctttcccaggtcccgccacattcacccagtctccctcccacgcaccacacgccaatacctcctccccttcccatgcatcacacgccgccacagcctccccttcccacacatcctatgccacgccgcctccttacccggtcggtttcaacgtcggcatcaccatgccatactccaccccacccatgagctacccccctgccccctatggcgggtacggcagcgggatggcagcttacgccaacggaatggcccctgctttccaccaggcttactaccggtaggtttagtcatgaaacaaaacaaaaaaaagtcgctgatgaatgacatgacaacaactgatagtcgcgcaatggccctgttttgtagcgactgactacaacggtaggttgggtatctcatcttctatgtcctttccatcaccaccactaggtttgtgtgttgtgtctagctcgtctcatctcatcttagaccactgcctttctttttttactggtaaggaacctggaacctgggtgtaaattatgtatggtatcagcgagactgtcgtcgcagccttgtgtaactctgttcggaactttgatctccttttttttgttgttgttgaaaagatcagcatgtgatcgttaagtaccggatgtaccatgaactttaaccaaaaggtttctcagtttagttgtgtg

SEQ ID NO: 1734 - DNA, 1004 bp, Zea mays
ccaggccatcaggttatcgagaaagctctcgtctcttccatttctaggctagcctaggtctggaccagttaggcacgcaagtatcaatcgattcataagaggaggaggccattgagggagccaagtagaaggcagtcacggcaaaccacgtatcttgttgttagaaagctggtgagcaactttgtcaagcctcaagagctcatggaagatggcagtgctccaagacggtctactccacccacccgcagaagcagatctgccgagttccacaatttttcagaaaggaggagaagggataagatcaacgagaagctgaaagcattacaggagcttcttccaaactgcaacaagaccgacaaagtttcgatgctagacgaagcaatcgactacctaaaatcccttcagctacagcttcagatgctggtcatggggaagggaatgtcaccagtggttcctcttgagctgcagcaatacatgcattacatcacggctgaccctgcccagttgcctccattgcgcccatccggccagcagcggggacaatttcagataactcaagccaatcctcagcgacaatctaacgtcgagtcggatttcttgagccagatgcagaacttgcactcttctgagccgcctcagaactttctcaggccaccgaaattgcaactttatacaccggaacagaggggtggcctacccagcacgagccacaacactggatggatttctgggagttcctcgtataacttcatggagtgatgtgctcctaatgacaaaatttgacacggcaggcgtgcagccttgtactcggaagagatcgttcagtttgggacctgcagcatggttcacctgagagaattccatgaatgtgtagtactagttaactagctagctagttgtgttattaaataaaacgttgtgattgtgatgctgctcattttgctatctgaatcttaccgtacaaaaaaaaaaaaaaaaaaaaaaaaaaaaaaaaaaaaaaaaaa

SEQ ID NO: 1735 - DNA, 969 bp, Zea mays
gaacggaccaggcaatcaggttatctagaaagctctcatgctcttccatttctaggctagcctaggtctggaccagttagagtagacacgcaagtatcaatcgattcataagaggaggaggccattgagggagccaagtagaaggcagtcactgcaaacaacgaaagctggtgagcaactttgtcaagcctcaagagctcatggaagatggcagtgctccaagacggtctactccacccacccgcagaagcagatctgccgagttccacaatttttcagaaaggaggagaagggataagatcaacgagaagctgaaagcattacaggagcttcttccaaactgcaacaagaccgacaaagtttcgatgctagacgaagcaatcgactacctaaaatcccttcagctacagcttcagatgctggtcatggggaagggaatgtcaccagtggttcctcttgagctgcagcaatacatgcattacatcacggctgaccctgcccagttgcctccgttgcgcccctccggccagcagcaccggcaatttcagataactcaagccaatccccagagacaatctaacgtcgagtcggatttcttgagccagatgcagaacttgcactcttctgagccgcctcagaactttctcaggccaccgaaattgcaactttatacaccggaacagaggggtggcctacccagcacgagccacaacactggatggatttctgggagttcctcgtataacttcatggagtgatgtgctccttgcctccttatgacaaaatttgacacggcaggcgtgcagccttgaactgggaagagatcgttcagtttgggacctgcggcatggttcacctgagagaattccatgaatgtgtactagctagttgtgttattaaataaaacgttgtgattgtgatgctgctcattttgctatctgaatcttacggtcaaaaaaaaaaaaagta

SEQ ID NO: 1736 - DNA, 5872 bp, Zea mays
ctcgaggccggccggggtatgtttcgcgtactcgcatttagtctattacacagaggaatagctgatctagacatgcaatttgttgttggtttagtcagtcagtcaagccagtcaaatcaaacctgaaccccgcttaagcgcaagtgagactgtgagagagaaagagcaaagggaagtcatcgtaggtattttgagaacattccatgcatacttgcctggctcgcatttgcctgcgagatcaccaatcaaacaagccacccgtgctgcctgctaccctgctacgctgcacaatcatcctgcggaatttagtaacggcaagttattccaaagttccgatccccaagttgtttattctccaatagtttgtcggtttgtgtgcttcagattcctcccgctctcgcgcaagtggtacactgtgtttccagctaccattttctccactaactaattttattttcagtgtctctcgtttctttatttgcgcgtcaagtttcagccattccttgctcaaaggaaaagtttgagccattccctgggaaggtaggtgagggtactggacaaatccgaaatgcaaatgggcatatgcatgctacatataaccgtaggcttgctactgccagagactcgggtacatggtatcgggttacagtccaaacaggaaattctaaggccgatggaagataaggatatgggtacagtcacccggtcctgccatgacgcgaaagcttatagaaatcaggtggcataaatactgtgcagggctaaaggttggtgggtcgaatggaccaggccatcaggttatcgagaaagctctcgtctcttccatttctaggctagcctaggtctggaccagttaggcacgcaagtatcaatcgattcataagaggaggaggccattgagggagccaagtagaaggcagtcactgcaaaccacgtatcttgttgttagaaagctggtgagcaactttgtcaagcctcaagagctcatggaagatggcagtgctccaagacggtctactccacccacccgcagaagcagatctgccgagttccacaatttttcagaaaggaggagaagggataagatcaacgagaagctgaaagcattacaggagcttcttccaaactgcaacaagaccgacaaagtttcgatgctagacgaagcaatcgactacctaaaatcccttcagctacagcttcagatgctggtcatggggaagggaatgtcaccagtggttcctcttgagctgcagcaatacatgcattacatcacggctgaccctgcccagttgcctccgttgcgcccctccggccagcagcaccggcaatttcagataactcaagccaatccccagagacaatctaacgtcgagtcggatttcttgagccagatgcagaacttgcactcttctgagccgcctcagaactttctcaggccaccgaaattgcaactttatacaccggaacagaggggtggcctacccagcacgagccacaacactggatggatttctgggagttcctcgtataacttcatggagtgatgtgctccttgcctccttgcctccttatgacaaaatttgacacggcaggcgtgcagccttgaactgggaagagatcgttcagtttgggacctgcagcatggttcacctgagagaattccgtgaatgtgtagtactagttaactagctagctagttgtgttattaaataaaacgttgtgattgtgatgctgctcattttgctatctgaatcttaccgtccaattctcctccatgttcatgcaaaggctgacaggtggcgtctgtatttatctgtgcagcagtatgctactatttgttagattgatctcatctagttcggttaaagggccgaaccttaactcccgcgttctgatggaggcgtaattaacttatagttgtggccctcttttacatcaaatatatatatatagtataatgtacagtataatgtatagtataaatagtgttttgcacggtgatatacatgatttgctagccacaggtgttttcagggacattcttccttctccccaccaataagccattgctgtaaatttgagagacacatctgcgttgggactagaattcacattatcatgtctgatgtgattgatggacactgttgtttgcatccaatccaatgagatgaataatatatcctccccccacaacttggccaaatctttcagcttccattcttctgcgtatgcaggtatgttgcggcaaagaaaatcaacagtcaaaaggcctacagtactaccacttcaggcccattccgtcaggcagcatgggctagattggtttcagcgaaccattcatagggcacataaaagtcactatagcctggaatctagctccatgctgcctctgaacagattgaactcattacacgtgcaaacaggagcagcccgaatctatgacactttggcgtcccgtccggcgtccgggtggtactcatcagaagcagggctctccctttgcttgaacagatcttgcagcacgaatttcagttcgcgtttttgcagcaggcatctagtctcttccacagaccttgctcatcttcagcaaggctgaaagcacgctgtccatgtcaggccggtccgccggatcggacgcggcgcacgacagggccaggctcagcacgtccgccaccgtggacaggtcgccctcggtgaccaccttcaggtcggggtccaggacgtcgagcaccccgtcgaggcccctcgagatcgcgttgtccacatactgctgcagtgtcagtggcacgccctcctcctcgatcatcccggtcgggcgtcgcttggtgaacagttccatcatcaagacgccgaagctgaacacgtccaccttcgccgagaccgtcctcatgtacgcgaattctgcgtgattggattgtacagacagataaaaacgttttcttggcagaagtgccaagaaatttgcagaattggtgctagagcaccatgtagattacctggcgccatgtacccgatggtgcccctgaacgccgacgacgtcgccgactgcgcggcggcgtccgtcagatggacgcccagcatcctcgcagtgccgaagtcgctgacgcgcgcctcccagtcgctgtcgaggagaacgttcgacggcttgacgtcgcagtgcacgatgggaaagtcgtacccggtgtgcaggtacgccagtccgtgcgccaccgagacgcacgcgcgcagccgctccgggaccgtccaccgctgcgcgtccctccccgggccgtgtatcgcgccgtcgaggtcgccgttgtccatgaactcgaggaccacagccttgatcttgccgggctcgcacgcgtacccgactacgcgcgccaggttcttgtgcctcaggcggctcagagtcgcaagctcggtgaggaagcacttgtcggacttggccgggaactgcgctaggttgagccgcttcacggcgaccaccttgccgtcgggctccacgagcacgcccttgtagaccgtgctcaggttgctgctaccgatgacgttgccttcgtcgaatgaactggtggcggcatccaactcgctgcaagtgaacttcctcagctccggcacgacgaagtcctccgcgaaactgtttgcaccggtagagcctcccttcttcttcttgtacctccggtatccgagaaagaggatcgtcacaagcaccagtagtaacagcacggccagcaccagcagcaccactaggaccgcgagccctgtcctcgagaaccccttctttccgccgtggcggcagggagcgagaagcttccagccgcagaggccagcattgccctgcaggctcgacatgctcaggttcgagaacacgccggagtccggcacgggaccctcaaattggttccaggagaggttcagcgacctcaaactggtcaggttcgccagtgccgacggtagggcccccgtgaacgcgttccgtgacgcgtccagcgtctgtatgttcttcagtgcgccgatgtttgaagggatgtcgccgtctagctcgttgccggagatgttcaggcttgtgaggacgtcgaggtgagggaagaggccggcaggcagggcgccggtgagattgttggcagagaggtcgagcgagtagaggttcttgcaccctgccagcgtcgacgggacaccaccggataagcggttgttggacagatcgatggactggaccatcgtgagggcgccgatctcggtcggtatcgggcccgtgaacccgttgttcgacaggttgaggtacatctgcagggcgctcagtttcgcgatcagcgcgctggggatggcgccggcgaggcggttgtgggagaggtccagcgtgaggagatggtcgaggcttcccaccgcggcaggtaccgtgccgttcagcgcattgttcgacatgtcgaggaaggagagggaccgcaggttggacacggcgtcggggatcgggcctacgaacctgttcgacgcgacgctgaggacagtgagctgccgcaggccgaagatctcgtcgggcagggcgccgtctaggcggttctgctgcagcgtgagcttctgcagggacgacaagttggagatgctcttcgggacgcgcccgacaaacccgtttcccccgagctgcagggcgatgagcttcgtcaggttgcccatctcctccggtatcgccccggacagagcgttaccctgcaactgcagcaagctgagctcgctgagcctgccgacgcgagggctcaagctgccggtgaagctgttcccggccagggttaacgtcctggcgtgcctgcagtcgaaaaggtcctctggtatgtcgccggacagcttgtcgttgtccgccaaggacaggaagtgtaggttctgtagctgaccaaggccggcaggcaaaggcccggagaactcgttgaaccccatgctcgcgttgtacagcgaagtgcagttggcaatgctcgccggaatggggccggagagcgagttgttctgaatgacgagcacttgaagattctggagcgatccaatgttcgccggaagaggtccggagagagagttgtagctgaaactcaggtatgtcaggttgacgagatccatcagcgacgccggcacctctccggtgagcctgttggcgtggagcatcagtttccgaagcgaccgtagctctccgagctcggccgggatggacccggtgagctggttcatggacagctggagcgaaaccagcgacgcgcaccggccgagcgagcggggaatctccgacgagagcgcgttgccgtacaggagcagcaccttgaggctggcgagctccccgagctcgcttggaatcgcgccggtgaggcggttgctgtacacgttgagcgtggtcaggttcttgcagcggccaatctccggcgggatggcgccggagaaccggttctcgaacatgtggacgatattgagacgcgagaagttgccgatccccggcgggatcgggccggagaactggttgccgctgaggtccaacgtctcgagccgcgtgagcctcgcgaaggacggcggaagctcgccgtcgagactgttgagcgagagtaccagctcgttgaggttggccaggtcaccgatgcagtcggggacggcgccggtgaggtcgttgttgaagacgctcaaccctgccatcgccgagcagttgcagaggcggctcgggatgcctccgcggagcgtgttgttgctgaggtccagcaactggaggctcccgaggtcgccgagctccggagggatggcgccggtgaggttgttggcgccgaggacgagcccctcgagcccgtcgatgcgcccgagctgcggcgggatgccgccgccgaagcggttcgatgtgaggtccagcaagaggtaccgagct

SEQ ID NO: 1737 - DNA, 488 bp, Zea mays
  misc_feature (483)..(483): n is a, c, g, or t
agaacggaccaggccatcaggttatctagaaagctctcatgctcttccatttctaggctagcctaggtctggaccaattaggcacgcaagtatcaatcgattcataagaggaggagaccattgagggagctagccaagtagaaggcagtcacggcaaacaacgaaagctggtgaacaactttgtcaagcctcaagagctcatggaagatggcagtgctccaagacggtctactccacccgcccgcagaagcagatctgccgagttccacaatttttcagaaaggaggagaagggataagatcaacgagaagctgaaagcattacaggagcttcttccaaactgcaacaagaccgacaaagtttcgatgctagacgaagcaatcgactacctaaaatcacttcagctacagcttcagatgctggtcatggggaagggaatgtcaccagtggttcctcttgagctgcagcaatacatgcattatnttcaa

SEQ ID NO: 1738 - DNA, 733 bp, Zea mays
aacacccaacacgatgcccctgggcccgggctactgcgactactgcgacaagcagttccaggacacccccgccgcccggaagcgccacctccagggcgtgcagcaccaacgcgcccgcgccctctggtacgactccatccgccaccaagaccagcatggcggcgcttcctccctcctcctgcctgacggcaccctcgccaagggcatatgccaccacttcgtccgcacggggacttgcaagtatggggattcatgtagatacttccatccgaagccagatggtgccaatccagcattagctgcaccagggcctgggtctgggcctggacccatggtgcagcagtctgattttattgcgaaccaacccaatttcgttggataccagggagtagacataaattcttcctcagggaagatactggggggacacgcctcttggggcaacctgccgccatcactgcaacctcctcctgaaggcggctaccctcccctcccgttcatcgactggggctgaaggggcgttgtctcgctgaaattcgaaccatttagcatttcataccttgattggttgtgctaaatcgcatatacttggagcgcagtagagtaaaggtgatcccagtttattttgatcttaaatttatctctgtaatagatatttacagtcaaaggtacacttcgcagattgcgttgatgtttgaatgaactcacatttgcatcaaaaaaaaaaaaaaaa

SEQ ID NO: 1739 - DNA, 5654 bp, Zea mays
cgacggacgccagcggccccgcgggccggtgctgtcctcctgcaggtaatacatgcatatataacccgaccagcaatcgttctgtgctgtacttgagtcgaggccggcgccgccgccgcggcagcgaggaggaggaggagcagaggcggcgaccatggcggcggggaacgagtggatcaacgggtacctggaggcgatcctggacgcgggcacgaggctgcgcgggccgtggcagcagcagggcggcgcggcttcgctgacggccgcgctgccgaggctgctggcggaggccggcggccagcagggcgccgcggcgtacagcccgacgcgctacttcgtggaggaggtggtgagccgcttcgacgaccgcgacctccacaagacgtggaccaaggtgcgtagatactagagggaaagagagacagcgcgcgtacgctggcggcgagccgatcggcaggccgcgcctgtccccggtgatccgtccgtctcgcctcatgagcagcggtgaccgattctcgtcgcaagcaggtggtggcgatgcgcaacagccaggagcggagcaaccggctggtgaacctgtgctggaggatctggcacgtcgcgaggaagaagaagcaggtacggtgctactgctttcgttcggcggaggtgcagtctgtctgtccgcgcatggcgcgcctgctctgcttttttttcggactcgttcaagttcttcgtctgcatgcgtggtttgtcctccgaaaaaaaataaacagagatgatctccagcttcgcgcagttgttatcctggcccatagggcaggcaggcaggcacctggcgtctccgattgtcaactgttttctttttcgttgttgattgacacgtctcgtctccccctgtactgaactagtatttcactttttgtacaataaccacgagcaggtgcaacgggagtacgcgcggcagctggcgcagcggcgcctggagcaggagctgggcagccgggaggccgccgaggagctctccgatggcgagaaggacggcgcccccgacgccgcccagcagcctgtgtcggtggcggcgcccgacggccggatcgccaggatcgggtccgaggcccggatcgtgtcggacgacgagggcggggacggcggcaaggacgacaggaacctctacatcgtgctcatcaggtattaattaaccatgtgatccgttgctgtccggcggctccgggggatcactcgctgcttgacacgacgccataatttggttgctgttgttgttgcgttgcagcatacacgggctcgtccgtggcgagaacatggagctcggccgtgacgctgacaccggggggcaggtccgtctcgaatttcccctaggcaccaagaacagagccgttccaacaaaaaaaaagatttttttttccaatgaaggctatactacctgtgccgctttgccatccttttcttgcgtcgtttcattcacgtccaggtgaagtatgtggtggagctggcccgggcgctgccggcgaccgccggcgtgcaccgcgtggacctactcacgcgccagatctcctgcccggacgtcgattggacctacggggagcccgtcgagatgatcacccatcaggccgacgacggcgacggcagcggcggcggggcctacatcgtgcgcctcccgtgcgggccccgcgacaagtacctccccaaggagtccctgtggccgcacatccccgagttcgtggaccgcgcgctggcgcacgtcaccaacgtcgcgcgcgcgctgggggaccagcagcagcagcagcccgacgccggcgcgggcgcgggcgcggccgccccggtgtggccgtacgtggtccacggccactacgcggacgcggcggaggcggcggcgcacctggccagcgcgctcaacgtgcccatggtcatgacgggccactccctggggcggaacaagctggagcagctgctcaagctgggccgcatgccgcgcgccgagatccagggcacctaccggatcgcgcgccggatcgaggccgaggagaccggcctcgacgccgccgatatggtggtcaccagcaccaagcaggagatcgaggagcagtggggcctctacgacggcttcgacctcatggtggagcgcaagctccgggtgcgccgccgcaggggcctcagctgcctcggacgctacatgccgcggatggtcgtcatcccgccggggatggacttcagctacgtcgacacgcaggacctcgctgagggcgacgccgacctgcagatgctcatgtagtcccggcaaggccaagaagccattgcctcccatttggtcagaggtacgtacgtacgggtcctctgtttctagtggatggaatggaattcagcatgacctcctctgttttgttttgtttgcaggtcctgaggttcttcgtcaacccgcacaagcccatgatcctggcgctgtcgcggccggaccccaagaagaacgtcaccacgctgctcaaggcctatggcgagagccgccacctccgcgagcttgccaaccttgtaaggataagaatccagcttgtcaatcggtaatgattctcacccaacttctgctgagctaacagaaagaagataccatgttgcagacactgatactggggaaccggcatgatatcgaggagatgtccggcggcgccgccacagttctgacggcagtgctcaagctcatcgaccggtacgacctgtacggctgcgtcgcctaccctaagcaccacaagcagaccgacgtgccgcacatataccgccttgccgccaagacgaaggtgcgccgtccattcattcttttttttttgaaacgagctttttatggctctgcttttaagaaagcagttaacagttcacagacagcaattccactgctgggacaccagcttacagtgtcagagcgaagacaactataaacctgaaactgggagagcacagctccatcccgccctacacgagcacctttgctaagaaaatcgaacaccttctggtcagaaccaccagaaaaaacaaacatgaactgaacactatagaacagaaaccaacacacattgcacacagctccctaggcccaaactcctctctaacactcatcttccagactacaagcaccttcaagacgaagaagcaactccagcagacaacaacaagaacccagatttccaaactagctaaaacccaagctcaggactgtgagagaaccaccccacaaaatcagatgacgccaatttctgacgctgactcatgcttcggttgatatttctgcagccaccccttcatgtgcttcagcatctcctccaagataaatacatcctttgacctcaacatcattccccatttctgcaagtacgcaatagcatccaacataatagttgtcagaccattaggaaaaaccttcacaatggccatcttatttctgtttctccaaatagcccatgatatgcccgacagaatgaataaacataatttttttatgtcggcggcttgattatcccacggttataaaacatttcttcaacaattataggaatcctttcctagttaaacattagcttccaacaaccccaaataaacattgctaaagagcaactaaagaaaatatggtctatattctcgtgattctaacataagactcacttagtactgccttttcaccctcttttttaaagctccatagcagatggaagcttccaaatgtttttatatacattattttccaaatgtttttatatacattatttttaactcccccatctttcctaaaactgtaaggcgatctagaagaaaaaccattggatttatttaaacttcaatttatcatatccctcccacgagaaagagagtgctccttcagctcgttatacaactcttcccacaatcccactcaacgaactccgtgtccgaaagaggtcttcaaaactccacataccggttttcatccacatgacaatccgacatcaggcatccttgtccctacagatgtcaaagaacctaggatacttcacttctagcggaacccctccgtaccaagtatgcttccaaaataaagtttcatctccgctcttaaccatattcaccgcaccccatttgaaaagatgttaaccttatgcggaccttccaaaattgagagacccctctaattttggatagaaaaaatatatccttaggcatgtattattcattcattcgttaattcgaatgcgataattttagtcgttccagaacgtagaccccaactcgttttgttttcttcagttttctggttcatttgtttattacgtcactttgaattgcagggagtgttcattaatcctgcacttgtggagccattcggcctcaccctcatagaggcaagaatctcgtggtgttcagattcagaaaattcggtttgatcttcaataaaaaaaaatccattcacatcttgttcgtgtcgtgtgtgcgatccgtgcaggccgctgcgtatggtctgcccgtggtggccaccaagaacggcggtccggtggacatcatcaaggcgctgcacaacgggctgctggtggacccgcacgacgaggcggcgataacggaggcgctgctcagcctgctagccgacaaggcgcggtgggccgagtgccggcgcaacggctccgcaacatccaccgcttctcctggccgcaccactgccgcctctacctctcccacgtggccgccaactgcgaccacccggcgccgcaccagctgctccgcgtcccggccagccctcgcgccgcgcccgccgagcatggcaccgacgactccctctcggagtcgctccgcggcctctccatctccatctgacgcctcgcacgacctcaaggccggggactccgccgcggccatcatggacgcgctccgccggcgccgctccgccgaccggccgccgagctcggccgcgagggcgatcgggcacgcgccgggccggcggcagggtctcctcgtcctcgccgtcgactgctacaacggcgacggcacaccggacgccgagcggatgaagaaagctgtcgacctggcgctgtcggcggcggcagcggccggcggccggctcgggtgcgtcctgtcgaccgggatgaccatagccgaggccgcggacgcgctcagcgcctgcggcgtcgacccggccggcttcgacgcgctcgtctgcagcagcggcgcggatctctgctacccgtggagggaggtcgcggcggacgacgagtacgcggggcacgtggcgttccggtggcccgggaaccacgtgcgcgcggccgtgccgaggctcggaaaggccgagggcgcgcaggaggcggacctcgccttcgacgaggccgcctgctccgggccttgccacgcctacgccgcggcgggcgcgtctaaggtaacggccgtttcttgggcatcttgtttcatgtctctcttctctcttctccatggcaacggcggatttacgagctccgtctttgtgattctgcactgcaggggaagaaggtggactcgatccggcagtcgctgcgcatgcgcgggttccggtgcaacctcgtgtacacgcgcgcgtgcacgcgcctcaacgtcatcccgctctcggcgtcgcggccgcgcgcgctcaggtaagaatggcatctcccgctcatcgtctggtggtcgtggac

SEQ ID NO: 1740 - DNA, 1264 bp, Zea mays
gcgatcgggcacgcgccgggccggcggcagggtctcctcgtcctcgccgtcgactgctacaacggcgacggcacaccggacgccgagcggatgaagaaagctgtcgacctggcgctgtcggcggcggcagcggccggcggccggctcgggtgcgtcctgtcgaccgggatgaccatagccgaggccgcggacgcgctcagcgcctgcggcgtcgacccggccggcttcgacgcgctcgtctgcagcagcggcgcggatctctgctacccgtggagggaggtcgcggcggacgacgagtacgcggggcacgtggcgttccggtggcccgcgatccgcgcccccgcgcccgccccgaggctcggataggccgagggcgcgcaggagaaggacctcgccttcgacgaggccgcctgctccgggcattgccacgcctacgccgcggcgggcgcgtctaaggtgaagaaggtggactcgatccggcagtcgctgcgcatgcgcgggttccggtgcaacctcgtgtacacgcgcgcgtgcacgcgcctcaacgtcatcccgctctcggcgtcgcggccacgtgcgctaaggtacctgtcgatacaatggggcatcgacctgtccaaggtgtccgtgctcgtgggcgacaagggcgacaccgaccgcgaacggctgctccctggcctgcacagaacgctggtcctgccggagctagtttgccacggcagcgaggaattgtgccgcgaccaagacgggtttctggcagaggacgttgtctccatggactccccgaatatcctcaccctcgccgagtaccaggcggcggtcgacatcctcaaggctatttgagagtccgggattatgatacatgatctgctccgacattccagctgttggttccacactctgctggggttattttggacggacagttaaaatttcacagcgaatgactgcaaactttatataaaaaagatacatgtttttgttttcggttacttttatttttttggaaggggcttatggtataagtgtacatgaatcttttggtgcacatagtatacatattaaattatatttcctctatttcaaaataatagtcgttttagttttagtcattagattttatgtctatatattcaaatagatcataaacctagacatgtgtaaaacatatatattaagtatgtatgaatctattagttatctaaaataaattataatttggaacgtagagagtaattatttatcgtaaatctattatccttca

SEQ ID NO: 1741 - DNA, 895 bp, Zea mays
cattggtacctcgagccggccgggaaatggttcttaactcggagccccagccggcccgtccaccctagagagctcttaaaaagccccctgcgccggccgcgccggggtatccctaatcccacctccagtctctgggcaccaaatttccggcggcgatggcggcggctgtggcgaggtcagggttccggcgcatgttctccgtctctgccttcgcgccgccgaaggcgcccgccgcgcgccccaaggccgacccatcccccaacctcttcgtctccggcttaagcaagcgtaccacaagtgaaggacttagagatgcctttgcggagtttggtgaagttttgcatgctcgagttgtgaccgatcgtgtcagtgggttttctaagggatttggctttgtaaggtatgctacgaccgaagaggcagccaagggaatagaaggaaaggatggaaagttccttgatggatgggttatttttgcggaatacgctaaacccagaccaccgccggaggaaacagggatgaattcgcagccccagcagtcatggggagctccatcaggttcctggggtgcacagtagatgaagtgatattgtgagagcccctccctgtccccagccctggggctcgtagcggatcgtgagggatgaatttgtgtgtggtgtgtcacaggtgtgaatgcctttgttgtcccaatattcctaccgtgttgggagtggtcgtttgctcgcgtccacgtctttcacatgaattggttactgtggtagttgtagttctggatacgggaccaaaactaaagtattgctgtcaacaatctgcaacagtcgaaaacctttgcaaataatgcctgctggaaaaaaaaaaaaaaaaaccacaaaaaaaaacacaaagggcccta

SEQ ID NO: 1742 - DNA, 875 bp, Zea mays
  misc_feature (840)..(841): n is a, c, g, or t
  misc_feature (845)..(845): n is a, c, g, or t
  misc_feature (850)..(850): n is a, c, g, or t
  misc_feature (852)..(856): n is a, c, g, or t
  misc_feature (858)..(863): n is a, c, g, or t
  misc_feature (866)..(870): n is a, c, g, or t
gatagatcttaaaccctagaaagctcttaaaagcccccgggccctccagccgggccggatccctaatcccacctccagtctttgggcaccaaatttccggcggcgatggcggcggctgtggcgaggtcagggttccggcgcatgttctccgtctctgccttcgcgccgccgaaggcgcccgccgcgcgccccaaggccgacccatcccccaacctcttcgtctccggcttaagcaagcgtaccacaagtgaaggacttagagaagcctttgcggagtttggtgaagttttgcatgctcgagttgtgaccgatcgtgtcagtgggttttctaagggatttggctttgtaaggtatgctacgaccgaagaggcagccaagggaatagaaggaaaggatggaaagttccttgatggatgggttatttttgcggaatacgctaaacccagaccaccgccggaggaaacagggatgaattcgcagccccagcagtcatggggagctccatcaggttcctggggtgcacagtagatgaagtgatattgtgagagcccctccctgtcccagccctggggctcgtagcggatcgtgagggatgaatttgtgtgtggtgtgtcgcaggtgtgaatgcctttgttgtccaatattcctacgtggttgggggtggtcgcttgctcgcgtccacgtctttcacatgaattggttactgtggtagttgtagttctggatacggtaccaaaacaaaagtattgctgtcaacaatctgcaacagccgggaaaacagtcgaaaacctttgcaaataatacctgctgccgtggacacgagggggggcccggtacccnnaaanaaaanannnnngnnnnnnaannnnnaaaaa

SEQ ID NO: 1743 - DNA, 794 bp, Zea mays
  misc_feature (669)..(669): n is a, c, g, or t
tgggacctcgtcccaaacactagaaagctcttaaaagcccccagggctaagcagcggcgacgtatccctaatcccacctccagtctttgggcaccaaatttccggcggcgatggcggcggctgtggcgaggtcagggttccggcgcatgttctccgtctctgccttcgcgccgccgaaggcgcccgccgcgcgccccaaggccgacccatcccccaacctcttcgtctccggcttaagcaagcgtaccacaagtgaaggacttagagaagcctttgcggagtttggtgaagttttgcatgctcgagttgtgaccgatcgtgtcagtgggttttctaagggatttggctttgtaaggtatgctacgaccgaagaggcagccaagggaatagaaggaaaggatggaaagttccttgatggatgggttatttttgcggaatacgctaaacccagaccaccgccggaggaaacagggatgaattcgcagccccagcagtcatggggagctccatcaggttcctggggtgcacagtagatgaagtgatattgtgagagcccctccctgtccccagccctggggctcgtagcggatcgtgagggatgaaatttggtgtgtggtgtgtcgcaggtgtgaattgcctttgttgtcccaatattcctaccgtgttggngagtggtcgtttgctcgcgtccacgtctttcacatgaattggttactgggggtagttgtagttctggatacgggaccaaaactaaaagtattgctgtcaacaatctgcaacagtcgaaaaccttt

SEQ ID NO: 1744 - DNA, 2726 bp, Zea mays
ccatgcctctgagaaaaccagctaatgatttgcccttttttaaccacctgaaacactcagttacgttcttcacttttcagtgccaacattattaagatgttgggaattgggattatcattttctgtctcctggtgcagccttcttctgtctctatttttagatcatggttgttatttatatttgctatgaggactcctattaggacggtatcttaagggtatggcttagttcaacccttctgattataccaaaactgaatttggtttctgagcaaatccaaccatgcctctgatgaacccagccaattttgccctttctatcaacttgacttatttagttttgttcttcactttacaatgccaacattattatgatgtagggattgccatttcctgtctcctgctgtagcttccttctgcctccattttttttggatcgtgctcgttctttatatttgctatgaggatcctattaggagtttaggacggtatcttaaggttatggcttagctcaacccttgtgattataccaaaactgaatatggtttctgagcaattccaaccatgcctctgaggaacccagccaatgatttgacctttatttatcaacttgactgatgtagtttattcttcgctttacaatgccaacattattgtgatattgggattgccatgtcctgtctcctggtgcagccttcttctgtctccattttttgtatcatgcttgttctttatataagctatgaggactcctattaggacggtatctaaagggttggcttattccaacccttgtgattataccaaaactgaaaatggtttctgagccaatccaaccatgcctttgaggaacctaaccaatcaatgatttgacttttttattaacctgactgatgtacttacgctcttcactttccaatgccaacataattatggtattgtgaccgccttttcctgcaatgctttcttttgtctctatttctggatcatatatttttttgtttatatttttatgtgagggctcctattaggacggtatccgaaggagcttagattttaattgtatatacctcttctgattataccaatactgaatatggtttcttagcaaaaccgagtctagctatcatttttgtcccagtctatgaaagatgagcagcaggtcaaagtttgtttttgttttattctttgtatagccatgccgcaatgcactctgatatgcagttctttctcttctcaggtatgctacgaccgaagaggcagccaagggaatagaaggaaaggatggaaagttccttgatggatgggttatttttgcggaatacgctaaacccagaccaccgccggaggaaacagggatgaattcgcagccccagcagtcatggggagctccatcaggttcctggggtgcacagtagatgaagtgatattgtgagagcccctccctgtcccagccctggggctcgtagcggatcgtgagggatgaatttgtgtgtggtgtgtcgcaggtgtgaaatgcctttgttgtcccaatattcctaccgtgttgggggtggtcgcttgctcgcgtccacgtctttcacatgaattggttactgtggtagttgtagttctggatacggtaccaaaacaaaagtattgctgtcaacaatctgcaacagccgggaaaacagtcgaaaacctttgcaaataatacctgctgccgtggaaaatcgagccccctctgcttgtggcatgtgtctgtgcactacgctggataacgactcggcatctcacgtctgggtgatagcggtgcgtcggctcagggccgatctgcgcagcagcacatttcatccgtggtctggtcggcagtgcctgcacgcatgatcatgccttggttgtttcgtgtcgttcttttctcgcttctggtttgcccacatggtttccagaagtggtttgggttcgtgttgcttgatatggttttgatgcttgttgattccacgtccgatgccggcgttccgctgcgctggtgtgcctgcagccagccagttggtgatgcacgatactgttgcgtgctgtcagtgtcacgtacttgaataaaatggtctggggtgttcaacctcaccctcacctcaatggtgtggcccctggtgctcatgtagacgcttccactgttccgtccgtggtctggaacccacaacatggacagacaggcttcgtcgttggcgccggtgtgaagagtcgaggattgccacatgagcgcctttcagggggtcgtgcaagatcagacatatatgggccagaatctcagatgatatatatgggcagcgagatccaagtgacggcgagaggtgcccggcgccgcaggcaaagcacctcgtccacctacgccgcgtggccacgcgatcgcgctgctattcatatccaaatcttaaattaaatgggaggttttgaatgcgtcaacagtgacatgaaccaaaccaaaccaaaatgagacagcgacatatagcaaatgcatagcataggtgtagctcaagctaatccacactttctccagcaggtactctaaattttagaggagtttctcaacctttatgttttcgacagcgttttctaaacggttctctaaatataaatgatgttattggatcttctatatatatatatatatatatatatatatatatatatatatatatatatatatatatatatatatatatatatatatatatatatatatagag

SEQ ID NO: 1745 - DNA, 1756 bp, Zea mays
tattaggtctcctcgactaacaactaattgcttgccggaaaaaaaaagagagaaggaaaacgagacaagggtattctagtcattttcggtgttaaaccctaccaccaccacggagtggtaaaatggtcatttaactcggggcccccctccgatcttaaaccctagaaagctcttaaaaagcccccaggggccagggctagcagcggcggcgtatccctaatcccacctccagtctctgggcaccaaatttccggcggcgatggcggcggctgtggcgaggtcagggttccggcgcatgttctccgtctctgccttcgcgccgccgaaggcgcccgccgcgcgccccaaggccgacccatcccccaacctcttcgtctccggcttaagcaagcgtaccacaagtctcggacttagtgatgcctttgcggagttccctggtgaaacctacgcggcggcctcctctgttcgtttagctccagtactgaatctctggcgtagatggacggtcacgcggccgtgattttacccgctcgttagtgttctggtggcgctggatctcgtcgtggtttatgtgtaggaatggttcatttgttaccgtgctcctcggaaatcttggtgaaagtttgaggtgcgtactgactgccaatggaagcacagcctgtgcatccacggcgctggacaatgaccatgtaggtttccttcattccagcctagggttttctacactgctggtgattggtttagtttccatttacttaccctatgaacgacggtgttggctattgcgcacaagcaactagggaatcaggtcacatgagaggagaatgggggagcccaataattgtaatactcctgcatgccattgttttttagtttgtataatttccgtgcactccattgtttcactgtttgtgaaactcgaaaatgacctaccctttgacttctgagttcaccagaagtcatggcagagaatgacgtcaggttggtctggtctggatgttgctgaatttttacagcaggaacaaagaaagattgtagtagtgagctcacttttattacagaattaaaattgggatattctgtctcttcccctttagggcttgttcagttaggaggggattggagggattaaatcctcacctagtcaaagttgaataggaagggatttaatccttctcaatcccctctgattcttatgcaaccggacatggccttaatgtatgtaggtttgatgtttccgaacatgggcttacttgcaggcttaagcaagcgtaccacaagtgaaggacttagagaagcctttgcggagtttggtgaagttttgcatggtatggttctctccttcctttgctgttcttttcatgctatggatttgaagcttctcatttctcttacaaccgcagctcgagttgtgaccgatcgtgtcagtgggttttctaagggatttggctttgtaaggtatgctacgaccgaagaggcagccaagggaatagaaggaaaggatggaaaggtatggttactttacattttctttgtcttcaattgaaggagtgttgctcaatctttggtttttgctgccttcaatttctgtacataatgcaacattgctcatcattagatagtctattttcatcctatgttttcagtgtatgcatctgtgatatatggcccctctccctctctctccgtttgacacatatctaaacatattgttatttgtggataagaatggatcactgggcacctgcatgctgca

SEQ ID NO: 1746 - DNA, 1228 bp, Zea mays
cattgggtacctcgaggccggccggaaaatggtcctttaactaggagccccagaaagatcttaaaccctagaaagctcttaaaaagcccccaggggccagggctagcagcggcggcgtatccctaatcccacctccagtctctgggcaccaaatttccggcggcgatggcggcggctgtggcgaggtcagggttccggcgcatgttctccgtctctgccttcgcgccgccgaaggcgcccgccgcgcgccccaaggccgacccatcccccaacctcttcgtctccggcttaagcaagcgtaccacaagtgaaggacttagagaagcctttgcggagtttggtgaagttttgcatgctcgagttgtgaccgatcgtgtcagtgggttttctaagggatttggctttgtaaggtatgctacgaccgaagaggcagccaagggaatagagggaaaggatggaaagttccttgatggatgggttatttttgcggaatacgctaaacccagaccaccaccggaggaaacagggatgaattcgcagccccagcagtcatggggagctccatcaggttcctggggtgcacagtagatgaagtgatattgtgagagcccctccctgtcccagccctggggctcgtagcggatcgtgagggatgattttgtgtggtgtgtcgcaggtgtgaatgcctttgttgtcccaatattcctaccgtgttgggggtggtcgcttgctcgcgtccacgtctttcacatgaattggttactgtggtagttgtagttctggatacggtaccaaaacaaaagtattgctgtcaacaatctgcaacagccgggaaaacagtcgaaaacctttgcaaataatacctgctgccgtggaaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccgtttttaaaaaaaccaatttttcctccccgtggcttggaaaaattaaaatttttttttttagggccccccaaaattaaaatcctggggccggtttttttaaaaacgggggggatggggaaaaaccctgggggttccccaaaattataaatgccttggaaaaaaaaacccctttttcccaagggtggggaaaaaaacaaaaaacccccccc

SEQ ID NO: 1747 - DNA, 1409 bp, Zea mays
gtaatctcaatcgtatcgtccacctcaacaaaccttcgtccacgcttcgactcctgcaggagtgagggagagagtgatggagaggtgcgggagctgggactgcgacgcggcggcagcgcagaaggcggtaccggcgccgttcctgaccaagacgtaccagctggtggacgacccggccacggaccacatcgtctcctggggggacgaccgggtctccaccttcgtggtctggcgcccgccggagttcgcgcgcgacatcctccccaactacttcaagcacaacaacttctcctccttcgttcgacagctaaacacctacgggttccggaaggtcgtcccggagcggtgggagttcgggaacgagttcttccggaagggggagaagcagctgctgtgcgagatccaccggcggaagacgtcgacgtccgcggctccgccgtcgcctccgccattcttcgcggcgcctcacttcccgctcttccacccggacgccccgcaccaccaccaccaccaccagttcgtggggggaggagacgacggggctgtggcggccgcgcacgtcggcggcgtcggcgtcgccctcgcgttcccgcacccgcattgttggagggagccgccgcactccgccgcgccggtagccacgcggctgctagccctgggcgcggctcctccggcgccgtcgtccccgctgccggccgccgatgccggcggaggcgggcgcgcggccgtgctggtggaggagaacgagcggctgcggcgcagcaacgcggcgctgctgcaggagctggcgcacatgcgcaagctgtacaacgacatcatctacttcgtgcagaaccacgtgcgccccgcggcgcccagccctgccgcggccgcgttcctgcagggcctcggcctgcaggcgcgcaagaagcccgccgcggggccgctcaaccactccggtgggagcaccacgtccagcagctcgctcaccatcgcggaggaggagccctcgcccccgcccccgccgcagcaggccgacaagagcgccggaagcagcggcactgcgcggtctgccgccgaccgcgcgccgcccaccatgctcttcggagtgcacctcagcgccgcgcgaggcagcaagaggccggcttccccggaggaagaagacgaccagtcgcccacgtcgcctgctgggaagccacggctggcgctggagtgcgccggcttgagcctggccgtcgcggtgccctccgccggcgcctcgtcccctgctagcactagctagctaagcctcactcaccttgcgcgcaacctgacgcgcgtttgcatgctgctgcatgcaaacgcaacggcgggcgtggccgttttgttgttctagctctagtttgatcgacgtgttccatttgaaccggtagatccagatgggttctctc

SEQ ID NO: 1748 - DNA, 2591 bp, Zea mays
gggacatggagaggctggcgacaactgttggccttcttctccgtggtcttaagcgtgacgatgttgagcgtgttcaggaggtgtgcaaacctggtagtctgaagacatgcaaaaagttcgaggcggaaatatatgtcctgacaaaggatgaaggtggccggcacactgcctttgtcacaaattacagcccccaattctacttcaggacagctgatgtcactggaagggttgacctgcttggggagatgaagatggttttgcccggtgacaatgtaactgccaattttgagttgatatcacctgttcctcttgaacctggtaacgattacattctcaatttctttcgacagtatagaactatagaccaggtcttctgacaacatgctgttcttcgtgatgccattgcacgctccaagctacttcttttcattgaatactaaagaaattcatattggatcgtcaactcgtgcctttgatgcagggcaaagatttgcgattagggaaggaggaagaacggtcggtgctggagtcgtctccaaagttcttagctgatcagtttccactttcttctccgtagcaattcagtgaacaaacgagtgttgatatgtccgaccgggttagaaacgagcgcaaagcaccgggttttcttttgcatttttcttggaatgcctgagcaaaggcagagctggcctggccagtggccaccattttattgttgaggcgtggtgctgtgtaacaccacggttagtttggttgacacgcaagttgggcataactttgattgaataatactagtctcatcataaacatattttctagcaattttgtcatgtcggtcttggaggcgctttgtcaagtccgcacaaaaaaaatgctggttggactatatatgtgtatgcatttgtgatgtttaccgtcgctagcttctgatctggtgatgcgaaattttaatggcatggatattatctatttgttttcgaatttgattcgactacaaggactaaacccgatccgtatctgagtccatgttctttagtatctgatatgtatttgatatttatccgtattcataaagtcataaagttggatatgtattatgttgatactgttttaaatattagctgacataatttaataacatttgtattcgatgtgaatcgaaaagaaaaaaatgtaaaaataaacacggaacgactgtttgtatcggtgctggatagatttttgtgggatgaattagtacattatctttttactcactttttcttttggtttatggaatggaatgaattaatccattaccaccttatttttttagttacttggtactcatatgaataatatggtcatttcatcaaatttgaggaatgaagtcatcatgttaccatctcattttaaatagattgattttccaaaccaaacaccctttagaaactaagaaatattaattcgtatgagcgtggcatcctaaattctctctgcttgttggctatttatttttaaacacattgtaaacacgtaagctaataactaataacgtgtcacgagccgaaggctcagcccggcgtgggccagcccaaaattaatcgtgatctttttgggcttaggtcaggccatgtacacctacaatttgaactagaaatgacaattggcacattttacgagagttcccacagtaaaaaccctatagaatgctttgcattcgcgggtacgcgtgcggttcgattctgaactcgatgaattcttttctcgtgggtacgaaaacattgtactgtgtctgccaacccgcaaacccacaatgaatatatatgtacttatatatatgtgtgtgtctatatatatgtgtgtatgtgtatctgtgtgtacatgttatatactaggtgagtgcccgtgcgttgcaacaaaaacatataatatcatgataacttacatacaaatgtgctgttacgagaaaagttttcataatccattgaaagaaaattaatcaatatgaacgtggatcaagcaatttccacatttctaacggatggtctcttttagctatcgtacacacatacttcaaaacgtttgcgacctctagcaattaagagcatctccaacaaatctatttagatcccaatatctcatattagtatctccctaaccatatttgggatctaaacaaatatcattctccgacaactccctagcgatctcccaaaaagagttaaacttccatgcatggcacgtagtagcttcgacaacattggatttaacaacaacctgatatggcgtgcaacagctaccagttcgcgcggagatatctagtaacacacttcagaatcaaatgtactactacactcagcaggtttccaaaggggccaattatgacaaatcaaacatgtatctattcagttgcttgacaaaacttaggaaacatttgctgaagtatttgtgtcctcatcatgatctagagaatagctttcttcataataactttctgccatacccaactcagaggatatggtcttcaataccgagcttgctcctttgacccttctgtgtaccttcctatcagatgaatgaacacacacattaatattggatatgttgct

SEQ ID NO: 1749 - DNA, 3764 bp, Zea mays
actcttaggatccccctgacaccatagcatcaaatactcttaatgctttctccatcttgccaacaagacagtacccatccatcagcatattatacaccacagcatcaggatgcagaccaacatttacagttaagtcaaatatattttgtgcgtccattacccttcccagtttgcaaaggttgttaattatcgaaccgaagaaaacaatatcaagacgcatgccattattcattatttccgaaatcaattccttaggctttcagtaaactaccatagagtacaaaaaccttgaatcaggcaatggtatgcatatttgtcaggtgctactccttgatcaatcatctgattaaatttttccatagcatcatccatcttaccgattctgcagagggcagcaatcactgtcctataggttaccacatcaggtttcactccatggtctctcatttcattgaagatgatcatagccttatctagcattccacagtttgcatatgccttgatcagcacattaaaagtataaaagtcaggtgcaataccgtcacctagcatcaaatcgaagagatctgtcatatcaactaaacatcctttagtagcgtacccgttgagcataatattgtaggagaaaacatcaggattttggcccttcattgccattgtgtcaaaaacatctctagcttccttgatttttccatacttgcaaagggaacccatcaacatgctcaaagtaacaacatctggtaagatgctgtgtcttctcatttctttaaataccctaaccgcctccttccactgtcctgtggaggagtatccatatatcaagttattatatgtccagttatttggcagaacacgtttattgaccatttgtcgaaggaaagcctctgccttgtccattgctcttgccttacacagggcatggaccacagagttataagtcactaaatcaggtggaatgccccgctgtaccatttctttgaatagatcacatgctttatttacgtcaccctccttaaaaaagccgtcgattactgtattgtaggcaaccacgttgggcgagcagacagctcccccttcagccatcatccgtagcaaatcatctgcctggccactctttccttggtcgcagaggctcttcagaagtatgctgtacgagaaaacatcgggcacacagcccaactcaggcgttctgtggagaaggatgtccaaagcctcgtctgtccgcttcgcttcacaaaagccctcgagaaggtggctagcgatgatggcatcgacgcgcaagcctgtcctgaggagctggccgaagaacgccagcgctagctctgggcggtgcgcgcgggtgcagcagtccatgaggatggcgtaggtgtaggatgtgggggacagcacccgcggtccttgagcccgagacgccgcgcggttgaagagcgcgacggcgagggcagggccactcccgcaggcggcggaggacggcgcacgcgcgagcgccgcgaggaagccgttcagatcgcgctcgagaacgggcgtgcctcgacgctgcaactcgtcgagcaggtcgtgtgcctcctcagggcggagcgtcccctcccgcacgcgcgccgtggcggcggcgaggatgcggcggcggcagcgaggaggaggatgcggcggcggcgaggaggaggatgcggcggcggtggagacggcggaggagatgcgggcacatgacggcattgccgcgctgggggtggggggattttttgggcgtccgggttcctccctccctcgtcattcagtggttattactcaacacccgactactgacggggatcattatccaatttaagattcggatcgaattagggtccgactttatttatatttatttttaacatagaaataattttgagccataataaattatgtaggagcatttacatcacgatctattatcaataggtatgcatgtatcatgtatgtatcacaacgatgagtcgacgacggttagagcaactccaagaaaacatgcaaaactcccgaaaaatgttttttaggggaaatcgtgtttttttctcctccaacggaccacacaaacttccccaacattttcgcggccacgcatccacgcagattcatcctgcatatatgcgggaggtaaaatcctccccaatcgctttgagtgcctccatcccactggtttccacgacatttttcatcctcacgtgcatttccttggtcgagacatggtgggaggcagcggtgggagaggcttcgtcggcgtcgagctcagtaacgacctctgcgtcgttgccagggaccgtgagatgtagccgacgacgtcacttggtccggttctgcagctgcaagcttcctgtgatagccagaggatgtgggaggtggtggctaccggcggaaggctcctccaatggcagatgggtggcgttgcagtccatgtcctcggtggcggagtggacttgcgaggtacatgccaaggtggaggagcacccggcctcggatgctaggcgttgcctgtgggtgcggggttgcagcaggccttatcggcgcaacaacagtcgcagcaactaatgttgtacacggtgcacgggcgtgctactagctacgagaccaagtgggatgagctgcacccgatttcctaggctgcaccctctgcattcttgcctgatgttctacttctgcagcttgagacttgagagattggtgatagaggcgtttcattatttgtttctctttagcgaataggagacgcactgtgttgttgcaatcagaattgtgggctttcttgtggcatattttgctcttgatttcattagtacgatggtgaatggagggcacattgtgatttttagatcagaattgtggttccttgggctgccttaatgtgttgaatgttgatttcttttctttatacgatgttagatatagagttgtctaattgcagatacaaggtgctaaagccatcatgtttaccaatttgctacatgttctctcaatttggtagtaattgtcagtttggaacatgtaatctgagtgttagtcagtttgctacatgtttctgaatgtgtgtcaatctgagtttggaccatgttatcaacttgtgtcaatctgccacctgtaagtggcgctgctatctgtttctgaattatttaagttttgttcatgcatgtggcattggtatctgtttctgaattatttcgatttggttcatttaagtggaccatgtaatcttgtctctattcttttgaattcagttataattcagtaagttagccgaggggaattgcagcacatgaaataatgcaggaaagacagatgcaaacgtatcaggcccatttaatctctactggcccacgtaggcaaattcaaatatttaagggttaagttttcagcagtctgttgtgggtttaaaaaaatttagggaaactttttttacagcagcccccaatataaagtttttggaaacaatttttaagcagtctgttggagttgctcttaagcgtggtgatgtcgagcgtgtccaggttagatttcttgaattcaaaattgtctgagaagttttttgaaatattcacttaattgttttgcctggaaaccactcttgcatttgatggtacatggttgcacgatcaccaaacaaattatacaattctcttaatcctgatcctcagtgtatgttccttgattctaggtgtccaatatcgaaactgaacgatctcgaatgttgacaccctgtcgtttcctaccatttcaggggacgagctcgaatt

SEQ ID NO: 1750 - DNA, 898 bp, Zea mays
cattgggtacctcgaggccggccgggctgccgtccgtgcgcaccccccggaaaacttaaagccctaaacccatcttgctcccccctcgtctccactgctctgctgctcctcgcaccgccgccgccgccgccgcagcgacgtaatggcttccgccgcggtgctccggaacgccggctcccggcgcctcttctcctaccctactctccgcgccgctgcgatatatgtaccttctgcgctacccgatgcgcccgcggcggcggcagcgccggcccagccgccaccgacggccgggaccctctgggcgaggtctatggccaccttcacgcgcacgaagccccatgtgaatgtcggcaccattgggcacgtcgatcacggcaaaaccactctcactgctgccattaccaaggtcctggccgaggcagggaaggccaaagccgttgctttcgacgagatcgacaaggctccggaggagaaagccagaggaatcaccattgcgacagctcacgtcgagtatgagacggctaaaaggcattatgctcacgttgattgtccaggtcacgcagattatgtcaagaacatgatcactggagctgctcaaatggatggtggtattcttgtcgtgtcagctcctgatggcccgatgccacaaactaaggagcatattcttcttgcccgtcaggttggtgtaccttcccttgtgtgcttcttaaacaaagttgatgctgttgatgatccagagcttctggaacttgtagagatggagcttcgggagctcctcagtttctacaagttccccggtgatgagattccgatcatccgtgggtctgcgttgtctgctttgcaagggaacaatgatgagataggaaagatgcattttgaatttaatggacgcagttga

SEQ ID NO: 1751 - DNA, 2173 bp, Zea mays
gcacgaggccgcacggtatgcgtccgcccgggaaacttaaagccctaaacccatcttgctcccccctcgtctccactgctctgctgctcctcgcgccgccgcagcgacgtaatggcttccgccgcggtgctccggaacgccggctcccggcgcctcttctcctaccctactctccgcgccgctgcgatatatgtaccttctgcgctacccgatgcgcccgcggcggcggcagcgccggcccagccgccaccgacggccgggaccctctgggcgaggtctatggccaccttcacgcgcacgaagccccatgtgaacgtcggcaccattgggcacgtcgatcacggcaaaaccactctcactgctgccattaccaaggtcctggccgaggcagggaaggccaaagccgttgctttcgacgagatcgacaaggctccggaggagaaagccagaggaatcaccattgcgacagctcacgtcgagtatgagacggctaaaaggcattatgctcacgttgattgtccaggtcacgcagattatgtcaagaacatgatcactggagctgctcaaatggatggtggtattcttgtcgtgtcagctcctgatggcccgatgccacaaactaaggagcatattcttcttgcccgtcaggttggtgtaccttcccttgtgtgcttcttaaacaaagttgatgctgttgatgatccagagcttctggaacttgtagagatggagcttcgggagctcctcagtttctacaagttccccggtgatgagattccgatcatccgtgggtctgcgttgtctgctttgcaagggaacaatgatgagataggaaagaatgcaattttgaaattaatggacgcagttgatgagtacatccctgatcctgtgaggcagcttgataagcctttcttgatgccgatagaagatgtgttttctattcagggtcgtggaactgttgttactgggcgtgttgaacagggaacaatcaaaactggtgaagatgttgagatcttgggtttggcacagactggtcccttgaagactacagttactggtgttgagatgttcaaaaagatactggaccatggagaggctggtgacaacgttggccttcttctccgtggtcttaagcgtggtgatgttgagcgtggccaggtggtgtgcaaacctggtagtctgaagacatgcaaaaagttcgaggcggaaatatatgtcctgacaaaggatgaaggtggccggcacactgcctttgtcacaaattacagcccccaattctacttcaggacagctgatgtcactggaagggttgagctgcttggggagatgaagatggttttgcccggtgacaatgtaactgcgaattttgagttgatatcacctgttcctcttgaacctgggcaaagatttgcgattagggaaggaggaagaacggtcggtgctggagtcgtctccaaagttcttagctgatcagtttccactttcttctccgtagcaattcagtgaacaaacgagtgttgatatgtccgaccgggttagaaacgagcgcaaagcaccgggttttcttttgcatttttcttggaatgcctgagcaaaggcagagctggcctggccagtggccaccattttattgttgaggcgtggtgctgtgtaacaccacggttagtttggttgacacgcaagttgggcataactttgattgaataatactagtctcatcataaacatattttctagcaattttgtcatgtcggtcttggaggcgctttgtcaagtccgcagaaaaaaaatgctggttggactatatatgtgtatgtatttgtgatgtttaccgtcgctagcttctgatctggtgatgcgaaattttaatggcatggatattatctatttgtattcgaatttgattcgactacaaggactaaacccgatccttatctgagtccatgttctttagtatctgatatgtatttgatatttatccgtattcataaagtcataaagttggatatgtattatgttgatactgttttaaatattatctgacataatttaataacatttgtattcgatgtgaatccgaaaagaaaaaaaaaatgtaaaaataaatacggaacgactgtttgtatcggtgctggatagatttttgtgggatgaattagtacattatcttttt

SEQ ID NO: 1752 - DNA, 1763 bp, Zea mays
ttgggtacctcgaggccggccgggaagccctaaacccatttcccccccgtctccactactctggtcgtcctcgcgccgccgcagcagcagcagcgacgcgaccgccggtaatggcttccaccgttgtgctccggaacgccggctcccgccgactcttctgctactccactctccgcgccgccgcaatattgggacccgccgcgccacctgatgcgcccgcggcggcgtcggcccagccgccaccgatggcaggaaccctctgggcgaggtccatggccactttcacgcgcacgaagccacatgtgaacgtcggcaccattgggcacgtcgatcacggcaaaaccacactcactgctgccattaccaaggttctggcagaggcagggaaggccaaagcagttgcttttgacgagatcgacaaggccccggaagagagagccagaggaatcaccattgcaacagctcatgtcgagtatgagacggctaaaaggcattatgctcatgttgattgtccaggtcacgcagattatgtcaagaacatgatcactggagctgctcaaatggatggtggtattcttgtcgtgtcagctcctgatggcccaatgccacaaacaaaggagcacattcttcttgcccgtcaggttggtgtaccttcccttgtgtgcttcttaaacaaagttgatgctgttgatgacccagagctactggaacttgtagagatggagcttcgggagctcctcagtttctacaagttccctggtgatgagattccgatcatccgtgggtctgcgttgtctgctttgcaagggaacaacgatgagataggaaagaatgccattttgaaactaatggatgcagttgatgagtacattcctgatcctgtaaggcagcttgataaggctttcttgatgccgatagaagatgtgttttctatccagggtcgtggaactgttgttactgggcgtgttgagcagggaacaattaaaactggcgaagatgttgagatcttgggtttgacacagagtggtcccttgaagactacagttactggtgttgagatgttcaaaaagatactggaccatggagaggctggtgacaacgttggtcttcttcttcgtggtctaaagcgtggtgatgtcgagcgtggccaggtggtgtgcaaacctggtagtctgaagacatacaaaaagtttgaggcagaaatatacgtcctgacaaaggatgaaggtggccggcacactgcctttgtcacaaattacacaccccaattctacttcaggactgctgatgtcactggaaaggttgagttgcttggtgagacgaagatggttttgcccggtgacaatgtaaccgcgaatttcgagttgatatcgcctgttcctcttgaaactgggcaaagatttgcgatgagggaaggagggaggacagttggtgccggggttgtctccaaagttattagctgatgagtttccactttcttgcccgtagcaatttagtaaagaaatgaatgctgacatgtttcttggaatgcatgggcaaaaaggcagagctggctggtctggccgccattcattctggacagtaccttgtgctttcttgttgaggtggctcatcataaagcatattttgtagccacttttccgagttgatattagtgggttcttaccaaatttaccgcgaaaattgctggtcatgttgggccgatgcgtcgttcttcgataggagatgaagtgctgttatcagtgccaaaaaaaaaaaaaaaa

SEQ ID NO: 1753 - DNA, 1898 bp, Zea mays
ttgggaccctcgaggccggccgggcctctcttcttctgccttcccgactctacctgacttcgcccgctctgagaaattcactctcaccaccaccgcgccgcctccactccccccacacccccggtctgaaacccaagcttccgcttctctcatggccgacgccaccgccgccctctcagctcggagcaaggtgcaggctttcctggaggctgcgcgcgccggcgacctccaatccctcaagaacctcgtcgcggcgctcgacgaggacggcacgggcgccgcctccgtcgccgccgccgtgcgtgacgccaacaagcgcaccgccctccacttcgcggcgatcggatgtcgcaccgacgtctgtgaattcctcatcggcgagctcggcctccctgtcgacccaaaggacgatgatggcgaaactccgctcatccatgcgacacgccagggccatctggacactgtcaagtatcttctcgaccatggagctgatccttcgctggccaccagcctaggagccacagcgctacaccatgctgcaggcatagggaacacggaactcatgaagcttctcctctccaagggagttgacgtcgagtcagaaagtgatgctggcactccccttgtgtgggctgctggtcatggcaaccaggatgctgtcaaacttctgcttcaacacaatgctaagccaaatactgaaaacgatgatggtgtcacagcattgttatctgctgttgctgcaggttccctcccatgcttggaggtcctaattgaggctggtgcaaacccaaatgtcaaggctggtggagcaaccccattgcatattgctgcagatagtggaaatatagaagtcatcaaatgtttgcttaaagctggagctgacccaaatacctgtgatgatgatgaattgaagccagttcaggttgctgcttggagaaataaccatgaagctgttgaacttcttttaccgttaacatccccaattccaggtgtttcaaactggaacgtagatgggattatagaacacatgctccctaaagagtatgaggaaaagtctcaactgaaggaagcgacatctctgaaatcaggcctaacacaaactattgaggtgtcatctgaagcaaaaaagaggtccttggaagccaaatcaagaggtgatgatgccttcagaagaaaggactaccttgtagcggtggatgcttatacgcaggctacagagttggacccaactgatgcaacagtgctctcaaacagaagcctgtgctggctgcgggcagggcaagctgagcgtgctctggaggacgccaaagcatgccgtgcattgagaccagattgggcgaaagcctgctacagggaaggtgcggcgcatcgtctgttacagaggtttgaggaagccgcaaacgccttctatgagggggtgcaacttgagccagagaacacggagctcgtcaacgcattcagggaggccatcgaagccgggaggaagttccatggcgtcaacacgccaagctcaacacaatgagactttgctgtttggttggataggtagatgatgaggcggatggacatgaacgttgtcttagttggaatttggtgagatgatgaatgagatgatcatgaaatttgaaagagcgaatttgccagatttattttgtgttttgtgattgttttcttaaacttgttttcttgcgcaaaaaaaaaaaaaaaatgcgctctttcttgaattgcattttaatcagtgttagggtctggatgatttagctgggaaagggagaagatatgctagggctatggaaagtagatcgtgcatatggtgatgcaaaacgatgtttacagtgtgaagtttaaaataggagatctgaataagctattggagacaatattatacagactatttg

SEQ ID NO: 1754 - DNA, 4461 bp, Zea mays
cttttggtggccagaagctgccagaagccgaaacaaacatgccccataccaggtctatgggcgggctaccgggtccaggcagcccacggactgggccctccattcccattccccttccgcgtgcacgtgacgtggggacgatatcgcgggcggcgtttggttcagagtccgacaaggcaaagcgagagagaaggacacccagcgaagctaagcaaagcaaaccgaagccggtttcatatcgcaccccgcaccccgctcctccctcctcctgctccggctcccttcctccacagctcgaataaagtcccctcctcttccagtcttcctcctccgcgctccaatcttcccagcggcacggtttcggttcttgcagagtagcacggaggttccttcgttgggggttcttggtctgccttgagcgatttggtgcgccgcggattgttgtgtggttgtgagttgtgactgcagagacaagggccgtgtggagagtcgagccatcgaggtcgaggaggagggaagggaaaaggggggcgcatgggcggccagtggctgggggaggggatgccgtcgtccaacctgcagtgcttcttggactgcaccacccccaccgtcgagacgcacattctccccaagacgaatggacgattgccgaccgacgcctggcaccacgctcagatcgacagcgtcgatgttcttcaatcttggtttctggccggggcttgccacggtcgtcgcgtcgtcgatctgcggcgtcctggcctcctgggagtctcggatttgtcatttactccttttctccgcaccgcttagtgtggtggggtgaaaaagatgggctttcttctactctttccggctcatcttttttttactgatgcatcgttctgctttttctgaccgtaaattctcatgtcgaattgctggtaacagtacgctagtactgttcctttctccccccttaattatttggaggattgtttgcacggaaccaagtcttactagccggagaaagttgcgattcacgctgcggtgattcctgccatcttgaattcggctttccttcaactgttccattaatgctcttgggtgacggatcatatgtagggccgcttgttagtactactctcttcctatctgaaagttactcgccgttggttttggtccagacgaatggacgattgccgaccgacgcctggcaccacgctgagatggacagcgtcgagtacttcaatcttgccgacctctgggaacagtactatgaatggagcgcgtacggcgccggagctacggtgcagctcccaggaggggacagagtagttcagtactatgttccatacctgtcagggatgcagctatacaccaacaaggtcctgactgcatccaggtatgggcaagaccttgctagggggcaaatttcgagtttattcatggtgattttcagctgtgggccaatccaattctctgttttcttgcagaagttttggtgaagataatggcatggatttatggagtgatgatgaggacaacgagaagatgtcgagatcctggagttccacctctgatgaatcattgttcaactgtgatgtgttatggtccaacaggaagcgtccagggcacctgtactttgagttctttgaagtaggttcaccttatggaagggttcctctcattgacaaggtgaatttctatgggctttgctgtgaccttatcgctgttgtgattttgatcgcatttcttacatgatcattgccctttctaggtttatgaactatcccagggctttcctggattgacatcactgaagagtgctgagctttcgcctgttagctggatgtcagttgcctggtatgatcaaatttatgtctgctgtttgtgttcttctgaaagaacaaaaaatagctgatgaaatagttctgtaactaagaccattcttgtttagctttccttctgcaaatagttttatagatatattgaatgaagcagttgcatacggcactaaacatgtgccttatagcagtctgatgacagatttgagtgctttgattatcttttttttctaaatagtaacccttatttctaggttcaaatcgattcttggttgattttcttctcggtgatgatagcaattagcattatcattcatgtttgtctgctactttgactaggtaccctatataccacattccttaccagcgcacgagaccattacctagaacatcctaatcgaaaataccatttcctcctcgtttcaaggtatgttttcctcgttttgtttgaaggcatgtttgttcatcagagtgtcagtcactaaactctaccattttcttaaattcttacggcacaataatttgattattctaatatgcttctgtaccagtgccaaacagacgttgtataaccgttgaaattgttatcaacaatcttcatactttttagggtcttgagttgatttcccttttccgatgtttaggatatatgtgttggcatattggttgaaatttcaaactcaggttgtgcatcaaagcatgactacaggatatagtgacagctccttttgtttagtgcagtattctaataaacatctagtcttctaatacttctgttgtgttgtgacttagaacttatttgcatataaaacattagggcttaatgagtgaaaaagttaccgtttgctcaagctcaaatcccatgatatgtattgcaacattattatcgttcacaggaaagagtatttctcatgtctgtgtacctgagaaaagatttccccgaaccattgatatattgcttaatgtacactaaaaaagaggaatgtcaatctggtggcctagacctaggggtggtaatagatcgtgatccaaatgtttcttcacgatttgttatggccctaaataaattttggttcaaaaatgaatagaattagagtccgatccttaaattttatagtgtaaaatttagagcccattgtcacctctaccaggaccagaagaaaggaatttaaactgttgctttctcattcttcttgtaattggttggttgagtggtctttagttttcaaacaatgaactttatatttggaaaaggtgtaactgatgttcagttacgtttctatatctagaaagtttcctactatataacttaatgatgtgctctatactgcataccagttggtatggcacactactcttaaatcaatcgatggcttagcttacaagagtataagagtttccttcaaagctttgttcgtcttgctatgttgcgtccagtttgtcaactttggtttcaaaaggcttcatgtcttagctttaaagtctgtagttaaggaaaccactcaaacaaaaagttagtggcagcagttctttgctcagtaaagagaaggaaagagaccgtgttgtcatgttccacgacttcattacttatccatagacatgcagttgtttcttgaagctaaaaatacctatgttatataacatggaggaagagttgttcaatagaccatctttggagaaagcttgtttggattgcgatatgtgcaaaagcacctaggttcaccagctgtccttcccaagaaaacaaatgatgatatatagagtccaaatcaagccaagatctttaagcttgaatatgctttgcatgtgaatacattgactttcggtcagttatttgttaatgtatgtccttaatcacggctgcaccagcgatgaccttagtactgttttcaaaccctcagtaacctgtgttatgtttctcacagatcacgggcttgagaccatgaccactgattgttgccatccagttgcaaacggcaaacaaaatggccacatggataagaagagcaacaccgtatcactgcctccatttggcctcgcagcacacaagatacaaggttccctctggaccaaccccatgacaggagaccgcagaaagatggacttcctcttcagtgcggcagactcctggctgaagcagcttggagtccagcatcatgacttcaacttcttcatcactcaccccatgtgaactgctgatccggagtggcttgcaaagaaccacatgggtacagtttgaagctagtgatattacctacccaccaccaacggggtagcaaaacgtttacagtacaatgcgctggtgaaatgagtctaacaatcgcaggatagatttatacttgagtttactgctgcagcgaataccaaacatgtcggcactcaaaaaggttttctgtttcttgtttcttggcagaaaaatgtaactgatctgtacagaagttttgcaactaatttggtatccaatgtgggggttgagctgttaaaaaaaaaaaaaaaagccctagagaatgttagttccaggacgaaactgttgacgcagactccagctggacctgaatctgtcgatgacaattagttatcttctacagtaaggcagttgtacgcacacattctcattcagtctgattggatacctgca

SEQ ID NO: 1755 - DNA, 1698 bp, Zea mays
ctggccgggaaggcaaagcgcctcggggccgcccgcagcgcgagtccgcaaagcaaaccgaagccggtttcatatcgcaccccgcaccccgctcctccctcctcctgctccggctcccttcctccacagctcgaataaagtcccctcctcttccagtcttcctcctccgcgctccaatcttcccagcggcacggtttcggttcttgcagagtagcacggaggttccttcgttgggggttcttggtctgccttgagcgatttggtgcgccgcggattgttgtgtggttgtgagttgtgactgcagagacaagggccgtgtggagagtcgagccatcgaggtcgaggaggagggaagggaaaaggggggcgcatgggcggccagtggctgggggaggggatgccgtcgtccaacctgcagtgcttcttggactgcaccacccccaccgtcgagacgcacattctccccaagacgaatggacgattgccgaccgacgcctggcaccacgctgagatggacagcgtcgagtacttcaatcttgccgacctctgggaacagtactatgaatggagcgcgtacggcgccggagctacggtgcagctcccaggaggggacagagtagttcagtactatgttccatacctgtcagggatgcagctatacaccaacaaggtcctgactgcatccagaagttttggtgaagataatggcatggatttatggagtgatgatgaggacaacgagaagatgtcgagatcctggagttccacctctgatgaatcattgttcaactgtgatgtgttatggtccaacaggaagcgtccagggcacctgtactttgagttctttgaagtaggttcaccttatggaagggttcctctcattgacaaggtttatgaactatcccagggctttcctggattgacatcactgaagagtgctgagctttcgcctgttagctggatgtcagttgcctggtaccctatataccacattccttaccagcgcagcgtgaaggacttatctgcatgcttcctaacttaccataccatttcctcctcgtttcaagatcacgggcttgagaccatgaccactgattgttgccatccagttgcaaacggcaaacaaaatggccacatggataagaagagcaacaccgtatcactgcctccatttggcctcgcagcacacaagatacaaggttccctctggaccaaccccatgacaggagaccgcagaaagatggacttcctcttcagtgcggcagactcctggctgaagcagcttggagtccagcatcatgacttcaacttcttcatcactcaccccatgtgaactgctgatccggagtggcttgcaaagaaccacatgggtacagtttgaagctagttatattacctacaccaccaccaacggggtagcaaaacgtttacagtacaatgcactggtgaaacgagtctaacaatcgcaggatagatttatacttgagtttactgctgcagcgaataccaaacatgtcggcactcaaaaaggttttctgtttcttgtttcttggcagaaaatgtaactgatctgtacagaagttttgcaactaatttggtatccaatgtgggggttggatccatactgtagaaaaaaattgtgaactttagtgccctagagaatgttagttccaggacgaaactgtttgcgcagactcc

SEQ ID NO: 1756 - DNA, 1360 bp, Zea mays
cattgggggcctcgaggccggaaaccctagcccgctacccctgccccttctctcttcgtcgcgcctccgcctccgccgtcgtagcatcctcctccgccacctcggccatggcgacatccccagcgctcctcttcccttctccctcctcggcatcctctgcgccttcgtcggcgcgggtggaggcagtggtgcttttcaacgtctgcgacagctacgtgcggcgcccggaccaggcggaccgcgtcatcggcaccctcctcggttccctcctctccgacggcaccgtccacgtccgcaactcctatgtcgtcccccacagcgagtcagccgaccaggtcgccatcgacatcgactaccaccataacatgtacgcctcgcaccagaaggtgaaccccaaggaggtcatcgtcggatggttctcgactggatttggtgtttctggggggagtacgctcatccacgagttctattcaagggaagtacaaaaccccatccatcttacagtcgacactggcttcactaggggggaggcttccatcaaagcctacatctcatccaatctgtccctcagagatagtcaactcgctgcacaatttcaggaaatccctctggatctgaagatgattgaggcggaaaaggctggatttgagatcctgaaatctactatggtagagaagctccccaatgatctggaaggaatggagtcatcgatggggaagctttacattcttatcgatgagatctacaaatacgtcgatgatgttgtggaaggacgcgtggcacccgacaacagaattggaaggttcatctctgattcttttgcttcggtgccgaaattgtccccggctgctttcgataagcttttcaatgacaagattcaggataaccttgcgctggtatacctgtcaagcatcacaaggacacaaatcagcatcgccgagaagttgaacactgctgctcaagtgctgtaggtttggcggtgtggcatctggtttggacgtggatggcttgatgctatctgtgatgcttggcgtaagtgtgattggtgacagaaatgcatttttgtactcattattattattgctaaatgagagacctgatggaaagggttagccaacgatgagatcccataatgttgccagaatgccagtagagtggtggatggcgagatgtttctgtttggatagtattctgtgctccaggttgaatatttgtaatgcttcaaaaaaaaaaaaaacaacacatcggcaatgtggagcaatgaagagatttgctccacattttacgtcgtcatttagaggtgtggtggcatgcaatgtgatgctgttgttgcaggaaaaaagaaaaaaaaaaaaaaaaa

SEQ ID NO: 1757 - DNA, 1492 bp, Zea mays
gggaccctcgccgccggccctcgaagggagcaaggaaaccctaggccgctacgcccttggccccttctctctcttcgtcgcgccgccgtagcacgactccgactcggccatggcgacacccccagctctcctattcccttcgccctcttcggcatcttctccgccgtcatccgcgcaggtagaggcggtggtcctcttcaacgtctgcgacagctacgtgcggcgaccggaccaggcagaccgtgtcatcggcaccctccttggatccctcctccccgatggcaccgtccacgtccgcaactcctacgtggtcccccacagcgagtcggccgaccaggtcgccatcgacatcgactaccaccataacatgtacgcctcgcaccagaaggtgaaccccaaggaagtcatcgtcggatggttctcgactggatttggtgtttctgggggaagtacgcttatccatgagttctattcaagggaagtacaaagccccatccatcttacagtcgacaccggcttcactaggggggaagcttccatcaaagcctacgtctcatccaacctgtccctcggtgataggcaactcgctgcgcaatttcaggaaatccctctggatcttaggatgatcggggcagaaaaggctggatttgagatcctgaaatctacgatggtagagaagctccccaatgatctggaaggaatggagtcctcaatggagaagctttacattcttattgatgagatctacaaatacgtcgatgatgttgtggaaggacgcgtggcacctgataacagaatcggaaggttggtctctgaatctgttgcttcaatgccgaaattgtccccagctgctttcgataagcttttcaatgacaagattcaggataaccttgcgctggtatacctgtcaagcatcacaaggacacaaatcagcatcgccgagaagttgaacactgctgctcaggcgctgtgactttggttgtggcagatctatctggttgaaacgtggatgtttggcctacgtgaccaattggtgacagggatgcattttttgttatttgttattaaaaaatgggagagctggcaggaaagaaaagggttagtcaatgatgggatcccggtagagtggtggatgtttctgtttggatagcattatgtgctccaggctgaatatttgtaatgctccttggttgtgtagcgacacagttaacgacatggcaggcaaccgaggtcgtctgggtacatcgcaaataggctggtgccgaggtgacctcgacaggagtcgcagcaggctggcactaatgatgcgaataaagcaatacctcccaacacgttaaaacggggtccaaaattcaccatgattatgaagaagctgtacagctgatggaaacgtaggctcattgcaaatcaataaaatgtactccgtctcaaattaaaattttatttgtatttctagtggatttatttatacaataattaatgtatgttctat

SEQ ID NO: 1758 - DNA, 1900 bp, Zea mays
ctccacgaactcactcgttcgttcgcattgggttacttgctgatgattggcgctgatgcaggtcgccatcgacatcgactaccaccataacatgtacgcctcgcaccagaaggtgaaccccaaggaggtcatcgtcggatggtgagcaaccatcccctgggctcacaattctacatccatagcgcgaaactaggcattttaggcagactccgattatatgcaatagctgaatccccaatgcagagtaactttgttttggggctgtattagttttagtggatgcagtcattttttttgcatcaaatgcaccacacgtcttgttgctagaatacgagtttgacattacatgcctgattgcagctacagttattgtctttttttattgcattgtggacagaatcagaatagttccttctttgtgcttcacaataattgatgggctcagagtttaacattacatgcctgattgcagttacagttagttccttctttgtgcttcacaataattgatgggctcagagctatatttcgtgtctgttggtttgatatcatcgaaagaacattcccaagcactagaaaagtcacttcgaaaagtctgtgaattaatttaccaagtatccttaatgaactttttgaacctgtttgatacatatctactgtctgtttgtaggttctcgactggatttggtgtttctggggggagtacgctcatccatagcgtggtcgcggccgaggtacaaaaccccatccatcttacagtcgacactggcttcactaggggggaggcttccatcaaagcctacatctcatccaatctgtccctcagagatagtcaactcgctgcacaatttcaggaaatccctctggatctgaagatgattgaggcggaaaaggctggatgtatgttaccggtgaatagcagatatataccttctatctgggggagatctcattttgcacctgtattagttggtccttctgttactgtgttgaacttctcaggaatagtcacatcagtagttggatttagtaataatgtctctgtttctatttctgtttctgtattaatttctcgtagacaactgatgtttgtaagaaccatattttgctctgctacatcctcagttttagtagcagaacattttgaagcttccatcactcttactaccttctgttacagttgagatcctgaaatctactatggtagagaagctccccaatgatctggaaggaatggagtcatcgatggggaagctttacattcttatcgatgagatctacaaatacgtcgatgatgttgtggaaggacgcgtggcacccgacaacagaattggaaggttcatctctgattcttttgcttcggtgccgaaattgtccccggctgcttgacaagattcaggataaccttgcgctggtatacctgtcaagcatcacaaggacacaaatcagcatcgccgagaagttgaacactgctgctcaagtgctgtaggtttggcggtgtggcatctggtttggacgtggatggcttgatgctatctgtgatgcttggcgtaagtgtgattggtgacagaaatgcatttttgtactcattattattattgctaaatgagagacctgatggaaagggttagccaacgatgagatcccataatgttgccagaatgccagtagagtggtggatggcgagatgtttctgtttggatagtattctgtgctccaggttgaatatttgtaatgctcgttggttttgtgtagcgacacatcggcaatgtggagcaatgaagagatttgctccacattttacgtcgtcatttagaggtgtggtggcatgcaatgtgatgctgttgttgcaggaaaatcggtttcgctgtcctgttatagcaaaaaaaaaaaaaaaagg

SEQ ID NO: 1759 - DNA, 2929 bp, Zea mays
  misc_feature (2449)..(2449): n is a, c, g, or t
ctggccgggacttttccgcgccgccggttcgtgccaaaaccctactccctagaaaatgcagcggcgcctaagctgaaatcagtgaatcgtgcgccgcggcgaagagagaactcgaactcggcaggacttgtgcgggaggaggaggggagcgggggtcagagagggagatagagatcatcaggtttgccatgtcctccagggctggcggcggcaagccgttgtggtctgcctccaccatcgtcgccaaagtcgcgagtgggtaccacatcctcaggatcgatggctactccaggaccatggagacccccacaggagagtccatcgcgtccctcccgttctcggtgggcggccgttgctggcgcattcgctactaccccaacggcgacaagttggagaataaagaatacatctcgctttatctttatctccacgacagaagcgtcgaggcagagaaggcgcagttaatgttccgtttcgtcggtgacgtagcggagcagccgttgattctgggaagactgcataccttcgaaaagcaaggttgggggtacgccaagttcatcaaaaggaaagatttggaagagtcgaagcatctcgtggacgattctttttccatcaggtgcgatgtggccgtgcgcttcaacgatgtccgcgtggagaaggcgccggaagccgctgctgcagcatctatgatttccgtgcaaccatctgacctgcaccagcacctcggcagtctcctgctgacccagaagggcgccgatgtggtgttcgacgtcgccggtgagacgttcgccgcgcaccggtgcgtgctcgcagcccgctctcctgtcttcactgcagagctctttggtgcgatgaaagagggccacaccggaggcgtggtgcgcatagaggacatggaacctcgggcgttcaaggcattgctctacttcctttacaccgatttactattcccaaagacaatggcaacgacgatgaatcaagctgaagacggagacgtaggcgacgacgatgaagacgttctgtgtcagcacctactggtcgctgcagacaaatacaacttggagaggctgaaatcgctatgtgaaaagaagctgtctgagtgcatccatgtgggcacggtagcaatcatcctgacgctagctgagcaacaccgctgccctggactgaagaaggtgtgcctccattttctcagatctcctgcaaatttgagggcagtcgcctccagcgacgcctttaagcatctgagcagcagctgcccctctgttatggtggagttggttgccatgcttggcaactcagcgtagaccttcatctaagcaggaaactgcacttggtgtttttttctggatcgacttgtattatcaagcggtcttggaaaaatgctactagttcatagtttccacttccagtagctatgcatcctaagtttcaaggtagattctgaagtagttgaatccgttggcgcttttggtacaccatttcgcagcggatgattttggtatctggtagctagctttgaatgtctgccagaagcccagaagtccatctatgtccttaacatacaattctcagacgttggaaacttggaatgcaatgcagttcttgttattgttattaagttgtagaattcgtttacttctagttctctagccgtcaatctagatgcatatataaaaaaaaaaaaaaaaaaaactcgagtgtcttctcggcatcacgttggagttggttgttttgtggttgcctatggagatggacatctacactagctttgctgcaacatcttcgcttttatttggatgcacatttctgattgtaacactgagcatgcttgctgctgtgaaactgagatgtattttgatcgaaacaaagtcaaaccatatgcattggccatgttaaaaacatatcttgatgtggagaatgacgattccgatcaatctcaaagccagattattcccttgtcaaacgatgtgatctcttattatcgtatgtactgttgatggtgaagataatctaaatgttaggaatgactcggtccgataaccgagttggaatctatctcgtttcctccttccgttagattcgcgtcggctggggcgcaaactgttttctggttgtgtctcaagaagtcatattaataagcgccattgcattctgccttcgctaaacctttggccgccatagctcagaaatgacttgagcctctgtttgattcgctgtttaatttgtcatactttatctaacttttttcttccttaagattgagttcttcagttcaaactactaatcttagacgaagtgtgtcatagttagccataaactcttttgcattactctagtgactggattaaccctaatggcctccgtcgatcccaatgcccctttagcaccatgcaacgatggggccgagggagacgaacaaaggcagcgccaccacctaacgtcgtcactntattagccaacgtcgccggcctcaacattggaccaaaaggtatattggcaagttcctctctcccaatctctctaatgctagatctatgagtatcagttcgttattgagtcgctccatgtctctaatgctagacctatgggtatcaattcattatcgagtcactggattgaaatggggagtggggacttagctattgtttggttcacatatttgtaacgtaaatggaaactgataactttaaaccatgttcggttaaatttaaccataattagataccacaccataaattgatatcattatatttaaacttgttaccgttagtaatcgagtgtgaatcattaccgttactatttatgttacattttgtgtatcaaatggcaccttagtggtactgtcttgctgtaacttgtaagcgcagtaaatttagaaagattctaagggtgtgtttggttgagaagtgggacagaatagagtggcccc

SEQ ID NO: 1760 - DNA, 4290 bp, Zea mays
  misc_feature (2274)..(2274): n is a, c, g, or t
  misc_feature (2805)..(2805): n is a, c, g, or t
  misc_feature (2909)..(2909): n is a, c, g, or t
  misc_feature (3514)..(3514): n is a, c, g, or t
atcagagacaaattcggtatttatctatataatcctaattagggttacttgacattctcagtcaatcatggggatagtagaatcgtgggtgtagtgtatgatgtagctgacgcggcagcggttttgatcggacacaaaatgacgtagaaaattagatacaaccagtggacatgccgattcaaatgaccggaatttttttgtctgtaggccgaaatagaggcctgccatagtattctatattctatagtatgtatactcgcaaggctgtactttggtgttttttcgttcggtaaaaaaaaaagactaaatgagactaaatactagtcactctaatcaaacagaccatctggacgaaacagaggacgtggtgagcctgatcgacgtggcccatatttcggcccaataatacaaactgggttgtgtttttgggaactctgtaaatcgggctagaaaaaaggagcccaacaccggcgacgacccatggccagctcctttttcgttttgccttccctttccagtttccgcgccgcctgcgccgcccagccggcactccaaacccgactccaaaatgcagggagggattgtcatggctggcggcggcaagccgtcgtggtctgcctcgcccatcgtcgccactgtcgcgagtgggtaccacatcctcaggatcgatggctactcccacaccatggggacccccacaggagagtacatcgcgtccctcccgttcaccgtgggcggccatcgctggcacattcgctactaccccaacgggaggagctcggagaccaaagagtacgtctcgctttctctctatctccacgactgggtcgctgagacagtgaaggcgcggttcaagttccgtttcgtcggtgacgtggcggagcagccgttgatactgggaggactgcatagctttgataatattgacaacaattgggggcgccccgagttcatcaaaaggaaagatttggaagagtcgaagcatctcctagacgattctttttccattcggtgcgatgtggtcgtgcccaccaacgaagtccgcgtggtagccactgctgcggctgctatggtttccgtgcccccatctgacctgcaccagcatctcggcattctcctgctgaccgagaagggcgccgatgtggtgttcgacgtcgccggtgagacgttcgccgcacaccggtgcgtgctcgcagcccgttcgcctgtcttcagtgcagatctctttggtgcgatggaagaggggggccacaccggaggcgtggtgcgcatagaggacatggaacctctggtgttcaaggcattgctctacttcctttacaccgacttgttagagacagagacgatgaaacaaggtgaagacggagacgatgaagacgttttgtgtcagcacctactggtcgctgcggacaaatacaacttggagaggctgaaattgctatgtgaaaagaagctgtgtgagtgcatccatgtgggcacgatagcaaccatcctggcgctcgctgagcaacaccgctgccatgcactgaagaaggtctgcttccattttctcagctctcctgcaaatttgagggcagtcgccgccactgacggctttgagcatctgagcagaagctgcccctctgttatggaggagttggttgtcatgctcagcaacttggtgtagaaaactgcacagtagttgtgcatcctaggagattctcaatcttttggtgcttttgccagttgacttgactgcgtatgtgccgctctccaccaattcgcagcgggtgattttgttagctgctagctttgaatatccacaacaagtccgtctatgtgcttaatgtttaattctcagaagttggaatgcactatagctcttgctttcttattaagtactactctatccaaccacgtgaattagtcgtcgttttagatttatcttaagtcaaactatttaaactttggccaataatatatatatataattgttttaaactacaggaattacatattatgctagtcatgatacttttatgttgtcggttaaagttgatagtgattgaattaggataaatctaagacggctaaatcacaagagatggcaaactaatttaaaattgctgttgtggcggtcaataggtcctacactacatagcgctgcaatatttcgcgaccaaccaaaccaacattatggggctgtttggtattacgcctaaactgccacctcccgctacacttttgctgccgcaattgtggcggccgaattggccgccgcgacttaggcgcggngcctcgcgtcaggaaccaaactggccctatatgcgttaggtgagtcgctgcaaaagcaaacgtagtgcgaacaacatacttcacatgtctagaaagcagcgagttagaaccgtttttttgggtggtgaccattgttaaacacaagctcacaatagcggtcacctagatctacacatacatacataatttgctcctttcctggttccacaaacgtttggcattaaaatgcacgcctctgggctcaaaagccacctccgggtgcaaaatcaaaatcgtctcggggcggcgccaggctaaaataaaatctaggcgaagatgcctctgagcacaaaagccacctctaggtgcaaaaccgtctcagggcggcaccattttaaaataaaatctagacgaagacgcctctagacgcaaaaacagccttcgggtgcaaaaccgtctcagggcggcgccagattaaaataaaatctaggcaaagacgtctccaagcgcaaaagccgcctccaggtgcaaacaatgcctcagggtgccgcnagtataaagtaaaatcttagcaaatgcacacaacactaaattaaattatgacgaagacgcctccacatatgcccacaggcgacccctgattaaaccaaaatacngttcaagacaaccagaggtgcgaagcccttcaagagcacaataaaacaaatcgtggtaacatacacctgtggcgcgggggcacccacgaataaaaggtccatcctaaggccgccacctatcccccgttggtaaaggggagagggcaacatttcatttttatttctgtcgatcggagacaaccgccaacattgctagagtacattattagtacaaacaccattctcagcattgacgatgtcaccattacatattcgccaggacccacaatcaaggactcggggctcctccttcggtataagaccagcctccctatattcacacaacatgatcaagctcccgacctcgctaagtagcccaagggcagactcaacacaatctgaagcacgactaccactaacagcccccgtcaaaactcgacagggacccaaatcaacatcgccaaattcgctggccttaatacacacattctttcctaacattggatcaactaaattgaaatattcctggcgttggccaccaccttgcccccgggtagtccggccagcgccatgccctcgcggaggatgtctttgctcagaggtcccaacgtgagttcgacgcaccncgttcacttcaacaagacccatagatgcctcaggggcctccgacgccacgacatccatcgcgacaaaaaagtctaagtctctgttggatgaaccgtccatttccacaaaaaaacctaagttatcatcatcaatcgatgactacgaaccaaagaaatcgttgccactatcagagttagacagacttcagcaagctaaatgggtaacacataggacatcatccatcaggatttcctccttgaccaaaaggatgttagggttactttgcgcaggccctcggagaggaacctgcgcaaaagcattattccaaacacaacattagcccctacaactgctcaaatcaaaaggactcccatcagaacaaatttacaccttcacagtgtcagcaacattagacgaaggctcggtggcacgacccagcaggtgactcctccgccaatggtgcacatgtagctgtggcagagtcggcttccgtggtatccggcttctcagacctcgcgtcccctggcttctcgcctcacccgccccctcataagcctccttcgcctattactaaaaggttagaaaaaacaataaaataaaccaggcacagagaaccgaacgcctaccttttccagctccaccactgaacgctttcaagaaacttcaccgaatgaaggtgcgcatcggcctccttcaaaaccccttcattgatcctagagacatcaaccttgccacgtgtcatgataaaggagtgcaaaacctcccaccccctagctcccgacgcggaatccctaca

SEQ ID NO: 1761 - DNA, 1714 bp, Zea mays
tcgaggccggccgggatcgccgcctccttcgccgtttcgccttccacttttccgcgccgccggttcgtgccaaaaccctactccctacaaaatgcagcggcgcctaagctgaaatcggtgaatcgtgcgccgcggcgaagagagaactcgaactcggcaggacttgtgcggaataggaggggagcggccgagcgggggtcagagagggagatagagttcatcaggtttgccatgtcctccagggctggcggcggcaagccgttgtggtctgcctccaccatcgtcgccaaagtcgcgagtgggtaccacatcctcaggatcgatggctactccaggaccatggagacccccacaggagagtccatcgcgtccctcccgttctcggtgggcggccgttgctggcgcattcgctactaccccaacggcgacaagttggagaataaagaatacatctcgctttatcttaatctccacgacagaagcgtcgaggcagagaaggcgcagttaatgttccgtttcgtcggtgacgtagcggagcagccgctgattctgggaagactgcataccttcgaaaagcaaggttgggggtacgccaagttcatcaaaaggaaagatttggaagagtcgaagcatctcgtggacgattctttttccatcaggtgcgatgtggccgtgcgcttcaacgatgtccgcgtggagaaggcgccggaagccgctgctgcagcagctatgatttccgtgcaaccatctgacctgcaccagcacctcggcagtctcctgctgacccagaagggcgccgatgtggtgtttgacgtcgccggtgagacgttcgcagcgcaccggtgcgtgctcgcagcccgctctcctgtcttcactgcagagctctttggtgcgatgaaagagggccacaccggaggcgtggtgcgcatagaggacatggaacctcgggcgttcaaggcattgctctacttcctttacaccgatttactattcccaaagacaatggcaacgacgatgaatcaagctgaagacggagacgtaggcggcgacgatgaagacgttctgtgtcagcacctactggtcgctgcagacaaatacaacttggagaggctgaaatcgctatgtgaaaagaagctgtctgagtgcatccatgtgggcacggtagcaatcatcctgacgctagctgagcaacaccgctgccctggactgaagaaggtgtgcctccattttctcagatctcctgcaaatttgagggcagtcgcctccagcgacgcctttaagcatctgagcagcagctgcccctctgttatggtggagttggttgccatgcttggcaactcagcgtagaccttcatctaagcaggaaactgcacttggtgtttttttctggatcgacttgtattatcaagcggtcttggaaaaaatgctactagttcatagtgtccacttccagtagctatgcatcctaagtttcaagtagattctgaagtagttgaatccgttggcgcttttggtacaccatttcgcagcggatgattttggtatctggtagctagctttgaatgtctgccagaagtccgtctatgatgtccttaacatacaattctcagacgttggaaacttggaatgcaatgcagttcttgttatcaaaaaaaaaaaaaaaaaaaaaaaaaaaaaaaaaaaaaaaaacaaaaaaaaaaaaaaaaaagcggcc

SEQ ID NO: 1762 - DNA, 1652 bp, Zea mays
gtcttcaaagagagtttcttgatcagggagacacagtcagtgatttacttaaactcttgatccagtattagtagcttcattgtccagtttctgattcttttatacctatcaaataactcaatactcaacttggtaatggatggtagcagtctagttctgggcttctggctactaatatagatatcccagtttctttgcataaggagatcaatacaaaagaccatctagcagagttgtttggatggtgtacgtagcactcctcggtttctaagtgtgactttctgtgggaagcaaattttaggccagggttaaaaaaatcctcggtctgtccatgccaaatcacaagtttaaagtctggcctaggccataatcattctcatgtgggctacagtaccctcgttcccgctttgtggtgggttcacgggttcagtggttttttcggtttgtgtgataactgataagttatctttaatgcaatactcaaggactgtcttacccccaacaggtcgagtttattttaggagatcaatcaatagcctccataccggtattgcttgctactatttagctaattgataggttgaaaaatctttcatcaaaccgtgtcagtgaaagaatattgcaatggcaattgccaactcagttactcactactcagtaacaaatagggctccttccaaacacatgccctacctttctaatacaggcagtggtagcgctagatttagcaatcagcgtgtaatagcatgtttgggttcagatatactgtttgtgaaataagcttttgaacagatgttttggacatcttgatacctaaatcttatatgtggaaaattcataatcatatactgaagggggtttcccccctacatctgttgtttccccccattctgcttgctagccaggggacatatacaaaaacacgactttatgaaacacgcctgtgtgaccattttctattgatattaagacatttctttgtgctgccatttgtccctgtattgttattctattaagttgtgttatcttctgaacacctggtcatggttgacaggtgctcggtctgcctagcagaatacgaaccggacgagaggcttcagaagatacctccctgtgggcataccttccacatcaactgcatcgaccactggctctccacaaacaccacctgccccctctgccgagtatcgctccttcccgcccccaaggcaaccagcaccggactggatctggaagcacagactgcggtagaagaggagtctccgaacgcacatcatcgccaggagggactcgttgatgccaacacaccacaggaaggtgaggcggccggaggtgacggagcaagtagcgtgcaggttgaagaaccgcacggcgacgcgcccgagccattggcggtgacggtggtcgctgtcgctgcgcctcaggctgacgctgaaggttcaccgagtacagcatgccaaactgttaaagggaagaaataaggatagcctagcccatcgatgtatttctattaccaatgtgtgtttagctgggaaaggaaaaaaacgcataaagatggggccattgatgttatgattgccatttttctggggaggaagaagaagaggcaagagttcagttgtggggaaatcttattgatacagcacttaacc

SEQ ID NO: 1763 - DNA, 850 bp, Zea mays
ccggccgggttcttacgttcgtcttgcttctcttcttctacctcttctacttgaggcggcgcagggccaattggcagtccttgcggatgaggacaaataatttgatacgaggagataatgccagactggagtgtggcttaaagaaggagatgcgggaaatgttgccagttgttatcttcaaagagagtttcttgatcagggagacacagtgctcggtctgcctagcagaatacgaaccggacgagaggcttcagaagatacctccctgtgggcataccttccacatcaactgtatcgaccactggctctccacaaacaccacctgccccctctgccgagtatcgctccttcccgcccccaaggcaaccagcaccggactggatctggaagcacagactgcggtagaagaggagtctccgaacgcacatcatcgccaggaggagggactcgttgatgccaacacaccacaggaaggtgaggcggccggaggtgacggatcaagtagcgtccaggttgaagaactgcacggcgatgcggccgagccattggcggtgacggtggtcgctgtcgctgcgcctcaggctgacgctgaaggttcaccgagtacagcatgccaaactgttaaagggaagaaataaggatagcctagcccatcgatgtatttctattaccattgtgtgtttagctgggaaaggaaaaaaacgcataaagatggggccattgatgttatgattgccatttttctggggaggaagaagaagagcaagagttcagttgtggggaaatcttattgatacagcacttaacataaccgagattagtagtacttgtgagctgtttttcatctggt

SEQ ID NO: 1764 - DNA, 1802 bp, Zea mays
ctctcgctacctcgagcccggccgggacttctcgtcccaactcccaagttgcaacccagccacctcgtctcctcccctccaactccaagcctactcccacccgatcccccctgccccgcccccggcgccgccggttctcgcattcgcggcagtccatctcgctgccccttcccggcggcctctgatccgtgctgctcgtcgcccacgcgaaacctgccgcctcccttgttgccgcgaccgcgagccctcttccctcccctcgcggccctgatctcagttccactgtgccccgaccgtgatccgtccgcacccgcttcatgcccagcagcgttcaatccgtcccctaatgccgctgcctccaaatagttctccgtgtgctggttcttgcggattgcgctgtcaggtccacataatattggggacggtgcagagtgtcctccgttttttcctctctcgcacctaaagttttcgggagcagttagttagagtatattcgattccccctgatatagtttgtttatttcacactacgaagtctatgcactcgagagaaaaatcactggtagcgacggcatcaattcttgtgacgtttagtggctagaacaccctcactagcgctcattcatgtttacccgaccttgtccttttcccttccgccttccgtgtgctggtatcaatttgttgtaatttggggaggccaggagttttctcgccttcttgcccttgttctgcccgtagtaagtgcttgccgtttggttgattggaactcccaagtgttcgtcggtcacatttatatagctttacctcactaggataatcataagcaaggtttccccaaaattcttagaccagttgggatcaggacccgaaggtagattgtgttggctatttgccggtagggcattgtgactccgtgatgtcttgcacctctccagatccaccagactactgctcagccgaatcgcctgagctcaagctgtaccaggccttcatcttctcggtgcctgtcttcttcacattcgtcttgcttctcttcttctacctcttctacttgaggcggcgcagggccaattggcagtccttgcggatgaggacaaataatttgatacgaggagataatgccagactggagtgtggcttaaagaaggagatgcgggaaatgttgccagttgttatcttcaaagagagtttcttgatcagggagacacagtgctcggtctgcctagcagaatacgaaccggacgagaggcttcagaagatacctccctgtgggcataccttccacatcaactgcatcgaccactggctctccacaaacaccacctgccccctctgccgagtatcgctccttcccgcccccaaggcaaccagcaccggactggatctggaagcacagactgtggtagaagaggagtccccgaacgcacatcatcgccaggaggagggactagttgatgccaacacaccacaggaaggtgaggcggccggaggtgacggagcaagtagcgtccagattgaagaaccgcaccgcgatgcggccgagccactggtggtgacggtggtcgctgtcgctgcacctcaggctgacgctgaaggttcaccgagtacagcatgccaaactgttaaagggaagaaataaggatagcctagcccatcgatgtatttctattaccaatgtgtgtttagctgggaaaggaaaaaaacgcataaagatggggccattgatgttatgattgccatttttctggggaggaagaagaagagcaggagttcagttgtggggaaatcttattgatacagcc

SEQ ID NO: 1765 - DNA, 2068 bp, Zea mays
  misc_feature (1482)..(1482): n is a, c, g, or t
  misc_feature (1548)..(1548): n is a, c, g, or t
caacagattatctatctagtttgactagttaggtggctagccaaatttgactagtgagagagccaatttagagagtcggataacttagcgagtcagatagctagtctgttggagagttattttgttgttgaatagctaaaatttggctcggtcgcgtaagagcatcacgtccatccggccggcctatcaaatctgcaaatagctaccatggcagagatcgatcaatcacgtttcatgcatgcaagatggggatgatggaagagtgctgcgttgtccatgcatggctttgcctaactctccaccacgcttgtccggccggcgcacgcctaacacgtttcgaacgtgcgtgcgcggccacgcggtgtcgatacattccggcactcgtcgcctcgccgcaaccgcaagcctgcctatatatgctcgatctgcgccgccccgacggcgccagacggataaacagatgtcagctgcagtgaacaagtcgtcggccgggacgaagaagtcccggaagccgtacgtggtgagcaggccgcgggagaggtggaccgccgacgagcacggccgcttcctccacgcgctgctgctgttcggccgcgactggaagagggtccaggcgttcgtcgccaccaagacgggcacgcagatacgcagccacgcccagaagcactttctcagagcggacaagaagctgggcctcgccgtgccgccgccgcaccctcgccgctctgccgccgactatggtggtgccctggcgccggacgtcgagacggttcagctcccgttgtctcaggacgacctgcgcttcgctcaggtgtacaggttcgtcggcgacgtcttcggctgtggcgcgatgtggccggtcgaggcgcagctgcagaggctgctgggcgcggaccctgtagtcgtggacaccatcctacgggtgctggccaacctccaagacaaaacttccctccctgtagcttgtaggtcgacaatattttgtagccagttacgttatggcgggattggttttgaatcctgtgattacaaatttcctgctagataaaaaatagggatttttacgtcactagttctcaaagtcgatcggtacgagtaaaccgatctgtgctagacatgtcctcgtctaagggcctatgcaggaacttcatagaaattatgtgcaaattttagaagaatcccaaatatatttaagagcttcgcccccaaatatatatatatatatatatatatatatatatatatatatatatatatatatatatatatatatatatatatatatgagtcctaaaaattaaaatagaatatgatttaaagtgtttacagctacaaaaacatttacagttcatatatttgagtcatatgccattgttattatgaaatagattatattattttaaaaataaaagttaggaatactatattattgtgatatattggtccctggaacggtgatatcctagcctaagtcttaagagnatctccaacaatgtgattaaaaaataccttataatttaaaaacgaggatgatttaaagaatttaangcaccataagaaaaataaactccaacaataaagccaacagtctgttaaattttgtccgcttaatctcaattcgcgccattcttctcatattcacgcgccgcctttcttttctcccttgcccacgtcgccattttcttctctgtagtagcccccaggaacgaaaggagccaccatccccacgccaacggagggagcgagcgtcaacacgagctgccgccaaggatcgaaaggagaaccagccgcaaggagccctgcctctgccaccattttctcccgcagaccgagtctccaattccccatgttgctgcatgattttttagcaaaacagcgcctgccttctgcggccatgaatcctggcccaagtgatcgtgatgctgccatccgtcaggtaaactggtcagagaaatagcaggcatgttcattgtttcagatttgcatgtaacaacactataatgattgtcttgtagttgattttttttattcgatactcagcaattgattctttatataaacgatgacc

SEQ ID NO: 1766 - DNA, 825 bp, Zea mays
aagacggataaacagatgtcagctgcagtgaacaagtcgtcggccgggacgaagaagtcccggaagccgtacgtggtgagcaggccgcgggagaggtggaccgccgacgagcacggccgcttcctccacgcgctgctgctgttcggccgcgactggaagagggtccaggcgttcgtcgccaccaagacgggcacgcagatacgcagccacgcccagaagcactttctcagagcggacaagaagctgggcctcgccgtgccgccgccggacgtcgagacggttcagctcccgttgtctccggacgacctgcgcttcgctcaggtgtacaggttcgtcggcgacgtcttcggctgtggcgcgatgtggccggtcgaggcgcagctgcagaggctgctgggcgcggaccctgtagtcgtggacaccatcctacgggtgctggccaacctccaagacaacttccctccctgtagcttgtaggtcgacaatattttgtagccagttacgttatggcgggattggttttgaatcctgtgattacaaatttcctgctagataaaaaatagggatttttacgtcactagttctcaaagtcgatcggtacgagtaaaccgatctgtgctagacatgtcctcgtctaagggcctatgcaggaacttcatagaaattatgtgcaaattttagaagaatccaattaatttcataggttctccaacaaatatatatatatatatatatatatatatatatatatatatatatatatatgagtcctaaaaattaaaatagaatatatttaaagtgtttcagctaaaaaaaaaaaaaaaa

SEQ ID NO: 1767 - DNA, 1718 bp, Zea mays
gcacgggaccggtcccttctgctccctcgctgaaaatttccggtgctgagcgtgcatcggcagagctgactgtgactggtgaactgaaggaaaggggaggagaaggggagggaagctttgggcgggagaggaagcctagcagcaacagtaggcagtagcagggttgaccggaggggcagtggagtctggagagtaacccaacaaccccctcctcccctccccttctgtcttattgccacatctccacgtctccaccaaacaaggcaacaagggagaagtagatctgcatctgcgagagaaggcagcgggggtggtgatgatggagagccagccgctgcaggccccgacggccacggctccggcccccggatctgcggagccagccggagctccgccggccgtcacccccggcaaggagttcacgcgcacctgcaagggcctcgtcgtcgtgctcatcggaggatacgtgctgctccagctcctcccttcgtcactcaactacctcgccatcatcccctccaagacaatcccctatgtatggaccgtctttaccgctggttacatcgagcaagtcctcccaggggccattggcagttctcttggtcttctcttttgtggaaaggacattgaaccagcatggggccgcaaggaattcttgaagttcattattttgatcaactccatctgtggcattcttgcattttgctttgctattggactctactacgtcactggaaaggagagcttccttgtcacaccactttctggtttccacggttgccttgctggctttcttgtggccctgaagcaactcttaccaaaccttgagcttcctatgtgctttttctggaaaataaaggcaaagtggatgccattctttgttgtatgtttctcaagtatcatggccttcatcgtgcctgattccattaacttcctgccaactttggtgtccgggatgtacgttagctggctttacctgagatacttccaaaggaacccactgactggacttaagggtgatcccagtgatgacttctccttccccagtttattcccagctgccatgagaccagttacggaccctgtggccaacctgtttgataggctgttgtgtgcaaggtccaggactttggaagtcgccctcccgatatcagatcctaccaaggcttcaagaagaagggagcgtggcgagagggttcttgaggaaaggttggcggccgacaatgctggtgacacagaggcctcgcctcgtggccatggcaccgcggaagactgagaactttcttgtgaccatcagctcctcttataggagccatggctttgctccctccagcgtttatagctctgcacttttgtcttctggagatggagctattcagttcacagcgaacgaataatacgatgttcttagtttctctttttttccgcttctttgtctgcgaggatttattggttaaattgtgtactagtcaattgttatggtacagcgaaaaagagagaagaggatgatggcattcgcagcgaggtgttgagattccgttgtagccatgcatttgcagccgattgtttggtactggtcaaagttctgtagtagtcataatactctgctcaaaatatagaaagaagaatggcttcgtcagtatcagatgttgagatatatatatttttcttttagtgacgtgatttgagccgacaaaaaaaaaaaaaaaaaagcggcc

SEQ ID NO: 1768 - DNA, 1638 bp, Zea mays
gcacgagcctccctcttctttccggtgccgagcgtgcatcggcagagctgactgtgactggtgaccggagtagagaaggaagcctagcactagcagaaatagtaggcagtagcagggttgaccggaggggcagtggtgacccaacaacctccctcatcccctccccttctttcttattgccaccactccacgtctccaccaaacaaggcaacaagggagaagtagatctgcatctgcgagaggaggcagcgggggtggtgatgatggagagccagccgctgcaggccccgacggccacggctccggcccccggatctgcggagccagccggagctccgccggccgtcacccccggcaaggagttcacgcgcacctgcaagggcctcgtcgtcgtgctcatcggaggatacgtgctgctccagctcctcccttcgtcactcctttgacttgtgtctgcgccttgcaggacaatcccctatgtatggaccgttttcactgctggttacatagagcaagtcctcccaggggccattggcagttctcttggtcttctcttttgtggaaaggacattgaaccagcatggggccgcaaggaattcttgaagttcattattttgatcaactccatctgtggcattcttgcattttgctttgctattggactctactacgtcactggaaaggagagcttccttgtcacaccactttctggtttccacggttgccttgctggctttcttgtggccttgaagcagctcttaccaaaccttgagcttcctatgtgctttttctggaaaataaaggcaaagtggatgccattctttgttgtatgtttctcaagtatcatggccttcatcgtgcctgattccattaacttcctgccaactttggtgtccgggatgtacgttagctggctttacctgaggtacttccaaaggaacccactgactggacttaagggtgatcccagtgatgacttctccttccccagtttattcccagctgccatgagaccagttacagaccctgtggccaacctgtttgataggatgttgtgtgcaaggtccagacctttggaagtagctctcccaatttcagatcctaccaaggcttcaagaagaagggagcgtggtgagagggttcttgaggaaagattggcggccgacaatgctggtgacacagaggcctcgcctcgtggccatggccatggcaccgcggaagactaagaactttctcgcgacccatcagcgcctcttataggagccatggccgcccatggctttgctccctccagcgtttatagctctgcacttttgtcttctggagatggaactattcagttcacagcgaaccaataatatgatgttcttagtttctcttttattttatttttcgcttctttgtccgcgaagatttattggttaaattgtgtactagtagtcaattgttataatacagtgaaaaggagaggagagggtggtggcatttgcagccgattatttgttactggtcaaaattctgtactagtcatatactctactcatatatagaaacaagaatggctttgtcaaaaaaaaaaaaaaaaaaaaaaaaaaccaaaaaaaaggagcaaaaaaaaaaaaaaaaaaaagcggccaa

SEQ ID NO: 1769 - DNA, 1366 bp, Zea mays
ctggccgggaaacaggcaaaagggagaagtagatctgcatctgcgagaggaggcagcgggggtggtgattcacgcgcacctgcaagggcctcgtcgtcgtgctcatcggaggatacgtgctgctccagctcctcccttcgtcactcaactacctcgccatcatcccctccaagacaatcccctatgtatggaccgtctttaccgctggttacatcgagcaagtcctcccaggggccattggcagttctcttggtcttctcttttgtggaaaggacattgaaccagcatggggccgcaaggaattcttgaagttcattattttgatcaactccatctgtggcattcttgcattttgctttgctattggactctactacgtcactggaaaggagagcttccttgtcacaccactttctggtttccacggttgccttgctggctttcttgtggccctgaagcaactcttaccaaaccttgagcttcctatgtgctttttctggaaaataaaggcaaagtggatgccattctttggtgtatgtttctcaagtatcatggccttcatcgtgcctgattccattaacttcctgccaactttggtgtccgggatgtacgttagctggctttacctgagatacttccaaaggaacccactgactggacttaagggtgatcccagtgatgacttctccttccccaggttattcccagctgccatgagaccagttacagaccctgtggccaacctgtttgataggatgttgtgtgcaaggtccagacctttggaagtagctctcccaatttcagatcctaccaaggcttcaagaagaagggagcgtggtgagagggttcttgaggaaagattggcggccgacaatgctggtgacacagaggcctcgcctcgtggccatggccatggcaccgcggaagactaagaactttctcgcgacccatcagcgcctcttataggagccatggccgcccatggctttgctccctccagcgtttatagctctgcacttttgtcttctggagatggagctattcagttcacagcgaaccaataatatgatgttcttagtttctcttttattttatttttcgcttctttgtccgcgaagatttattggttaaattgtgtactagtagtcaattgttatattacagtgaaaaggagaggagagggtggtggcatttgcagccgattatttgttactggtcaaaattctgtactagtcatatactctactcatatatagaaacaagaatggctttgtcagtattaggtgttcagataataatatttttccttttagtgacgtgaaaagagagccgacaatcggtttcacataagaaatttataggtaga

SEQ ID NO: 1770 - DNA, 1422 bp, Zea mays
ctcgaggccggccgggaggcagtatccggccggccgggaggggcagtggtgacccaacaacctccctcatcccctccccttctttcttattgccaccactccacgtctccaccaaacaaggcaacaaagggagaagtagatctgcatctgcgagaggaggcagcgggggtggtgatgatggagagccagccgctgcaggccccgacggccacggctccgccccccggatctgcggagccagccggagctccgccggccgtcacccccggcaaggagttcacgcgcacctgcaagggcctcgtcgtcgtgctcatcggaggatacgtgctgctccagctcctcccttcgtcactcaactacctcgccatcatcccatccaagacaatcccctatgtatggaccgttttcactgctggttacatagagcaagtcctcccaggggccattggcagttctcttggtcttctcttttgtggaaaggacattgaaccagcatggggccgcaaggaattcttgaagttcattattttgatcaactccatctgtggcattcttgcattttgctttgctattggactctactacgtcactggaaaggagagcttccttgtcacaccactttctggtttccacggttgccttgctggctttcttgtggccttgaagcagctcttaccaaaccttgagcttcctatgtgctttttctggaaaataaaggcaaagtggatgccattctttgttgtatgtttctcaagtatcatggccttcatcgtgcctgattccattaacttcctgccaactttggtgtccgggatgtacgttagctggctttacttgagatacttccaaaggaacccactgactggacttaagggtgatcccagtgatgacttctccttccccagtttattcccagctgccatgagaccagttacagaccctgtggccaacctgtttgataggatgctgtgtgcaaggtccaggcctttggaagtagctctcccaatttcagatcctaccaaggcttcaagaagaagggagcgtggtgagagggttcttgaggaaagattggcggccgacaatgctggtgacacagaagcctcgcctcgtggccatggccatggcaccgcggaagactaagaactttctcgcgacccatcagcgcctcttataggagccatggccgcccatggctttgctccttccagcggttatagctctgcacttttgtcttctggagatggaactattcagttcacagcgaaccaatatatgatggtcttaggttctcttttattttatttttcgcttctttgctgcgaagattattggttaattgggactagtagtcaattgttataaacagtgaaaagagaggagagggtgtggcatttgcagccgatatttggtactgggcaaaat

SEQ ID NO: 1771 - DNA, 1325 bp, Zea mays
ctggagaccaaaactgtgttatcgagaaatatctggagtctcagaaacaactcttggtatcgcttttttacgagctgactaattccatctcaatcgttatttccagggagcgtggcgagagggttcttgaggaaaggttggcggccgacaatgctggtgacacagaggcctcgcctcgtggccatggcaccgcggaagactgagaactttcttgtgaccatcagctcctcttttaggagccatggctttgctccctccagcgtttatagctctgcacttttgtcttctggagatggagttattcagttcacagcgaacgaataatacgatgttcttagtttcttttttttttcccgcttctttgtctgcgaggatttattggttaaattgtgtactagtcaattgttatggtacagcgaaaaagagagaagaggatgatggcattcgcagcgaggtgttgagattccgttgtagccatgcatttgcagccgattgtttggtactggtcaaagttctgtagtagtcataatactctgctcaaaatatagaaagaagaatggcttcgtcaatatcagatgttgagatatatatttcttttcttttagtgacgtgatttaagccgacaaccggtttcacataagataagaaatcgatgccttgaatttatgaggtataatcaagagtgagtaaatgttgttgcgaacaaactgtttcctgttttatctgacaataagaactctgatttgcagcgggggcctagaggtgccgcccgcgggcgagcccctgttgcctttgattagtagagaacgacgatgtaatctagttctaagagtatgcacaacatcatttaatatatgatctattaagggatctttaaaaaggttaaactagaaaaatacaagagccaaacagtctccacattactctctatatgtctccacagtactctctatatattgtttcttaacaatatttacattgtgactaatttcaaaaacatttaaatgtatcatgcagtctctcaagttgttcatatataaaatatcgatctagtgactcaggaacatacctataccttaattgtatgatgataacactctcatattgtatatgaaagggaaatagccttacacctttttcctaatttattttgtggttgaattgtccaacacaaataattggactaactagtttgctctagactataagttttacaggtgccaaagattcacaacaaaccaataaaaagaccaaaaagagttcaaagtgaaagagcaaaagaataccgaagtgtgccctggtctggcgcaccggacagtgtccgg

SEQ ID NO: 1772 - DNA, 2264 bp, Zea mays
cccacgcgtccggcggggtcccctccttcctcggggtcttgccggccacgagggctgatcttcaggacggcctgttcttggttcggttcctgagagcgattgatagcgccagacggagtttcttctttaggagtcgtgcactatgggtaattgctggtttaaggggaatccatactttaacagggtttcttccaatgcaaccaaagcagaatctcccaaaattcagagcccctcggagagaactgaaaaggaggattgccagctaccatccaacccgaaagaggtggaggcgctgagaaaggatacagctcgcaatcctttgatagcgttcacatttgaggagctcaagagaatgacaaaaaatttcaggcaagattcgttactaggcggtggtggatttggcagagtctacaaaggttttatcaccaaggatctccgcgaagggttagagatagaagagcccacaagagttgccgttaaggtccatgatggtgacaatagcttccagggccatagggagtggctggctgaggttatatttcttggacagctctctcacccgaatttagtgaagttgatcggctattgttgtgaagatgaccacagggtccttgtttacgagttcatgcctctaggaagtgtggagtctcatttgttttcaagggttatggtgccacttacgtggtcgatcagaatgaaaattgcgctcggtgctgcgaaaggacttgcttttctgcatgaagctgagaagcccgtcatctatcgggacttcaagacatcaaatatattactagatgaggaatataatgcaaaactatctgactttgggcttgcaaaagatggaccagttggcgataagtcccatgtttcaactcgtattatgggtacctacggttatgctgcaccagagtacattatgacagggcatctaacggcgatgagtgatgtctacagctatggtgttgtactactggagctcctcacgggccggaagtcactggacaagtcccggccagtcagggagcagatgctggcagactgggcactcccgttgttggcacagaagaagaaggtgcttggtatagtagacccaaggcttgccgaggactacccggtgaaggcagtgcagaagacggcgatgctggcgtaccattgcctcagccgcaacccaaaggctaggccgctgatgcgcgacatcgtcgcgactttggagcctcttcaacagctggaggagacccctggagacagcgtggcagtgacacttgaagggacttgaagcagtgttccattcacagctcacatcacagtcacacacagctctggaaaacacgggtgccacgtacttaactatgcatgataagtagctagctagtgttcttgatatgcaggatgatttcttgattgtttaattaatccatggagacagtagctttgttcagcagaaagttggtgtgtatctcagtaggacggttcatgtgtgaactccctggcatttcgggtgcgggcaagtctgtgcgatctgtatttgcaatgcttgttgcccgcagaggaagcttgcttaccagtgtttgtaacctagtactgtgcagttcatgatctatgcatgttgaataatgtgtgtgtatatatatatataacaggtataacgggagcactgagcttccaatagttaaagaaagcctaagccgaccaaccctgcaacctggttcaacccaacacgtcgactcaaccaggctgtcgggtacgtcacccgcgcgcaaaaaaagaatgcatgtatgagtcaaacacgttctcttgcatgcgcgtaaatttaggaaagatatgcatggtggtttctatttttaaatgttttatttcttccataaatttagaatcgctgcaacagccatgcaactagactcataaggatcattttatgatatatactgatactaaatatactacactgtgtaaataattatgcaattcggtatattgcgtaaaaatctgttaccagctgcatgcgcacgaatttatgatggaaagaatatgcaatgaaaggaaatgaattgcatgcataaaaacaaaaaaatcgtatttaatattttatttttttcataaatataggatccctccaacaacatgcagctaaacactcgaacgccatgctgctgcccgtctccatcaatggccaccgtcttgtggccctcgtcgactccggctccaccaccaacttcatgtcggtgggtctgatgagccgcctgcaggaagatctactagagtcg

SEQ ID NO: 1773 - DNA, 1881 bp, Zea mays
acaaaagagaaatgacccgtttcgagccaaggcatcctcgcgtctcgctctcacccctcctcggcgcctccccgaccacagtgtaaagcccctgtcccttcctccccgactcgcccctcatggcgaggaggcgctgctgatgcctcgcggcgtcggatcggacgcggcggccacgacacctagccgcttgcggtggcgctcgcctacgcgcccaatccgccgacgctgctcctcggatcccccgagagattcaggccccgtctcgcctcgtcctgcctagtgcctaggtgaggctctggcctccaaaggtgcgtgggtgggatctgctgcctcggtttgcgttattcccaagtgccctgcccatactccaacagcggtccagtcgacttccccaagtgctcgacccctacaaggcagcgcgcgtgcgtcacctcaaccccttgcatgcgctggcgctaaccctatctaggagacggagcggcgggccagcggctactcgggcaaagagaggacgagagcgtgcaagaagagaaggcccgtgtcaggcggcggctatagcctttcagttgaggattaaagtggaggtttaagaagcttgagaattggcatcatctcaagaatacattgaagtgcaagatgccaaaaataaagagtctatctaatgcatgccgagtatcattttctccagaaggtcccatatctgaagaggcgcttgagagagtccgtgcactgttagatatgataagacctctagatgtcggcctagataatgaagcccaaattgcacgcaattggagtagttctacgcgtccatcaaatgggagacgaggacgcaatggggctaaccagttcgcggctccaatcaaatatttgcacattcatgaatgtgaaagcttctctatgggtatattttgtatgccaccttcttcagttatcccacttcataatcatcctggaatgactgtacttagcaagcttctttatggacgtctgcatgctgaatcttatgactgggttgacatacctgatcatccaattgatcaattacaaacaaggccagccaagcttgttaaagattgtgaaatgactgctccagagacaactattctttaccctaatgcaggtggtaacatccacactttcagagccattacaccttgtgctctctttgacgttctttctccaccatactccgctgaggatgggcgacactgttcatacttccgaaagtctcagatgaatcagccacctgttgttttgcctgctgagatagatagctctcaggtagtttggttggaggagttggaggaccatcagcccccagaaggctttgttgttgcaagaggtctgtataaaggccctgtaattaggagataatttgctttggagcgcagaatcaaccaagctgcaaatcagctgaaagacgatgcaggcttgtagtgcctagtgcaagcatcgtcaggtcatgtgcagcctacggtttatttgtacatctcaaagtgatctttgataatttaacagcagttttacagaacaggaacggatgttttttgtttggctgccattttaactgtctcactgctggagtatctctgacctagttatggagctcttatcagatcaagcccatggagaacatacttttgatgtaccagcatagctattgtcatgatgtaccagggaagatcaagacaagtgtttccatttggtgatttcagaaagaatttggtgtggggctaccattttgtctgtaatagcagcattactattttggagcaagactgtaaattacgggggaggaaataatatcattagatttatcatgaaatatattttcatgatatatctatttagccaaaaaaaaaaaaaaaaaaaaaaaaa

SEQ ID NO: 1774 - DNA, 1522 bp, Zea mays
  misc_feature (1506)..(1506): n is a, c, g, or t
tgtcttagttccagggcatcctagctcgcgcgtctctcacggtacctgctcctcggcgcctccccaaccaagcctccgcatcttcctctcgacgcgcccctcatggcgaggaggcgctgctgatgcctcccggcgtcggatcggacgcggcggccacgacacctagccgcttgcggtggtgctcgccgagctctacgcgcctaatccgccgacgctgctcctcggatcctccccgagagattcaggcctcgtctcgtctcgtcctgcctagcggttcactcgacttccccaagtgcccgacccctacaaggtagcgcgcgtgcgtcgcctcaaccccttgcatgcgctgacgctaaccctatctaggagacggagtggcgcgccagcggccacgccggcgaggagaggacgacagcgtgcaagaagagaaggcccgtgtcaggcgcagctataggtggcaggtgcaaagataggcaacaagtgtccaacaacacgactgtggatcaattgacctgcatttcagcctttcagttgaggattaaagtggagctttaagaagcttgaaaattgacattatctcaataatacattgaagtgcaagatgccaaaaataaagaatctctctaatgcatgcaaagtatcattttctccggaaggtcccatatctgaagaggtgcttgagagagtccgtgcactgttagatgagataagacctctagatgttggcctagataatgaagcacaaattgcacgcaattggagtagtactacgcgtccatcaaatgggagacgaggacgtaatggggctaaccagttcactgctccaatcaaatatttgcacattcatgaatgtgaaagtttctctatgggtatattttgtatgccaccttcttcagttattccacttcataatcatcctggaatgactgtacttagcaagcttctttatggaagactgcatgctgagtcttatgactgggttgatgtacctgatcatcccattgatcaattgcaaccaaggccagccaagcttgttaaagattgtgaaatgacggctccagagacaactattctataccctaatgcaggtggtaacatccacacattcagagccatcacaccttgtgctctcttcgacgtcctttctccgccatactccgctgaggatgggcggcactgttcatacttccgcaagtctcaaatgaatcaaccatctgttgttttgcctgctgagatagatagcacacaagtagtttggttggaggagttggaggaccatcagcccccagaaggctttgttgttgcgagaggtatgtataaaggccctgtaattaggagataatttgctttggggcacagaatccaccaaactgcaaatcagctgaaagacgatgcaggcttgtagtgtctattgcaagcatcctcaggtcatgtgcagcctacggtttactttgtacaatgtcaaagtgacctgtgataattcaacaccagttttccaggcccagncgttataaggaggaaa

SEQ ID NO: 1775 - DNA, 5220 bp, Zea mays
ggcccacgcgtccgcccacgcgtccgcccgtttcgagccagggcatcctcgcgtctcgctctcacccctcctcggcgcctccccgaccacagtgtaaagcccctgtcccttcctcccccccgactcgcccctcatggcgaggaggcgctgctgatgcctcgcggcgtcggatcggacgcggcggccacgacacctagccgcttgcggtggcgctcgcctacgcgcccaatccgccgacgctgctcctcggaccccccgagagattcaggccccgtctcgcctcgtcctgcctagtgcctaggtgaggctctggccttcaaaggtgcgtgggtgggatttgctgcctcggtttgcgttattcccaagtgccctgcccatactccaacagcggtccagtcgacttccccaagtgctcgacccctacaaggcagcgcgcgtgcgtcgcctcaaccccttgcatgcgctggcgctaaccctatctaggagaccgagcggcgggccagcggctacgcgggcaaagagagggccagagcgtgcaagaagagaaggcccgtgtcaggcggcggctatagtgtatttaatcttcatccatgttaatatgaagtctgcatttgttatactattctcaaactactccatccgttccaaattgtgcaaggataggcaacaagtgttcaaaaacacgtctgtggatcaattgacttgtatttcagcctttcagttgaggattaaagtggaggtttaagaagcttgagaattggcatcatctcaagaatacattggggtcctcgaggccggccataaagagtctatctaatgcatgccgagtatcattttctccagaaggtcccatatctgaagaggcgcttgagagagtccgtgcactgttagatatgataagacctctagatgtcggcctagataatgaagcccaaattgcacgcaattggagtagttctacgcgtccatcaaatgggagacgaggacgcaatggggctaaccagttcgcggctccaatcaaatatttgcacattcatgaatgtgaaagcttctctatgggtatattttgtatgccaccttcttcagttatcccacttcataatcatcctggaatgactgtacttagcaagcttctttatggacgtctgcatgctgaatcttatgactgggttgacatacctgatcatccaattgatcaattacaaacaaggccagccaagcttgttaaagattgtgaaatgactgctccagagacaactattctttaccctaatgcaggtggtaacatccacactttcagagccattacaccttgtgctctctttgacgttctttctccaccatactccgctgaggatgggcgacactgttcatacttccgaaaatctcagatgaatcagccacctgttgttttgcctgctgagatagatagctctcaggtagtttggttggaggagttggaggaccatcagcccccagaaggctttgttgttgcaagaggtctgtataaaggccctgtaattaggagataatttgctttggagcgcagaatcaaccaagctgcaaatcagctgaaagacgatgcaggcttgtagtgcctagtgcaagcatcgtcaggtcatgtgcagcctacggtttatttgtacatctcaaagtgatctttgataatttaacagcagttttacagaacaggaacggatgttttttgtttggctgccattttaactgtgtcccactgctggagtatctctgacctagttatggagctcttatcagatcaagaccatggagaacatacttttgatgtaccagcatagctattgtcatgatgtaccagggaagatcaagacaagtgtttccatttggtgatttcagaaagaatttggtgtggggctaccattttgtctgtgtaatagcagcattactattttggagcaagactgtaaattacgggagaggaactataataatatcattaggtttatcatgaaatatattttcatggtgtatctatttaggccttgtttggaaggagatctttttctgcatcaaaaaaaaaaaaaaaaaaataggccgttaaagtttggtggtgacctagattgctgttagtctggtggggacctagaaatgaaagcgagtacagaagtccctcgctgccttagcgaatcctggtgttgtgataagtcgcgcggtaaagtcctttttcatctcagaaaccatatattttttttttttttttggaaaacataagggtacttaggtttttttattcaactaatcttgaggaacgaaatgtgaggactacattaagtgtccaaaccaaaccatgcatcatctgatctagctaagataaaactatcctgatctagctaagataaaactctccttgatctagctaagataaaactctccttgatctagcctgggtcgctatgagcaggtggcctgaacggtgagcgcgccggattggcaccctgcgccggcaaacgcggccgtgtacttgaccgtgcacgactccctgccgacgcacgcgtccgtgaacgccttgagcgcggccttggactcgcagcctcccttgtaggcgccgcagctgcccctggcgacgccgaagctggccacgtcgacgctggcgacgacgcggccgtggccgccgcatgacagcgtgacgtcgtcgccgagctcgacggccgccacgcacacggggcccacggcgacggtgtggaacgcggcgcgtgtcgggtcgccgccggcctcctcgaagaggatgagcgtgttgggctcgccggcgcggaggaaggagcgcggcacgtggtagaagcgctgcgctggctcgccgcaacccgtgaggcagcggatgccatcgccctccgctatgaactttccccggtagtcgcagacgtggcaaccgggcatctccgccgcggtgtaggacggccagtagcgtccaaggctgttgccgttcacccacgccacgcccttgttcaggcccagcaggtccaccacgacggcctcctcgccggcgggagcttcaaaggtggtcttgtaccacgtgaagggccggttgacggggatggtaccgttgtggctctgccacttgtagccgggcttgtcgaggtggatttgcctgagctcaccggccaacccagactgcatgcaaacatcaaagtcatgacctgttcattcatccaggaggatcggaactgaaaacaagacgatcaaagactgcacgacgttgtaccttgtaagaccaagagcttttggtaagatcaatggcggtgccgtttgtcccgacaagcttaaccggcccaccggcgatgcccgctggcacaagctcaaacgaaggtccatagttctgtttgtttttaaccacaaaagtaataagcatacatggtgaacaacgaaggtacaaactgatcgatgctagcgcaggatgtaccttgagtccgactgtgccgctgaggagagaaacgtagttctttccggagtggagcttcaccggagactggagctggaagacgaacgctccatcggccgagtggttttgccctgtcaaatcaaataaataacattagcacttacaagaggagaaagccctcggtgttgtcgtactggtggtgctactcaccaacaagccttccgtttacaaaagcgtacatctcatggccacttgtgttcacgtacagcgtgtaacttccctctcccttatgctcaaggctgtaaaatttgatttgcatcagcgtttacaatgcaaatagtatattattatttggggaaaaaaatgcaatacttgtaccttgtcctataccacaagtagtcgctctgatcagtggatgttgcgatctgctccaagagttgtgactgtctgaagctgccacggtggtctgtcatgaagggcttgaggttctcgggcatccacgaccatcgcatggtctccggttccttctccaccgagttggccttcttcaccattaccgatgtttgcgtcttgatctaattatgccattcaattcaatgcaaactcaaatcgatcagtaagtgatctaatgtaaacccaaatcgatcagtaagtattgcgtatataaacaaacagaaaggaaaagaacctttgcagtgttgtaggcaacagtcttgcagttgggcaagatgctgacggaccatgccggaacgaggtgagtttcgccgccgagggtcaccttcatatccctgtcgacgaactggttgttgatgaagcaaactgaagaaccaccatacatgtacttggttacctaaaccatattgtcatgaacaacatttttagttaccaagacaaaaaaaaaaagaaaagaaaagaaaagacaatcgtcagttgtgaaagctacgtacagtgacattcttgccataacttgtgtcattgtacttcccatggacaaggattttctccatggacctgatcaggtcgtggagatctttcaggtgcccgtatttgggctgcctaatgttacctaatacatgcacaaaaaattaatctaacataggagcaatactttgtactatatgtatgtatatagctagacaaacctaccatactcatccaaaggtgcatcgtaatcatagctggttgtgatgtacgggccaccagaagtgcgtccgaaattggttcctccatggtactattatatgaattcaggtgacgaaaaccatgcatataaggttacaattacaattaagataattgtgcaattcatggtaagaacaactagaagaaaaaactatcaccatgtagtagttatggaccgatccacgcttctggaagaacatggcaaccgcgaaagcaatgtcctcagcggatctatggaaatccggcttatcccaggctttgaacctattataaattatttatttattttacaataatactgttccaagataatggaaaacttataaaaaaatagaaactgaagttaccagccagtccagttttctgtccatatcttgggaatgccggtcctattcgggaaccaatcgtggcaatagaaaccattgcaggtgttgatctagtaagaatcatacacattagataagtctgtattaaaccatttgatcaccataattaaactatagtcggagaggaggaggaggaagaagtcatcattatacttacgacgttgtgtggcacatcgttatcctgctggcacatgatccacgggacaccgacctcttgcttattcgccatgtccgcgc

SEQ ID NO: 1776 - DNA, 1231 bp, Zea mays
ggaatcctctcgagctcgtcgaaccttctggctcgccgccagcgcgctccattctccaactacctcaccaccctataaatgtagtcgcctactcgcctctgcgccgtcaccatcgcgaagacacactgggtaggaagatcgcagaaaaaggaagcagcagctttgatcgggtggagtttcttgctcactgatcgtcgagttcctgttcgattgaagttccaggcgcggacacgcactgaagcctttggggtccgtgacgatgtcgaggagagccgcagcgttgttgctcgcgtgcctcgtcgccgtgacagcggcggcgctggcggacggcgcgctgctcccgtggttcggcgacggccggcgcgggctcgacgaggcagcggtgtccgacgtgggcctcctggcggccgacccgttccggatcctggagcacgtcccgttcggcttcgaccgggacgacgtggccatggtctccatggcgcgcgtggactggcgcgagacccccgacgcgcacgagatcgtggtcgacgtgcccgggatgcgcagggaggacctcaggatcgaggtcgaggacaacagggtgctgcgcgtcagcggcgagcggcggcgcgcggaggagcgcaagggcgaccactggcaccgcgaggagcgctcctacggcaggttctggcgccggttccgcctccccgagaacgccgacctcgactccgtcgccgccagcctcgacagcggcgtcctcaccgtgcgattcaggaagctggcgcccgagcagatcaagggcccgcgcgtcgtcgggatcgccggaggagacggtggcgccgaggcgaaggagagcatcggaactggcgccggagatggtcatcagaccaagaaggtggagctctgaacagtgaggtgggaattgggatgactcaatgacggagatggctctgcgcgtgtgcgtagttttactagtttatgtgttcgcgtttttcttttttgtgacagcgtatatgcacttgtatggagtggaagtgtgccatgttttactgaggaataaaaacctacagtactagtgtactacgatcttccttccgctgaaaaacacagttgctgatgatcttgcgacttgcgagactgttttttttactaattggtaactgcattctaaaatctgaaagtaatttggggaattttatacgactgtgctttgtgtgggcgcgtccacaacgtctgagatgggcgacattgg

SEQ ID NO: 1777 - DNA, 1432 bp, Zea mays
  misc_feature (55)..(55): n is a, c, g, or t
ggtatcaccaggcccatggaaaggtatgtgtgatgggccatgcgccgtgacctgntccgcgataaacgctgacttggcccagcccaaaagagacgccgacggcgacgaggacgtttcaggagatctctcccgccatcgggacgttagccgtgcggcgaagcctctgcaacaacctcgaaccctctcgagctcgtcgaaccttctggctcgccaccgcgctcccttctccgacttcctcaccacgctataaatataccccgcctcgctgccctgtcaccatcgcatcatcataccaccgatcgaaggcacactaggcactagctaggaagagcgcatcaggaagcgtacgtcaactggcttgcgcgtcgattcttgtcttgaagttgaaatcttggcgcgagtgtcgacctttaatcaatcgggcgaagttttttgctcactgatcagcgacttctgttagattgaactttgaagtgcgcacgcactgccctgaagccttcgggtccgtgacgatgtcgaggagagccgcagcagcgcttgcgctcgcgtgcctcgccgtgctggcggcggcactggcggacggcgcgctgctcccgtggttcggcgaagggaggcgcgggggcgacgaggccgcggcggcggcggcgtctccgctgtccggccccggggtgggcctcctggccgatccgttccggatcctggagcacgtccccttgggcttcgaccgggacaacgtggccatggtctccatggcgcgcgcggactggcgcgagactcccgacgcgcacgagatcgtggtggacgtgcccgggatgcgcagggaggacctcaagatcgaggtggaggactacagccgggtgctgcgagtcagcggcgagcggcggcgcgcggaggagcacaggggcgaccactggcaccgcgaggagcgctcccacggcaggttctggcgccagttccgcctccccgagaacgccgacctcgactccgtcggcgccagcctcgacaacggcgtcctcaccgtgcggttccggaagctggcccccgagcaggtcaagggcccgcgcgtcgttgggattgccgggggagacggtgacggcgacgcgaagaagagtattggcggcggcgccggggatggtcatcatcagaccaagaaggtggagctctgaacagtcaaacgaggggtgttcgcgttttttttttttttgggtatgttctttatgttccacgacgtatccggtatctccacctgtattgtatggagaggcagagaaagtgtgcgatcttgactgagaaataaaaacctacagcactatcccttcaattcaaaaaaaaaaaaaaaatgatcttgcatgactttttttctcttcggagaagctattctgtgtccgagtatatggttgttctacgttattttttacgaataactcattac

SEQ ID NO: 1778 - DNA, 1513 bp, Zea mays
actcctatgggcgattggttccctcgaggccggccggggtgctattgtcggttcgtcgggcgtagcggcagcgatgatattttagtcgtactcgtacagaagccacagccctctgctagctagctagctcctgctagaatggaaagtgcaggaggggaagctcggccggtgctgccgccgccgccgccgccggtgcaagagctcgccggcgcagcgaacgacgtgccagctcggtacgtcgcgcgcgcaggcaacgagcccaaggtcacggtaaccgcgccggtcccggtcatcgacctcgcccggctgtgccagccgggcggcggcgccgacgaggcctcgaagctccggctggcgctcgagtcctggggtctcttcctggtgaccaaccacggcatcgaggccactctcatggacgccatgatggacgcgtcgagggagttcttcaggcagccgctccaggagaagcagaagcacagcaacatgatcgacggcaagcacttccagctccaagggtacgggaacgaccgggtggcgtcggaggaccaggtcctggactggtgcgaccgcctttacctcttggtggagcctcaggaggacaggagccttgacctatggcccgcatgtctaagggacgttctgcacgatttcaccacagagtgcacgagagtgaaggactgcctgcttcgagaaatggcgaaggcgctagatgagctcggcgacgacgacgactacttcatcgaccagttcggcgacagggccgacacccatgccaggttcagctactaccctccgtgcgcgcggccggacctcgtcttcggcctgaggcctcactccgacggcacgttcctctcgcttctcatgctagacgacagcgtcggcgggcttcaggttttccgggacggagcctggtacgacgtgcgcaccagacctcacaccctgctcgtcaatctaggagaccaaatagagataataagcaatgggatcttcaagagcccagtgcaccgggttgtaacaaacgcggagaaagagaggctatcagtggttctgttctattctatagatcctgagagagaaatccggcccgctgacaaactgatagacgagaaccatccagcactatacaagaaggtgaaagtcaaagaatatactgctggactctacgaacatttctctcgagggaaattggttaaagagactgcaaagatatagcttgttcgctttggattaaatccatggactaatccttagagacaaaaacactgtataagtagtaaaagtcggtacgaattaaagctcaagctagtcgtatctatgtaatgaataagggtgaaacctttgcgatcctagataataaatgaaattaatttttaataaaataaagtgtatatagttcggccccccctatctcggcttcattggcgtgtcctggtcagaagccatgactatagatgctaaagtgtatattcaatggtaccggtacttcaacaacaaggttaagactatctcgagc

SEQ ID NO: 1779 - DNA, 1064 bp, Zea mays
ttgggtacctcgaggccggccgggaagtgcgttatcacacacaagacacaaccccactcacccggcagggaggccctcttcgtcggcggaggccatggtttccctcaagccgcagaagaggctcgccgcgggagtcctaaaatgtggcaaggggaaggtgtggcttgaccccaacgaggtctacgagatctcgatggctaactcgcgtcagaacattcgtaagctggtgaaggatggattcataattaagaagccacagaaaatccactcaaggtcccgggcaaggagggcccatgaggccaagcagaaggggaggcactcgggttacggtaagcgcaggggtaccagggaggctaggctccccaccaagatcctttggatgcgcaggatgcgtgtcctcaggcgtctgctgcgcaagtaccgtgaagcaaagaaaatcgacaagcacatgtaccatgatatgtacatgaaagtaaaaggaaatatgtttaaaaataagagggtactcatggagagcatccacaagtcaaaggccgagaaggccagagagaagactctctcggatcagtttgaggccaagcgggccaagagcaaggcttcccgtgagagaaagatcgcaaggagggaggagagattggctcagggcccaagggaacctgcggcagcaccagtatcagctactgctccggctgcagctgcaccaaagaaggcgaagaagtgaaaagggtgatcttctagttctaggacctaattttggagcgccccaactcttttgctgttacatatccaagctgtcagatatctgtaataacatcttagacttgtttgtcccaagtttatttggaacgaattttcacagaatctgcttaatgcttcggtggaacccagttctggttttgctattttaccgtgtagatctggccgctgtggctagcctccgtgcttttttgcttcgatgttccataaccttgtctggtgttgactcgcgatgacgcaggttttgtagtgttctttggtgaattatgagctctgatgtgatattgatacgtgggccgtcccatttc

SEQ ID NO: 1780 - DNA, 1155 bp, Zea mays
aggaaaaattttatcacaactatatctacaaatcaaacacacatctaaaccagttaaccacaaaaactttggtagcgtggtcgcgccagggccggccggggacttgtgcgccatcacacacaagacacaaccccactcacccggcagggaggccctcttcgtcggcggaggccatggtttccctcaagccgcagaagaggctcgccgcgggagtcctaaaatgtggcaaggggaaggtgtggcttgaccccaacgaggtctacgagatctcgatggctaactcgcgtcagaacattcgtaagctggtgaaggatggattcataattaagaagccacagaaaatccactcaaggtcccgggcaaggagggcccatgaggccaagcagaaggggaggcactctggttacggtaagcgcaggggtaccagggaggctaggctccccaccaagatcctttggatgcgcaggatgcgtgtcctcaggcgtctgctgcgcaagtatcgtgaagcaaagaaaatcgacaaacacatgtaccacgatatgtatatgaaagtaaaaggaaacatgtttaaaaataagagggtactcatggagagcatccacaagtcaaaggccgagaaggccagagagaagactctctcggatcagtttgaggccaagcgagccaagagcaaggcttcccgtgagagaaagattgcaaggagggaggagagattggctcagggcccaagggaacctgcggcagcaccagtatcagctactgctccgtttgcagctgcaccaaagaaggcgaagaagtgaaaaaggtggtcttctagttctaggacctaattttggagcgccccaactcttttgctgttacatatccaagctgtcagatatctgtaataacatcttatctcgtttttcatgttggacaatgtagtagagttgtttgtcccaagtgtatttggaacgaattttcacagaatctgcttaatgcttcggtggaacccagttctggttttgctattttaccttgtagatctggccgctgtggctagcctccgtgcttttttgcttcgatgttccataaccttgtctggtgttgacccgcgatgacgcaggttttgtagtgttctttggtgaattatgagctctgatgtgatattgataa

SEQ ID NO: 1781 - DNA, 1004 bp, Zea mays
  misc_feature (31)..(31): n is a, c, g, or t
cctcgaagccggccggggccctgccgccccngccccccggacttggtgcgccatcacacacaagacacaaccccactcacccggcagggaggccctcttcgtcggcggaggccatggtttccctcaagccgcagaagaggctcgccgcgggagtcctaaaatgtggcaaggggaaggtgtggcttgaccccaacgaggcctacgagatctcgatggctaactcgcgtcagaacattcgtaagctggtgaaggatggattcataattaagaagccacagaaaatccactcaaggtcccgggcaaggagggcccatgaggccaagcagaaggggaggcactctggttacggtaagcgcaggggtaccagggaggctaggctccccaccaagatcctttggatgcgcaggatgcgtgtcctcaggcgtctgctgcgcaagtatcgtgaagcaaagaaaatcgacaaacacatgtaccacgatatgtatatgaaagtaaaaggaaacatgttgccgcccgggcagggtactcatggagagcatccacaagtcaaaggccgagaaggccagagagaagactctctcggatcagtttgaggccaagcgggccaagagcaaggcttcccgtgagagaaagattgcaaggagggaggagagattggctcagggcccaagggaacctgcggcagcaccagtatcagctactgctccgtttgcagctgcaccaaagaaggcgaagaagtgaaaaaggtggtcttctagttctaggacctaattttggagcgccccaactcttttgctgttacatatccaagctgtcagatatctgtaataacatcttatctcgtttttccatgttggacaatgtagtagagttgtttgtcccaagtgtatttggaacgaattttcacagaatctgcttaatgcttcggtggaacccagttctggttttgctaaaaaaaaaattaaaaaaaaaaaaaaaaaaaaaaaaaaaaaggcctggtcccg

SEQ ID NO: 1782 - DNA, 2004 bp, Zea mays
aaatacccctatataaacagggtatctggacgcccgggccgggctctcatccatccagagaagctagagtccaggtctcactcgcgaccgagagccacagagaaatggggggccctggtcgtccctggcgccggcacgtcttcctcgtcgtgtcgctgcagcttctccttgtggcgccatggcaggacgagacggccgctcgagctctcaatttcaccaggcaggatttccccagggccttcgtctttggtgccggcacgtcagcttaccagtacgaaggggcaaccgatgaagacggaaggagcccaagcatatgggacaactttactcatgcaggtaggatgccggacaagagcactggcgacctaggggcggacggctaccacaaatacaagggagacgtgcagctgatgagtgacactggcctggaggcctaccgcttctccatttcttggtccaggcttattccaagaggaagaggagccatcaaccccaagggcctcgagtattacaacaacctcatcaatgagctagtaaaacgaggaattgagatacacgtgaccctgtcccacctggattaccctcagatcctggaggacgagtaccacggctggctgagccccaggatggtggacgacttcgaggcgtacgcggacgtgtgcttccgcgagttcggcgaccgggtgaggcactggaccaccatggacgagccgaacgtcaactccatcgccgcctacgacaacggcgccttcccccccggccgctgctccccgccgttcgggttcggcactaactgcaccgccggcggcaactccagcgtcgagccctacgtcgtcacccacaactgcatcctggcgcacgccgccgtcgccgccctctacacccgcagctaccgtgccgaacagcagggcgtcgtcggcatcaacatctacaccttctggaactaccccttctcccccgcccccgccgacgtccaggccacgcagcgctcgctcgacttcatgatcggctggatggtcaacccgttggtgtatggagactaccctcaagtgatgaagaggatagtcgggtcccgccttcccaggttcaccaagcggcagtcggagatggtccgcgggacggcggatttcattggcataaaccactacacctccgtgtacgtcagtgatcgccccaacgacgcagcagccgacaccacggggccccgggactacaatgctgatctgtcggctaccttcagattttctcgcgatgatccagccactggccagttcgtcccaatcaacatgccaagcgacccgcagggactgcaatgcatgctcgagtatctcagccaaacctacaacaacatccccgtctacgtgcaggaaaacggctacggggcgctcttcaacgactccatccatgaccacgagagagccgagtacttgagtgcctacatgggcagcgcactcgctgcactcaggaacggagccaacgtgaaagggtacttcgtctggtcgttcttggacgtgtttgagttgttggctggctactactcgcgatacggcctctaccatgtcgatttccaggacccggagctgccgaggacgccaaaactctctgcgctgtggtacggcaagttcttgaagagtgaaatcgacgacataatagagaacgttgtcgtcagcgctactgacgacgcgcgctcgcatgctgctgaacaatgagttagattgctagcgagcagcagcacacgacatgcatgtcgtagtagcggaggaaaagaatgttgtttcttatccattctttcttttttcacaagtccacagaagctcagaattttcagcagttcgtcaggctcggaattcagtgttcgtgaatcgtagccatagccaccctctttaatttggctgtagtagccctgtagtatgcgctacgtacggcaacagttgtcatgagtcactctctgtcgctactgacacaataaataatacagaaaggaactgcttttgcacgtcgacg

SEQ ID NO: 1783 - DNA, 1585 bp, Zea mays
gaaagtggaaggcggctgcctgctcccgcggtctcttccgtctcggaggtgggagagagcgatcagcggcgtcgccgggtggatccaaagcgcgcgagaaaatgcagggcggatccagcggcatcgtgtatggtggcctcaagtaccaggcgcggtgtatcgccgacatacgcgcggacgccggctcgaccaccttcctcgccggcaccctcagcctcaaggaggagaacgaggtgcacctgatccggttttcgccggcggagagcgagctggtgtgcgatggcctcttctaccaccccaacgagatttgggacctcaaatcatgccccttcgatcacagggttttctccacagtctacacgtctggtgagggctatggtgcatcagtttggaagatcccggagctcaatgggcaatcaaactcaccacaacttgagcagctctttgagcttagtgggcatacgggcaagattagacgtgtgatctggtggccacttggaaagcatgataaactaattagcattgatgaccgaaatatttttctttggaacatagacacgtcaaaaaaaatagctaaggtgatctcacagggatcaactgacatgcttccaaatttacgtggtggagcttgggatccacacaatcataatttagttgctgcaatatctgattcatcacttcagctgtgggatctacgttctatggaaaaatcaactgcaattgaacatgcacatatacgggatgtggattataaccccaagaagcaaaacattgttgcaacagcagaagaggaatttggaattcgcttgtgggatctcagaatgcttaagtatcctctaaaagatctccctgggcactcacattggacatgggctgttcggcacaatcctgcgtatgatgagctccttctgagtgctggaacagattcaactgtaaatttatggttggctaaagttagcagtgacgatcctgaatctgatagcccttctgctttatccaataggcaagaagtaccattactcaactcatatactgactatgaagacagcatctatggtattgcatggagctcccatgatccatcattattcgcttctttgtcatatgatggaagggttgtcttggaatcagtcaagccctacttgcagagaaaatgaaccttgtctagttttctaaattgtaaggtgcaaaatatggtttcttgtttcctttatcttgtccttattattactgaagttacctcatgtcctaataaactgttctcttcctgctacctgtgggcttgtttgttcatattggaagctgagtagctttgccttgccattctgtagcctcttaacaagcatttatgtgatgattcggtttactgttgtagcaatggcagaaaaatggataacaagattgttacagaaatcaatttttaggatgttgtatatttgaagtgtccactgaaaaggtcttgtgttatatgatgaggtggggttgaactcaatttgtaaaaccgttcagaatttcagattagtaggattagtttttttttacttttctgtttcgcattcagaatttcgttctttgcaggtagaag

SEQ ID NO: 1784 - DNA, 1673 bp, Zea mays
ctgccaaagcgtatttctgcgacatctaaaggagtgtggaaggcggctgccttgtccgcccggcctcttacgtctcggagcgagaaatcagccgcatcgccgcgcgcatccgaagcgcacacgacaatgcagggcggatccagcggcatcgtctatggtggcctcaagtaccaggcacggtgtatcgccgacgtgcgcgcggacgccagctcgaccaccttcctcgccgggaccctcagcctcaaggaggagaacgaggtgcacctgatccggctttcgccggcggagagtgagctggtgtgcgatggagtcttctaccaccccaacgagatctgggatctcaaatcatgtcccttcgatcacagggtcttctccacagtctacacgtctggtgagggctttggtgcgtcagtttggaagatcccagagcttaatgggcaatcaaactcaccgcagcttgagcagctctttgagcttagtgggcatacgggcaagattagacgtgtgatctggtggccacttggaaagcatgataaactaattagcattgatgaccgaaatatttttctttggaacgtagacatgtcaaataaatcagctaaggtgatctcacagggatcagctgacatgcttccaaatttgagtggtggggcttgggatccacacaatcataattcaattgcttcaatatctgattcatcacttcatttgtgggatctacgttctatggaaaaatcatctgcaattgaacatgcacatatacgggatgtggattataaccccaagaagcaacacgttattgcaacaacagaagatgactttggaattcgcttgtgggatctcagaatgtttaagcttcctctgaaagacctccctgggcactcacattggacatgggctattcagcacaatcctgagtatgatgagctgcttctgagtgctggaacagattcaactgtaaatttatggttggctaaagttagcaacaatgattctgaacctgatagcccttctggttcacccaatagacaagaagaaccattacttaactcatatactgactatgaagacagcatctatggtattgcatggagctcccatgatccatcattattcgcttctttgtcctatgatggaagggttgtcttggaatcagtgaagccctacttgcagagaaaatgaatcttgctggtctaacttttggattgtaagcaatggcagaaaaaacataataaggatgttgcagaaatcatcctgcttgacatcaggtcttcaaccctcttgattgaagccagcaatggctccaaaacactcagatctagcttcagttgagatattacagcacagttgagattgtcagcagtttcctttcctgtatcttcaaattttgtccactaggatttcatgttcagttgctagaaatttggctgtgaagatctgatctgtatgttaataactgttgcccatctgtctgaaatagttttctatacttgattcttaggatgttgtatatttgaaaagtgttcacaaaaagatattgcggtatatgatgaggtggagttggactgtaatttgtaaaaccattcagaatttcaaattcccaggattagcttgttttaccaaatattctgttgcgcaaaaaaaaaaaagtactctgcgttgttaccactgct

SEQ ID NO: 1785 - DNA, 1192 bp, Zea mays
ctgccatggcgatccccccttcgggcgtttgggaccctcgacggccgcggccaactacaccacaccgcaccggcaccaccaccaaccgagcggctccaggctcctgctcaggaaggggagaagaggcgagccttccttgggaagtcgcaggaggagagaaggggaacaaagatggggcgcggcaagatcgagatcaagcggatcgagaactccaccaaccgccaggtgaccttctccaagcgccgcaacgggatcctcaagaaggcgcgggagatcagcgtgctctgcgacgccgaggtcggcgtcgtcgtcttctccagcgccggcaagctttacgactactgctccccgaagacatcgctatcaaaaatcctggagaagtaccagaccaactctggaaagatactgtggggtgagaagcacaagagccttagtgcagagattgaccgtataaagaaagagaacgacaccatgcagatcgagctcaggcacctgaaaggtgaagatctaaactcgctgcaacccaaagacctgatcatgatcgaggaggcacttgataatggactgacgaacctgaatgagaaactgatggagcactgggaaaggcgtgtgacaaacactaagatgatggaagacgagaacaaattgctggccttcaaactccaccagcaagatatcgcgctgagcggcagcatgagagagcttgagctgggttaccatcctgaccgggacctggcggcccagatgccaatcaccttccgcgtgcagcccagccatcccaacttgcaggagaacaattagactgctggatgccctcgttccactcgccgaggatttcacccagccaccaccgctggcttgtatgccctcgtgcgctggcaactgtatctttatctttccggtatgtttggatgaacgtataatgtgtgtcagtgtcggtcgcatgacgtgccgatgtcgtgcatctctctctctctctgccagagcagcggaactctgcaccgtgagtaacttaattggtaccgtatgatctgccggacagtgaatagtttatgtgagtgggtcaaaccataatgtgtagtatttgtgtcgaactgtcaatggcacgtatttggattttcactacacgttacatatgaagggatatacaaaaaaaaaaagccgcaaaaaaaaaaaaaaaaaatttgcggcc

SEQ ID NO: 1786 - DNA, 1092 bp, Zea mays
  misc_feature (11)..(37): n is a, c, g, or t
  misc_feature (56)..(80): n is a, c, g, or t
  misc_feature (93)..(121): n is a, c, g, or t
  misc_feature (236)..(273): n is a, c, g, or t
  misc_feature (314)..(318): n is a, c, g, or t
ccacgcgtccnnnnnnnnnnnnnnnnnnnnnnnnnnngcggctccaggctcctgcnnnnnnnnnnnnnnnnnnnnnnnnnttccttgggaagnnnnnnnnnnnnnnnnnnnnnnnnnnnnnggggcgcggcaagatcgagatcaagcggatcgagaactccaccaaccgccaggtgaccttctccaagcgccgcaacgggatcctcaagaaggcgcgggagatcagcgtgctctgnnnnnnnnnnnnnnnnnnnnnnnnnnnnnnnnnnnnnngcaagctttacgactactgctccccgaagacatcgctatcnnnnntcctggacaggtaccagaccaactctggaaagatactgtggggtgagaagcacaagagccttcggcacgaccagagattgaccgtataaagaaagagaacgacaccatgcagatcgagctcaggcacctgaaaggtgaagatctaaactcgctgcaacccaaagacctgatcatgatcgaggaggcacttgataatggactgacgaacctgaatgagaaactgatggagcactgggaaaggcgtgtgacaaacactaagatgatggaagacgagaacaaattgctggccttcaaactccaccagcaagatatcgcgctgagcggcagcatgagagagcttgagctgggttaccatcctgaccgggacctggcggcccagatgccaatcaccttccgcgtgcagcccagccatcccaacttgcaggagaacaattagactgctggatgccctcgttccacttgccgaggatttcacccagccaccagcccaccaccgctggcttgtatgtcctcgtgcgctgccaactgtatctttatctttccggtatgtttggatgaacgtataatgtgtgtcagtgtcggtcgcatgacgtgccgatgtcgtgcatctctctctctctctgccagagcagcggaactctgcaccgtgagtaacttaattggtaccgtataaaaaaaaaaaaaaaaaactcgagcccgacagtgaatagtttatgtgagtgggtcaaaccataatgtgtagtatttgtgtcgaactgtcaatggcacgtattt

SEQ ID NO: 1787 - DNA, 1134 bp, Zea mays
  misc_feature (51)..(52): n is a, c, g, or t
  misc_feature (67)..(67): n is a, c, g, or t
cattgggcgccgcgccgcccgccgggaaaaaaaaaaacccaactacaccanncaccgcaccggcacncaccaccaaccgagcggctccaggctcctgctcaggaaggggagaagaggcgagccttccttgggaagtcgcaggaggagagaaggggaacaaagatggggcgcggcaagatcgagatcaagcggatcgagaactccaccaaccgccaggtgaccttctccaagcgccgcaacgggatcctcaagaaggcgcgggagatcagcgtgctctgcgacgccgaggtcggcgtcgtcgtcttctccagcgccggcaagctttacgactactgctccccgaagacatcgctatcaaaaatcctggagaagtaccagaccaactctggaaagatactgtggggtgagaagcacaagagccttagtgcagagattgaccgtataaagaaagagaacgaccccatgcagatcgagctcaggcccctgaaaggtgaagatctaaactcgctgcaacccaaagacctgatcatgatcgaggaggcccttgataatggactgacgaacctgaatgagaaactgatggagccctgggaaaggcgtgtgacaaaccctaagatgatggaagacgagaacaaattgctggccttcaaactcccccagcaagatatcgcgctgagcggcagcatgagagagcttgagctgggttaccatcctgaccgggacctggcggcccagatgccaatcaccttccgcgtgcagcccagccatcccaacttgcaggagaacaattagactgctggatgccctcgttccccttgccgaggatttccccccgcccccagcccccccccgctggcttgtatgtcctcgtgcgctgcccactgtatctttatctttccggtatgtttggatgaacgtataatgtgtgtcagtgtcggtcgcatgacgtgccgatgtcgtgcatctctctctctctctgccagagcagcggaactctgccccgtgagtaacttaattggtaccgtatgatctgccggacagtgaatagtttatgtgagtgggtcaaacccataatgtgtagtatttgtgtcgaactgtcaatggcacgtaaaaaaaaaaaaaaaaaaaaaaaaa

SEQ ID NO: 1788 - DNA, 1956 bp, Zea mays
  misc_feature (42)..(42): n is a, c, g, or t
tctgacttcccaatttttgaatttaagttgtgcggaactcanatgtttggacccaaccttaggattcataagatattggggaaagtgccgtggggtttactcaaatgttatgggatttttgggtggtataaactgggcaattctcgtgggtcgcatctgtcaactgtacccaaatgcatcaccaagcatgctggtatcccgttttttccgagtctacagcaaatggaaatggcctaatcctgttatgctttgccatattgaggagggctatcttggtctccctgtgtgggatccaagaagaaattacagagacagggggcatcaaatgcctattattacacctgcttacccttgcatgaattccagctacaatgtatctgttagtactagatatgtgatgatccaagaattcacgcgagcgtttgagatttgtcaggccatagatgaaggaaaagcagattgggacgcattgtttgagccatatccattttttgaatcatataaaaattatctagaagttaatatcacagcgagaaatgaagatgatctcaggaattggaaaggctgggtggagtctcgccttcgcactcttgtattaaagattgagcgttattcacacgagatgatccttgcacacccatatcccaaagatttctcagacaaatccaggcccttacattgcttttacttcatgggtctttggagaaaacaaaccacccaagctcaagaagctgagcaatttgatatcaggggaattgtaaatgagtttaggaatactatttgtgcatatcaacattggaaagaaggaatggacattgaagtgtcccatgtaaaaagaaaagaaatccctttgtttgtttttcctggtggagtgcgtccttctcgtacttctagaacaacgcacaagaacagccgtgccattccaacacgtgatgtttcagctgatgatcaagtgggaaacctattgggcgttgccagttgtagtgatgctcaacatgtaccatgtaaaggcagctatatgaaacaaccagaaccagattttgctggaggctttcagttgccaggaagtatttctctgttgccccctagcttacccaataaagtagttctgaatgggtctgctaattttcatgcagaatctattgagagtgaacatccagaacactatcaggaaagtaagtttgtggctgtgcagaataccgtgtgccttgtagtcaagcaacctaacagtttgctcccaaattcaaacaacaattcacaattgtatggatctgattcctctcttaacagttcaaaaagggaatgtgcaggcagtgctgcaaacaacttgctgaagttatccccagctattccagccacacctgatgaacttgatgagctgatatcctatcaaactaatcagaaagatgtaaatgctgaaaataacttggagatcggttctgaaaataacttggaacaaatatgcagtctgaggccccaagaatctaataataatctgaagcgtaaagccaatcaagagctcgagccacttgagcttgccgtcccatccactggtgctgcgccgcaatcgacaggaactgccccaagaaaaccactcaggttgaggttaacgactttggggaaaccgaagccagctgaaggaacttcctgaatggaattgcccaggagccaacatacctagagcttgtttttccttgtattgaagcaaggatatgtggaagcgctcggcacatagcctgctttggcactgcgagttgaaacgaaatggaaaacggaggccgcctgacgtaaatgagtgcgattgtaataaattgtatgtagttcatagctgggttggtatcagagttcaccatttcgtttttgctgtagcgaatttcgtttttttaaccaaagtttgactcttatattttttgaatttggaaccaaaatccataaaaaaaaaaaaagaaaaaaaaa

SEQ ID NO: 1789 - DNA, 1941 bp, Zea mays
ggcacgaggctaagattggttccaaacattctgagtttccgcacaaccttaagattcataagatattggggaaagtgccgtggggtttactcaaatgttatgggatttttgggtggtataaactgggcaattctcgtgggtcgcatctgtcaactgtacccaaatgcatcaccaagcatgctggtatcccgttttttccgagtctacagcaaatggaaatggcctaatcctgttatgctttgccatattgaggagggctatcttggtctccctgtgtgggatccaagaagaaattacagagacagggggcatcaaatgcctattattacacctgcttacccttgcatgaattccagctacaatgtatctgttagtactagatatgtgatgatccaagaattcacgcgagcgtttgagatttgtcaggccatagatgaaggaaaagcagattgggacgcattgtttgagccatatccattttttgaatcatataaaaattatctagaagttaatatcacagcgagaaatgaagatgatctcaggaattggaaaggctgggtggagtctcgccttcgcactctggtgttgcagattgagcgttattcacacgagatgatccttgcacacccatatcccaaagatttctcagacaaatccaggcccttacattgcttttacttcatgggtctttggagaaaacaaaccacccaagctcaagaagctgagcaatttgatatcaggggaattgtaaatgagtttaggaatactatttgtgcatatcaacattggaaagaaggaatggacattgaagtgtcccatgtaaaaagaaaagaaattcctttgtttgtttttcctggtggagtgcgtccttctcgttcttctagaacagcgcacaagaagagccgtactattccaacatgtgatgtttcagctgatgatcaggtgggaaacctattgggcgttgccagttgtagtgatgctcaacctgtaccatgtaaaggcagctatacgaaacagccagatccaaattgcgctggaggctttcagttgccaggaagtacttctgtgttgcctcctagcttacccaatgaagtagttttgaatgggtctgctaattttcatgaagaatctgttgagcgtgaacatccagaacactatcaggaaagtaagtttgcaactgtgcagaatgctgtgtgccatgtagccaagcagcctaacagtttgctgccaaattcaaacaacggttggcaattgtatggatctgattcctctctaaacaattcacaaagagaatgttcaggcagtgctgcaaacaacttgctgaacttatccccagctattccagccacacctgatgaactcgatgagctggtatcctctaatcaaattaaagctaaccaggaagatgtaaatgctgaacggagaccatctttggagatcggttctgaaaataatttggaacaaatatgcagtctgaggccccaagattctaatgataatctgaagcgcaaagcgaatcaagagctcgagccacttgagcttgccgccccatccactgttgctgcggcacaatcgacaggaactgccccaagaaaaccactcagattgaggttgacgactttggggaaaccgaagccagctgaaggaactacctgaatcgaattgcccaggagccaaaattacctagagttcgcttttccttgtattgagtcaaggatctgtggaagcgctttggcaccgcgagttcaaatgaaagggaaaatgaaaaaaaaaacggagaccacctgacgtaaatgagtgcaattgtaataaattgtgtgtagtacatagctgagttggcataaatgtacgctgtggtacgttttcttgacgacttagctacgcttgttaaacgggaatggatatcatcttcgaagcatataatcttctcatgtgtcaaaa

SEQ ID NO: 1790 - DNA, 1226 bp, Zea mays
tcactagtccccccccccccccccccctatgagctgtgatcttgcatttttctatagtttcagttaggatgccctgttactgtgatattagtggcaaacaataacatgtgaatacaatctatttaccttgtttcatttttcaattacatgcgatatacctacatacgctattacagatctaaagaacattttgagggtgcataaagcataattgcagcagatacttttgttgaagtagtcatctaatttgtactattctgcaagtactggttccgcttggaacagccggcagccccagcacaataaacagtgctgggcaggttttaaaagcagcaaaaactttagctttattccccagcagcttgtctatctccagcagccttatcacatctcctgtttcaagctctactatgtaaacaatgcagtctacagtgttttacacgactatatacatgacctgctgggcctacgcttacaaacagggccactgttttttgtgaatctctagtcgttggaacttcctcacggttcttcatagctatgtctagtttactactttatggacccaatcaagccaattcgcaagttggtgtaactgtcacaattaactcttttctggaaaacagaacagaaaacttccatttatattttctggtattatttcctttgtattttcttattaacggtgtgttcaaccatgtgttttggcgctcacaaaagccacttgagcttgccgccccatccactgttgctgcggcacaatcgacaggaactgccccaagaaaaccactcagattgaggttgacgactttggggaaaccgaagccagctgaaggaactacctgaatcgaattgcccaggagccaaaattacctagagttcgcttttccttgtattgagtcaaggatctgtggaagcgctttggcaccgcgagttcaaatgaaagggaaaatgaaaaaaaaaacggagaccacctgacgtaaatgagtgcaattgtaataaattgtgtgtagtacatagctgagttggcataaatgtacgctgtggtacgttttcttgacgacttagctacgcttgttaaacgggaatggatatcatcttcgaagcaaaaaaaaaaaaaaaaaaaactcgagggggggcccggtacccaatccgccctttagtgggggggggtataacaattccctgggcgggcgttttaaacggccgggactggaaaaacccgg

SEQ ID NO: 1791 - DNA, 1571 bp, Zea mays
agttgaatattagcgtcccccggccgcaatccgcaactctgcacttggggttgggctcaaccgaatcgcccccgcgccaggccgttctcgtcgacgccgccgaccaataaggagcctcgcacgccacgccaccaccgccgccgcaacccacgcgatggcgccaccggactccatctccacgtgctcctcccttcccctcgccgctgcgcccatgtccgaaccgacccccttccccttcgctgcgtcgccgcttccaaacccgctcgtagccaccgcctccttcctacagcaccacctctcccgtttggcttcccacctgaacgtcccgcgccccgccctcgctgccgcggctgcgcgcacgccgggcccccagggcgcctccctatctctctctctcgcgcccgatgaggtcgcgcgcgctcttaccggcactcccgtcttcactgtctgcaactccagcaacgagttcgtgcttgtctccgaccctgccaccggcctccgctccctcggcctcctctgcttccgttcggaggacgccgacgccctcctgtcgcatgtgaggacgcggcaaccggtgctaggcaagggggcaaaagtggtgcctattacacttgatcaggtctatatgttaaaggctgaaggtatcgcatttaggttcttacccgaccctcttcaaataaagaatgcactggagatgaaatcgggcttaactgcttttgatggtgttcctgtttttcagtcagatctgctggttgtgaagaagcagaagaagcgctactgtccagtatattttcaaaaggaagacatagaaagagaacttacaagggcttccaaaggttcaagagggtcagccttatctaagaaaattatggttggaagtttggaggatgtcctgaagaaaatggagataaatgaaagagattctggctgggatgatttgatctttataccccctgggaagagcctcaaccaacatatcaatgaggtatcagcatgattttgttccacggtgatagctcagagtttgaacagactattcactttaaatgctatgatggtcagccaaacgaaatatcaaattgctgcctgagcttttcctttggatagctattttcatggtcagctttgtcagggaaaattaactaaagtgatagaatatggctgtgaaacaattttcttgttgcttcgattcacaaaattaacacaggttacacaagaagatttgatgaagagtaagttgcgacattggtaaatcaccttgcaatatagtttcatgaaagggttatacaatagaaaaagagatgaatgcttatggccctatttggatgcatagtattttttggtgttgataaaaaaaaaaaaaaaattaaatattttggttttcgaatgctaaggtgtttggacatcacaaccttgtagttttgaaacccatgcttttgctaaaactatagtcgtcttgttttttttagaagcttagcttcgtgcttaaactgttgtgtttgtaacctccgtttttgtatgagtgatatatttgtattcccaaaaatttgaatttcactgctttggccgac

SEQ ID NO: 1792 - DNA, 1635 bp, Zea mays
cattgggtacctcgaggccggcctcgggcccggcgtctgagccgcctgtctcctcctcgttctctcagcccgttcggcgcaatgccaccgccggcgccgctcttcctctcgctcgcctccacgccaccgcctgcgcttatgcccgtacaccaccccagggccccgcaatccctaaccctagtccctccggttgcctcctccagaaaggccgccgccgttcccgcgtgccccgtcgcctccccgcgccactccgactacttcgatccgcgggctccgccgccgccgcgcggggacggagggtacgggcgccctcccaacggcgcgcaggacgggagggtcttcacgagctacagcatctacaagggcaaggccgcgctgtcattcgatcctaggccgccgctcttcgtgccgctcgattctggggcgtacaaggtggccaaggagggcttcgtgctgctgcagttcgcgcccgccgtggccacacgacagtacgactggacgcgcaagcaggtgttctcgttatctgtgtgggagataggaaccctgcttactcttggtccaacagattcatgcgagttctttcatgaccctttcaaggggcggagcgaagaaggtaaagtgcgtaaggttctaaaaattgagccaacaccagatggcaatggtcgctttttcaacctcagtgtccagaatcggcttatcaacgttgatgagagcatttacatccctataaccaagggagagtttgctgtcattgtatcaactttcaattacatcataccgcacctcatgggctggagcacatttgtaagttcaatcaaacccgaggagtcacggccatacagcaggccgcagtccacgtctgagtacgaatggcgaaggtgatgtgttgatcaactacagcaaaatggctgagacccacactgaagggatgagattattggtattgtttggctgggtaatctcagatgtggttagttgatggatgcctttttggggtactccttttgtttcctttctagttcagcaggcaggtagcactacttgtatccagagtttcacggggcggttggggagggggcatattttgggcagcaaacctcagttctgacatggaatgatgcagtcacgcagcaggggcggttgtgaatctgctccgtaaggccgtggctccagtgatagcgggacgcagctgacagatgctttgggttgctggggaagggttggcctgaaattgttgcttgcatacacgagattattgtgtacatgtagtctgcgactctgcgttacccccttgatgaatgtccgccctgtggaactgtggtgtttttgctgatgattttgctgaattcaaaagcttaaaccattagaattagaaagagagatactcacgcgcccgcaacccctagtacttgaactcaagacgacattgataccgtattacaaggtttcatgcagagaccaggtgaactaaaaagctgaagccgttggcatcgactacttcacaatacttcctctcatgttcgtgcctggttacagccgttgaaattgacatatacttcccaacacttcctcatgtttgcgccttgtacgtggttacacgtgacttggagtgttttgaagtatacgtggactgca

SEQ ID NO: 1793 - DNA, 1146 bp, Zea mays
  misc_feature (55)..(55): n is a, c, g, or t
agttccttcctctatattactcggattgagtgggattgggtgggttaaggaaacngtaatcggagcacaaacacacacacacagaccatggtgatggaggagacgatagatgacagtgagatgagcttgtcgaacatggtgctgggcttcctggaagatttcgagagggacgagcgacggccggagaacgacgacgacaacaacgaggaggagggctccagcggcggcgacaccgccgagagcaaggccttctggcagacccaacacttgcagctgcgcgaggcactggccaagggcagcccagccgagagcaggatccgcgcggacacggaggaggccgtcaagagcatgcgcgccgcggcctgctcctgctcctgcacggggcggcccgccgcccgggactgccggccgtgcatgctccggcacgtcgccgaccggctgcgcgacgccggctacgacagcgcgctctgcaaatccaagtggacgcgctcgccggatatcccttcaggcgagcacagctacgtggccgtggcggtgcagacgaggagcggcaaggccgtgcgcgtggtggtggagctcagcttccgcgccgagttcgaggtggcgcgcgccagcgccggctaccgcgcgctggtgaccgcgctgcccgaggtgttcgtcggccgggccgaccggctgcgcggcgtcgtcaaggtcatgtgcgccgcggccaagcagtgcatgaaggataacaacatgcacatgggaccctggaggaagcacaagtacatgcaggccaagtggctcggcacgcccgagcggggagtcgcggcggcggcggcggtggcggcggagatgccggtggtggcggttccgtcggtcgcggtcggctcttcgccagagaagcagaccaagttcagggcgtccatgctgaccttcgactttggccggaccgcgctggaggtcgcatgatggacgcacacgcacatacgctgccggtcgagcggcattagtagttctctaaatatagacaaaggagcgtcaactttcgagaagaagaaaattatatagagtgctcctggggcctaggtttttgtcaggattcagaaagccgaatcggtaacaccaatcgagctcggtataaaaaaaaaaaaaaaagcttatcga

SEQ ID NO: 1794 - DNA, 1703 bp, Zea mays
tttttttttttttttttttttctcattccaaaactgaatattttattccaaatcatagatccacatttcagtcagtgctatgtcgagttgtagcaaatcttcaatataacaataactaaacgcaaaagatcaactattataaaactgggaacacagcctttgcagtcataatcaaccagctaataagatgcctactacccaactgaatgctaataagcatcatccatgctaaaagagatgccttattgtgcccaggtgctacttcgcctcgctcactagtgactggggtgaccccagtcccaaccgccatctgaaactgtcatgcatacaagttccctaaaaaatacctggattgtagaaggccacgcagggaaagacggcggcgccttccttatcttcatctaccaccctccgttggagagacttgaggtcttgctgctgctgctgggattccgacatggcgaggaaatttttgtgcgtctgtcagatgcaggggcttgcttgctacttagagacgacggcttcgctgatgtcttgatggcgctccaacggcaacctgctgttgatgcatggtcgtgctgaaacctgaagccgatctggaattatggatgctgcccgcggtggtggtggacggctggacgccaggaggatgcagggcgacgcgtgaggtgtgaagcaaggggctgggcgaagcaacaacggcgactagctactcacaacggtggtggcgtgtggaaaggctctggctgctcgcaacggcggcggcgtgtgcgaaggttgtgctcatataagctagggttagataactggtcaacagtgagcgtgcccaccccacaccccacgggctgttgcagttttgggcctccacactcaaacatttggcccaatagctgcgctaaattcagctaagtctatgtgtttagcgggctaaatgaggtaattagcggctaactttggttagcgttaaactgggcatctcctagcttcagagctcctcaaacgctatagccggctaaatagccgctattagcgggctatttgaaacactgatcctcctccgacaacaacctctgaattcctcgtccacaggtgaagccttgaaccaagaatggcggcgaaacccagcgagccatctcccgtcgccacgaggacagcattcccgtccaagtcacgcgcattcggtggtttgatgatggacatgtggttttctgccacgtccaagttcagaactgcaaattcgggcggcgtggctgatagtattaaatacatgccatcgccgatgaccacgctcggcgtgcgggcgggagagaaacgagggcccggaggggcagaagacgaactccaccagtagccagactctgatgagtacaggtgtgactgctgcagggcccccgccacatcgttgtaccccacgagggcgacgacgaatgggccaccgcggcagtcgaggtggtcacagccgcgcgcagcacagagcaccgccgcattgaagaattgtcgtcctgggaacggggcctccggcagcagcttcttcttctcgcaggttccgctatcccatacggcaaggctcgggctcacgtccgggacccaacagaggatgttcctccaggctccagttgcagtaagggtccacggcctcaaagaggacgcggccatggcggcagtcgatgacgcgccagccgttgttgctgcaggcatgcaag

SEQ ID NO: 1795 - DNA, 1689 bp, Zea mays
cccctgtgcgtgcgccctacagtgcgaattgcttgctgtcgttcactactcctgcctgcctctttagtttaactgcctaagggtaaaaaaaacaacggttaggatctaattttcactatggttgttgttcaaatccacacttctgtagggcaaaacacgcaccgcggttcaagtttttctgacccgtggcaccaattctagattgctagcctactagctgagctacaaacctcaggttgttctagggcgatcgagcgcattgaatccggctaggtgcctgacgtggatccgtgctgttcccgtgtcccagccagcaacagccagggcccacttgcgcgtccccaatcgcctcatccgcatatcccggggcccactggtgaccagctaccggctaccgctgcccgttcgccacgtccgctcgctcccggtatatatacgacctccctagtcccttccccacattgcctgcgcactagaagaagcagaaggaaacgaaatcggagcacaaacacacacacacacacacagaccatggtgatggaggagacgatagacgacagtgagatgagcttgtcgaacatggtgctgggcttcctggaagatttcgagagggacgagcgacggccggagaacgacgacgacaacaacgaggaggagggctccagcggcggcgacaccgccgagagcaaggccttctggcagacccaacacttgcagctgcgcgaggcactggccaagggcagcccagccgagagcaggatccgcgcggacacggaggaggccgtcaagagcatgcgcgccgcggcctgctcctgctcctgcacggggcggcccgccgcccgggactgccggccgtgcatgctccggcacgtcgccgaccggctgcgcgacgccggctacgacagcgcgctctgcaaatccaagtggacgcgctcgccggatatcccttcaggcgagcacagctacgtggaggtggcggtgcagacgaggagcggcaagtccgtgcgcgtggtggtggagctcagcttccgcgccgagttcgaggtggcgcgcgccagcgccggctaccgcgcgctggtgaccgcgctgcccgaggtgttcgtcggccgggccgaccggctgcgcggcgtcgtcaaggtcatgtgcgccgcggccaagcagtgcatgaaggataacaacatgcacatgggaccctggaggaagcacaagtacatgcaggccaagtggctcggcacgcccgagcggggagcggcggcggtggcggcggcggagacgccggtggtggcggttccgtcggtgacggtcggctcgccagagaagcagaccaagttcagggcgtccatgctgaccttcgactttggccggaccgcgctggaggtcgcgtgatgaacgcacatacgctgccggtcgagcggcattagtagttctctaaatatagacagaggaggtaactttcgagaagaaaaaaaagttatatagagtgtacctgggttttaggtttttgtcaggattcagaaagctgaatctgtaatatcaatcgagctaggtgtaaacagataaggcgagcttgtcacgcgtactccgatcgcgtcactgtaatggaaatgaagctaaaagatcatgggtgtcggttcacatgtcagtaacgaaatggataactgataacgttaaattaaaaaaaaaataaaa

SEQ ID NO: 1796 - DNA, 5310 bp, Zea mays
  misc_feature (560)..(560): n is a, c, g, or t
  misc_feature (628)..(628): n is a, c, g, or t
  misc_feature (3782)..(3782): n is a, c, g, or t
gacccttagttgctaaacttatatctctttgaggtgtttgagaacattatagagggttacacctaagacatattcatgtaagctatttctatggacttatccttaggtcctaagattttgtgtccatttcctggggtcatactatcgctggtgggcatagacacattgttctatattatgataggaatccacttcattgtgtatggacccttatctccatgatgttttggctccaataggctcgggccccgatcgcttttgagaggcgcgatcgatgagctttaaggaccttagggccagtagatggtccccatcatttgggtatcactctatgttttggggcctagattgccctcgaacatatacttcataatgacctaaggcatgagtgcctctggggtcttagacttattctcatgagttccccagagcccatgagtccattagggctctctcatgtgcaccctagtggacgagggaacctaggagcttttttcatgagtgccttggggcaacagggccccgagcgattcttattaagagtatcatagggcacgagngactctggggcttattatcatgagtgtctcaggacacgaggggccctgaggatttattattatgagcncccttagacacaagtggcccccacagactttaaactgtagctactaccaggggccaggtctccgagacttatattatccttctttaggctttcttggggacactacgtgccccaagccttaaatcaccctagagtctagtgcccctcagatctttctatgaatttataagtcttagtacgtaattatccatttagggcgccctcgtgtcaaacctcccaagctcctcctttgatcagtgttaagcgaggtctctagggcatggtgcgttaggagcgttgaccccaacatagtaggtcccacaatagcttcatgtaccgagatttttgagtacgtcttcacaaccgtgaggggtataatcttctccgaatgttgacaatatctgtcagtcttgttttgaaaaatttaatgtaaggaacacgatgatacaactagaatgttaattaaatgcttagtttgtaaagtgcaccttttaagaaatccaaaaaatataaatgtttagtttgtaaaccacagtttttaaaaattttgaaaatattcttcaaacactgatcctagttctcactgtcaagcaatgttttaaatgtctggctaagcatcttagcggtgagggtttgaatcagctaaaatggctatagctggcagctaagccatttagcagttttagaagaaaatatgacatatctttatatattagagcacaaactcataaccagccaaatttgttaatatatctaatatctacttcacatttcacatatcaataagcatctaagcatctagtaatgaagaagcaaagaaaacatgggaactggtaacctgccttactgctgctgctgggattccgacatggcgaggaaattgctgtgcgtttgtcaaatgcaggggcttgcttgctacttagagacgacggcttcgctgatgccttgacggcgctccaacgacaagctgctgttgatgtatggtcgtgctgaaacctgaagctgatctggaattatggatgctgcccgcggtggtggtggacggctggacgccaagaggatgcagggcgacgcgtgaggcgtgaagcaaggggctgggcgaagcaacaacggcgactggctgctcgcaacgacggtggcgtgtgcgaagggactggatgtgctcgtataagctagggttaggtaactggtcaacagttcaacactcaacagtgagcgtgcccaccccacaccccacgggttgttgcagttttggaccttcacattcaaacattgagcccaatacctgcgctaaattcaactaagtctatgtgtttagcgggctaaataaggcgattagcgactaactttggttagcgttaaattggacatcttctagcttcagagcttctcaaacgctataaccggctaaatagccgctattagcgggctatttgaaacactgctgtcaagtgggtggtggcgatagccgcaggctctcactgtcaagtgggtgtggatccatgttctcacgggctcgaggagctttggtcaccgtgaagtggcccgggccccctgtttaggcccaaagcctgtagcttaacggcccgggagttcgccgcgagcgcgagcccgacggccccgacaacaaacaacagagcaggacaggatagaccccttgcccttggcaccgcccacccgtctgactgtctgagccgcctgtctcctcctcgttctctcagcccgttcggcgcaatgccaccgccggcgccgctcttcctctcgctcgcctccacgccaccgcctgcgcttatgcccgtacaccaccccagggccccgcaatccctaaccctagtccctccggttgcctcctccagaaaggccgccgccgttcccgcgtgccccgtcgcctccccgcgtcactccgactacttcgatccgcgggctccgccgccgccgcgcggggacggagggtacgggcgccctcccaacggcgcgcaggacgggagggtcttcacgagctacagcatctacaagggcaaggccgcgctgtcattcgatcctaggccgccgctcttcgtgccgctcgatgtaggtagaggatggggtcccggtgtttccgccgtttcctacgcgtattgatgctgcgtgtgcgaatccttgtagtctggggcgtacaaggtggccaaggagggcttcgtgctgctgcagttcgcgcccgccgtggccacacgacagtacgactggacgcgcaagcaggtatgtttttttatacccaacgcaccaatttgagccatttcgggtatggggacagaagagccgacatttgtagcttagctagaaattcaggttgcttttcttgtgttgaaaataaatgttatagcaatttagatgctcaattgtcgactggttgagttgttgcttctttctaagctgaaccagcaactatggaagcaatgtcattcggtccctctgttatctttcctgcttcctatagcttacttgctgtatgtttttgtaaattttgtatataaacctattgattctttgtatccatctatctaacgtggttacatgaacttttttgatgtaattcaatgctatgctatgcaggtgttctcgttatctgtgtgggagataggaaccctgcttactcttggtccaacagattcatgcgagttctttcatgaccctttcaaggggcggaggttggtatcatttaatgtacctgattacctgagttctagtgagtctcccccttgttgtttagttctcaggtttccagaaaagatgctacaaatgcagatcatcatgttatgcatcttgttattctcctaggctgttgaagcataattttttttgttgtctgtccagtggtgtaggaatgcagtgaatcgtcatcaaacttctttcatactgcttgtgccaatctggtttaaggacctgtcattgttgcttatcaactttatttgcttggtgattgaggaatgtattcttgcctctccttttgttgcagttagcaaaagaggggatttgtttcaactgtgttttttatttcaaaacaaaatcttgccagctaatgcaatcttgatttcatccaacatctctaatcaagatttctcgatgagggttccatcacccttcagtcacattatcatagcatcatatatctagactttaagcattttttacatcnttgtgttcatcgtgttttatattttcttccatgatttattgtttcatgtgcatccagccttggcactgtgcatcaagaaaatatttaccacattatttcatcttttgatataaacagcgaagaaggtaaagtgcgtaaggttctaaaaattgagccaacaccagatggcaatggtcgctttttcaacctcagtatgtagttgccaactcattcttacatattttggtttcatcaatttatgctcgcagattgatctgataagcatgtatggctgctaggtgtccagaatcggcttatcaacgttgatgagagcatttacatccctataaccaagggagagtttgctgtcattgtatcaactttcaatgtaagtagcatgccccgtactcctgtttttatcaccaatccttccttgtacaggtgcttctttgcaactagccttttttttcattgttattgtttgaacattactttgcgcttgactctgggttctacacttgtgctcccattgttctgcaaatattaacatgttacatgatttataccatcaatctatattttcaaaatttatgtagtatgtaattgttgatttggttatgtatgtttgccgtgtattcaatcttcatgattttacctctcattactcagttagtcctgccaccttcttttggttaacagtatcatcccaatcttgtgtcagtgttgaatttctgaagtgtgtgagttgctgctaagtgctaacacaaataagcaatgaagctagctttcatcatagccaagagttaacaaacagttgggcaaacagtgcccgtttatttgtgttttataggcaaaacaacatgttgacattgacatcatttgagaaaaaaaaacaatgtctgatcgtgtatcacttgtgcagtacatcataccgcacctcatgggctggagcacatttgtaagttcaatcaaacccgaggagtcacggccatacagcaggccgcagtccacgtctgagtacgaatggcgaaggtgatgtgttgatgaactacagcaaaatggctgagacccacactgaagggatgagattattggtattgtttggctgggtaatctcagatgtggttagttgatggatgcctttttggggtactccttttgtttcctttctagttcagcaggcaggtagcactacttgtatccagagtttcacggggcggttggggagggggcatattttgggcagcaaacctcagttctgacatggaatgacgcagtcacgcagcaggggcggttgtgaatctgctccgtaaggccgtgactccagtgatagcgggacgcagctgacagatgtttgggttgctggggaagggttggcctgaaattgttgcttgcatacacgagattattgtgtacatgtagtctgcgactctgcgttacccccttgatgaaaggccgccctgtgggactgtggtgtttttgctgatgattttgctgaattcatgctaaaaaaaaaaaaaaaaaaaagggcggccgccaccgcggtgga

SEQ ID NO: 1797 - DNA, 1673 bp, Zea mays
  misc_feature (1672)..(1672): n is a, c, g, or t
ggccgggcccgggaaactttatccataatctgaatccggccggcgcttcccaacccagaacacaacagagacagaaccgcttcctctcggaatcgggcgttctgggctcctctgtttcctttcgtcaccgtcctcgccgttgtgttcccctctcagtctcggggttttcttctcgcgggcacctccggctgcttcctttgccaccgcagcaccagcgctgtccatggagcccccgccgctctcctcgttgcaggaggagggggaggaggggcctaccgtcgaggactcgtccgtcttctccgcagccgttgtgccgcctcgccccgccacgcacagccactcgctccacaagtacgcgccgctggactggtccgcctacttcgacgaggagcgccgcgtagccatccccgacaccgacaacgttttcaatgcgtacacgaccggatcggaggggcccgtcgtgttctgcctgcacggaggcggttattcggggctttcatttgctctagcagcaagtcaaatgaaggacaaggctcgtgttgttgccatggatctaagggggcatggaaaatcaacaacgaatgatgatctggatttgtccattgaaactcttaccaatgatgtcatagctgttatacgtacaatgtatggagatttgccaccagcaattatacttgttgggcatagcatgggcggttcagtggctatacatgtggctgcaagaaaagaaattagaaatcttcatgggcttgttgtcgttgatgttgtcgagggaacagcaatggcttcattagttcatatgcagaagatcttagcaaaccgggcacagcattttcctagcattgaaaaagcaattgaatggagtgtcaaaggtgggccattaaggaacatcgagtctgctcgtgtgtccattccatctaccctgaaatacgatgaatcacgagaatgctatacatatcgcactcctcttgagcaaacagaaaagtactggaaaggatggtatgaaggtctttcagacaagttcctatcttgcccagtgcaaaagatcctgttgttagctggtaccgacagactggacagagctttaacaatcggtcaaatgcaaggaaaatttcaaatggtggtgattcggcacactggacatgctatacaggaagatgtacctgaagaatttgcatcgcacatactgaagttcatatcccgcaacaaaatagggcctaacggtgttgagatacctgggctcattaaaaaatggcagcagtagacataatgtacaagttaccgttctggaaaatgttcaggaaaatgatgagtaggtctgcctatccgagttctcttcatatcgaattaaaaaaaggttcaagatgatcatgcgatcgttaacaatcagtcattggtttcgtcatctgttggcaactctcccatgtcgcttgagttgctttgtttctgacatcactctgcgacctgccggcgtcttttgtacgagggttcttgtatgtttttaggtagagctgagtgcagtgcgttgtaatgctttccgtgaggttattatactgctatcaagcaggatcagctcgttatgacagctctgtttcgaatttctgctggcctcggcaagtttgatgggaataaatcgaagaagccttctttgataaaaaaaaaaaaaaaaaanc

SEQ ID NO: 1798 - DNA, 1823 bp, Zea mays
ggcacctcttaattaccctttcggtaccgcgatgccctaactcggtgcttttgcagcagccactcgctccacaagtacgcgccgctggactggtccgcctacttcgacgaggagcgccgcgtagccatccccgacaccgacaacgttttcaatgcgtacacgaccggatcggaggggcccgtcgtgttctgcctgcacggaggcggttattcggggctttcatttgctctagcagcaagtcaaatgaaggacaaggctcgtgttgttgccatggatctaagggggcatggaaaatcaacaacgaatgatgatctggatttgtccattgaaactcttaccaatgatgtcatagctgttatacgtacaatgtatggagatttgccaccagcaattatacttgttgggcatagcatgggcggttcagtggctatacatgtggctgcaagaaaagaaattagaaatcttcatgggcttgttgtcgttgatgttgtcgagggaacagcaatggcttcattagttcatatgcagaagatcttagcaaaccgggcacagcattttcctagcattgaaaaagcaattgaatggagtgtcaaaggtgggccattaaggaacatcgagtctgctcgtgtgtccattccatctaccctgaaatacgatgaatcacgagaatgctatacatatcgcactcctcttgagcaaacagaaaagtactggaaaggatggtatgaaggtctttcagacaagttcctatcttgcccagtgcaaaagatcctgttgttagctggtaccgacagactggacagttggtttacaatttgcagagctttaacaatcggtcaaatgcaaggaaaatttcaaatggtggtgattcggcacactggacatgctatacaggaagatgtacctgaagaatttgcatcgcacatactgaagttcatatcccgcaacaaaatagggcctaacggtgttgagatacctgggctcattaaaaaatggcagcagtagacataatgtacaagttaccgttctggaaaatgttcaggaaaatgatgagtaggtctgcctatccgagttctcttcatatcgaattaaaaaaaggttcaagatgatcatgcgatcgttaacaatcagtcattggtttcgtcatctgttggcaactctcccatgtcgcttgagttgctttgtttctgacatcactctgcgacctgccggcgtcttttgtacgagggttcttgtatgtttttaggtagagctgagtgcagtgcgttgtaatgctttccgtgaggttattatactgctatcaagcaggatcagctcgttatgacagctctgtttcgaatttctgctggcctcggcaagtttgatgggaataaatcgaagaagccttctttgattatctatttatcttccgcttcaacggagccgagatgtgcaaaaaaaaaacaaacatgagaaatgagcataggtacataaagaaaattgagcttagaagaggacaatacaaatctatatgggatcgagtgaaaaaggtaagctctagatatttaatcaattgttttggttactaattatatttgtctaagtgctagggactttatgaaaaaggtaagctctagacatttagtcaattgttttggttactaattatatttgtctaagtgctagagactttatgaagctaagccaaaaaggagcaaaagtgaataagattgaaaaggagaaattgggctggactgcgttgcattggacagtccggtgccaccgaccggacagtccgttgcactgtccgccaaacaggccgctctcaggaattttagcctgcg

SEQ ID NO: 1799 - DNA, 1874 bp, Zea mays
acttcagcaaaattctctctttatgtgtttcctacttcacttctgtgtacgtaatgaagtggaaagacttctttcctaacaaagagctgaaggagccaccatattttgatgctcgagctgtatgttacccgaatttgaagactattcgtgattatttggcttggagacaagtggactgtaagctactggaattgattcaaattatcttgtatagcaaacgccacctcatatttgttcacacaacttttttgtttgccctgaagtcctacaaggaaactgcattatatacaccaaagttgtacaaagcatgaacctttgtgaacataaaaagaaaagtgatctatgtacgtgtcagaatcaaacagtaattttgttagttcactgatatgcatattctttgtttgtgccttcaggtcatataaataatcagtacaacacctgcttctggatgttggtgaaatctggaaaaagtgaacaagaggcccagctagctttgaagggaacatttgcaaaggacaagaatgagctgcttgctaaacaattccaaataaactatgatgatgaactggctatgttccgcaaaggatctagtgtttaccgagagaaggtagaaacaattgtgaagattgatgactatggggagcccataaaaagaccaagattgaaagttacagtggcacatgttgataccatagggactgcgttttgggaaaaccatccacacattcttcgagaaggaaaatttatgcacgggtttgtaaagaaatttggcatcaatcacatattttcaccttgtaattggatcattgttcgcatcattgcttgccaatttgaccaattctcaacaattcattcatttgacaagccaaatgatgagactgcactaaggctgatgaatgaatctgcatctttgatgatggagcaataccctgacattgtctttggctatggttttagcaatgagtatagttttgtgttccatgagaagagtgaactataccagagacgggaaagcctaatcctttcatcatgttcttcatatttcacttctctttacatgacgaaatggaaagagttcttcccctacacagaattaatgcagacaccacactttgaggcagatgctctatgttatccaaaactaaagatcatatgtgaatacttatcatggaggcaagcagagtgtcatgctggcaaccaatacaacacatgcttttggatgctagtgaaatctggaaaaagcgaaaaagaagcccatgagatattgaagggaacgttgtctaaagataaaaacgagttgctttttcagcaattccaaatgaactacaacaatgaacctgctatgttccgaaagggttcatgtgtctatcggcgaaaggtggaagaacttgcgggggctgaggacggcggcaatggcacatcaagagagcggtggcatgtgaaggtggaccacgttgacctagggcccggtttctggcgaaagcacccgtggttaatgactaattgcactcagtagtcccgactgatacatggtttttgtactggtttatcagtgtatgtaactcttgctgacacaggtctagaaacgaaagacggttgtttgttcacacatcgaggcttctcttcaccctctattatgttctgatggttttctgagtcgtcaagaaaaaaaaaaaaaaaaaagcctgaagccttgctagcgttgttttccttctgagctgtgaaaacccttgttcttaatagctgccatgaacgcacgcacctcacgctttgcctgaacgaggtcgaacataccatgcgtgtagggtaatggcgcttttgacaggaggccagaaatgacaattttggatggtgtcttggtttgagcagtagcc

SEQ ID NO: 1800 - DNA, 2762 bp, Zea mays
ctcatcaactagtagcggtattttatcgttttctcttcgaagcacttttgactgacatgttgatccacaggcaaggggtcgccacgtagcttcatcatcgtactaaattcggacttctctctgggacgatcacacgttaccgatgtgcagttgaattcacggacatctgggcccgtatcatgtggggtatccatgtcagtgagagagcaagaatgaggttgggagacgggagtgatcagcccgcccggccggcccggcccggacctccctccggttcggcgttagagtacgggacgggaaagcgaaaccctcacggcgccggaaccccaccagtcctccaccacctcccaattccggaagcgaataaacgccactagattccggccgcggtccctcctccagcgccggcgtcccctcgattggctgcgaaccttgcggcttcgttcgcgcgatcgcagatcggggctggtttgtctagatagaggtgctctgttgcgtaggagagggtgggggcgtcagagctgccggcgttttattttggtcctttttcagccggtgagctgcggctttctcgctaattactcggcgcggcagcagacttgggctgcacaagcttgctatctctggttcaattggcccagcttgcgctctgattgccccccaaaactgcgtgcgtgtctcgcagcgtgctggaattgctcatctgttcgtctggcgaagcaattggctagccgattacatctccggctcaccttgatctcactgcagtctgctgaaatcgcccgtctctgcgggccattgccgctcgcttcattcgtgggttgctgagggcgccttgggggcctggggcctgaatttgcgtggggcagtcttgggaaagcgcaagggaacctttcctcgtgaccatgaatctactggaggagttgatccgggcgatagagctctggctccggattgttaaggagcaggtccccttgatcgatcccacccttgacccagtgttacttgttcctggtattgctggctccatccttgaagctgttgatgatgaaggaaacaaggagagagtttgggtgcgcatccttgctgctgagcatgagttccgggagaagctctggtccaaatttgatgcctccactggtaaaactgtttctgttaacgagaaaacaagaattactgtccctgaggacagatatggtttgtatgccattgacacattagacccagacatgatcattggtgatgacactgtgtactactatcatgacatgatagtggaaatgattaaatggggatatcaagaaggaaaaactctctttggatttggttatgatttccgtcaaagcaacaggctctcagagacacttgacagattttctaaaaagctggagtcagtgtacacagcttctggtggaaagaagatcaatctcattactcattcaatggggggattacttgtgaaatgtttcatctcactgcacagtgatatatttgaaaaatatgtcaagagttggatcgcaattgctgcaccattccaaggtgcccctgggtacataactaccagtctgctgaatggaatgtcttttgtcgaaggatgggaatcaagattctttatttccaaatggtgtatgcagcaattgctacttgagtgcccatcaatctatgagttgctggcaaaccctaacttccagtggaaagacatcccactgctacagatttggagagagaatttggataacagtggcaagaaaagtgccctgttagagtcgtatgagcctgaggaagcaataaagatgattaaagaggctctttccagtaatgagatcattgctgatggcatgcatattccggtgccccttaatttggatatattgaattgggcaaaggaaacttatgatcttttatgcagtacaaagcttccggaatcagtgaaattctacaacatttatgggattgattatgatactccacatactgtctgctatggcagtgaacagcagccggtttcaagtcttagtagcctcttatatgctcagggaaaatacgtctatgttgatggcgacggatctgttcccgcagaatcagcaaaggctgacggatttaatgcagtggcaagggttggggttgctgctgaccaccggggaatcgtgtgcagtcgccgcgtgttccggatcgtccagcactggctgcacgccggagaacctgacccgttctacgacccgctgagcgactatgtcatactcccaacactctacgaaatcgagaagcatcgtgagaaacacggggatgtcacgtcagtagcggaggactgggagatcatctcccctaacgacggcaagaccatgaggccaggcgagcttcctcctatggtcagcacactgaccacgagccgggaaggcaaggagggtgcactggaagaggcgcaggccaccgtggtcgttcacccggagaagaaggggcggcagcatgtgcaagttagggctgtgggtgtcagccatggtggctaaagccgtaggagccactttggttgtctactctatctagcagtagcagctatacctgtctctgtgcacgcactgtaaaattggatgtacatatatggctatgacctctgtagggactctggttttagaactataaatgggcaccctgcctgcttgtaaatgttcagaaccgaaaacacaggccctgttcttttttttccttttttaaaaaaataaaaagatggtaaaggattccatcactcggaagacaaaaaaaaa

SEQ ID NO: 1801 - DNA, 4681 bp, Zea mays
  misc_feature (1927)..(1927): n is a, c, g, or t
  misc_feature (3499)..(3499): n is a, c, g, or t
atgtggtaaatacctcggtaccctcgcgctcccccggcctgtcatcctagcaacctaacatggttgcgacgtgccccaagcttgtttgacttccctgcctgtcatggacaaaacgcattatgcccccacgagattagttgataggactagctgctaggtggttattgcatactggtcttcaccctttctcttgccacctcgggcatcctcagccgccctaaaaaggatacatgcttcatacctagatcatttggtgttcagttttgtttttaagccatggcgaattcccggactggacgttacaagatgtctaatctctcacacacctcaaaggaagatacttcacctgagggttcaggtactaccgagagaactggagcctggagtaacatgttgaacactcttatgcagcaagcctcaatctatggtgtggctgctgggtattgtttatcagcgtcgctgctctcgatcatcaacaaatgggcaatcatgaaatttccatatcctggagccctgacagctctgcagtatttcactagtgttgctggagttctcctatgcggacagctcaagctcattgagcatgacggccttaatttgaggacaatgtggaagttcttacctgctgctgtgatgttctatatctccatcttcacaaacagtgaactcctgcttcatgccaacgtggatactttcattgtgttccgctctgctgtgcctatatttgtcgcgataggagagacgctgtatctccatcagccatggccatcactcaagacatggctttcactctccacaatacttggtggaagtgtgatctatgttttcacagacaaccaattcactgtgactgcttacacctgggcagtggcctacctagcaagcatgtccattgatttcgtgtacatcaagcatgttgtaatgaccattgggctgaacacatggggccttgtgctatacaacaaccttgaggccttgatgctattcccactcgagcttctcgtaatgggagaatttgatcagatgaaggtcgacagctccaaagtgtcaaactggctttcatttgatgtggtcctccctgttgctctctcatgcctgtttggactatcaatatccttcttcggattctcctgcagacgagctatttctgctactgggttcacagtgcttggcatagtgaacaagctcctaactgttgtgattaatttgcttatctgggacaagcatgcctcttttgtgggtaccattgggctcttgatatgcatgtcaggtggtgtgctctaccagcaatccaccacgaaaccgaaggcacccaaggttgagccgaaggaagagaacgacgaggagcagcagaaattgctgcagatgcagggagttcaagagagttcataaaccttacaaagaaagtacaactacaaagaagcatatggctagtactcggaaagaggacagcctcacctgagcgtttttgtattggctagtacttgggaagaagcatatggatgaatgtagtcatgaactaggagctacaaaatcccatgttttagatattagaagtcatggaggggacctaattatcactgtgcaattctttattactatactaccacttccatttgtaacgcaaaattgttatgataggatggcaaatatacctgcatcgaatacttcctatacgaaagcatctatctcatacaggtcggtgacggtgacactatgatctatgtttagtcatttctctgctggagtttccctatttgttctgtaccttattgttggtgatgaagccattggttcttttgctgaaaagaaagttttgtaatcatcgatgttggtgcataagggcagctccattgtgctttctaagccggtgcaaagagcacagtttttttatttgtttgggctgcaaggagtttacacattgganaccttttatgtttctaacaaagcacacgttgacgtgacaattttgtagtaccttgttatgagaaaatcctgtaactctgcaattttgtaccttgtcaaatatgatgctattgaagtaactttgcttgctcttggcgtatgcattgcaattttactgtgctcccgggcaaattttttactgtgctgaaaatctgaaagcgaagccgttcaagtagctttgcttgggcacttggcaacgtatcccatcaggacaattaaaataacgaccgcattaaaatgataatagtagagttggctgttgtgcaaatactactttgaagtccccgcaagaagaaatattgatgaagtcttcgaatagaagaaccagggttcgtaaaaaatgcaagtgtagtgtaggcacaactgtctttgcggtaaggaatgtcagaatcggtttgattctcttttctaaagtttaaacctctaaattttttaaagtactttaatagagtgttcggaactgcttaacctcataatttgtatcgccgtcattgcggcctttattcattcccaacttccgtccgatccatttgcggccgagattctcccaagatgtggtttctattctatcgccgtcattgcgctctcctcccgttgtaaacccaaagaccttcgtcgcacggacccgtccttgctaattgctcactccatcggcgccgggtcatcctcgtggccccgtgccgcaccgcgaaaccaaaatctcgcaatcctaacctaccccagcgacctagcgccgtcgtcgctcgacctcccctcgccgcgccgggccccccagagggtctcaggccatagcgaggagccggggttccgctccgacccgaatccgagcctcccccaggacgcagcgggtctcgtttccgtactcgtagcaggtaatcgcggagctctcctcctcctcgttctttgctctgtcagtggcgatgctactactattggttcgatccctgcttaggtttgatctagggtttggagtttttgaggtgatttcattatgccaatcgcgttatcgcgcgtagttttgttttggttttaatcgggcgcttactgttgacgaggtctgattaaaatttcaactttccaggaagtttcgcgcgagggattgattgtcgagctagagatgtacgggcagggagggagcttcaatccacactatcgccatggcccgcctccgccccagcagcaagctggggtaactgggtccttcccccagcaacctgtgccaccgcctcggccaccttacccacagcaccctggagtgcggcctccggctgggccgtaccagcatggcgtgctgccacatcagaaccagccatacccctttgcgcagcatggtcggatgcaccagatgccaatgcttccgccacagcagagaggttatgggtcgatgccaatgccagggtcgctgcctccgcaacaagctatgcatcaggcccctccacagtatccgcccctccctccacctccacctcggccgcctggctttgttcatgataatgtgctgcctccatctctgcctcctcctcctcctccttcnccaccaccaccaccaccaccaccaccaccagaagcagcagcagcagcatcatattctcctcctcacacacttgttgttgcacagtcatgcggcgcagaggcagaagcaaaagaaggtgcatctgaaggtggtcgttttgccaaaactctggaagcagctactcagctaattgtttctgatgactcagatatggacatggatggttagcactcccctttccctcccctatctcagtacagtgatactattactctgtttgaaacttgcacattatttacactgctgcatttggtgtcacagcaatgtcatctgatagtccatacggtgaaaaacatcactgtgcatgaatgttgtacctgactttggcattttagattatttttcacttcgacatgtttctaaacattgactttgtaatgcaatttccaggggatgaggactctccatcaaagcagccccttaccccagaaacttctttgcctgtgactgttgaatgtactggaaatgttaatgtgtcaaagttcagtgatgtttcaactgaggacaatgctaaaactgcggatgcaactgaggacaatgctaaaactgcgcatgcaactgaggacggtgggagcacattccaactgatacaaggttatggctccgatgacagtgcaaatgaggctgatgctggtcctggcagtgctaatacccttgtgacattgcctgaagataacctgcatggtcatttaagtgatagtaatactgagtttgattatcagaaacatgttaatgcaaaaggaaatgtgaatacccctcatggcactgagcaaaatggtaaggctgaaaattatcatctcaaggttgagagcaacccagtgaagcatggcacagatgtacttgggcatctggccaaagaagatacaagtggcagtgaaattgagggaggtcaaagtagtaaaaggcatgggaggatacaaaagaaacgaacccggagcatctcacctcagggtagaagtggtagtccagtgggggcaaacaagagcagtccatcccaaaggtatggtgcctctgccttgtacctaccttgaattttaaatagatgcatcagttcatctgtgtaattgtatttccgtattttagatttgttataagttatggcatccgatatggtatatcttgtttcctttggaagtctaaaag

SEQ ID NO: 1802 - DNA, 3303 bp, Zea mays
gtaataagtttactgtgatgattgatgaatgatgatatctctggcgtcatgcccgctcgcggctcgcacctagcagtgtcgccgcctcgccgtggacgacggatatcgcgggcgcggcacccccgttcccgtcctcgttcgcttgcctgatcagatcctcatctggccgttcacgaaggcacgcagccgagctcgcagcgcacgcaggggcggggagaaccggataagtcagaaggtccaccccgcgacgcgaccgcgacccgcgaggcgggcgagcccgccgaggcggaggagggcgcctcgagatctcctccgcgcggctcgcgggtcagaagcagcgaagtcgcatttgtaaattcatcatcgtccccgactccccgcctgcaaaaattctgctgtggcctcctgccctcctcatttgccttccattgcctgaaatcccaattccgagattcccaaattgcaggaccccactgctagtgctaggttcccactccgcgcgcgcccagttaacccccgtccgcggccgcgggttgactcgcaatcggaatcgcaagcgtccggatccgggctcacacctccgaccgacagccaccgcgcagaaaacaaggcggagacccggcgataaatccccgcgccccatccttttccgttccccacaccaccaccgagttcaccggggctggaggaagcgtctacaagacaaggatcagcatcgcttcatgtgactgattggttggttgcgccggcctgcgaggatctagcaccgagttcagggagcacttcgtgagacttgttcattcgtcttgaggtgctggagccgtcacgttgtggtagttgagaggaacctgtccaatttccatagttgcgaggaaagattcctgagatgtctactctctcagacccctcaaaagaagatacttcacctgagggttcaggtactacccagagaaatggagcctggagtaacacattgaacactcttctgcagcaagcctcagtatatggtgtggccgctgggtattgtttatcagcgtccctgctctcgatcatcaataaatgggcaatcatgaaatttccatatcctggagccctgacagctctgcagtacttcactagtgttgctggagttctcctatgtggacagctcaagctcattgagcacgatggacttaacttgaggacaatgtggaagttcttacctgctgctgtgatgttctacatctccatcttcacaaatagtgaactcctgcttcatgccaatgtggatactttcattgtgttccgctctgctgtgcctatatttgtcgcgatcggagagacgctgtatcttcatcagccatggccatcgctcaagacatggctttcactctccacaatacttggtggaagtgtgatctatgttttcacagacaaccaattcactgtgactgcttacacctgggcagtggcctacctagcaagcatgtccattgatttcgtgtacatcaagcacgtcgtaatgaccattgggctgaacacatggggccttgtgctatacaacaatctcgaggctttgatgttattcccccttgagctccttataatgggagaatttgatcagatgaaggtcgacagctccaaggtgtcaaactggctgtcattcgatgtggtcctccctgttgctctttcatgcctgtttggactatcgatatcattctttggattctcctgcagacgggctatttctgctaccgggttcacagtgcttggcatagtgaacaagctcctgactgttgttattaatttgcttatctgggacaagcatgcctcttttgtgggcaccattgggctcttgatatgcatgtcaggtggcgtgctctaccagcaatccaccatgaagccgaaggcgcccaaggttgagccgaaggaagagaacgacaacgacgaggagcagcagaaattgctgcagatgcagggtgttcaagagagcaatccaactcagaaataaagctcttcataaaccttacaacgaagtaatgctttgatggattaccttctttgcaacagcctcacctgaaacgtttttgtattggctaatacttggaaaaaagcatatggatgagtagtcatgaattaggagctacaaaatatcatgtttttgatattagaagtcgtgaggggacctaattatcactatgcaattctttattactgtattaccacttacatttgtaacgcaaaatcgttatgataggataccaggtactcggcaaatacctgcattgaatacttcctatacaaaagcatccgtctcatacagttcgggggtgacagtggtagtatgatctgtttttaggcatttctctgctggagttagcctatatgttctgtaacttattgttggtgatgaagacattggttcttgtgctaaatagagttttcttatcatcgttgttggtgcatgccgccggcagctgcgttgagttttctgagccggtgcaaagagctgagcacacggtttttttgtgtggactacaacgagtttgtacattggagatttctccagactgaagcatcccacttcccagtgagactgccatcctccttggccataccgccatacagatttgttcccagccaatcaatcggtataatttggtagtccgccaagcaccgagttatgtcaaccttcgctgttagggctggtttggtgacagtgatttgcaggggattctccttgctattcaaaattaacctttatagatcctttcatagattctctatatttctctgatcactaaattagctctcagatgtgagaatgtcaacagccgccgcggcttggtgtcaaagccttgcccttccggcgttgtttccggtgtgcccccctcactccttgatgaacaggccgggttgttcttggcagagttgccgaagcatgaactctcatcctacaaacagactctcatcctacaaacagtgtgttggagtttcttcgaacagatccagtagtagtatgataaacgagcagttgtgcaacaacaatacgatgaactctccttattttgagcaagaagaggggaataagcttctttcaacttcttatgagtttaaataagagcctcatgagtagttagatgctcctaaaaagggttgttcaagagctttgtgcttcttgagcaattctttgggttcttctctcttcttgtttaaaatggaatgaacatattgtaatagctcaatgagtttctccttaaagggcttctcttcatcctcactttcactctcattgtcactctcattgaatagtaccttaggacc

SEQ ID NO: 1803 - DNA, 2023 bp, Zea mays
cattgggtccctcgaggccggccggggttcgcttgccacttattagatcagggggcggggaagaacatgacaaatcggaaggttcacgcgtgcccgcgagcgtgccacgcaagggcgagggagcccgcgaggcggaatgcccctcgagatctcctctgcgcggctcgcgggccagaccatcagaagcagcaagtcgcattagtaaattcaatcatcgtccccgcctgcaaaagatctgccgtggcctcctcgtttacctattgctggttctcaaatcgcacgccctcactgctagtgctaggctccccttcgcgcgcgcgcgcagttattaccccgtccacggccgcgtgttcgcaagcatccagatccggctccccacctccggcgaccaccgcgcagagaacaattccgtccaacgggaaaccccgcgataaatcgccgcgcccatcgtttggcgtccccccacagcaccgaattcaccagggctggaggaagcgtctgaaagatgtctaatctctcacacacctcaaaggaagatacttcacctgagggttcaggtactaccgagagaactggagcctggagtaacatgttgaacactcttatgcagcaagcctcaatctatggtgtggctgctgggtattgtttatcagcgtcgctgctctcgatcatcaacaaatgggcaatcatgaaatttccatatcctggagccctgacagctctgcagtatttcactagtgttgctggagttctcctatgcggacagctcaagctcattgagcatgacggccttaatttgaggacaatgtggaagttcttacctgctgctgtgatgttctatatctccatcttcacaaacagtgaactcctgcttcatgccaacgtggatactttcattgtgttccgctctgctgtgcctatatttgtcgcgataggagagacgctgtatctccatcagccatggccatcactcaagacatggctttcactctccacaatacttggtggaagtgtgatctatgttttcacagacaaccaattcactgtgactgcttacacctgggcagtggcctacctagcaagcatgtccattgatttcgtgtacatcaagcatgttgtaatgaccattgggctgaacacatggggccttgtgctatacaacaaccttgaggctttgatgctattcccactcgagcttctcgtaatgggagaatttgatcagatgaaggtcgacagctccaaagtgtcaaactggctttcatttgatgtggtcctccctgttgctctctcatgcctgtttggattatcaatatccttcttcggattctcctgcagacgagctatttctgctactgggttcacagtgcttggcatagttaacaagctcctaactgttgtgattaatttgcttatctgggacaagcatgcctcttttgtgggtaccattgggctcttgatatgcatgtcaggtggtgtgctctaccagcaatccaccacgaaaccgaaggcgcccaaggttgagccgaaggaagagaacgacgaggagcagcagaaattgctgcagatgcagggagttcaagagagttcataaaccttacaaagaaagtacaactacaaagaagcatatggctagtacttggaaagaggacagcctcacctgaacgtttttgtattggctagtacttgggaagaagcatatggatgaatgtagtcatgaactaggagctacaaaatcccatgttttagatattagaagtcatggaggggacctaattatcactgtgcaattctttattactatactaccacttccatttgtagcgcaaaattgttatgataggatggcaaatatacctgcatcgaatacttcctatacgaaagcacctatctcatacagttaggtgacggtgatactatgatctatgtttagtcatttctctgctggagtttgcctatttgttctgtaccttattgttggtgatgaagccattggttcttttgctgaaaagaaagttttgttatc

SEQ ID NO: 1804 - DNA, 1774 bp, Zea mays
gacttccctggctgtcatggacaagcgcattatgccctcacgagataagttaacagggctagctgctaggtggttgctgcatactggtcttccctctttctcttgccacctcgggcatcctctctggcttagaaaaaaaatatgcgcttcatagtccatacctagatcttttggtgttcagttttggtttcaagccatggcgaattctcggattggacgttacaagatgtctactctctcagacccctcaaaagaagatacttcacctgagggttcaggtactacccagagaaatggagcctggagtaacacattgaacactcttctgcagcaagcctcagtatatggtgtggccgctgggtattgtttatcagcgtccctgctctcgatcatcaataaatgggcaatcatgaaatttccatatcctggagccctgacagctctgcagtacttcactagtgttgctggagttctcctatgtggacagctcaagctcattgagcacgatggacttaacttgaggacaatgtggaagttcttacctgctgctgtgatgttctacatctccatcttcacaaatagtgaactcctgcttcatgccaatgtggatactttcattgtgttccgctctgctgtgcctatatttgtcgcgatcggagagacgctgtatcttcatcagccatggccatcgctcaagacatggctttcactctccacaatacttggtggaagtgtgatctatgttttcacagacaaccaattcactgtgactgcttacacctgggcagtggcctacctagcaagcatgtccattgatttcgtgtacatcaagcacgtcgtaatgaccattgggctgaacacatggggccttgtgctatacaacaatctcgaggctttgatgttattcccccttgagctccttataatgggagaatttgatcagatgaaggtcgacagctccaaggtgtcaaactggctgtcattcgatgtggtcctccctgttgctctttcatgcctgtttggactatcgatatcattctttggattctcctgcagacgggctatttctgctaccgggttcacagtgcttggcatagtgaacaagctcctgactgttgttattaatttgcttatctgggacaagcatgcctcttttgtgggcaccattgggctcttgatatgcatgtcaggtggcgtgctctaccagcaatccaccatgaagccgaaggcgcccaaggttgagccgaaggaagagaacgacaacgacgaggagcagcagaaattgctgcagatgcagggtgttcaagagagcaatccaactcagaaataaagctcttcataaaccttacaacgaagtaatgctttgatggattaccttctttgcaacagcctcacctgaaacgtttttgtattggctaatacttggaaaaaagcatatggatgagtagtcatgaattaggagctacaaaatatcatgtttttgatattagaagtcgtgaggggacctaattatcactatgcaattctttattactgtattaccacttacatttgtaacgcaaaatcgttatgataggataccaggtactcggcaaatacctgcattgaatacttcctatacaaaagcatccgtctcatacagttcgggggtgacagtggtagtatgatctgtttttaggcatttctctgctggagttagcctatatgttctgtaacttattgttggtgatgaagacattggttcttgtgctaaatagagttttcttatcaaaaa

SEQ ID NO: 1805 - DNA, 1317 bp, Zea mays
ttgggtacctcgaggccggagttcgtggagtggagtcaccacagaatcaaagaaaagctttcccccgatcctctcgcggacaccagcgatgggttcccgctacgaggtggaggtcaccgtcggctccgcccgggacctcaagaacgtcaactggcgcaacggcgacctcaagccctacgccgtggtgtggatcgactccggcagcaagtgctcgacccgcgtcgacctcgacaacggcgagagcccggcgtgggacgagaagctgctcgtcccgctcccgcccacctcccgcctcgacgacgccgtcctctacgtcgacgtcgtccacgccaacgccgcccagggcgtcaagccgctcgtcggctccgcgcgcctcccgctccgcgacgtcctcgacgacgccggggtcgggggcaaggcctcgcgcagcctccgcctcaagcgcccctcgggccgcccccacggccgcctcgacgtccgcgtcgccgtcaaggagccgtccaggtactacgaccccaacccctacccggcccccgcggcctacgccaacacgggcggcggcacccgtgacccctacggctcgtccgctgctgctgccggcggctactacggctccggaggcggatacggttccggtggtggcgcctacggtggcggcggctacggcgccgcgcagccctacaccgcagcgcccccggcggggtacccttccacctacggcgccgcgccgccgcctcagccagcggcagcgtacggcgctcctcctgccgctgcatacggcgctcctcctgtcgccgccaccgccgcgtacggaaccggcgccgttgcttccgacgggaagaagaagaacaagatggggatggggacggggctggcagtgggcgcggcggcgggcgtgctcggagggctggcgctggccggcggggcgagctacctggaggacaagttcgaggagcgcgtgtcggagcgggtggaggacaacctggagagggaggagtcgtacggaggcggcggctacgggggtggctacgacgactatggcggcaacgacgactatggcggcgacgacgactactgatgggtcctgatcctccgatcgtttgcccggctgctacgcttgccatccaccttcaccttcgtcttgctgtcctagatgtttgctgtatcaatcgcatgttctctattcctgccttcagtttcttttctcagttgtggtttatcgaggcggggttgatgttgagatttgagatcctcacctgaggaatggaaaaatgctaaattgattaattcggttgcgaaaaaaaaaaaaaaaaaaac

SEQ ID NO: 1806 - DNA, 3256 bp, Zea mays
  misc_feature (304)..(304): n is a, c, g, or t
tccaaggggcaagatgctctttttgttttgaatttaacacccttatagcccccaaaaattgatgaaagcatccagtataggaaacaaaagatggtataaataatatataggaaagattttaagttttagtgccaaatctagaagaaatatattttagcatcaaatataaattttatccattcatattgccacaactacatagagtcatagacatctacatgtgtggtggcgggctttgaacttctgtgatctatacttgagcgtgacatcagactcaaaatccaaataactgttttttagtcgnaaggcttacatggaaatctaaaaaaaataatctatacttgagcgtgacatcagactcaaaatctaaataactgctttttagtcggaaggcttacatggaaatttaaaaaaaattaagcactcgtaatatatttactaatagtcagttactcgtgctatgctatagttgttatatatcatataaatatgtagtgaaatatttatttaaatataattattgttttataaacactaagttatgtgtggtatgatggttagcctaaatttttgaaacaggggagcgatggtgtccataaggcagtagctaagagagcgctgcacgggcgctagacgtcgtgtccacacagcgcacgacgtcgaggcggggcgcatgcggcaggtctagagtgttagtgccaaaggtgaaacgatggtagtactagttaaccacgttaggttcttaatatcatagagatagaattctttcacggtgctatggaacccgtttttagaagaactatttttgttcaccgcagtgccatttcatcttcggctgcatggcgtttctttattctaaattattacatgctaagtttaaaaataaattaatggacgataaatactcgaaaacggaagcagtatataatcacaacaaattaagtgtcaacttctggcgcagaaattcaaatgaaggtttaaactcgggccgcaagttgctcgggtaggccgggtgcgtgaactggtcagcacagcgtagctaaaatattggtgatgcagtccatgtacatacgtagcccagtgttggatgaataataatcaacgttagactaccgtggaaggaaagaaaagaatgcacggtagaccgagcctgcgtgcacctaacggggggcaatgtcgtcattccttaatagccaagcaaacgagacagcgaattgaaacagcaccgcagaccaggaaaagaccgcaggcattgctaatccaagagggaagacgacgagcaaggacacggccgtggtagccgttccgtttcgcttggggtggttgggtgggtgaggtgggcccgcattgaagccagaagcgaagccaccggtggtggtgcagaccgcagacctgggactctgggagggaggcgagcatcttcccctggcaagtggcacacgcgcacacagtaggcacaggtttggaagccgcgtggagactggaggggaaggtcccgtcgtctccaccttccccactggcaccgccccccagccgagccgccacagcccacagggcaggcagcccgtgcccggcgtcgttttcccggaccccgcgtgcgtgctaacattcgcacgtcaagtccgtatttataccggccgcctacctcccggtgcctgccgcagttcgtggagtggagtcaccacagaatcaaagaaaagctttcccccgatcctctcgcggacaccagcgatgggttcccgctacgaggtggaggtcaccgtcggctccgcccgggacctcaagaacgtcaactggcgcaacggcgacctcaagccctacgccgtggtgtggatcgactccggcagcaagtgctcgacccgcgtcgacctcgacaacggcgagagcccggcgtgggacgagaagctgctcgtcccgctcccgcccacctcccgcctcgacgacgccgtcctctacgtcgacgtcgtccacgccaacgccgcccagggcgtcaagccgctcgtcggctccgcgcgcctcccgctccgcgacgtcctcgacgacgccggggtcgggggcaaggcctcgcgcagcctccgcctcaagcgcccctcgggccgcccccacggccgcctcgacgtccgcgtcgccgtcaaggagccgtccaggtactacgaccccaacccctacccggcccccgcggcctacgccaacacgggcggcggcacccgtgacccctacggctcgtccgctgctgctgccggcggctactacggctccggaggcggatacggttccggtggtggcgcctacggtggcggcggcctacggcgccgcgcagccctacaccgcagcgcccccggcggggtacccttccacctacggcgccgcgccgccgcctcagccagcggcagcgtacggcgctcctcctgccgctgcatacggcgctcctcctgtcgccgccaccgccgcgtacggaaccggcgccgttgcttccgacgggaagaagaagaacaagatggggatggggacggggctggcagtgggcgcggcggcgggcgtgctcggagggctggcgctggccggcggggcgagctacctggaggacaagttcgaggagcgcgtgtcggagcgggtggaggacaacctggagagggaggagtcgtacggcggcggcggcggcggctacgggggtggctacgacgactatggcggcaacgacgactatggcggcgacgacgactactgatgggtcctgatcctccgatcgtttgcccggctgctacgcttgccatccacctccaccttcgtctcgctgtcctagatgtttgctgtatgaatcgcatagtagatcatgttctctattcctgccttcagtttcttttctcagttgtggtttatcgcggcggggttgatgttgagatttgagatcctcacctgaggaatggaaaaatgctcacctgaggaatggaaaaatggtaagggcttgttcggttattcctatcccatgtggattggatgggattggaaaaaattatgaaagattttaacttgtttgagattgaaatccatccaatcccacctaatccacatgaattaagagcaaaacgaatatgccctaaattgattaattcggttgctactccttcgtcttggcaagtttaggatgtatcaatttgtgcgaatagttgatgttaccaaaggttccacgctagggagacaccaggggagagcttcgcgcgtggaagccatttctctacagtaacttacggtgacc

SEQ ID NO: 1807 - DNA, 1360 bp, Zea mays
gcacgagaccattacctagaacatcctaatcgaaaaataggcgccggctgagcgaggtcttcatctgcgcttcaccagcgacgattatccactagtttgggttgcctcctgctgattgctaggtaggggagcatccgatcatgtcgagcgcggcggtgaacgggctgtccggcgccggcggcggcatcatcgcgcagatcatcacctaccctctccaaaccgtgaacacccggcagcagacggagaggtcagcgaagaagaggaaggccaggagcggctccagcgccaccccagcctccaccatgtaccagatgctccagctgattcaaaccgaaggatggagtgggttgtacagcggcctcaagccctctctcatcggcactgccgcgtcgcagggaatctattactacttctaccagatcctcaagaacaaggtggaagatatagcggttgctcgtagcaagaagggccttggggatggtactgtcgggatgctttcttggcttggtattgcagctgttgctgggtcaatcaatgttcttctaaccaatccaatatgggttcttgtgacacgtatgcagacacatactcaagcgaaaagaaaaatattggagtctaagagggagcttttactgaaagaaatgtctagggcgaattcgttggaggttgcagttctgaaggataggctggttaaattggagtcagaaaaagctcgtccatatggtactcttcaagcgatccaggaggtttaccatgagtctggtataagaggattttggaaagggcttattccaacattaatcatggtatgtaatccatcgattcagttcatgatctatgaaacattggcaaagcgtctgcagtcaaagcgttctggaaagcagctaccaaaaaggcacctcacagctatggaggtttttttattgggtgcattagcaaaacttggagctactttagtcacctatccattgctagtcgtgaagtcaaggttgcaggcaaaacaagaaattggcagcaatgtgatgtccagatacacgggtacaatagatgcgataataaagatggttcgctacgaaggactacacgggttttacaaaggaatgggcacaaagattgtacaaagtgtctttgctgcctcggttctctttatggttaaagaggaattggtcaagttagcagtgcttttagttgggagtagtaggactattcttattactacatccaagaaacaataggtggtcgtgtatttgggagaaaagttctttttttttttttgcctcaacttgtaatgtatagggtcccattatacatatcctgttcaagatcaatatgaaattctttactggttactagggaaaaa

SEQ ID NO: 1808 - DNA, 4488 bp, Zea mays
  misc_feature (565)..(565): n is a, c, g, or t
aattcggcatcgccgggctccccaacccaatcctccagctgcggaatggcggcggcggagccgtgctgcatctcgcacgcgttcgagcgcgccactcgccaggaacccggccgcctcgccgtcatccacgcagcggcctcgggcgccgacagcgaggagcgccgcttcacttgcggcgacctcctcgccgccgtcggctccctctcccgccgcatcgccgccgcgctcggcagcaccgccaccgatacccgccgcgaccgcgagcaaggctcagggtttcgggccgccggcgccgtagtgccgagggttgtcggggtgtacgcctcgccgtcgttggagtacgtcgccgccgtcctcgcggtgctcaggtgcggcgcggcgttcctcccgctcgacccgtcgtggccggaggagagggtctcgtgggctatctcggcgtccaacgcggcgctcgtcgtgtcttcagttgggtcgcgaggagccacgctgtttgagagcagcgcctgccctgttctgcgcttttatggtggcatccggcggcgatttcgggatggaaatggcgggngatgacggggaggagcttgtctggccgtgcgagcacgagtggcaccgcaagttctgctacgtgatggtcacctctggttctaccggaaaaccgaagggtgtttgcggcactgagaaaggtcttctgaatcgttttttgtggatgcaaagaaggaatcctctgtgttcagatgatgttttgttgtttaagacatctgtcagctttgttgaccatctacaggagttcctttctgcggtcttgacttgctcaacacttgtcattcctcccagtgagtggagagctaatccagcatccttggccaacttaattaaggtttatcggatatcaaggatgacattggttccatcacttatggagataatactacctaccctggcggaaaaactttctgatggctgtaacccacttaagatcctaatatttagtggggaagttctgtctgtatcgctgtggaagagagtctatgaatttctgccagaggctactatcataaatctgtatggaacaacagaggtttccggtgactgtgcattctttgattgcaaaaaattgcctacaattttggagcaagaagaactaaacagtgtaccaattgggtttcctatttcaaattgtgaggtttctcttgtcaccaatgatggactatcagatgaaggtgaaatctctgtcagtggagcatgcttgtttactggatatttagctgatcccatgacaagtaactgccctgaaggcagtgaagttttagcatactacagaacaggtgactttgcccggcgcctaaagacaggcgaacttattttccttggaagaaaggaccgaattgttaaaatttatgggcaccgtttctcacttgaggaggtagaatccacattgagggatcatcctgatgtcagtgacgctgctgttacttttcaaagtaatggatctctggattttaaggcatacttggtgctgaggagtaataataaatttcttaaatgtactcagggttatagtggattacattcttcccgagatatcattgcaccacttcgaaactggctcatcatgaagtttccactagctatggtcccaaggctttttatccccatgaaatcattacctttgactttgtcaggaaagattgactatgtcaagttatctagcttggtttgtgcatttgagccttgtgaaattcatccagaaagcagtccagctgatcctcatatgcaagttatcaaaaaggcattttctgatgccctactggttcatgaagtgtctgagtatgatgatttcttctccttgggtggtaactcaattactgcagcacatgtggcccacaaattggagattgacatgagattactttatatttataccaccccttctaaactttttcatggtttacttggggaacacagtcatgtaattcctccaactcctgaatttcacaacagaaagaagttgagaaaatatgcaagcatatcagattcctttggcccagtttctgaatatttggacagtaactttcatgaccaagggcagataagtaaagagggtgcatacgatcactttgcagggaatcattggcagaccatggatactaaattttcacttacaaaaggtgtggtctattggccgttgcaatagatttatgcatggttctgaagggatggtacaccttgaagatatttgttcatatgttccatataacaaaaagggttacctcgtgaaaatttggagcattcttctagattcatgtgttgatgcctcacctttgcttgtcataaacaatggaatgatgtccatctttattggttctcattcatatttgtttctttgcattgatggttataggtgagtgttgcctattacatggaattctatgcttctttttttctgatgtacctcatgctctatttttctatcatttaagattattgtatcagtaatttgtttaaattatatttgatgagaaaattagtaccatctggtgtgtggatactgacttttcttagaacttgtttcctattggttttgtagtggttcagtgaggtggagtgtcaaattggaaggccgtatcgagtgttctgccgctataactggtgatttctcagaggttgttgttggatgctataaagggaaaatttacttccttgatatgtctacgggaaaattatcctggacctttcaaactgatggggaggtaaaaatgcaaccagttgtggacaagatgaggaatttaatatggtgtggctcgtatgaccattacttgtatgcgttaaattacaaagatcgctgctgcacatacaaagttttttgtggtggaagcatttatggatctcctgctattgacatggcacaaaatgtaatctatgtcgcatctacgagtggccttgtgactgcagtatcatttaaggaaccatccttcagagttctttggcaatatgaagctggtgcgccaatttttggttctctcgccatagatcatcaaagtggaacagttatttgttgtttagtgaatggcctagttatgacattgaactcacaaggttctgttgtttggaaggcaactgttggtggtcctatttttgctggtgcatgtttgtcacccaccctccctcatcaggtgcttataccttcccgtgatggcaacttgtactcttttgatactgtgtctggtgcccttctttgggtatacaaggctggggatccaattactgcatccacttttgttgatgagctgcgggcatcagtgtcatttggaccatctgagagatttgcttgtatctgcacgagttccgggaaggtccatgtcatcagatttagagtagacatcagaactagagtagatgctaagtacaatcaggagcaaggtggtgacggtgttaaatctgaggagttagttcaaggactggatgctaagtacaatcaggagcaagctggtgaaggtgctaaatctgaggagttagttcaaggactggcatccattgatcttccgggggacatattttcgtctcccttgatggttggtggacgcatctttgttggatgccgagatgatcgattacattgtctcaccgtcaccacatagtttcaagtgattttgctggaggtgatatagttttgcccatgcctgctgcccgacaacctctcttccgcgacaagggcctttggcctttcctattggtaaggtgcgtggcaggctggcagcacaacacaggccacgaatgagtttggttgaagctcctgattgcatttggtgatttgggtctccaatgattgctttccatgtctacacaagaagctttccacagcctgctctcgcctaagcaagtgctacttgatgtcttgatcaaagtgagtggaaacctctcaacctcacattctccttgcagcatctgtattcagcccatgtggaacctttgccactgtcctgcaaggctggtcagtcatgccgctgttcccttcagtggaaattaactgataggaagaccagtgatttgcggagactgtaaaaattgttccacatagatctatactatttcctaaaaggagtttatgacagggacaatattctccaagaaatggttcgagtcgatccagcttcctgcaccagaaatgtactagtctctaggagtagaagttttttctttgcattaggtttcatgtttttttacttaccttgcatgcttccagaactctcgctgggaatgcacacatttttcatttcctttggctattagtagggatgccaacggagaattccccgtcgggttttggctccccctggctgtacgatccccgcggggatccctacgaactcttcctaattccccgttctctcgcggggataaattcccgtcggggatctctgtccccgtttaaattataatcatgatatacttttttttgttatgaatacaaaatattgtcacttgtat

SEQ ID NO: 1809 - DNA, 2660 bp, Zea mays
aattcggcacgaggccaaatgtggttaaagttaggaacagtcttctccctgaaattgatttagtgatttcaaacagacttatatgtgtgttgcaggtatggttattctactcatggaagatctacagggaaggtatcttttgttcttatattttggttgcttaacaaataccttatgtagaaactataatcttctctctaaccatatcttagtggaaagtttattcttccattgaacatcccactgagtgtaatgcatatgcagaaatgcatatgcagaaattgaggtagcatataactgccgcaagggaaaatatggtgtagcagatgaggatataatcttatatggtcaatgtgtttgaattggtccaaccattgatatttcttcgcggttgctagacttgagagtcgcagttttgcatagtcctatattctatctgcactaagagtaatatatacagccaagcggacgtttggtttaacatttacaaggtatgtttggtccttttgttttttggaattaatggttgtccgatgcttgtcattcatatgagttctaatatcatgcccccttaaagtactcatcatcaaaagtttccatgtgaatgttttaaatgtagatttaaagggttgaaagacatcaaacagttattcaaacatgatcttaagtgtcgtgaaagactacaagtgaggttcaacttggcaaattgtttttctagtaactaaggagcaacaatgctatgtattttagcttgacttatatatctaagtacttacatttttggaatcgggcaaacagtgatagtttgaatcacatgttttgccaaaaggaattattagaactgttcaaaagttaggaaaaaatacatatttatgctttcttatgcacgggtaaattgctctgttcatatataaaaaaaataattgtagtattattgcttatattgattttaaatgatgaccttattagatgtgccatcgagaccacatatattagcattttgtaactaaatacaatgcatgaatatatatagatagcctttacatcgtgctacatgcttcctagaaataaggaaccattacaacatatatatttttgatgatgtacaacttcgtcatcggatataccgttccttcttttttacatacattttgataagaatgtcaaaatgttaaaaaaatagcgcgcgcatggcgcgcgttagacactagtagatttcagaactatcatgaagcgcgtgctcgctggttgttagttgttacagagcaacagcccagggaggccaagatgctacttagctactaaaaccaactgacaacaagtgcacagcccagtgggccgctaagctgcaagaaaaccctcgcccctcgttctggattgagattctctgcagaggctgcgatgttgggccgtcctgccctgcccggtgggtatatgtaagctcagaccgccaccggaaccttctcgagcccgcggccgcacacctccgcccgaagccgccagtcggactacgaacggcggcggcgcctcggctcccctgatctccctcaccggaatggacggccaggctccgccgcttctcgacgccgtcgtgctcgagccccttgcagttggcgacgagctccatccgcggcgtcctgtcgaggtggaggacgctccggccgccgctccgccctccggtatggacggccaggttccacctctctacaacgtcacgcgggatcctctgaccgtatccgacgagctgcagcccacgggcgaggtggtggatgacgccctactcgtcgcgcccgatatcgtcaagggcgaggtgatggaggacgacatcctacccgtcgcaaccgacatcatcaacgacgccgcctcggagtgccccgaggctggcagtgatggcgtcgtgctcaccgacgagctccgcaatcgcatcgtcaagcaggtacgctctctgtggacatcccctctgcaacttctcttcccatatgagctggttctgctcaatatgttgactcctaaatttctacacgtaaagtgcttaatctgatatacttgccttctgaaacatgaaacacttttaacttgcaggtggagtactatttcagcgatgagaaccttcctacggacgagttcctgctgaattatgtgaagaagaacaataagggctttggtaagtatctgtcgcctgaggttgtaaattttagcgtaaacactgataatgcggtgctgactacctcagatattctagttacttagctgtgtagggtgtcactaccaggctgtagttgtaacgtattgtctgaaattcttttggtaactgtttagtgttcaggttgtgctttattttgttctacatcacaattattttctgctaagatgcttggattgatatattctgttcttcagcattgatcaatgtgcaactcttcttctcttgtagtgtttttccctatttttaaaacaccagtgatttaattttccccagcactcgtacatgtgaaatggagatgaaaatgatgaaatgtgacaggtacttatgacgaggcctttgcattggtactcctggtgcagctttctttaagttgtgctgagaagcttgtctagatctctgtgaataccaaatttattgattttctgattcactccattccactaagaacattatg

SEQ ID NO: 1810 - DNA, 1450 bp, Zea mays
ttttttttttttttttgggaaaaaaaaggctttataaagtcggagtaacccactaccgttcgcatcaaggaacgaagtctgactgactgacacaggggaaagtagcacttgagtactgctgcctatacacacacgcgtatggcaaaaaaaatttgacgcagaagcgggcgcaggggcagacgcatgcatgatgcatcgagcccccccagctcgcagtcgcaccggaggaatgctaactggagagccacgcctgccgcggaggaccgggactaactacgagctgccgcggccgttcctggtgcaggtgggacccacctcgcttcctttcctccttccagatcattgggtgcccttcgcgccgcgcggcccgcgtccagggtagagagagagagagggatggtgtgagggagggaagggagcaaaggcaaagcagccaacgaccagagagacacggaggctgagagagagagagagagagagatttgggaatcgagaaagcagcgaggaagaagaagatggagcaggaggaagcgtgcacctcgtcgctgcggcagtgcaggatttgccacgacgaggaggacgagcggcgctccgccatggagtcgccctgcgcctgttccggctccctcaagtacgctcacaggggatgcgtgcagaggtggtgcgacgagaagggaagcgccgtctgcgagatttgcctccagaactttgagccgggctacaccgttcctcccaagaaaacccaacctgctgatgtcgcggtgaccatcagagacagcgtgggggtgcccaggccgcagcacgagcctgaagaggaggagcaggagcaggtggacgcggcgttgatcggaggcagcgacccggagtacgccgagtgcgcgcgcgccgccggcaggagcgcgtcctggtgccggtcggtggccgtcacgttcacggtcgtcctgctgctgaggcacctggtcaccgtggtcacggtcggagcggccaaccagttcgccttcggtctcctcacggtatacttgctgcgggcgagcgggatcctgcttccgttctacctcgtcatgaggctcatctccgtgatccagcaggggcagaggcagtaccgcctccggctgctccaggagcagaggaggcacgcgttgaggtcggcccggctgcacggccaggaacaggaacagcatgtcatcctggttcgctgaggaacgagccattcattcaccttggtgtccatacattccattcatccgtcgtacgcgtacaaggttgtaagatgtaccactccatttttttgttcaggcctttacaagcctaaaaaaagcttatatgtaccaccacttcatttgtaaaccctcaaaatttgttgctgagaagatcgacatatcatgtatagatcaaaaaaaaaaaaaaaacaaaaaaaaaaggggaaagagaactggcgcaatgttcgatt

SEQ ID NO: 1811 - DNA, 1101 bp, Zea mays
gggaaaaaaaaaaaaaaaaaatagtcctatttgtggcatagtggtagctatgttgtttaatgaccaacaggtctttggttcgaatcttcacttctttatatagttttaaaaaaaaaaaaaaacaatgggttgcgtgcgcccgggccgggagccaagctcaccagagcagagaaactcgcacgcacgcactctcttccccccctcctgcccactctccaacgcagcacaagcatctagcaaagctgcgcagcgcagccagcaagcaagcttggtccggagagacaacagatataagccagccagagagcagcagacggaggcatggcgacgtccgtggcctgcgccttcttcttcgacgcggagccgctgggcgagcccgggcggcacgcgctggacgcctgcgcgctctgcgccaagccgctcagccgcaacagcgacatcttcatgtacaagggcgacaccccgttctgcagcgaggactgccgctatgagcagatgcaccacgacgcggcgtacgcaaggcaggcggccagcagccggcggaagcagcagcagtcgcagcggagcagaggggcctcgtccgtgggcgccaaggcggacgtgtccgtggccagctagtcagtagtagtaaaagcaagcacagcgaggccgagaaaagaggaggaggagaagaagaaggccgtgctggttcaagcagcgctacagctgcaagagatcccgttggggggcggcgctccgctccgctccgcagctctcctggctggccgcgaggggcgctgcgccgcacaacgagtttcgtgcgcgaaacagaggcaagcgggggtggatggatctgaagaccgaagaaggtgacagatcgaacctgatctgcgggttggaagcttaaaccgacgccatacgtgctctgctccccttgtttatgtgttcccctgacgggaatcgggatcttctgggctgtgtgtgtgctagagcttgaggcgtgggggtgtcaggtgtgtgcgggagcaccatcggcctgtaataactgtacgaatcattccagcatatgttatgtgctagccctaaaattttgatcgcagaaaaaaaaaaaaaaaagcggcc

SEQ ID NO: 1812 - DNA, 849 bp, Zea mays
gggaggcaaggcaactcagccaagctcgtgagagcagaggaactctctttcctcacacaccaaagcagcagtggcaaagctgcgctagaggccatcaggccataatagcccagagagcagacgaggcatggcgacgtccgtggcctgcgccttcttcttcttcgacgcggcggagctgctgggcgagaccgggcggcggcaagcgctggacgcctgcgcgctctgctccaagccgctggcccgcaacagcgacatcttcatgtacaggggcgacaccccgttctgcagcgaggactgccgctacgagcagatgcaccacgacgcggcggcggcgacggcctacgcgcggcagcaggccagcagccggcggaggcagcagcggagcaggggcggctctgtgtccgccaacgaggcggacgtgtacgtggccagctagtttaagagcaggcgcaagcgcggcgaggccgaggatggtgaaggccgtgcgctgcctggttcaagctagagaatcccgtcggtggaggcgcaggcgctcacggttggctgcccgcctctgcgccgcacgagctttgtgagcgggggatggaagactgaagaaggcgatcaggagacagatccagacaacccgcgggttgaaaacttggatatcgacgccatacgtgctctgcgcctcttgtttctgttttcccttccctgatgggatcttttggctgtgtgtgggttagaggttgatgaggcctgaggtgtctgcgactgcgagagctagcagcatcgatctgtaaatgtacacggcgtttgagcacgtcgttatgatcgatagtcgcgaaatttcgatgtcaaaaaaaaaaa

SEQ ID NO: 1813 - DNA, 5392 bp, Zea mays
  misc_feature (1967)..(1967): n is a, c, g, or t
ctgagataggcgtgaaaaggcgctgtatggaatggacctgggatgtcactatgtcagactgttattggtactattaagcagccctgtttgatagttgaggaccaggttactacttactagtattcttgttctggaagcaagctaaccagttccagagttactggtgactgacagtctgctacaaccatatgcctccctccgttcttactgcaaactgcacacacacaaaaaaaaggccccgccgcccagtacggatcacaagctcacaagacaaggtgaaggcgtcttttcgttcgttagtgcgcgaaagatcaagacgcccgtgccttttaatccaaaggaaggacaacgcgaaaagggttgcttggattgcacacttgctatgcgccggctcgggttggctctccgatctcgtctccctcgccgatcgtggctgcaggtggagggccgtatgtatcgcggggaggtgtaaagcaccggcgctttggtgatgaattcatgcctgcctcagttatgatgagcatgcgatgcacttgtgtgcactgcccgcccatttcttttctactgccccttttccgatcgatctcacactggagtccgctctcatgaatcatgatgatggtgcctggccgggccctgaaacattcgaatggagtagctctcgcccgcggtggcggtggcggtggcgccacccaaagcggaagggaatgcacttgaagaaccgtcccgtcagagcctccttgtcgcagagcgttcaccttttttttcttgcaggtaacttgggcgggactttactgacacgagcaacaatctctgataacgctacaagataggcaccgctgcgcaatggtcgcagccacctaccaaatcccttctctagagtctagactgacattgagcgccgccgcgcagacgttgtttacctgaccacgtgccacgggctactagctgctacgactgacgagtaatcagcagttgatcagcccaatgatgcagcttgcgccagcaaaacacaagctacctgaaactcctgctgggactactgggagacgaagaaatccaaccagacagacagacgtgtctaagcatgggtcgcccacggatgacacaccatgcgattctccgaccgtgatggtgccgcaagtgacctactaattttccccccgtgacatcacccgggaatgctctgtcgcgagacgcggcgcgggctctctttcctcgatccgcacggaaaacacccttccaagcctccgtttcggttggtccaccacgaattctggccaggtgcgtactccgtgacgagccagatttgttagcgactttgttgttggccaagacgagcggaaagcagcggcaacctaaccggaaacatctgtccgccggtgcattagcacgtcacgtcacgtcacacaggagaatgaagctgaagaacagggaggaaagaagaaagtttgggctgccaatgtatcttccgtattagagtggcctacacagtttagttgcggtttgggtcacaacctgttatgggccgtgacggagaaaacgtaggtttctgttgggccatggaggacaggagacggtgtcttatggaccggcctcaggcacgtggacggcacccgatccggccttccacttgagtctgcactcagtagcctagcccacgagcaccgcaacgaggccaccggcggccgcggcccatccagacacaaacgcgttaacaactagtagtcaacataattgattccacacaatatgtcaagatccaaaacagccccatctaatttttagttgcagataacaattagtcctagccgatccaatcaaatccactgaaacatttccagcaaacatggctattcaaaacacaatattcaccaaccatctttttacagcatttccttgttctaacaaaaatacaacagcatttacgttacccctggataaaaatggattcaaacatgaagcgngccgccacgaaaaaaagaagctaaagcagaacagtggacaactatgaacagtgttcctattatatttacattcctacgatgcaagtgtgcctcgtcctctgaagtcctgaattggtataatcttctcagcgcataaggaacagcagaagacctgagttgcataatgatttatcaagcctaggatttttcattcttgtcgcctttcatcgttcttccagagggagacggttcgccactggaagctggtgaggcagcagcctgttgaggctccttcagagaagtggccattcctgaaacttcctacagaaaaagagaaagcaaatgatgtatgttgtcattatccatgtgattggttgtacgagcgtctagcgtctggctagctgtagcctgactaatcggatacgcgcttggatcacgtctgtgtggatgcaagaaaagatgtataatttggctatgattacaccagcacatccggaacctgtttgttccatacagacaagcaaacataggatgaggtctggtcaatgcatgtgaagagcctaattgatctaacgcaggtaaccaaacatatggtatatgagcgtaatggatcacaacaagcgtgaaaagcaaaattacaaaaaccgcattatagaatttggtgggtgggggggtacaactcatagttgaatacttgaatatatttgtttacccgaacaaattgcatatcaatctgtagtcattaccgccgccaactaaaacccatgcaacttggaaccccaaaccaatcatgcagtttacacaattgagttagtcactgatgtgctgacatgcacctcaccttatgcactacaagcagacaagctgaggaacttatgtgcctgaatactaatgcacacaaaaacaaatctgacaatagtaccacaccttttaaatttctgaatcgtcccaattatgtttaaatgcagtggaagcttaaattactagacattgtgccacaagcatacccacaaagattaaacatatacaatatacaaatgtaaagtatatacatctacatattattacagaatttctagcatcattcaatcatctatttaagagcatcatagataattggataaagtagcagcactaagataataccacgtaacacattacatattccataacatgatcattaaatagttgttaagccttcagctgccttctatgacattatcattcaaaatgttgttaattagtcaaaagagatgaatgacgggaggtcaagttcatgctttgggctatgtttatagcaggtattttatacccacgggttaatgggtatgagtgagggttaatgggcatgggtgaggacgggacgccgtttagccattgagtgaaggtttttgaacatttagtctatatacatatcataacagctagtttaaaaactttattttctcgagtgatctctatttttttaagataaaatgtaataatttttctttagaaaaagagaatcctaaggaataatggagtctctaaaatagccataatagagtaaaattcatcggatatggggtcgcaggtgttgccatctctgctcccgtcgctagctggttcgagaatcacccatggccccagctttccggtaagctccacgtcagtcccgcttgtcgtgttcctcagctcgcaacgataaatacgcacccgggtacggaccctcggggccggccgggaagctcaccagagcagagaaactcgcacgcactcactctcttccccccctcctgcccactctccaaagcggcgcaagcatctagcaaagctgcgcagcgcagccagcaagcttggtctggagagacagatatagccagccagagagcagcagacgaggcatggcgacgtccgtggcttgcgccttcttcttcgacgcggagccgctgggcgagcccgggcggcacgcgctggacgcctgcgcgctctgcgccaagccgctgagccgcaacagcgacatcttcatgtacaagggcgacaccccgttctgcagcgaggactgccgctacgagcagatgcaccacgacgcggcgtacgcaaggcaggcggccagcagccggcggaagcagcagcagtcgcagtcgcagcggagcagaggggcctcgtccgtgggcgccaaggcggacgtgtccgtggccagctagtcagtagtaaaagcaagcacagcgacgccgagaaaggaggaggaggaggaggagaagaagaaggccgtgctggttgaagcagcgttacagctgcaagagatcccgttggggggggggggcggggctccgctccgctcctggctggccgggcggggcgctgcgccgcacaacgagtttcgtgcgcggaacagaggcaagcggaggtggatggatctgaagaccgaagaaggtgacagatcgaacctgatctgcgggttggaagcttaaaccgacgccatacgtgctctgctccccttgtttatgtgttcccctgacgggatcttctgggctgtgtgtgctagagcttgaggcgtgagggtgtgtgcgggagcaccatcggcctgtaataactgtacgaatcattccagcatatgttatgtgctagccctaaaattttgatcgcagacatgttcttgttaaaaaaagaaaaaaaaatgccttcacgtgtttcgattgatctcttccgcaccaaccgatgagatgaagcttggcaaacgatatgcctgccgggtctcctttgagcgttcagacgaagaccgcgccacaaaatctgcggccgggccgtttgatctcgagactgattaaacaaaaagtgtacatctgtctagctagcagacggtggagataattaattatagcagattctcaaagttttaccactaataaaagtcttgaattcacctcagatttctggaatcgaatctccagtcatgggaaatggcacccggggtgaaccataatcacctcagattcatcagttctttttccgatcgaagtccgaaccccgtccggccgtcggccccaaggcacagactgactgacaagttacgtcttggatccgtccgaaacctgcgagtaaacggaattctgagcgaccaatagtctgacatgactgtgcagcgcaggcgcagcggcttcgtcgagctgaggtgtcgacaaaacaactagctgcgcaagtgttccagtcgcgtaaccacagctatagatacatacaattactactaaagtagcagtattaagttttttatatccggagtcagtgtgaagctagtgaaacaaaagatccaaaaaaatgtccgaaatcaatgcacacacgtcagaacacccttggttctccttttatcttttgtttacgtcgcactcactactcatcgctgagtcaccggcagtccccacctcacccaatcatggcggcgagagacgtcatggggccggccaaaa

SEQ ID NO: 1814 - DNA, 783 bp, Zea mays
tttttttttttttttttttttttttttttttttttggcaacgattctagcaaacatgacttattcagaatacaatattcacctgccatttaaaaaaaatacagcagcatttacgttactgccccctgaataaaaatggattcaaagtttcatacatgaagcaggctgtcacgaaagaagctaaagcagcagaacagcagacagctatgaacaatgttcctaacatatttacattcctatattgcaagtaagcctcatcatccgaagttctgaacattacaatcttctcagtgcgtaaggaacagaagaagtcctgagttggataataatttatgaagcttaggagatttcattcttgtcacctttcatcgttccagaggaagacggttccccactggaagccggtgaggcagcagcctgttgaggctccttcagagaagtggacattcctgaaacttccttcataagatgtaacctgagatcagtagggcgaacatcctcaccaatgcaaaccataacaaattgtgaatagtgaaaaagaacatctgcagcagcttgcttcttctgatccgtctcgtagtcatcctcggcaaccatagaactgctccgcgcagccattcttaaactatttccttgctctgtttgctcaggtggtgctcgatggcagggaggggaaagccggcgagctgtggcggcctggtggtgagaggagcaccgatctgcaacaaagacaacggagacgacgaatggcccccggggggggggcctacgtagcctgactcga

SEQ ID NO: 1815 - DNA, 3340 bp, Zea mays
  misc_feature (1273)..(1273): n is a, c, g, or t
tcattttgatgccatggagtggcatgaaaatgaactagtttccatttttttcaaaattttgagtggcatgtttccaactgacccgaagaaaaaatgtgtgttttgtgatagtgatgaaacgattcaacacttactatttcaatgtcattttgccaataatatatggcgactcattttctggtgttttgggttgagaccacctcagtcaatccgccatgttttcgggaactggcttctaggtgtggactctataactagaaagctgataattacatgtgtttcaattctattctgggctatctggattagtaggaatgatttagtttttggtaatgttcctttgctaactttcatacaggtgctcttcaggggaatatactggcttaggttctaggccatgttgcagaaaagccaagcggaaactgataactaaaggcagtctgtcgtcgattagagatggtggaaatggagaattacgcccgtactagatggaggtttacaaataggattgtgttgtaaccaaaccacctatccttttgtttcgttgttggtagagtggaaggtttgttcctcctcttcggagcagacggatgtgctacggatcttataataatttagctctattctcttggcgaggtgaaagccggatatattatacactatctaaaaaagaggaaccaaatgcccccgtgtgtaagtacatgcatgctgcaaaacgggttggtgaccggtgagtatggccattgtgtgaatgaagcagtatttttttcgctgaccccaaggtgtctcggagctcgtgtcgagatgcgcgcgtacgtcttgcatttttccccacgcaaacatgcctcagcagtccccaccaccccggcaccccctccgtgaaagtcgatcccatcagtctgtgggcctgcaatcctgcacacactcgctgcaacattccaaaaaccctcatcttgttccattttgtccctcggttctcgtagctagacgactgcagaaacgccaacggccggttactgaaggaaaagaagaagaagaaagagagcagtatatatatgcagcaattctgtgaaacactggagtagtacacaaacgtacatatatgcactacaggtgtataccatgcagaatcagcgtagtacgtagtagagcctagaggggaaatttaaaatgtatcttggattctgtgtgcgcgcgcaagggccaagacaagacaatgcacccctctctctctctctctctctctctctctctctctctctctctctctctntctctctctcttcttctgctgctccgtgtaacactgtgcaacgccacagtagaacgaacgaatgaattttgcgactgctcctgctcggaaaggcgcagtcttcctcaactgctacctgtagcacgtctcgctttctatctctcttcttctgcttgtgtgtagtataaaaactacctagaacatcctaatcgagcccttctactcgtcacactcacactaaactagagagctactcaagaaaataaatgcctcttcttcttgctctcgtcgtcctcgtctccgtcccaatggagttgagcgccgtcacctgtcgcactgccgctgctccagttgcagcctgggcgccatttgggcgtccaagggagcagacgacgaagcgaacaagcctcacagacaggcgaggcggccggccggcgagcagctcgcgttgagccctctcgcaccactacatacgctgttgcatgctttgctgcgagctgtgcgcgcggagcatggagatgcatggaggcggcagaggtggtgggtgtgagcgcgtacgtggggaattgaggcgtcatggtccgagatatatacatgtctctcttgctaggtaccttagattattcttagattattcttagttctgttgttagtacgtacttcgtccgacgatcctggaatattgtgttttatttcattgctagctctcttgtttctgtttcatatttcctgccttttttccccctctggtattaagatttaagaagctgtaagtgacgcatcctttggtgtggagagctcgttctgtgatgtttgggcatcgttcccaacagtcttctcgagcagtatttctagtatatatctatatatgatatatttatatatgtgtaaaaaaaagaggaggaagactaaagccttaagccctggaatgcatcacttacactttgtcatgtgtaattgatctatgtgtttgactgttttcatccttgccttcttatattctactctattatttctctagctactacttctgctcgtatccactacatgtattggtgtttagcgctggaactcaaaagtgcatctatgtttgtttccccttataatttagtgccttttgggtgtataatgctatcttcaacgacttactcattcatatctcctattttaaactctactatgttaatctatactgcaaaacagtgttttacacggtcatatgcacgatctgccgaatagaatagaaactgtctgaaagtagcgcggacatttcaccttctccctatcttcttatattaatcctagtgctcacctatagatttgcaatccgagagagcattaatattttccgtatttgtgtataaactacatcatgttactgaatatgtatggtatatagggctgacaatgagctctaaatgttacactataaaatataatgatcggatcggattaggatcaaactctgtttctattcatttttttgaactaaaattaatttaaggctctaacaaaacgagaagaaacatttagatcgtgggccattacataccacccctaatagtaacacatcggcgagtagtttacctgccagcagctctctgtccttgccggttatcaaaataacaatgagaaagagtgcaatgatgctacatgccaaattctccatgcatcccttcccccacctacggcttcatcatcactcggtgcaggagtaatgtatgtggacatcccagatgcagcctcatatgcagatcgacggtggtgtgtttaatgcacacctcaataattggcgttagagatatatcccttgtaaccccgcacatgagaaggaatgtactgaatcgaatcgagccctgccgactgccgttattgccggctgccggtaccgcgctggaacaagataaagatgtgacgggacggagaggatccggctgggcttgcacagatcaagcacacatgcaaggcatggcagctcttgctgctttctagatgatccagggggcattgatggcatgtagaactgtttaccatcacatgcacgcacgcatgtttacccggttaccccccccccccccccccctctct

SEQ ID NO: 1816 - DNA, 827 bp, Zea mays
gccggccgggtcgggcagagtcacgcacggatgctccctatataacatggccaaggccggccgggccggcgagagccaggcaccacgcacggaccactcggtctcatgtagctagcagctagcactcactagcagcgaagagtgaggagtgagaggacacggtaaccccagcggcattcgctgctggtacaccaataatcgagcagcgtgcgagagagagagacgaaccgagccacagagaagagggaacgcgaagctactggcgaactgacataacacgcctgcgatcggtagatagatctacatcatctacaccgccgaggcgccgacaaccacttggcgaccatgagcacgggcacggacgccgtcccggtcgccgtggcgccggcgaagcgcccgcccatcaacaagtacgccttcgcctgcgccctgctcgcctccatgaactccgtcctcctcggctatgacatctcggtgatgagcggcgcgcagctgttcatgaaggaggacctcaagatcacggacacgcagatcgagatcctcgccggcgtcatcaacatctactcgctcttcggctccctcgccgcgggcctcacctccgactggctcggccgccgctacaccatggtgctggcggccgccatcttcttcacgggcgcgctcctcatgggcctcgccccggactacgggttcctcatggcgggccgcttcgtggccggcatcggcgtcggcttcgcgctcatgatcgcccccgtgtacaccgccgaggtggcgcccacctccgcgcgcggcttcctcacctccttcccggaggtcttcaacaactt

SEQ ID NO: 1817 - DNA, 2304 bp, Zea mays
ctcggccgggcgtcgagcagagacgaagacagcaggacgtcttttcggcggacttcaccgcatacaccgctgcccgcgcgcagccgcgcaggtgcatctgcgccgccgccggcccgccgcacccgcacgtctccttatacccatccggccatctacacacggcagtccacgctcgtggcaccgcactcactccgaatcctgaagcaacaaacaccagaagcgcaccaactccccaaccaccggagaccgcaccccagcaaaggatggcatctgactccacggccgccgtgacggtggacggcagcgcgcttgcggggcgcgcgctggccgcggcgggcacgcggcacatgttcggggtggtgggcatccccgtcacctccctcgcgtcccgtgccgccgcggccggggtccgcttcctcgctttccgcaacgagcagtccgcggggtacgccgccgccgcctacggcttcctcacgggctccccgggcgccctactcaccgtctccggcccaggatgcgtccacgggctcgcgggcctctcccacgccaccgccaacgcctggccgctcctcatgatctccggatcctgcgatcaggctgacgccggcaggggcgacttccaggagctcgaccagatcgccgccactaagcccttcgccaagctcgccgtcaaggcaacaaccatcgccgacatcccgcgcctcgtcttccaggccctcgccgccgccgtgtccggccgtcccggagggtgctacctcgatatcccgtccgacgtcctccaccaaaccctccctgaatccgaggccgcggctctcatagcagcagcagccgccgattcggccgcatccgatccttccccgtcaatgcacaagtctcttgacgagggaatcgccaaagctgcggacctgctccggtgtgcggagcggcctctggttgtgattgggaagggtgcggcgtatgcgcgcgcggaggaagcgattcggaagctggtggacaccacgggcatccccttcctcccgacgccgatggggaaaggggtcgtgcctgactcgcatccactctccgccacggcggcacgctcactcgccatcgggcagtgtgatgtggctctggtcatcggtgctaggcttaattggttgcttcactttggcgagccacccaagtggtccaaggatgtcaagttcattcttgttgacgtctccgaggaggagattgagctccggaagccacacgtggggattgttggggacgcgaagagagtaactgagctgatcaaccgggagatcaaggacaatccattctgcttggcaaggtcgcacccatgggtcgaagcgatcaccaagaaggccaatgacaatgttcttaagatggaggcgcagctagcgaaggatgttgtgccattcaatttcatgacaccattgcggatcatccgggatgcaatccttgccgaggggagtcctgctccagtagtggtatcagaaggggcaaataccatggatgttggcagggctgtacttgtgcagaatgaaccaaggacaagactggatgcagggacatgggggacgatgggggttggattggggtactgtattgcggctgcagcagctgaacctgaacgactcgtggttgctgtggagggcgattctggattcggcttcagtgcaatggaggttgagacgttggtgaggtaccagctgcctgttgttgtaatcgttttcaacaacaacggtgtctacggcggcgaccggagaagccctgacgagataaccggaccatacaaagatgacccagccccaacctcatttgttccggcagcagggtaccataagatgatggaggcttttggagggaaagggtatcttgtggagacaccagacgagctcaaatctgccctttcagaatcgttccgcgccaggaaaccagcggtgattaatgttatcattgatccttacgccggcgcagagagcggtcgaatgcagcacaagaactgaaggcgttgggcttttgtaccataccatagcaggatgcagatgcgacttgatacaaataagcagcaaccgtcaatcaatccttttgtttcttttttacgacctcgcttcgttgttcgtggtacagacgtggggcgcttttaattggaagtcccatttgaaggcatgtgaatgtgttatgattatctaaatgccaaactttaaaggcgtgttgatgaggatgtgtggaaaacctgtgcccatatatgagccggtataattatttctcaaagtaataaagtcagtgttttagggtctgtgaaaaaaaaaaaaaaaa

SEQ ID NO: 1818 - DNA, 2355 bp, Zea mays
ttcggccgggtgccaagggggagaaaataggcgacccttctctcccccgtcagcgagtcgggcagagacgaagacaagcaggacgtcttttcggcggacagcggacttcaccgcatacaccgctacccgcgcgcagccgcgcaggtgcatctgcgccgccgccggcccgccgcacccgcacgtctccttatacccatccggccatctacacactgcagtccacgctcgtggcaccgcactcactccgaatcctgaagcaacaaacaccagaagcgcaccaactccccaaccaccggagaccgcaccccagcaaaggatggcatctgactccacggccgccgtgacggtggacggcagcgcgcttgcggggcgcgcgctggccgcggcgggcacgcggcacatgttcggggtggtgggcatccccgtcacctccctcgcgtcccgtgccgccgcggccggggtccgcttcctcgccttccgcaacgagcagtccgcggggtacgccgccgccgcctacggcttcctcacgggctccccgggcgccctactcaccgtctccggcccaggatgcgtccacgggctcgcgggcctctcccacgccaccgccaacgcctggccgctcctcatgatctccggatcctgcgaccaggctgacgccggcaggggcgacttccaggagctcgaccagatcgccgccactaagcccttcgccaagctcgccgtcaaggcaacaaccatcgccgacatcccgcgcctcgtcttccaggccctcgccgccgccgtgtccggccgtcccggagggtgctacctcgatatcccgtccgacgtcctccaccaaaccctccctgaatccgaggccgcggctctcatagcagcagcagccgccgattcggccgcatccgatccttccccgtcaatgcacaagtctcttgacgagggaatcgccaaagctgcggacctgctccggtgtgcggagcggcctctggttgtgattgggaagggtgcggcgtatgcgcgcgcggaggaagcgattcggaagctggtggacaccacgggcatccccttcctcccgacgccgatggggaaaggggtcgtgcctgactcgcatccactctccgccacggcggcacgctcactcgccatcgggcagtgtgatgtggctctggtcatcggtgctaggcttaattggttgcttcactttggcgagccacccaagtggtccaaggatgtcaagttcattcttgttgacgtctccgaggaggagattgagctccggaagccacacgtggggattgttggggacgcgaagagagtaactgagctgatcaaccgggagatcaaggacaatccattctgcttggcaaggtcgcacccatgggtcgaagcgatcaccaagaaggccaatgacaatgttcttaagatggaggcgcagctagcgaaggatgttgtgccattcaatttcatgacaccattgcggatcatccgggatgcaatccttgccgaggggagtcctgctccagtagtggtatcagaaggggcaaataccatggatgttggcagggctgtacttgtgcagaatgaaccaaggacaagactggatgcagggacatgggggacgatgggggttggattggggtactgtattgcggctgcagcagctgaacctgaacgactcgtggttgctgtggagggcgattctggattcggcttcagtgcaatggaggttgagacgttggtgaggtaccagctgcctgttgttgtaatcgttttcaacaacaacggtgtctacggcggggaccggagaagccctgacgagataaccggaccctacaaagatgacccagccccaacctcttttgttccggcagcagggtaccataagatgatggaggcttttggagggaaaggctatcttgtggagacaccagacgagctcaaatctgccctttcagaatcgttccgcgccaggaaaccagcggtgattaatgttatcattgatccttacgctggcgcagagagcggtcgaatgcagcacaagaactgaaggcgcttgcttggcttttgtaccataccatagcaggatgcagatgcgacttgatacaaataagcagcaaccgtcaatcaatccatttgtttcttccttacgacctcgcttcgttgttcgtggtacagatgtggggcgcttttaattggaagtcccatttgaaggcatgtgaatgtgttatgattatctaaatgccacgatgcaaactttaaaggcgtgttgatgatgatgtgtggaaaacctgtgcccatatatgagcctgtataattatttctcaaagtaataaagtcagcgttttagggcttgtttgg

SEQ ID NO: 1819 - DNA, 1404 bp, Zea mays
  misc_feature (3)..(4): n is a, c, g, or t
  misc_feature (22)..(35): n is a, c, g, or t
  misc_feature (39)..(39): n is a, c, g, or t
  misc_feature (1349)..(1350): n is a, c, g, or t
  misc_feature (1352)..(1353): n is a, c, g, or t
  misc_feature (1368)..(1368): n is a, c, g, or t
  misc_feature (1376)..(1376): n is a, c, g, or t
  misc_feature (1382)..(1382): n is a, c, g, or t
  misc_feature (1404)..(1404): n is a, c, g, or t
ccnnggccgggccggggaaacnnnnnnnnnnnnnnaaanaaaaaaaaaaaaaaaaaaaaaaaaaaaaaaaaaaaaaaaaaaaaaaaaaaaaaaaaaaaaattttctctcctctctccgtcgccgcctcgggccaaaccctacgcagggagttgattgatcgattgcagccatgagtaagttgcattccgagcttctcaaggattgcatctcccagatagttcaggatgccaagaagaataggaagttcactgagactgttgagcttcagattagtctgaagaattatgatccacaaaaggacaagcgtttcagtggctctgttaagttgcctcacatccctcgtccaaagatgaaggtgtgcatgcttggtgatgcccagcacgttgaggaggtaaacaggcagttgatgatgcacttgaaaatgtacttatttatatgttgaacatgcttgcagtagtaaatctgcaaaaacaccaatgcttcgagttactcaactgtggctggcatgtattagtcagtccaagcccgcacttgattccatttgcaattaaatctgcttatacaaatcctgctcaactgcatggaagattgaaagttttgctaagataatgcaagtgcccttcctatctggatcaacttttctccacacaaaccattttactgcattctcaggctgagaagatgggacttgactacatggatgttgaggccctcaagaaaatgaacaagaacaagaagcttgttaagaagcttgccaagaagtaccatgcttttttggcatcagagaccatcatcaagcaaattccccgtctccttggtcctggtctcaacaaggcaggcaagttccccactctggtcactcaccaggaatccctggaatccaaggtgaatgagacgaaggctacagtcaagtttcaactgaagaaagtcctttgcatgggtgtcgcggtcggtaacctgtctatggaggagaagcagatccaacagaacatccagatgagcatcaacttcctcgtgtctcttctgaagaagaactggcagaatgtaagatgtctctacatcaagagcaccatggggaaaccattcaggattttctaagtctgtttttttgtgaagtctgctctttatgatatttggtttttgaaccgaggttgtcttgaactaaaactcttgttagatcatgtttggttggtaggatatttgagtctgggcaggtgtcttactcttgcgccatgtctttgtaatctctctatataagttttttgagaggctcaggaaaaaaaaaaaaaaaaaaaaaaaaaaaaagctgtacaaaaaaaaaaaagcttgtactcgccaaaaaaaaaannannaaaaaaaaaaaaaanttaaaaanttaaanaaaaaaaaaaaaaaaaattttn

SEQ ID NO: 1820 - DNA, 1286 bp, Zea mays
aagcgtttgctaccacctgggcggccggggtttccatcccattttctctcctctctccgtcgccgcctcgggccaaaccctacgcagggagttgattgatcgattgcagccatgagtaagttgcattccgagcttctcaaggattgcatctcccagatagttcaggatgccaagaagaataggaagttcactgagactgttgagcttcagattagtctgaagaattatgatccacaaaaggacaagcgtttcagtggctctgttaagttgcctcacatccctcgtccaaagatgaaggtgtgcatgcttggtgatgcccagcacgttgaggaggctgagaagatgggacttgactacatggatgttgaggccctcaagaaaatgaacaagaacaagaagcttgttaagaagcttgccaagaagtaccatgcttttttggcatcagagaccatcatcaagcaaattccccgtctccttggtcctggtctcaacaaggcaggcaagttccccactctggtcactcaccaggaatccctggaatccaaggtgaatgagacgaaggctacagtcaagtttcaactgaagaaagtcctttgcatgggtgtcgcggtcggtaacctgtctatggaggagaagcagatccaacagaacatccagatgagcatcaacttcctcgtgtctcttctgaagaagaactggcagaatgtaagatgtctctacatcaagagcaccatggggaaaccattcaggattttctaagtctgtttttttgtgaagtctgctctttatgatatttggtttttgaaccgaggttgtcttgaactaaaactcttgttagatcatgtttggttggtaggatatttgagtctgggcaggtgtcttactcttgcgccatgtctttgtaatctctctatataagttttttgagaggctcagtataatatgcgtattatacgttatacccaatcgtttctgttactgtggaaaatgagtttccgccattgctgctgcgcccttgggtagcgcccctctacttacgggatagagccttgtaggaagtttttggtcactaatctggctgctattactagacattttgtgtaaagcgcaggcctagtgtcttaggttcttacgtgagttgggttaggagaagggattaacctggtgcttttgagtccaggtgctaggatttgaagggtcagtgaggtttggatagcctagtgtctgatggctatacatactatatttataaaaatattgtgtgatgattaaaaaaaaaaaaaaaa

SEQ ID NO: 1821 - DNA, 1675 bp, Zea mays
tatatatatatatatatatatatagttttgcctcgattcaacttttgaagtttcgtttatcttggatatatatttttatttatttggtagatctcactatgattttctacagatttgataaaagtaagagaaagttgagttaaacaaaactaaaaccacctctattttaaaaacacacagaatatttctctcttattggtagtacttatgggttcggcgcaatcttgatattctgatccaaactgaagcttcacctattcaaaaataggtggtgaaacccaacaatttctactcctgatgtgcctaatagcctctctattccagtaaccacgtgttggcggttcaatggatgagatctactgttggaacttggaattgattccgacgagtgaagaagtgttcctagccgcgagcggatcggatcccctgcagatgttgcagataaatcactgacgtgtgggtccgtgtatgtacctaggtccgcgccccgcggacccgccgcctgcagtgcagaagatctgcttccgagcccaatacgactcatcctgctgaagtatctcctcccccgaacggcactggcaacaaccgtccgtccacctcggtgcggacttgatcaggtcttcgagtccaattcgatcgcgtaatcctcgctccggcggggttataaactcatgatccaacaaaccgcatgatccactccactgtcccacccgaccgacgaccccaatccatggctgcggcagaggcgccctgcgacggcagcgtcgcgcgcatcaggctgatgtgcagccacggcggccgcttcctgccgcgcggccccgacggggcgctgcggtacgtcggcggcgagacgcgcgtcctggtcgtgccgcgcgcggcgacattcccggacctgacggcgcggctgtcagaggtggccggcggcgcgaaggtgcgggcgatcaggcaccgcctcgccgacgagggcgtccaggacgtgatcgtctcggtcacctgcgacgaggagctcgcgcacatgcgcgacgagtacgaccgcctgcgggctacgcggccgtccgcgacgttccgtgtcttcttcacgaccaccactcacgctggctccggcggaggcgctgcctaccggcggagatcggcggccggacttccacccctgtcgatggagatgcggcgcacgcagagcgaacaggtcctcgccgtgcgcgcacaccagcaacaggcgatgcgacgcgtcaagagcacgcaggagttcgcaggggccatccgcttgcagccgtctttccaccgccgtggcaaccagcagtgctgcagctcctctcagcgctgcaacatgtgcgcccccgcgccgacggcagcacagccggcgtgcgcactaccctacctgtccaagaaagtagctcctccttggatgcccgcggcgaaggcaacagagggagtgtttgctattagagtttagattaaaaagaggcaggatctagtgttgaaggcccaaggctcccactcccacataactaacagagcgagtctgctattaaggtttggattaaaaaagaaatagatcgaaaaaagtagctgtgtcctattctagtattattagagtttagattactgtgacaataatatcatcatcttctctttatagaagcggtaaaaatttctgtaagtaatgtcatctata

SEQ ID NO: 1822 - DNA, 834 bp, Zea mays
cctcgccgcccgcggcgcgggcgcaagccaacgctcgatcgcaaacgcacacgctactctctttttttttttttgttgttggtggtgaggggctggctctggctggatctggatggcgcacgggcggatgatgatgatgggctgcgtgttcctggcgtgcctgctggtggcggcgtctgtgccgtccaccgcgtccgcgttcgtgttcaaggcgggcggcacgggcgagtggcgcgtgccagccgcggccgctagcggcaacgtcagcgcgtacaacgcgtgggcgcaacgcaaccgtttccgcgtgggtgacgccatcgctttcacgtaccagcccggcaaagactcggtgctcctcgtcgacgagaggtcctacgacgcctgcgacacgagctcgccgaccgacaccttcgccgacggcagcaccgtcttcaccttcaaccgctccggccccttctacttcatcagcggcagcaaaggcaactgcgaccgcggcgagaagctggtcgtcgtcgtcatggccgagcgcgcggccatcggcacgggcggggcacggggctggcgccgtcgcccgtcgtcgtcgtcgtcccccaacggcccattctccgccttctctccgccgccgccaccctttggcatcgacatctcgccgagtcccacggccgcgtatccgccaccaagtgccgcgccgcccaagatggcaggacttgccggcgcggcggcgtttgccattattggagccttgttctacgcgcttggttgatgatacgtacgcgtgttttgtttatccactcagatcatatgcatatacatagcgaccatatatgccattga

SEQ ID NO: 1823 - DNA, 1066 bp, Zea mays
  misc_feature (1015)..(1015): n is a, c, g, or t
  misc_feature (1026)..(1027): n is a, c, g, or t
  misc_feature (1032)..(1036): n is a, c, g, or t
  misc_feature (1048)..(1049): n is a, c, g, or t
gacgcccgcagccacgcagcactggccagttctaacgctcgatcgcattcgcacgtacgctatagctagctagcctttttggccgcgcgcgcgcacacgggtttttgtcggggacacaggcaggcaggtaccccggcgggcggcaagctcgatggcgcaggggcggatgagctgcgtgttcctggcgtgcctggtggcggtggcgtcggtgtcggcgtccaccgcgtccgcgttcgtgttcaaggccggcggcacgggcgagtggcgcgtgcccgccgcggccggtagcggcaacggcagcgcgtacaacgcgtgggcgcagcgcaaccgcttccgcgtgggcgacgccatcgctttcacgtatcagcccggcaacgactcggtgctcctggtcgacaagaggtcctacgacgcctgcgacacgggctcgccgaccgacaccttcgccgacggcagcaccgtgttcaccttcacccgctccggccccttctacttcatcagcggcaacaaggacaactgcgaccgcggcgagaagctgatcgtcgtcgtcatggccgagcgcgcggccgtcggcaacgccaccgagccgggcgcggggctggcgccgtcccccagcggcccgttctcgtccttctctccgccgccacccttcggcatcgacatctcgccgacggcggcgtatccgccgccaaacgccgcgccgcccaaggtggcagcaggagttgccggcgccgccacgtttgccatcggagccttgttctacgcgcttgtttgagatacgtctgttttgtttattcgaaatgttctcgtgcatgcgcgcaaagtggagggagatgatcacgcggctgtgctttactagcttgctcaaattatatacatgtatatccgactgagtcgagtgaatgtgtttttaatgtataataatgtatcaaatatggttgatgatgtaatattgtatgcattgtttcgttaattcagtgcggaactgcggatgaaaaaagtgattttagtcccnaaaaaaaaaanntaaannnnnaaaaaaaataanngaaaaaaaaaaaaaaaa

SEQ ID NO: 1824 - DNA, 980 bp, Zea mays
cattgggaccctcgaggccggccgggggatccagtcgcacctccctctccgaaatcaaggtagcatacaccgctgcagtttctagagccctctctgccactcgtgatcccactagtcacgatgcctgccctcgccaagcccgcctcccgcaccgccaagcccgccgcggctccgaagccgaagcctgccgccgccaagccgaaggcggccaccgctggtgcctcccacccgccttacttcgagatgatcaaggaggctatcacggcgctaaaggagaggaccggctccagctcgcaagcgatcgccaagtatgtgggggacaagcacggcgcgtctctgccggccaacttcaagaagatgctttccatccagctccgtgggtccgcagccaagggcaagctcgtgaaggtcaaggcttcgtacaagctctcggacgccgccaagaaggcatcccccaagaccaaggctaagccggcaaaggccgccgctgccaagaccaccgcccccaagccggccaaggccgccgccgccaagtcaaagaaggcagcggctgccaagccaaagaaggccgctgctgctgggaccaagcgcaaagtgcccgagaagaaggtcgtggcgaagccgaagaagtcccccgccgccaaggccaaggccaagccgaagaccgtgaagtcccctgcctccaagaaggcacggaaggcctccgcatgagatgggttgctttaggtctaagctctgattgtggttggtgtcagttaggtactgtacaaactaagtgtgtgcccaaagtgtctcaggcggtgtgttatgtgcttagcaagttctatctatcagagtgttttagtttaacaatggttttacctctggcttttgtagtcaggtttctgaaatccctgttctcgcgcagtctaaatttctgaattctagcgcactacaatcgtttcgatctcaaaaaaaaaaaaaaaatgtagaactgcgct

SEQ ID NO: 1825 - DNA, 823 bp, Zea mays
atccagtcgcacctccctctccgaaatcaaggtagcatacaccgctgcagtttctagagccctctctgccactcgtgatcccactagtcacgatgcctgccctcgccaagcccgcctcccgcaccgccaagcccgccgcggctccgaagccgaagcctgccgccgccaagccgaaggcggccaccgctggtgcctcccacccgccttacttcgagatgatcaaggaggcccgcccggcgtcaagaagatgctttccatccagctccgtgggtccgcagccaagggcaagctcgtgaaggtcaaggcttcgtacaagctctcggacgccgccaagaaggcatcccccaagaccaaggctaagccggcaaaggccgccgctgccaagaccaccgcccccaagccggccaaggccgccgccgccaagtcaaagaaggcagcggctgccaagccaaagaaggccgctgctgctgggaccaagcgcaaagtgcccgagaagaaggtcgtggcgaagccgaagaagtcccccgccgccaaggccaaggccaagccgaagaccgtgaagtcccctgcctccaagaaggcacggaaggcctccgcatgagatgggttgctttaggtctaagctctgattgtggttggtgtcagttaggtactgtacaaactaagtgtgtgcccaaagtgtctcaggcggtgtgttatgtgcttagcaagttctatctatcagagtgttttagtttaacaatggttttacctctggcttttgtagtcaggtttctgaaaaaaaaaaaaaaaaaaaaaaaaaattagcgcgccccctcgtgcc

SEQ ID NO: 1826 - DNA, 948 bp, Zea mays
cattgggtacctcgaggccggccgggatccagtcgcacctccctctccgaaatcaaggtagcatacaccgctgcagtttctagagccctctctgccactcgtgatcccactagtcacgatgcctgccctcgccaagcccgcctcccgcaccgccaagcccgccgcggctccgaagccgaagcctgctgccgccaagccgaaggcggccaccgctggtgcctcccacccgccttacttcgagatgatcaaggaggctatcacggcgctaaaggagaggaccggctccagctcgcaagcgatcgccaagtatgtgggggacaagcacggcgcttctctgccggccaacttcaagaagatgctttccatccagctccgtgggtccgcagccaagggcaagctcgtgaaggtcaaggcctcgtacaagctctcggacgccgccaagaaggcatcccccaagaccaaggccaagccggcaaaggccggcggctgccaagaccaccgcctccaagccggccaaggccgccgccgccaagtcaaagaaggcagcggctgccaagccaaagaagaccgctgctgctgggaccaagcgcaaggcgcccgagaagaaggtcgtggcgaagccgaagaagtcccccgccgccaaggccaaggccaagccgaagaccgtgaagtcccctgcctctaagaaggcacggaaggcctccgcatgagatgggttgctttaggtctaagctctgattgtggttggtgtcagttaggtactgtacaaactaagtgtgtgcccaaagtgtctcaggcggtgtgttatgtgcttagcaagttctatctatcagagtgttttagtttaacaatggttttacgtctggcttttgtagtgaggtttcggaaatccctgttgtcgcgcagtctaaatttctgaattctagcgcagcacaatcgttcgatctc

SEQ ID NO: 1827 - DNA, 2888 bp, Zea mays
tttgccgagctacagtcccccaattcgagatgaggataatcacgattcacgaaaagagacaccaatggcattttgatacacatacacccgtatccagcttggaaaccgcagggcgaacgactgaaaccacgcgcaaacccacgcccatccgtgtgttcgtacagctgtttcacagaacaccgaaaatccgtgcaaccccatcgcgcacacgtacgcagcgagagccggactaccattcacgggtctacggtgcacgtgttccatcgacaggcgctagcgcggttttgtttcgaggtacaaaatgcatttcccgctctgggcgtcgggcggcgcacactgcccttgcgcccgcaccgcccactccatccaacggccaggatgcgctaagtgctcctcccgcggatcgtgatccgtggcttcgcatctccagccaatcagaatgcagaacgtccctcccgccggatcgctcccttcccgaactatataaaacaaggtgacccggcccagtagaatctatccagtcgcacctccctctccgaaatcaaggtagcatacaccgctgcagtttctagagccctctctgccactcgtgatcccactagtcacgatgcctgccctcgccaagcccgcctcccgcaccgccaagcccgccgcggctccgaagccgaagcctgccgccgccaagccgaaggcggccaccgctggtgcctcccacccgccttacttcgaggtgagccttgtcgacctgcgttcggtttttattgattgatattggtttccgccggacctgctggtgcctcccacccgccttacttcgagatgatcaaggaggctatcacggcgctcaaggagaggaccggctccagctcgcaagcgatcgccaagtatgtgggggacaagcacggcgcgtctctgccggccaacttcaagaagatgctttccatccagctccgtgggtccgcagccaagggcaagctcgtgaaggtcaaggcttcgtacaagctctcggacgccgccaagaaggcatcccccaagaccaaggctaagccggcaaaggccgccgctgccaagaccaccgcccccaagccggccaaggccgccgccgccaagtcaaagaaggcagcggctgccaagccaaagaaggccgctgctgctgggaccaagcgcaaagtgcccgagaagaaggtcgtggcgaagccgaagaagtcccccgccgccaaggccaaggccaagccgaagaccgtgaagtcccctgcctccaagaaggcacggaaggcctccgcatgagatgggttgctttaggtctaagctctgattgtggttggtgtcagttaggtactgtacaaactaagtgtgtgcccaaagtgtctcaggcggtgtgttatgtgcttagcaagttctatctatcagagtgttttagtttaacaatggttttacctctggcttttgtagtcaggtttctgaaaaaaaaaaaaaaaaaaagccgaaattacagaaaactcgcgcagtacaatcgtttcgatctccgttctagtttatccatgtagaactgcgctacttctgtcttcaatttaggaatcatattttctgcgattaggatccgggcggaagaaaaccgacgaagacgacgaaactgggggacatgccgtagcttcttccctgcactcatccgatatttgcttgtggataatgtcgagcccgtggattatcttcgctgttgcaaataatgtcgagcccaggtaacaagtgacccagagtgcagccgaaacgcacgtcgtggttgcagccgaaacgcacgatgcgcgtgctgtccgccgtctggttcggccgccgttggccgtggcggcgattagtcacgtccccgctcccgagctctgcaccaatccaaggtactatctcaaaatgcaattggagctggattctacatattttgtatacaagcacattatcctagacataatatccgatgttgtttggttcattatgagatagtattatctgaattgtaagaatcctatgaaaaccaaacatgccggaaccaatgactgactcccgcggtcctcgcgtcgggtaaactaaattttcgttggcggcgcgattcaaaatttcgaagccaggattaccgcggcgcgtcgcccagctgatcgattttgttgggtgccaggctggcgacaccaggtcttttgacgaacccgaacagtccacaaggttaaagcgcgggctggcgtcaccatgcaggaatgctaaattttattgtgttatcaaaaacgcgggctggcgtcaccacgtatgaatgctaattttttcttgtgttatcaaacatattatatataagaatattatatataagaatgatgttttgtatgaattgttttatacattatttattcactagaataaaaaaaataaaagcgtcttccgcgaagtacctgcctccggacgagccctgcggcgctgagcccggggccaaacgtgacaaagctagatagagaggcagacgaaccaaagggaaaccaattgagtagatcccttgctcacctagagactggtccgctataagtgtcggatcgcattaactacgtctagcatcgagccacgatagaggcgctgatccgtctccgactcatgtcctaccgtaccctaacatactcaataaccacggacccctaggactgtggcatatttatggcccgcgccctcgacaagtgtcacactcatggcttagcgggactaggtcgagtgcgcataccgactgcagggcacaatgagacaagtcataccgagatctaggctacgaaatgaggaaatcgcccccggatgggtgtacacgcaaaatatatgacggacacacaaacgacgaaaggaaggtggacacatcgatgatgacc

SEQ ID NO: 1828 - DNA, 1003 bp, Zea mays
agttagcaatatggtgctattggttccacctatccctttgtcatccacttatatgggcttttgagattttcctgtgatttattagaaattcttaattgggccaagcccataagtcctaacaagagagagaggctcgaatctctcatcgtcatcatacaatacaagctcctagaagatgatcatatatgcattcatgccgatggcatctaggccgagtcatcaccaaccaaccaagagtgttcctttcccttcgcttgccgcagctagtagctataaatagagaaggtagcatggacgcactggcccacgcgtccgagcgaggacactacacagcgcgctactgacatgtcgatgctcaccagcatactgggtcgcaagcatcagcagccgccgcagcagcagcagcagcagaagggcggcggcgcgcgcactggcaccggcgccggcgccggcacggaggcggcggcagtggagccggtgagcatcgacatcgcggagcaggggccgctagtggacgccatcacgctggcggcgttcgcggcgccggcgctaggcctgccgccgttcgcgacggccagcatggactggaaggagacgccgacggcgcacgtgttcatggccgacctccccgggctgcgccgcgacgaggtgaaggtggaggtggaggaggagaggctgctccggatcagcgggcagcggcagcgcgccgccgaggagaagggcgaccgctggcaccgcgtcgagcgcagctccgaccgcttcgtgcgcaccgtgcgcctcccgcccaacgccaacaccgacggcgcgcaggccgcgctccaggacggcgtgctcaccgtcaccgtgcccaaggacaacgaccgcaaggcctacggcaggcttatcaccatcaccaattaattagttattaatcatatatatgatgtcattatatatgtaagcggcatgtgtatcgttatcatcaccgaataaaaaaatgattatgccaagggaaaaaaaaaaa

SEQ ID NO: 1829 - DNA, 2287 bp, Zea mays
cattgggaccctcgaggccggcccgcagtcacccacccccaccccaccccaccggcaccctcaccctcaggcctccgcctctttctcagcttctctccggttccttccttccggtcgccgattcttctacgcgaaagattcctggctggctctcgtctctcgcgtctcgttctcgcgtgcatggggctggacgtcggggagatcgggatgggcctggatctggggctggacctcaggctgttcgccgcgcggagcgccggagggatggccaagggcgctgcgccggcggggatccagtcctgcatcaggagcctcgaggtggagcgcaggaagatcgaggtgttcaggcgcgagctcccgctctgccttcgcctcctcgccgacgtgatcgacgagttgaagttggaggctgccaagagaggcgaggacgacgacggggcgacggtggtggacgacggcgacaaacggaaatggatgagcaccgctcagttgtgggtggacagcgacgccaaatcggacgagtctgacaaagagcaacagagtgaaatcacgtcgccgccggagcccaagttgttgggtggtggcgcacccacgccgataagggcggccggtttcggcggtggcggtgccaccacccctaccgcctccgttgttcagaagagaagacagctccgccagctctggcctgtcgttggtatcgttgtcgccggcaaccaaggcggcggtgccgatttctcctccggtggtggctgccagcggtactaccaccagcgccagattttgtggcaccaccatgccaccatctggctccgaggtcatcaacatgcactcgcaggctcagcagcaagccagcaggaaggcaaggcggtgctggtcaccggagcttcaccggcggttcgttgccgctttgcacgaactcggtggccctcaagtggctactccgaaacagatcagggaggtgatgcaagtggacgggcttacaaacgatgaagtgaaaagccatctccagaagtaccggttgcacaacagaagatcctcccccggcgcggcggcggctccggtgagccagtcgatcatgctggtggatggcgtctgggctgctcaggagcaaagcagcggctcgcagtccgggtctcggcagggcccgctccagttctccagggcaggtatggccgtcggtggcggcgacgacagcagcagcagcgacgacgacgaagacgacgacaagtcggaggatggctacagcctgaaatgggaggctgcgtttgcggaaggtcggatgagagtgtagagagatagcgttgtcgcggcttgatcgagcatgcatcggtggattcttgagaccgagagagtggttgtagtgcagccaggcatgtatacagggagattgggcgcgcgcggccccgtgtgcgcccaagagatgaactgatcatgcggcgtttggaaagctgataggcgttttgtttgagtcgttgctgacttctgttaacttccgggcagatcacaaaatttttcgccctgagaataacttattaataataatattactgcggcggctgctgttattttatatacatacatatacatacagtattcgttgcctgcgtgtcgtcttctaatcaagtagtaacagtgttgttgaatgatcattttttaataaaaaaaggtaatctctttgatataataatatccgtactaaccaacattaaccttgctaatctctttggtatcaacatgcatatgttttctgctcggccttctacgtcgagtcggatacccgtagatctccgataagttgcacgtccttgtctcgtgcatgtcctcttgcatggttaacaactcttatctccgtccgcccattccatgcttatacggcgctcatcagtaataatataatgtaatccgacgcgttcagaagcatgctgatggctggctataaacaattttcgttctgaccacatcaacgatgagcacatgaacgaacgagagagagagagagagagagagagagagagaagataatagataaataaaatagaatatcacggggagagggaggggttaattattccgattcggcggcgattccgatcggctcaagcatcgcttggttcgcaaggcgctttcagcgttcgaatattcttgctgctgcttgcacttgcagcatctgctgccagcgtccgtccgtcctttattttcgcggcaacatggggagggtgctccggctgcgctgtcccctgacgataagctagttaatttagcgcgtgggttagttgccattggtcag

SEQ ID NO: 1830 - DNA, 1512 bp, Zea mays
  misc_feature (28)..(28): n is a, c, g, or t
ggtacccccgggttcggccgggcctggnagatcccctcacagtcatcctccacccaccccacccaccgcctccgcctctctctctctctcgtttgttcgtctcggcttccggtcgccgattcttctctgcgcaaaagattcctggtggtggtgcccgtaccttgctccacgcctcgctcgcgtcgcgtgcatggggctggacgtcggcggcatcgggatgggcctggatctgggtctggacctcgggctgttcgccgcgcggagcgccggagggatggcggccgcggccaagggtgcgccggcggagatcgagtcctgcatcaggagcctcgaggaggagcgccggaagatcgaggtgttcaggcgcgagctcccgctctgcgtgcgtctcctcgccgatgtaatcgacgaattgaaggatgaggccgccaagagaggcggagacgcggaggccaaggccgacgacggcgataagcggaaatggatgagcaccgctcagctgtggctcgacagcgacgccaaatccgacgagtctgacaaagagcaactgagtgaaatcacttcgccggagcccaagttgctcggtggcgcacccatgcccataagggccgttgcggcggtgccacccctgccgcctccattcttcaggagagaagacagctctgccggcagtggtctgtcgctggtaccacccgcagctaagccgccgattcctcccatgtctgccagcgacaacgcgagcggcagattctgtgccactatgccaccgtctggctctggggccaacttgcactctcaggctcagcagcaagccaggaaggcgaggcggtgctggtcgccggagcttcaccggctgtttgttgccgccttgcatcaactcggcggccctcaagttgctactccgaagcagatcagggaggtgatgaaggtggacgggcttacaaacgatgaagtgaaaagccatctccagaagtaccggctgcacaacagaagatcccccggcgtcgtggctccggtgagccagtcggtcatgctggcgggcggcctctgggctcctcctcatcaggagcaaagcagctcgcagtccgggtctccccagggcccgcttcagttctctggatccggtgtagcggccaccgtcggcggcgatagcagcagcagcgacgaggacgacaagtccgaaggctacagccggaaatacgtgtaaaggccgcgttcgacggatgagagtgtagagatagcgtcgcggcttctgcttgcccgtctgtggcaataacagattcatcagtcttgagagaggttgtagtgcgtgcgcccaagagctcaactgatcatgggttggattgtttgtttgtcatgtacgtacatggaaagctgatggcttcctgacttttaatttctgggcaggtcccaaaattttcgcccagaaaaaaaaaaaaaaaatagataacatacaaaaaccccgggggggggccgggcccccaatccccccttaagggggttttttccaaa

SEQ ID NO: 1831 - DNA, 1588 bp, Zea mays
catccgcaccgccggccgcgctggctctcagtcacccacccccaccccaccccaccggcaccctcaccctcaggcctccgcctctttctcagcttctctccggttccttccttccggtcgccgattcttctacgcgaaagattcctggctgcctctcgtctctcgtctcgtttctcgcgtgcatggggctggacgtcggggagatcgggatgggcctggatctggggctggacctcaggctgttcgccgcgcggagcgccggagggatggccaagggcgctgcgccggcggggatccagtcctgcatcaggagcctcgaggtggagcgcaggaagatcgaggtgttcaggcgcgagctcccgctctgccttcgcctcctcgccgacgtgatcgacgagttgaaggaggaggctgccaagagaggagagtacgacgacggggcggcgacggtggacgacggcgacaaacggaaatggatgagcacagctcagttgtgggtggacagcgacgccaaatcggacgagtctgacaaagagcaacagagtgaaatcacgtcgccgccggagcccaagttgttgggtggtggcgcacccacgccgataagggcggccgtttcggcggtggcggtgccaccacccctaccgccgccgttgttcagaagagaagacagctccgccagctctggcctgtcgttggtatcgttgtcgccggcaaccaaggcggcggtgccgatttctcctccggtggtggctgccagcggtactaccaccagcgccagattttgtggcaccaccatgccaccatctggctccgaggtcatcaacatgcactcgcaggctcagcagcaagccagcaggaaggcaaggcggtgctggtcaccggagcttcaccggcggttcgttgccgctttgcacgaactcggtggccctcaagtggctactccgaaacagatcagggaggtgatgcaagtggacgggcttacaaacgatgaagtgaaaagccatctccagaagtaccggttgcacaacagaagatcctcccccggcgcggcggcggctccggtgagccagtcgatcatgctggtggatggcgtctgggctgctcaggagcaaagcagcggctcgcagtccgggtctcggcagggcccgctccagttctccagggcaggtatggccgtcggtggcggcgacgacagcagcagcagcgacgacgacgaagacgacgacaagtcggaggatggctacagcctgaaatgcgtgtgaggctgaggcaggctgcgtttgcggaagatcggatgagagtgtagagagatagcgttgtcgcggcttgagcatgcatcggtggattcttgagtctgtccgagagagtggttgtagtgcaggcaggcatgtatacagggagattaggcgcgcgcggcccgtgtgcgcccaagagatgaactgatcatgcggcgtttggaaagctaaagctgataggcgttttgtttgagtctttgctgacttctgttaacttccgggcagatcacaaaattttcgccctgagaataacttattaataataatattactgcggcggctgctgttatttt

SEQ ID NO: 1832 - DNA, 1355 bp, Zea mays
acaatccgcatcgatccccaccgcaaattgcccctatctatccctccctacaaatcgaaacaaagaaagataaaatcgagaggacgccagggccgattctctgcgtgacttggggcgtcgtcgccgagttttctccggccgagggcggcgcgaccggacaaccagcgtgagcgcgaccggcgacatgactcatatccttcccaaaccccgattatggatctgcgcatagggaaactcttgctctaatccatcttttgcttgtatacgatctcgatctgtttcgttgtttcgattccctgttcctccttccttaacttgcgcgcacgcggcaaccagcgtgaccgcgaccgtgagcgcgcggcggcgcggaagcccaacgccaagaactcccaggacgggctcaccccggagcagcgccgcgagagggacaagaaagctctggaggagaaggcggccaagaaggcgcagcaggcagcggccggcggcaccggtacctccacggacaacaacaagaacaaggcaggtggcaagaagtaggaggcagtggcgcgccgccacctctgtacgattaatcgatgccttgagcttgtaacttgttcgcatccttgtaggtgcgatgcttgttgggtcataaactctgatgatatcgagatttggtgatgagaataatgctatctatccctccctacaaatcgaaacaaagaaagaaaaaatcgagaggacgccagggccgattctctgcgtgacttggggcgtcgtcgccgagttttctccggccgagggcggcgcgaccggacaaccagcgtgagcgcgaccggcgacatgactcgcggcaaccagcgtgaccgcgaccgtgagcgcgcggcggcgcggaagcccaacgccaagaactcccaggacgggctcaccccggagcagcgccgcgagagggacaagaaagctctggaggagaaggcggccaagaaggcgcagcaggcagcggccggcggcaccggtacctccacggacaacaacaagaacaaggcaggtggcaagaagtaggaggcagtggcgcgccgccacctctgtacgattaatcgatgccttgagcttgtaacttgttcgcatccttgtaggtgcgatgcttgttgggtcataaactctgatgatatcgagatttggtgatgagaataatgcgtggttttctggctttctgttctgtcccaaaacttgaatggctgaatcatctagagttaggatgtggaggaacttttgcttgctgtcaacacatgtatgctgtcagttaacttttttttagattaaatagtgaatcatgccaattgccaaccaaaaaaaaaaaaaaaaaacgcccggcc

SEQ ID NO: 1833 - DNA, 1400 bp, Zea mays
cgccgacgtctatattagacttttaatagtagtagggatttgagggattgagaagaagttttacaatttcaaggaaaaattatataaacaagaagtttaaaaatagatataacaatttgtattacctcattcacttgtatgactaattttagggagaaaaagagagagaccgttttttttccggtttgatggagttgcaatgtgcaggtcaggtccatctccatggctccacacctcaagctggctggctgacagcatggccccacaacgctacgggcagggcagacaatccgcatcgatccccaccgcaaattgcccctatctatccctcccggcaaatcgaaacaaagaaagaaaaaatcgagaggacgccagggccgattctctgcgtgacttggggcgtcgtcgccgagttttctccggccgagggcggcgcgaccggacaaccagcgtgagcgcgaccggcgacatgactcatatccttcccaaaccccgatcatggatctgcgcatagggaaactcttgctctaatccatcttttgcttgtatacgatctcgatctgtttcgttgtttcgattccctgttcctccttccttaacttgcgcgcacgcggcaaccagcgtgaccgcgaccgtgagcgcgcggcggcgcggaagcccaacgccaagaactcccaggacgggctcaccccggagcagcgccgcgagaggtgcgcttattcttctccgacatgtccagatctccgttgcttggcgctgaccctgtcccgatccggttgttgttggcagggacaagaaagctctggaggagaaggcggccaagaaggcgcagcaggcagcggccggcggcaccggtacctccacggacaacaacaagaacaaggcaggtggcaagaagtaggaggcagtggcgcgccgccacctctgtacgattaatcgatgccttgagcttgtaacttgttcgcatccttgtaggtgcgatgcttgttgggtcataaactctgatgatatcgagatttggtgatcagaataatgcgtggttttctggctttctgttctgtcccattccttgaatggctgaatcatctagagttaggatgtggaggaacttttgcttgctgtcaacacatgtatgctgtcagttaacttttttttagattaaatagtgaatcatgccaattgccaaccaatatcaagtgcacactgaacgctagctagacaaatgtttaaaagtcaattctcatgaaatttctagcttgcctacatgtgttgctacttaattgttgttgggtgcaaacgagatagtaccaaactccatctatttcgaatcgaacaacttatgaacagtctcacatcatcaatttaatgtttggaaaagtggatatagccggtgaaaatgc

SEQ ID NO: 1834 - DNA, 772 bp, Zea mays
ccccccttcgggtcgacccccgcccccgacattacctgccgtgccgcagcattagaggtcctgtgtctcgtaggtggacatattctccgcgtgacttcaggtgtcgtcgccgagttgtctccggccgagggcggcggcgcgaccggtaaccagcgtcagcgtgagtgtgacaggcgacatgactcgcggcaaccagcgtgaccgcgatcgtgagcgcgcggcggcgcggaagcccaacggcaaggggccccaggacgggctcaccccggagcagcgccgtgagagggacaagaaagcgctggaggagaaggcggcgaagaaggcgcagcaggcagcggccggcggcaccgggacctccacggacaacaagaataaggcaggtggcaagaagtaggccgcagcggcgagcggcgccacctctgtacgattatcgatccatgcctttagcttgtaacctgttcgcatcctcgtagatgcgatgcttgttgggtcataaactcgttttctgttactctgatatcaaaatttggtgatgagaataatacgtggtgttctggttttgtgggttattattttcttctctttctatcgttttctgttctgttccttgagtggccagccagtcgatggatgggaatcctctagtttagagagtttagaggatgaactagggtgtgaaggagcttttgcttgctattgtgaacaactgggacatgatagcttttgaaattggaatttggtttcactgtaaaaaaaaaaaaaaaaagcggcc

SEQ ID NO: 1835 - DNA, 1484 bp, Zea mays
ccacgcgtccgcaaaagttgttctttgacctgacgaatgcggaacgctgcatctgactctaatggaatgcgtatgtgatgcaggtggagtcggaggacgaggcggaggcggcgtgcgcggtcgtgctgacgccgccgctgtcgctggagggcggccttgcggcggagctccgcccggccaatctcgcccagcgggtgctcagcctcttcctcaacgtccgcccgggctctgacctctcccacttccagctgccggcgacgttcaacctgcccaagtcgcagctgcagctgtacggcgagggcgtgtactgcgccggcgaggacctgctggggcggtgcgcgcgggggcgcgacagcctggagcgcctggcgtgcgtggtggcgtggagcatctccacgacgcggccccccatcttcggcttcgcgccctacaacccggtgctaggggagacgcaccacgtctccaccacctccggctgcggcggcggcctcaacgtgctcctggagcaggtctcgcaccggccgcccgtgacagcgctgcacgccacggacgcccgcggggaggtgcggctggtgtggtgccagagccccgcgccgcggttccacggcgccagcgtggaggccgcggtgcgcggcgcgcgggagctccgcctgctccggcacgccgagacgtacgttatcgggtgccccggcctgctgatccgcctcttcccgtcgcccgcctgcgagtggtccggcgacgtccgcgtcgtctgcgccgagtccgggctcgaggcccagctcagctactgccggacccgccgctccttcctcggcttcggcggcggcgacgcccgctgcgtcaggggcaggatcttccgctcggctgagcccggagacaccctgtgcgagatcgacgggttctgggaccgccaggtcacgcgcagggacctcgccaccggcgaggtctccgtgctctacgacgcgcagcgcgccatcggtgacctcgccacgcccgtggtgcaagaccgaaagggcgtgcgttcctctcggtcggccgtggtctggggcgaggtgagcgacgcgatcctgaagaaggactgggagacagcccagcaggcgaagcggcgggtggaggacacggcgaggaggttcgccaaggagaggaacgacaggggggaggtgtggacgcccaagcacttctcactgtcgcagaacaagagcggcgactgggagtgctggccgctggaggactccgtgccgccggctcctattgtcgtcccctcctcctcctcatcatcatcatgaaagatctatgaatccacagtacacacatacggtacagaagtgagagaaacaatgttcatggaacaaacgatgaacagcctattttggtcgtcgtaatctatacgtaaacggatccagtctgtatctgtattctgtacatccccactgggcatgatggatggtttcgacagcaacgctaaaaaaacccaaacaagaccc

SEQ ID NO: 1836 - DNA, 1553 bp, Zea mays
gcacgagaccattacctagaacatcctaatcgaaaaaggacttgcgtgttgatggcatagctgagtttgcaagatcagtggtgaacacaccacagcgaaagctccactagccctcacagcaacagatgcggacatgtacctccttgatttgttcacaaacaatgtggagtcggaggacgaggcggaggcggcgtgcgcggtcgtgctgacgccgccgctgtcgctggagggcggccttgcggcggagctccgcccggccaatctcgcccagcgggtgctcagcctcttcctcaacgtccgcccgggctctgacctctcccacttccagctgccggcgacgttcaacctgcccaagtcgcagctgcagctgtacggcgagggcgtgtactgcgccggcgaggacctgctggggcggtgcgcgcgggggcgcgacagcctggagcgcctggcgtgcgtggtggcgtggagcatctccacgacgcggccccccatcttcggcttcgcgccctacaacccggtgctaggggagacgcaccacgtctccaccacctccggctgcggcggcggcctcaacgtgctcctggagcaggtctcgcaccggccgcccgtgacagcgctgcacgccacggacgcccgcggggaggtgcggctggtgtggtgccagagccccgcgccgcggttccacggcgccagcgtggaggccgcggtgcgcggcgcgcgggagctccgcctgctccggcacgccgagacgtacgttatcgggtgccccggcctgctgatccgcctcttcccgtcgcccgcctgcgagtggtccggcgacgtccgcgtcgtctgcgccgagtccgggctcgaggcccagctcagctactgccggacccgccgctccttcctcggcttcggcggcggcgacgcccgctgcgtcaggggcaggatcttccactcggctgagcccggagacaccctgtgcgagatcgacgggttctgggaccgccaggtcacgcgcagggacctcgccaccggcgaggtctccgtgctctacgacgcgcagcgcgccatcggtgacctcgccacgcccgtggtgcaagaccgaaagggcgtgtcggcctcggagtcggccgtggtctggggcgaggtgagcaacgcgatcctgaagaaggactgggagacagcccagcaggcgaagcggcgggtggaggacacggcgaggaggttcgccaaggagaggaacgacagaggggaggtgtggacgcccaagcacttctcgctgtcgcagaacaagagcggcgactgggagtgctggccgctggaggactccgtgccgccggctcctattgtcgtcccctcctcctcctcatcatcaatgaaagatctatgaatccatagtacacacatacggtacagaagtgagagaaacaatgttcatggaacaaacgatgaacagcctgttttggtcgtcgtaatctatacgtaaacggatccaaaaaaaaaaaaaaaatagtctgtatctgtattctgtacatccccactgggcatgatggatgtcgacgcggccg

SEQ ID NO: 1837 - DNA, 3823 bp, Zea mays
  misc_feature (2298)..(2298): n is a, c, g, or t
ctcggccgggtattattttgtttctatgggacttttgtgtctcgtggagtctttttttggtcctcacaaatgtgaaaacctattttaggcctcgtatcatccattcatcactggtgaagccttcactggtccttacgagcctgttcaggagaccccacgaattcctgttggacgtgctgcagtagttgaccacaatccaggaggaggtcacttgctgggtgctggtctttctcctcaggttggaagcattaacagatgcttacgatttaacaacgctttgcaaccaaatatgcctttttcatatggaagcagttgtggcagttttgggagccatggtagctttaacgataatgctggctttagctatggaagctatgattttaacagtgtcgacatatataattcaccaatggatccttctgggtttaatttacgttcacaacttggaggatcgtttctcggatctagcccacatattcgacgaagacctcatctctcacatggtggtggcattcggttaagccctggtggtccagggcatatgtctcttggggccagtccatcacaatttacaccgccaaattcccagatgcaaatcccaacaggtcctaatggaaggtatggtgcctctccttcaagaggtggacatggctcttcgttgggaaaggttgctgttgtaggccaatacaataggaggaggaatcagggttatccacctatgccaatgccaccacatgaacacacatctcaactgatccaggggcaccaaggagatggtgtcagtactgctcgctttggtgcatatgcccaaggaaattctacctacctacataatgcactccctaattctagtcattatagttggagatcgcaaaggggatctggcagtggtttacctttggacccttcttctagccgtggttcttttccacccaccaattactatggctttcctttacactccgatgcgtcagcagatacattgccctccacctcatcagtatcagatccagccgattgggatctcaactctagtgacaagtcactcctgcaagaggaccgaacactgtcagctgggttaagtgatcttcgcttgatagacgcaagtggccaaacaaacagatctagcagattggctcctttccaaagtcatgatattttaagttcaaacccttcgactatgaatcaaagaaatggacacctatttcatgcatcatctctgggagagagtacacatactccaggtcatgtcacattggatggatacgaacacacaacttattctcagcgaagtttcccaatctatcgtgggcaaccatttcagcagtacaacaacatgacttccagttacatccgaccgatgagggctcatcacaatggtcagcctgtctggtctaattataggctgacagaacctccaccaactacaatgggtgacggaatgctctggggagggaggggtggccattcgtttgcagcgagcggactgccacctacacttaggaaagattttgggagaatcttttagtcctgaatccggaggaatgccgaatgccaccaaattgatggcatcagttgtttgcatctgcaattccgggttggattatttgctgggggtgcctactggtattgcaatttgttgtgttcctccgatgtctcccaggatgttcggttcaaatgattatatggtacgggatatgattacagtgctcgttctttgctatacctgcacgatctagtagaaaaatgtcagttgtgctacttgatgcgaatcttgctagttcgaggtttgggagagtttttctgtctcggttattgtcttcctttctctattctatttttgacagagggttaagttcctgaaccttaacatggctaagactgaagtgaaggccacgtggtcgtggtgacatgatttcgttttcgtgatactcgaggagccgactatctgtttttaagcatctttctgttgttgttttgctacaacaggttttctaagggcgtctgtgtccaacgtggtattagaatttgatggatctgagtcatctgactgtaaattctataagcaaactcaaaaggggtataagagcaactccaagaatctgccaaaaaacttttactaaaaattatatatcggaggcttcactaaaaaaatactttccctaatatcttatctccacacagaggatccctaattattaactgtccaataatttaaatctttgacacatcagcatgtgggctcatatgtatcgccgattatgctggtgtagacttatttcgaatgataaatcattnacactcaaacggtgaacttggaacacgaggttataatggtttaggttggagccacagtctagtgtagtgctgattgtagtattgcaatagaaagcgttacaactcgtgtgcttatgtcgtagaggaagaggggcctccccttttatatctctaggggtaggccttacatagttgtttctcttagatacagatagagagtcctttggttgttgtggtgggccctcctcctttggtcgtgcaaacttgtgcttccgtcatggtgtcgcccggtacacttgttcctacggtgggttcgtggctgacgtccctggggtgacatacgacgagtaccatggttcaacctcggggcttgattcatatggcacgactttctcctgtcgtcgtgggcccttcgctgtccttccgtatgtacagattcttctacccggtatagcgtcacgtcctgtcgcttctgacatactatttattatggagattctgctgactggtgccgcttggtcccatcagaccgtgcgatatgcttatattagaatggtgcgtatagtcgtgttgatggctatcgcgcgggttcctagtgacgtgtcctgctgtggtcgacgtgtgctcacggcttcatgacttggaccggcttcggcgagggcctagtcgtccgttgcgcctcatagacttgctcgacagggacttggtcgttcactctgcctctcggacttgctcggtagggacttggtcgtccgctttgcctcgcagacttgttcgacagggatttgctccgtctcgtagatttgctcgacagggacttggtcgttcgctccacctcgccgacttgctcgacatggacttgctccgcctcatagttttgctcgatagggtcttggtcgctcggggtttacactgtttgtgtgcatttttcgagaccgatccttgacggtttttcagagcctggtgtatgtccatctgttttaatgccgaatcattgcccttaagggcgatacttccggtcactacttgtctttttccgtgcacacatctcccccgtacaggattcttttcaaagtctttcttttaggggagggccttcctcctccgacctagtcgctgaggggaaggaggtcgtcgagctacaaacgggttacccaagtgagatttgacctctcctccggtagggttaggtcttggcgagcgatctcagtgggagtgctcgacccgttgggagcatctcattgagtccttctttattcgatcctattacggtggggccagtggtcaccctgtcagctaggtttccacgggagaatttgaggtgcgaccttggacgtggtgccgagcaaatgacctatgagacggtcacctagcttgcgactcgctgggagcttgctcggtccacccctcactctgcgcgttgagttgaagtgcattttggtttttacctgattggcatgatgtaattgtcatggcggcgtggtaaaatatggggtcatcattacgtcgctcgatgttgacgacccgatgggacatgaaatgacac

SEQ ID NO: 1838 - DNA, 1355 bp, Zea mays
  misc_feature (1340)..(1354): n is a, c, g, or t
attgggtacctcgaggccggccgggaaaaaaaaaactcctcgcgaagccagccaacgccaccaccagtccaccaccccaccatcagttactactgcctgcctgcctgcctgcgtctctcctccaggtccaggctccaggaatccaccccccacctcctcggattctttccccctctccagctcccccgtcctgcagccgcctgcactgtgctgccgccccgttcgcctcccggcctccagcctcctcggttcccgcgggagggccatgaagttaaggacaaaacgacctgaatggaagtcccttgtgcctctacaactgagcagattgagcaggaaatctgccatgcgtttctttttgttccccaaggttcagtcggctggtcaatcgccagatgataccccagtttatcttaatgtgtatgatttgacgccaatgaacggttatatatattgggcaggcctgggcatatttcactcaggaattgaagttcatggtgttgaatatgcattcggagcacatgactttcccaccagtggggtctttgaggtagaacctcgccaatgccctggtttcagattcagaaaatcaatatttcttggtacaacatgcttggatccaatccaagttaggcagttcatggagctgcagtcagtaaactacaacggcgatacttaccatcttatcacgaagaactgtaaccacttctgcaaggatatgtgctacaagttgaccggtaacaaaattcccaaatgggtgaatcggctcgccagaataggcgccatttgcaactgccttctcccggagtcgcttaagatctctccggttggccatgacccaaacagtcaatccgaagactcggagaagaggcgtctgaggaacccattcagctgcttctcttcgatctcgagccaccggcagctgccgtcgtcatctcctttcccaccatctcctgtgaaagggggcctcccccgttgctcgtcgaggaaaagcagcacggcgtctccgaaaaataggtagcctgccctggggcgcgcccctgcgtaacttccgagtcgtcgtgctaattcctgcggtgtcaacatctggatccgcacggcgagtgctgtgctgtgctgcgctgtagctttctgtcaggtacttgttttttggtcggtaaaaatcagatgcctgatgttgtatcatgtaaaaaacccctagcgacgtgtgctgctgatctgcctcgcaagatctgttgggagggtgaattgccactcggttctacccgccgcctatgtactctactcagggatttgtatattaatccattattctttcagctgttggaaaaaaaaaaagctcnnnnnnnnnnnnnnna

SEQ ID NO: 1839 - DNA, 1840 bp, Zea mays
taccgcccggccgccagccaaatcgaaggagattgaacgaagcagcccagccaaattcccctcgccgccccgtcccttctcgacatttcttgtcccgtcgtcgcctcaatctcgaagcctctccggcggagccgcctcatcatcgttccgaaggcctccaaccaaacatcctctagggtttccgcatcgtccgtcgcgatgggcttcacgaagcggtcgccccagcatcccgcctccccagccggcggcgaggtcggcgcccagacggcagggaaggtcacaccagtgccggcggcgccggagtcggcgcccgcggcggtggtgccgaggcctccggacgtggcgcccttcctgaccaaggtctacgacatggtctccgacccggccaccgacgcggtcatctcctggagcgccgccggcggcagtttcgtgatctgggactcgcacgctttcgagcgcgacctgctgccgcggcacttcaagcacaatcacttcaccagcttcatacgccagctcaacacctacggatttcataaagttgatccagatagatgggaatgggccaatgaaggctttgttaagggccaaaaacatcttttgaagaccatcaagagaaagaagaaatcctctcaggatgtacctagtgatctgcagtcggtgcctgtcaaaactgcacctggcactgagaatatcgagataggaaaatatggaggccttgaaaaggaggttgagacacttaagagggacaaggcccttctaatgcagcagcttgtagatctacggcagtaccagcaatcatctagcgctgaagtgcagaatttaattcaacgcctccgtgtgatggagcagaaccagcagcagatgatggcacttttggcaattgttgtccagaatccagacttcctgaaccagctcgtgcagcagcagcgcaggagtaactggtggaatgatgatggtaacaggaaaagaaggttccaagctctggaacatggtcctgtagatgaccaagagacttctggtggaggcgcacaaattattcaatatcgtcctcctgttcctgaaacttccaatcagccaataccagcaaatgaagctttctattcaacccctgcacaaccagcttcaagccctgcacttgagatgcccatggatgtagagatgacttcaaacaatgttaatacctttgattcaactggcaatgattttactgacacctctgctctatgtgaatggtatgacatggatatatttggtgatgaacttgagcacattcttcaacagccagagcaggactttcaagtggaccctcctttaacagttgaggattatggttatgatcatccacggttagagcaggactatcagatggaagcacaacagaattgcaaaaatcctcaatatgttgcctgtgtcttgaagcaaagggaaagccatgcatctgatgtccattagtactgatcagtttgagctgatgtcataactgaagcatgagcggtggtcccccagaatgttgtccagtaacattagtggatagagatttgtgatgaacagaatcttgagactggcaggttagccaccattgggaacctgaagaccgtcgggattgctcagaattcagtatactaatactaatactaaaaaaaaaaaaaaaacatgttgactatacatgatttcgttttccttactcgctcgaccaaaggcagccgtacaatatttttacttttgtccaggtgggagcatctaggtctttaaatggtttcggtgattaatggtgatcctagattattatgatttgcagagactataacttaggttatgatagcagtgattgattatgcgt

SEQ ID NO: 1840 - DNA, 6839 bp, Zea mays
  misc_feature (2694)..(2694): n is a, c, g, or t
caaaacacacattagtcacttcaatcttatgttgtcattgatcacacgacccactaaaagagcctagatgctttcaaacttatctagtatgtttgtagtctaattcttatgagttatgatatgttagctgatgcaagtttttatacaagtgtcgcgttgaccatgtttttttattctcgctcgttttatgactaaaactaattaaaaaatactcgaggcgctatagggtgatgatgtcatgaacaacatattggttcatcttttcagaaatctagcttataggtgctacataacttctcttgtggtttttttgttccggtagtttcagacgactcagaaacttgtcttgtgtttcaattggccttttagttatctaactacaaatgggagaaaacaatatatggaaaaaaaacagtcgtaactattttgtgtagttgacttgtcctcgcactcttggtcctccaccagacttatttaccatatcttttatttcaaactctactatgtaaatagtgtggtatacagtataaaatgatattttgtatggctatatccataatctgctacacgtatcaatttttttagttacaaatggatttcttcttattgaaatatctcacgcgagactttcgtacctttttttttgtaagaaaaaagcaaaggacgccggagaccggtgctgactgactgctgaactccagtatctgaatttggcctcatcaggaaactgtgacatgctgcagcattcgtcactccacgtgctcggctaggaatttaatcgatccccatgtcaaaaggcaaaaagtgatcggcacgggcggtcaggtcttccgcggccgcggggcacgcatggcagtctgctgtctgccactctgccggcggcaactggccctgtctgttgtacgcacaggcaggcagaccgcagatccgagcagatcaggcagccgtctgggcagaacaggcacgacgcacggccaccacccatctgtcctcgcagaaccggatgcccttcttctccgcatcacccacttgtgcctcggccctccgcctctccgcaggcggggcagggttctgcattgcccatgcgcctcgccgccacaccacttgctcgttttcagcggtccagtcccttcccctccccgccgccggcgacatcgctgcactggagtacaaaatccttctaccggttgcgcgtggatggatgacgaatatgtgcgtgacagggaggtttgctggtcgcctattgcttttttaagcaaaacgccggatggggaatatatgagcaaaccagcccggcactcgacaccgtgaaggcggcacccggattctctcgtctgaggtcgtccaaggttccctctccggtttttctatccaacaaccaacaaaccgttgcttgatgtcatgcgtcctagtctagtaggtgttcagcaaatactaatattattatatgtctgtagcccggcacgacagcatacgaacaagctaattaaacaagtcacaaagctagcaagcactacaagggtaggaatcgcggcggccatgcacttgcagtggcagtacatagcgctctggtcagctctgcaaggaagccacacacacacacacaatgacacaattcgtcaagtcctgcggtgcaagtgcaatgcacatcagaagggccagaggggcccccctctggatgaaatcagctttgcacattgcagggagagggttaaaaggcgggcactgctcgcctgcctgcagatgagggaggctgctttccaaagcacgatcgatttggcgccaatcaccggttaaagcggtgagccgcgcgcgattagataaaaatcatgtgccccggcgcgccgcgcgcgtgcccccgcgcgcctggggtgacgccggcgcgtgccccgcggggtgcgtggtgcccaggtggccgccccctcgcccgcccgatcccacccgtggacgcccacgatgcggtttcccccagagccctcggcacggcacggcacgtacgccgccccgagctccacgggaatgcacaccggcgcccgggcccgtacgaggtggaggggtgccgtggtgcacgaggccacgagcaccgctccggggccgggagtgccagccaacggaatataaataggggcgagcaggggttcaagcgctaccatccaggagccgagaatctctaaaaggcgccgctcccgtccacggcgcggcgggcagcagcgaagcgtcggtttcagaggccggcgggccggtcgagtcggtggagggagggtgggtagatagatagctagctactagcgggtagcggagagggtccagtcagtgggcgggaggagcgaggggccgggaccgggacgatggcgtcgcggaagtcgccggtggcggcggaggagcgggcggggacggggacgggggaggggaagggggagcggtgcgcggtggaggaggtggcgctggtggtgccggagacggacgacccgtcgatgcccgtgatgacattccgggcgtgggcgctggggctcggctcctgcgtcgtcctcatcttcctcaacaccttcttcacgtaccgcacccagccgctcaccatctcggggatcctggcgcagatcctcgtgctccccgccggccgcttcctggccgccgtgctgcccgaccgcgaggtcaggatcctcggcggcaggctcggcagcttcaacctcaacncggggcccttcaacgtcaaggagcacgtcatcatcaccatcttcgccaactgcggcgtctcctacggcggcggcgacgcttactccatcggcgccatcaccgtcatgaaggcctactacaagcagacgctcagcttcgcatgcgccctcctcatcgtcctcaccacacaggtacctccgtcggtccgtcctactacgtgctagttactactgcttaaaataaccaggggtacagcagctcaaattatattgttttcgttcgtttcttcagttctgctgctgatcacggattctagtatcaaaaaatataaattcaaatggtttaaaaaatatttttaatctaaataataaataaaatgacgtatctaaatgccttctaaaagtttataactttatcttcatgatcttttagagcgcttaataacctgctctacgaattaaaccaattttttttaaagcctgagcagtctcaatgatgaactaaatgctgttaacctgttaccaggcactagcacttagaattgacccgtctctaatctatatgtgtcgtcatttcatattcacgtctttggcacgcgaatgtaacgtgcacacttggtctagaagactagaatcaaaagtgcggctgataagcatatgcatcctcctcatcaagatgcgcagagcagtctatatcgtatttgttccctggttaccaccaatcatggcccccggggaagaaagctgaaaaggaggtctgaaaagtctcacgccgatgtcacgatgagaccatgcatgtatgtactcgtgctaggacggccgacaaataattggcaggattttgtttgtttgcacgcacatgcgtcttcaacatttcgtagtgggggtggggagcttcagaatccctgtctggttgctggctctagcctctagctgagaaaacattttttatgaagaaatataagttgaaacaaacattctttgtggaggaatgtacatgacaaaagaaactggttgggttaattaactattgttcactgtcctcagttaagtatataataatccaaaagcaaaggttagatgctgatgcaggcatggagcgcagagacagatggcgtttgactggtgaaattctaacaatatagtacttggccgtcgctggcatggccactgcagatactggggtacggctgggctgggttgctgaggaggtacctggtcgaccctgccgagatgtggtggccttctaaccttgcccaggtctcactcttcaggtaattttatttacttatttatcacccagttaatactgacgagtaatttctcagttactacttactagtagccctgtgtgctgggtggttatggtaacaatgttacaatggcgtatggtgcatgtacgcatgcagggcgctgcacgagaaagaagaggagggcggcaagtcccgtggcccgtcgcggatgcgcttcttcctcatcgtcttcttcgcgagcttcgcgtactacgcgctgccggggtacctgctgccgatcctgaccttcttctcgtgggcgtgctgggcgtggccgcacagcatcacggcgcagcaggtcgggtccgggtaccacggcctcggcgtcggcgcattcacgctcgactgggcgggcatctcggcgtaccacggcagcccgctggtggcgccgtgggcgtccatcgccaacacggccgtgggattcgtcatgttcatctacgtcatcgtgccgctctgctactggcagttcaacacgttcgacgcccgcaggttccccatcttctccaaccagctcttcacggcgtcgggccagaagtacgacaccaccaaggtgctcaccaaggacttcgacctcaacgtcgccgcctacgacagctacgggaagctctacctcagcccgctcttcgccatctccatcggctccggcttcctgcggttcacggccaccattgtccacgtcctgctcttccatggcaggtactttatactgcatcagcccttccctcccactttgatggaccgtcgcatccatgagcggtgtgctgaccagtcgtcgctgtacgtgctccttgacacagcgacatgtggaagcagagcaagtcggccatgaacgcggtgaagctggacgtgcacgccaagctgatgcagaggtacaggcaggtgccgcagtggtggttcctcatgctgctgctgggcagcgtggtggtgtccctgctcatgtccttcgtctggaaggaggagatgcagctgccgtggtgggggatgctcttcgccttcgcgctcgccttcgtcgtcaccctccccatcggcgtcatccaggccaccactaaccaggcacgcggcgctcccgctctactgccgtcgccactgccgtcatcgtatcgtctgaaccctgctgtttgtccgtgaaattccttgcagcaaccggggtacgacatcatcgcgcagttcatgatcggctacgcgctgcccggcaagcccatcgccaacctgctcttcaagatctacggccggatcagcaccgtgcacgcgctatcgttcctcgcagacctcaagctcggccactacatgaagatccccccacggtgcatgtacacggcccaggtacgtagtggtcgctgtcgtcgtcgtcgtcccccttcagcagacctttcgggagacgccgcccgcatatgaatgaaactggccctaaacctgcgccgcagctggtcgggacggtggttcgccggcgtggtgaacctgccgggggcgtggtggatgctggccaacatcgagaacatctgcgacgtggaggcgctgcacccggacagcccgtggacgtgccccaagtaccgcgtcacgttcgacgcgtcggtgatctggggcctgatcggcccggggcggctcttcggccagcacgggctgtaccgcaacctggtgtggctgttcctggtcggcgcggtgctccccgtgccggtgtggctgctgagcagggcgttcccggagaagaagtggatcgcgctcatcaacgtgcccgtcatctcgtacgggttcgccgggatgccgccggccacgcccaccaacatcgccacctggctggtgacgggcaccatcttcaactacttcgtcttcaggtaccgcaaggggtggtggcagaagtacaactacgtgctctcggccgcgctcgacgccggcaccgccttcatgggggtgctcatcttcttcgccctccagaacgcgcaccacgagctcaagtggtggggcacggaggtggatcactgcccactcgcctcctgccccaccgcgccgggcatcgccgtcaagggctgcccggtgttctgaatcttccgacctgagcgtagtaagcagtgtgtgtaacagtgtaaggaaatgtttgctacgggagccatggattcaaccaagcatcgattaaccgatgcagtgctttgtcactcgtgaatgtaacaccatagcgccagtggtggattcagatttcagagggagaaaaaaacacaggcccagtgtctttggaacgcccgaatttggagtcatctggaaccgacggctcaggtttactgcaaccaacaacttagcacttgcgatctagcgtgtgtaataaaagtctgcacagttcgaagctcggcgtgtcaagaacaagaagcatatgtgcggagaataccggagcggcgaaaactgcatggtttttatttagaacaagaagcatatgacgatacagtttttactccatgtcatagcttcaagaatccacaaaacacaaaggaatatacagactgatatttgataaaagcgagagtatgatcaagcgatctcatgtggtgaaagttggctaataaaagttgctctacgaatacctggttctggagtgccgtcgtccatcctcctcatcctcacagattgtacacttatcacctgaaagcagaaagtccttggctacttgcatgtcttctttgaactctggacgccgggcctctggatgctcaaagtggcagctcgaagatttcctcttcccttgctgcgatgtgtttcctgcagatccatgcaatgtggccgtcatctctgtatcgaacacgccacaggccaaatctctgtgctatgtccatccccgtcagaaccccttgccctttcaagaaatccacaagccattgcctggctgctg

SEQ ID NO: 1841 - DNA, 3070 bp, Zea mays
tgcatgcctgcagatgagggaggctgctttccaaagcacgatcgatttggcgccaatcaccggttaaagcggtgagccgcgcgcgattagataaaaatcatgtgccccggcgcgccgcgcgcgtgcccccgcgcgcctggggtgacgccggcgcgtgccccgcggggtgcgtggtgcccaggtggccaccccctcgcccgcccgatcccacccgtggacgcccacgatgcggtttcccccagagccctcggcacggcacgtacgccgccccgagctccacgggaatgcacaccggcgcccgggcccgtacgtacgaggtggagggtttgccgtggtgcacgagcaccgctcctggagtgccagccaacggaatataaataggggcgagcaggggttcaagcgctaccctccccgagccgagaatctctaaaaggcgccgctcccgtccacggcgcggcgggcagtagcgaagcgtcggcttcagaggccggggggccggtggagggagggtgggtagatagatagctagctagcgggtagcggagagggtccagtcagtgggcgggaggagcgagctaggggaccgggacgatggcgtcgcggaagtcgccggtggcggcggaggagcgggcggggacgggggaggggaagggggagcggtgcgcggtggaggaggtggcgctggtggtgccggagacggacgacccgtcgatgcccgtgatgacattccgggcgtgggcgctggggctcggctcctgcgtcgtcctcatcttcctcaacaccttcttcacgtaccgcacccagccgctcaccatctcggggatcctggcgcagatcctcgtgctccccgcagggcgcttcctggccgccgtgctgcccgaccgcgaggtcaggatcctcggcggcaggctcggcagcttcaacctcaacccggggcccttcaacgtcaaggagcacgtcatcatcaccatcttcgccaactgcggcgtctcctacggcggcggcgacgcttactccatcggcgccatcaccgtcatgaaggcctactacaagcagacgctcagcttcgcatgcgccctcctcatcgtcctcaccacacagatactggggtacggctgggctgggttgctgaggaggtacctggtcgaccctgccgagatgtggtggccttctaaccttgcccaggtctcactcttcagggcgctgcacgagaaagaagaggagggcggcaagtcccgtggcccgtcgcggatgcgcttcttcctcatcgtcttcttcgcgagcttcgcgtactacgcgctgccggggtacctgctgccgatcctgaccttcttctcgtgggcgtgctgggcgtggccgcacagcatcacggcgcagcaggtcgggtccgggtaccacggcctcggcgtcggcgcattcacgctcgactgggcgggcatctcggcgtaccacggcagcccgctggtggcgccgtgggcgtccatcgccaacacggccgtgggattcgtcatgttcatctacgtcatcgtgccgctctgctactggcagttcaacacgttcgacgcccgcaggttccccatcttctccaaccagctcttcacggcgtcgggccagaagtacgacaccaccaaggtgctcaccaaggacttcgacctcaacgtcgccgcctacgacagctacgggaagctctacctcagcccgctcttcgccatctccatcggctccggcttcctgcggttcacggccaccatcgtccacgtcctgctcttccatggcagcgacatgtggaagcagagcaagtcggccatgaacgcggtgaagctggacgtgcacgccaagctgatgcagaggtacaggcaggtgccgcagtggtggttcctcatgctgctgctgggcagcgtggtggtgtccctgctcatgtccttcgtctggaaggaggagatgcagctgccgtggtgggggatgctcttcgccttcgcgctcgccttcgtcgtcaccctccccatcggcgtcatccaggccaccactaaccagcaaccggggtacgacatcatcgcgcagttcatgatcggctacgcgctgcccggcaagcccatcgccaacctgctcttcaagatctacggccggatcagcaccgtgcacgcgctgtcgttcctcgcagacctcaagctcggccactacatgaagatccccccacggtgcatgtacacggcccagctggtcgggacggtggtcgccggcgtggtgaacctggcggtggcgtggtggatgctggacaacatcgagaacatctgcgacgtggaggcgctgcacccggacagcccgtggacgtgccccaagtaccgcgtcacgttcgacgcgtcggtgatctggggcctgatcggcccggggcggctcttcggccagcacgggctgtaccgcaacctggtgtggctgttcctggtcggcgcggtgctccccgtgccggtgtggctgctgagcagggcgttcccggagaagaagtggatcgcgctcatcaacgtgcccgtcatctcgtacgggttcgccgggatgccgccggccacgcccaccaacatcgccacctggctggtgacgggcaccatcttcaactacttcgtcttcaggtaccgcaaggggtggtggcagaagtacaactacgtgctctcggcggcgctcgacgccggcaccgccttcatgggggtgctcatcttcttcgccctccagaacgcgcaccacgagctcaagtggtggggcacggaggtggatcactgcccactcgcctcctgccccaccgcgccgggcatcgccgtcaagggctgcccggtgttctgaatcttccgacgcctgagcgtagtaagcagtgtgtgtaacagtgtaaggaaatgtttgctacgggagccatggattcaaccaagcatcgattaaccgatgcagtgctttgtcactcgtgaatgtaacaccatagcgccagtggtggattcagatttcagagggagaaaaaaacacaggcccagtgtctttggaacgccaaaaaaaaaaaaaaaaaagggcggccgccaccgcggtggag

SEQ ID NO: 1842 - DNA, 3318 bp, Zea mays
gttcttaattcatagcatttgagaacaagtccccaacaacatgaaactaagttttctctctctcttagactaataactagagaaaatacctttttcaagactgatctgcatcactgaacgtggtccaatcaaattgcccaacacatgtcatcgataatctccataaagacttgttcggttattccaattccatgtggattttaatggaaacttgacttgggtgagccttaaaattctcgatcatatgatattaagtaccaccaaatttagactaaaccaacaagctgtagcaaagggggggggatcagagatgaggtgtactagtaaatattcagtggataaacgacatagttgtaatccggcaaatgcatgttccttcaccccaaaagaagactttctcttgttttggatggttgatttttagatccatttgaaagctctatgaacatgttggtgtccaatcaattgttgtttgttacgctctagctacaactagaagagaatgatagacagaagacctccgaccacgcttgcatgcatgcacgtccaggtgtccggctagctccaccgattcaattgcaatcaaatcacggctagcattccagctgggatttgattgcaagtggctggtttgattgcatcagtggtaaaccatagtcggtcgttgtaatcctgacgaaaaacaaatctggcagtgagatgttcaattaagggtggtacacagtgcatacggccataatgataatttatataagggatttgctaagcatatagtcgtctgatttttttttctatttctagacgacaaactatatatatatatatatccatctaatctaaattcaaccatcagaatctattttattaaacttattctcatcttttcttttgttgctagttcatcttcgctttgagaggcaactgtaggatagaaaatgtcatgatatatataataatagaactagcacaacttgttagatggagatcgaagacgacgacgaagggcgctgtcagtgtttccctggcgccctctatatcttccttccctccaaaccctcctcgcctctccattttagttagtgcgctccatggccgggccgctcctgctcgctattcttagccccagagctcgcgccacaccacaacacgtacctcccgcgcgcggggcgtgcaagcacacggctgccccggcccgcgcgcccgtgccggccggccagcagacatggacatcgacctcgaccgggcgcgcgcgctgcgtatcctcggccgcggcgccatgggcaccgtgttcctcgtcgcggaggggccctcggccttgcgccccagccgctacgccctcaaggtcttcgacaagcgctccgccgcccgcagcaggaagcctgacgccgaccgccgcgcgcggtgggagatcagcgtgctctcccgccttgcgcacccgcacctcccctcgctcctcggcttcaccgagacggacgaccttctcgcgtgggccgtcccctactgctccggcggcgacctcaacgagctccgctactcgctccccgaccgcatcttctcccccgcggccatccgcttctacattgccgagatcgtctccgcggtcgccgagctccacgccgcgggcgtcgtgtaccgcgacctcaagcccgagaacgtgctcctccgcgccgacggccacgtcacgctcaccgacttcgacctgtcccgcctcctccaccccagcaggtcgtccgcggagtcgtcgtcgcccccgcggccagcgtcgtcccgcggccaccacaaccgccggtcgcgcgtccccgcgcggagcgactcggttctcagccagcaggtcaagtcgtactccaactccaacaactccaggccccctcaccagccctggtccgcggcgtcgtcgccgcggcagcagctccagagcctggtccgctacatcatggggagcggcgacggggccggggtgggcaggaagagcaagtcggcgcgggtgtcgccgctgagccggaagcccgcgagcttcggcggcagctcctccgccgccgcgtggggcaagtcctactccttcgtcggcacggaggagtacgtggcgccagagatggtgcgcggcgagggccacggcttcgccgtcgactggtgggccgtcggcgtgctcgcctacgagatggcgttcgggcggacgccgttcaagggccagaaccgcaaggagacgttccggaacgtgctgcagcaggagctcgagttcccgggggacacccggtggcggacgccggagctcgcggatctcatctcgggcctgctggagcgggacccgaggaggaggctcgggtacgccggcggcgccgacgaggtccgggcccacccgttcttcgccggcgtcgcgtgggacatgctcacggaggtgtccaggccgccttacatcccgccgccggccgacgaggacctcgcggacgtcgaagggttcgacgtgaggggccacttcaaggaccttcaccagccgccgcctcccaagtccgcgtcggagtcgtcctcgtccgagttctcgacggagttctgactgtgagctcgggctagcttcttttgcgctttggtcctcggtagattactatattgtaaccagagggtcgagggtgtctgtactgtacatacatggagacggggatggtgctgtaaattcgacgtagagttggtgtggttgtgcaaacattttgggaagcgcgagggctcgccggcgcactgtgctcgaggcattttcttcgtgtaatttttttccgcttggcttgcaagcgatcacctgactaccgaagaaaaggaaaaggataacttgaatcggcgcaattttactgcttggttgagtttatattactcctacaacgtaggcacggataaattcacgagaattctgatgcgaattaaagtagtacttctagttccagaggacgtgcaacgtaccgtgctctaatcatcataatatgggggtcattaaactgcgtccaacagattatccatataattatctaaaatagtgttttacactgtagactgtattatttagatagtaaattttaaaatataagatgagacgtgtggattagatgttggagataatcttagtgaagctaatcctttatttcagggtggtagagccacgcttgacatgcccacacattatttttgtaaaaatactaaaatcaaaaataaagaagggtttgaatcatacttgttgtctctaaatccacattcacacacctaaccaacacaacacacacatttacttttacagcatttcaaaaagactctttatttttgactctatttatctct

SEQ ID NO: 1843 - DNA, 763 bp, Zea mays
cactcctatagggcgattgggaatcacgagaggggccgggccccacacacacgcatccatcaaagaaacaagagcacacaaacaatacctctctagctcgccaccaacaatggcctctaggttctccatcatgctcgccacaacggcactggctacgttttttgtgattggttcgtgcaccaccccgctcaccttcaaggtcggcaaaggctccaagcctggccacctggtcctcacccccaacattgccaccatctccgaagtggagatcaaggagcacggtggcgatgacttctcctttgagctcaaggagggcccggccggcacctggacgcttgacacaaaggccccactcaagtaccccctctgcatccgctttgccgtcaagtctggcggctaccgcatcgccgatgatgtcatccctgaaaattttaaggccgacaccacctacaagaccaccctcagcatctgatcatcctcttatgaggaataatattttgaaagagctcatctgatccatgtgccagcgagctaatatttaattttttttctatggttattttatggcaccacaccacccaagaaataagttatgttacatgtcccttcgtgcaccttgttgtgttgggttaatacggttatataaattgaaatacaatatgtatttaatatttttagagagaaatatattgatttggtccatagttggacaaaaaaaaaaaaatcgaccagaacaccaaaaacaatgcaacacaattagacc

SEQ ID NO: 1844 - DNA, 2094 bp, Zea mays
caccaccctccttgcccgccggcgtctcctcctttccctcccggccacttctctcgtttcgccctccccctcgagcaccccgccggctagggttacggccaccgccttccacgcctcccccacttcccgtaggcggaggctggtcggcgtgcacgcgaccgcggcggcggagatggacccggacttctcgcccgggggcggggggcccagctttgaattcgccttcaacgaggtcaacttctccgaccgggaattgcgtatcgaggtcgtcgccggggatgactacgctccggggtccagcggcgccggtgccggaggaggtggcctcgccgactgggcgcgccaccgcaagcgtcgccgtgaggagctcctcaaggagaaagaatctacaactcacatgtcagaccaaacaaattgcaatgaagttgaagcagaagagtgtgatgcgtatgaagaaaatcaagaggaacctgtagcaatggtagaagaatctccacccgatgttggccaagatggtgatgatgggcaaggtattgattcgtcttggactgtggttggtacaccagttttacgagtcaagacaatttatatcagttcagcgattcttgctgcgaagagtcctttctttttcaagcttttctcaaacggcatgaaagaatcggatcagagacatgcaacccttagaattactgactcagaggaaactgccctcatggagcttttaagctttatgtatagtggaaagttggcaactactgagcccactcttctgctggatatcttgatggctgccgacaaatttgaggttgtttcatgcatgaggtactgcagccagttgctcacaagcttgccgatgaccacagaatctgcacttctctacctagatctcccttgctcaatttcaatggcagcagcagttcaacctctgacagatgcagctaaggatttccttgctgtaaaatacaaggatttgactaagttccaagatgaagtgatgaacatccctcttgctggaattgaagccatcttgtcaagtaatgacctccaggtggcatctgaagataccatctatgacttcttgctcagatgggcccgtgcacaatacccgaaatcagaagagagacgtgagatccttagttctcggctgctccctcttgtgcgattcagtcacatgacatgtaggaagctgcggaaggtcctaacatgcacagatatagaccacgagcaggcaaccaagtgtgtcaccgaggctcttctgtacaaagctgatgcaccacaccggcaacgagctcttgcagcggacacaacaacctgtcggaaattcgctgagcgggcttacaagtacagaccactcaaggtcgttgagtttgatcggccctatccacagtgcatagcatacttggatctcaagcgcgaggagtgctctcgactctttcctgcaggccggatatactcgcaagcgttccacctcgcagggcagggcttcttcctctcagctcactgtaacatggagcagcaaagcaccttctactgctttggcctgttcctggggatgcaagagaagggctcaacgagcgtgaccgtggactatgagtttgctgcaagaacgagaccatccggcgagtttgtgagcaagtataagggtaactacacatttaccggtgggaaggcagttgggtacaggaatctctttggaatcccgtggcaggcgttcatggccgatgacagcctcttcttcatcgacgggatgctgcatctgagagctgagcttacgataaagcaacctacgtagatgtgctgccgtcgggttaagtgtgtccagtcatgggtgatgtggaaaatgctgtgtgctgcagatatcctttttgttttttttccttttgttcacgcaccttaatccttacattaatagacagtttggtgatgacaaaatataaaggaaaaaaaagggctggaaagctgccttttgttgtttcactaagatgaaggttgtatgatctctgtctcttcgtagtggaagttgttacaccagatgaaaaagaaaagatatcggatgggaatccccccgcccttgagttctctgcaagtttccat

SEQ ID NO: 1845 - DNA, 2040 bp, Zea mays
acttcgggaaccacgtccaaaacgtttggagcccttttcctaatcttgctgctaccgcgcgctccctctccagtctcccggccatttctctcatttcgccctccctccgccggctagggttactgccaccgccttccacccctccccgactgcccgtgggtggaggaggctggttggcgtgcagggtacctcggcggcggagatggagccggacttctcgaccgtgggcgggcccagctttgagttcgctttcaacgaggccaacttctccgaccgggaattgcggatcgaggtcgtcgcgggggattacgacgcgccggggtccactggcggcggttccggaggaggtggcctcgccgactgggcgcgccatcggaagcgccgacgcgaggagctcttcaaggagaaagaatctacaacctacatgtcagaccaaactaattttaatgaagtcgaagcagaagagtgtgatgcatatgaagaaaatcaagaggaacctgtagcaatgatggaaggatctccacctgatgttgatcaagatggtgatgatgagcaaggtattgatccatcttgggctgctgtggttacgccggttttacgagtcaagacaatttatatcagttcggcgattcttgctgcgaagagtcctttctttttcaagcttttctcaaacggcatgaaagaatcggaccagagacatgcaacccttagaattactgactcagaggaaattgccctcatggagcttttaagctttatgtatagtggaaagttgacaactactgagcccactcttcttctggatatcttgatggctgccgacaaatttgaggttgtttcatgcatgaggtactgcagccagttgctcacaagcttgcagatgaccacagaatctgcacttctctacctagatctcccttgctcagtttcaatggcagctgcagttcaacctctgacagatgcagctaaggattttctcgctgtaaagtacaaggatttgattaagttccaagatgaagtgatgaacatccctcgtgctggaatcgaagccatcttgtcaagtaatgacctccaggtggcatctgaagataccatctatgacttcttactcagatgggcccgtgcacaatacccgaaatcagaagagagacgtgaggtccttagttctcggctgctccctcttgtgcgattcagtcatatgacgtgtaggaagctgcggaaggtcctagcctgcacagatatagaccacgagcaagcaaccaagtgtgtcaccgaggctcttctgttcaaagctgatgcaccacaccggcaacgagctcttgcagcggacgcaataacctgccggaaattcgccgagcgggcttacaagtacagaccactcaaagttgttgagtttgatcggccctacccacagtgcatagcatacttggatctcaagcgcgacgagtgctctcgactctttcctgcagggcggatatactcgcaagcgttccaccttgcagggcagggtttcttcctctcggctcactgtaacatggagcagcaaagcgcgttctactgcttcgggctcttcctggggatgcaagagaagggctccacgagtgtgacagtggactacgagttcgctgcaaggacgagaccatccggcgagtttgtgagcaagtacaagggtaactacacattcaccggtggaaaggctgttggatacaggaatctctttgcaatcccatggcagaagttcttggccgatgacagcctcttcttcgtggatgggatgctgcatctgagagccgagcttacgataaagcaaccctagagcaatggtctctgtatagtggtagttgttacgacagatgaaaaagatatcggatgggatacctcacgagttccagttcgctgcaagtttccagatttgccggtatctcactgccaatgagcttgtttgcctccgtaacggcgcagggtgtataatggcttatttattcctagtatatacaaatacaagttgatcaaaaaaaaaaaaaaaagggcggcccccga

SEQ ID NO: 1846 - DNA, 979 bp, Zea mays
ttccttgatggtataatgcattttgctgatgaagaacggtcatactcagctgacgtatttgaagaaatgcagaagatcaggcgctttggctcatggcctgtaacaatccatattggaacaaagtatagggcagttctggaaggccctatttgcaaagctaaccgagtcatgagatggcacacagtccagacggttcaaaagaagagttcaactcgtcgattcccaattggtttctctgcatttgctttcaacagtacactgttatgggaccctcaaagatggaaccgcccgcctatggattctgttataatccacacaggtggaagaggtggtttgcaggagtcacggtttatagaaaagcttgttaaaagtgagcgccaaatagagggtcttccagacaattgcaacagggtcatggtctggaatttcaacctggaacctcctcagctgaactaccccgcaggctgggcactttataagaacctagaagctgacatgcctgtaatatagcttcctgcgagctacgttatgccttgctcctagaggtggtttctcccggcaaggcagaaggttgaagcacgtctccagcggcatgttagttctaaatttcaactccctgtcctttaaggtgcccaggtaaagctgctggttgatgccatcctgaacaagttgcgccaaagatttcgtgccgagatctgtcttcggtaatgcaatgtcatcctgaacaagttgcagcggcaatcaaaataggatcccccccccctgccttttagtctcgtgtattccttttgtgctcttcatttttttttcctcatcagctcgatacgacatgtagactttcttttaggttttttttgtttttgtttttcatactgtgtgttaccttacagatgtaaaagcgcccccgtacattgcaactgttaaagaggaaaagcaaaataccgtcatttagcttcttcaaataaaaaaaaaaaaaaaa

SEQ ID NO: 1847 - DNA, 2394 bp, Zea mays
gccggccgggttgggataatcccaaatttctcgacgccgaccggcgacggcgaccgcccgcgatttgtttactcgtctcgctcacctccgcctccgcgaggagctcctttttctctatccaaccataccctcaccaactccccctgtctcggtttgcgtggagagagaaagggagggagcgagaagtcaagccggagccgggaacagctcaacaccacgggccgcggtttctgaaaaggagaggcgtggtgggaaggggagggggagcgggaggggggcgagccagccagagagccgtacgcgaagcaagcagccccctgcatctagatcaggcgttctgctcgcaccgccgccgccgccgccgccgcttccttctctcaccgacgctaattggagatcacgtctgggcctggctgctcgtcttccgtcctgggtacaattcgattgatgacctcatcagggaagaatgttttgcagtcttacatgagttaaagggatagaaagtgcaacaaccgtggaataaaggactcgtgcttttgagtaattcaggaggagtacatgcatcacgaagccttgattctggaatggtgtccagtcgaaggaacagtgggattatcctacgggaagggtcggttagggactggtccgagttcaacaatccctcgccgtccccaaaactgctgtactcacagtcctatgtcgcaatgagggggttgctggcctcagtgatctccttggactttttcctgctgtcgagcaagctaaaatctgtgtgcgcggctatgacttcccagaggcatggccgatcacaggagaggtcaaaatcaaaggggttgacctgcaggagagttgcagtccatctgctgttctttttcatggttggcattttcattgggttcatgcctttgttctctgtcgatgtttacaagagaatagtatccgaaaacgagaggcttccgttccatgatggtgtgattgaggcggaaatgatgggcaccaaagttaaggagttggagacagttgtagtagagaaagaggtcgaactgattgacgagcctcaggttcaagagagccctccagttcctgcaatgttggatgatgaggcagattttgctgaatcttcacctgcattacctgctattgaagaatctgacattcctgtgaagaagctgctgataatcgtgacgatcacttctgttcggccacaacaggcatattacttgaatcggctagcccatgttttgaaagctgtacaggcacctcttttatggttggtggtggaatggcctgaacagtcctatgaaacagcagaaattctgaggtcttctggggttatgtacaggcatcttatatgtagaaagaataccacgagtgtacgaaagattgctgtatgtcaaaggaataatgcaatctatcatgtcaaaaggcatcaccttgatggtataatgcattttgctgatgaagagcggtcatactcagctgatgtatttgaagaaatgcagaagatcaggcgctttggctcatggcctgtagcaatccatgttggaacgaagtatagggcagttttggaaggccctatttgcaaaggaaaccgagtcatgggatggcacacagtccagacggttcagaagaagagttcgactcgtcgattcccaattggcttctctgcatttgctttcaacagcacaatgttgtgggaccctcaaagatggaaccgcccacctatggattctgttatggtccactcaggtggaagaggtggtttgcaggaatcacgatttatagaaaagctcgttaagaacgagcgccaggtagagggtcttccggacaattgcagtcgggttatggtctggaatttcaacctggaacctcctcgagtcaactaccccacaggctgggcactatataagaacctagaaccggacatgcctgtgacatagtttcctgccgctgccactgtgcctgcttctagaggtgatttctcccagcaaggcagagaagtttggagcacacgtctccagcgtattggtagttctaaatttcaactccctgctgttaccaggtggtccagaactccacataggctgctcgtccatgccatcctgagcgagttgcgccaaagattacatggatactgcacgctgagatcttactcccttcccccgcgcgccttttagttttgtgtattcctgttatgccctttattttgtgtttctccttatattcaccagcagctagatacgccgtgtagactttcttttcatgtaggctcttctgttcttttcatactgtgtgtgttaccttactacagatgtataaaggctctcatacattgcagctgtttttaagaggaaaggcaaaaataccttcttgatacgtgaagcgattccagcc

SEQ ID NO: 1848 - DNA, 3545 bp, Zea mays
atcagggatctaatttattatcctaattgcagataataatgcaacaatgagagcagtccacagggccagtgcatcagatgcttcgcgaggaagcagtcacctgacggacctgtcatttgcaattgaggatccctggacaaacaatgtaaaacaaagggaattgttgctggataaggttgtaggtagcatagctagctccaacaaagacctctaaagggtcctgtatcctaaatatagaggattaaacagtcttctacgctctccagcaatatcctctaaacggttctctaaatttagagaacgctgacgaattctttatatatagagtttctctaaatagctctctattcatttgaatactttaaataaccggtttagaaaaataaaatatgtacaatacatttaagagtatgacaaatatgtatgtataaaaaaataaataaataatgtatctaatataagtatttgagtatagaggacgagatttagagaatgttgttggagaggaaggagatatagaggatagaatcttttaaagaatactgtaaaagacggatatagaggatggatatagagaacattgctcaagattgccacgagcaacttggaaaacctagcccttggtacttccctcgtcagcaacacggaaggaaaaagaagcgagagggacagggaagggaagggggcagcacagccgagacagccttaggtctggccgtccatccccatccaatgcaaaaggtgaaaggaagaacaaaacgaagcccaagcagaagacagccaacatctctgctcctccaagcagtaaccacagggatctacagcttccagccagaacaacgcctgcctgccagcgatggcttcggctgtctttggctttggacctatctaacctcgagctgccaggccaggaatggacgccgactttggctgctggttaaatctggacgacgacgacgacgtcgggctctaggatctcgacttgatgggcctggagatccctatggatgacatcaacgaaataaacctcctgatatagctgtacagtttcgtctcagtgggcccctcccacattgaatagctccctcctccctatagtgcacacaggtaacatgtggatttccctcacaatgacccaccaacccagcagttctaacaccaggccggttaggcttcacttagttttgattgataaaagaaagtttatagaggcctcttgacaaatccccacaaccacatgtaatttgcctccctttgttcatctggcgtgcatacgtcggtgtacatatcttgttttggtgctgtacgaggtagggaggctagttactccattcattcattcattcatttatcgaggtgtactcaacaaaggatatatatatatatatatatatatatatgtatatcggcaattcagtatcaccatcatcgttgattcttagtgctgaactatgaagcgcgtcacatctctcttgtttgttgtctctgagatttttgaggggcctaggcgaaagcttatatggagacattttaacccatgtatattcgcagaagacatctgtagcatatttctgtgcctgttgtgtgacttcgacttgcaacagttaattgactttgcaatggccattcccactgatcttgtcaggttctagtatgttttgctagttaaaatgtgaaccaatctgtcagaacttgaccaggaattcggggcagagttcctgctggtctcaccacacggcttgggattgggagcctggaattccaaactctgcgcggatgacacgtgctgtgtccacaagaagtgacctggcgaagcgtgcaagacccgccgcgcgcttcccgcatgcacgatgcatttgaactgcttcatgcgcgtgccactgccacctgccacggactccttcctggtcggcactggaaaacgtgtgcactgtctcgctcgcacaggtcttccaagtctgcgccttctctcgcaatggctgctttggtggccacggctgcagtgctgcacggctgcaccacagtcctgctccgatccaagcgtacgcaaagacggcgagacgactttctttccatcagctgaccttgtcccggtcttgcggtacgtagtttccaagctccatcaggcagtcagagtcagtcaggcatggatggacggctataaatctctccagggtcgcgtcgtgaccggcatcgaagacgatggctgctcgaggcgtggctcccgtgctcgcagcagcaatggctgttacggcattcgccgccgttgcgacaagtatatatatccattttcatgagctccgatatgatgaagagctatatatgcatacaacgcaagcatctaagccgattcactgagcctatctatatatatatatatatatgtgtgtccgatgtgtgcaggcgtgcgagccatcggcgtgtgctacggcgtgctaggcagcggcctcccgtccaagagcgacgtggtgcagctctacaagtccaacggcatcgccagcatgcgcttctacttcgccgaccaggacctcctcacggcgctgcgcggctcgggcgtcgcgctcgccctcgacgtcggcaacggcaaggtcggcgagctcgccgccgacccggccagcgccgcgtcctgggtccgcgacaacgtgcaggcctactacccggacgtggacatcaggtacgtcgtggtcgggaacgaggtcgtccccggcgccgcgtcggtgctgcaggccatgcggaacgtgcacattgggtacctcgaggccggcctcgccggcagcgtcaaggtgtccacggcggtcaagatggacgcggtcgacgactcctcgccgccgtcccgcggcgtgttcagggaccccgccgcgatgtcgcccatcgcgcagttcctggccgccaacggcgcgccgctgctcgccaacgtctacccctacttcgcgtacgagtacagcgacggcggcatcgacctcgactacgcgctgttccagcccagccccacgacggtcacggaccccgccaacgggctggtgtacacgaacctcttcgacgcgatggtggacgccgtccgcgccgcgctggacaaggccggcgcaggcggcggcgtcgacgtcgtggtgtcggagaccgggtggccgtccgccgacgggaacggcgccaccgtggacaatgcgcggacgtataaccagaacctcatcgaccatgccagtaagggcacgccgaggaagccggggcccatggaggtgtacgtgttcgccatgttcaacgaggaccagaaggacggggaccctacggagaagaagtttgggctctttagtccagacaaaacaccagtttaccctattaatttcgcaggaaattgagtagagcatgtacggatgggtacataaaataaagggttaattggaaaataaaaacgactttctatatgtaatacatataaataattttttgccagttctcttttgacaaagtttttcttgactgtcaacggattatcagcaacacaggatccgtacttgcggccactccaaaaaaaaaaaaaaaaagcggcc

SEQ ID NO: 1849 - DNA, 1269 bp, Zea mays
ggatttggatccactttgccatcaggcgcgcctcgttctttcttctccgccggctgcatccacaccagatggggacctcgaggccgccgggacaccacaccacgttgctctcaccggtggaaggaagtggaagtagaaggctggaagcggaagcattcgatttccatcgtggggcatggcggcggaggggaagaggaagggcgtcccggcgctagggtggtggctgatgctagtcggctccctccgcctcgcctccgtctggttcggcttcttcgacatctgggcgctccgcgtcgccgtcttctcgcagacggagatgactgatgttcatggccgtacatttggtgtctggactcttttgacctgcaccctgtgcttcctttgcgcactgaacctggaaaataggcctttgtacctggccaccttcctatcattcatctacgctcttggtcatttcctcacggaatacttgatataccacaccatggctgcagcaaatctgagcacagttggcttctttgcaggaacgtcgataatatggatgcttctgcagtggaattctcatgggaacccccggggttcctatgctgggaagcagtcatgactgatgcttgggttgttcgcttcacttgatgtggtctgggcccgctaggggaagaaggatggttgaagaaagctcgctggaaagccgcctgatgatggctctgcgccatttgtacttcagttttcaacttttcatcatgttatttcattgcatgagacgttcgtgtccgactgagcagggagatttccgaacagttatgccactggttgggaatgagaatttttgaacactgaactccggctgaatcatgtagtcaggagctgtaatagctttcaggcgtacctgagaaacagattgccattcagatagtcaccggttgggggctgagatgccaataaggcgggtatagaaaagaggtgggcgtatcatgtgctttcgttgcatctgtacgagccaaagggtgtatgtacttactctgaaacttttgttgtactgatgctgcatcttttgtccttgaaataaaccgtacgttagtacagtagagtcgataaagtttttatgtattgcgatgattgttcaatcacttttttttgtttacctcatgttcagttactttttttatctccatgttattcgtactatgccatccacacaacataaatttgttgcaaaataatgcttcattcgttcgtactatgccatgatatacttttggtaattggtag

SEQ ID NO: 1850 - DNA, 1292 bp, Zea mays
aacgaatccggattccggacacgcctcatcacttctcgtcctcccgcccccccgcctccgccggcgccgtccacgcgcccgcgcgcggcccggcaacgggagccaaggaaaccgaagccccgatggcgagcttcttccgggacgcgcgcctcccgcagcagcgcgtcgtcgagggcgtcccgttcccggcggtgctggtcccgagcgcccccgcgggcggcgggctcgacgagttcctggcggccgtgcgctccgagagggcgtcccggctggagccgctggtgcgggacgcgggggccctgctgctgcgcgggttccccgcgacgacggccgccgacttcgaccgcgccgtcgacgccttcgggtacgaggagctgccgtacgtcggcggcgccgcgccgcggaccaacgtcgtgggccgggtgttcaccgccaacgagtcgccgcccgatcagaagatccccttccaccacgagatggcccaggttccaacgtttccgtccaaactgttcttcttctgtgaagtggagccaaagagtggcggggagacaccgatcgtactgagccattacatctacaagaggatgaaggaagaatttcctgaattcgtggagaaactggagaaggaagggctggtatatacaagggttctgggagagggcgacgacccgtcttcgccaatcggccgtggatggcaatcgacatttctcactaaagataaagccgttgctgaggaaagggccgccaagctcgggatgaagctggaatggaccggcgacggcgtgaggacggtcatggggcccatcccggcggtgaagtgggacgagagccgggggcggaaggtctggttcaacagcatggtggccgcctacacggggtggaaggacgcccggaacgacccggtgaaggcggtgaccttcggcgacggctcgcccctgcccgccgacgtcgtcgccgcgtgcggccgggtcctggaggaggagtgcgtggccgtgccgtggcgtcgcggcgacatcctcctcatcgataactgggccgtcctgcactcccggcgctccttcgagccaccgcgccgcatccttgcctcgctctgtaaatgatgtatgtatgtatgtaagtgccccgccatggtatgggttttttacttggcagtggaactaattctggatgggcgcggatttgctgctccgacgagcgatgaacgcctgaaactgagaataatttcacacgctggagagagcggtgtttatttattagaaattccaaatagtgcagaaaaccgttcacccgtt

SEQ ID NO: 1851 - DNA, 2817 bp, Zea mays
aaaaaatagaatcccacaaaaacagatggaatagactctctcgtgtttccgtcctcagatttatgggcaaacacaaaaatatgtcggtccgttttcaacctgtctatgcgcatgagctttggtgtgtgacaagtggaacggaacactcaacactgccaaagtgagtgaccctgaccggctcctgtagtcccgcttccctaaaacaccaggccaagacggaaaactcccgcgaagccgtccacgttcacggttcatccctctgtccagagcatcattccgaattcccaacgaatccggacacgccgtgaagtgaagcccctcgtcgcttctcgtagtctcgcacccaccgctccaccgtctccatccacgcgcccgcgcgcggcccggcaacgggagccaaggaaaccgaagccccgatggcgagcttcttccgggacgcgcgcctcccgcagcagcgcgtcgtcgagggcgtcccgttcccggcggtgctggtcccgagcgcccccgcgggcggcgggctcgacgagttcctggcggccgtgcgctccgagagggcgtcccggctggagccgctggtgcggcacgcgggggccctgctgctgcgcgggttccccgcgacgacggccgcggacttcgaccgcgccgtcgacgccttcgggtacgaggagctgccgtacgtcggcggcgccgcgccgcggaccaacgtcgtgggccgggtgttcaccgccaacgagtcgccgcccgatcagaagatccccttccaccacgagatggcccaggtaatcgagtcttgagcctcccctgcactctggcaccataagagcagcagcggggtaactgaaattcaggagacaacgcagtggccacgacatgtacatctgcaacgtgggcttgctttttaagcctagtacccatttttcaattcaaaattagattgatcttttttttcacgtagagctcagtttgatgaccaagctacaatacagcacgcacgctttgattttttaggttccaacgtttccgtccaaactgttcttcttctgtgaagtggagccaaagagtggcggggagacaccgatcgtactgagccattacgtctacaagaggatgcaggaagaattccccgaattcgtggagaaactggagaaggaggggctggtatatacaagggttctgggggagggcgatgacccgtcttcgccaatcggccgtggatggcagtcgacatttctcactaaagataaagccgttgctgaggaaaggtagcagtagcaccattgcattgtatatacccatctgaagaattggggcctttgtcacatctttatgcatgaacagggccgccaagctcgggatgaagctggaatggaccggcgacggcgtgaggacggtcatggggcccatcccggcggtgaagtgggacgagagccgggggcggaaggtctggttcaacggccgcgtggccgcctacacggggtggaaggacgcccggaacgacccggtgaaggcggtgaccttcggcgacggctcgcccctgcccgccgacgtcgtcgccgcgtgcggccgggtcctggaggaggagtgcgtggccgtgccgtggcgtcgcggcgacatcctcctcatcgataactgggccgtcctgcactcccggcgctccttcgagccaccgcgccgcatccttgcctcgctctgtaaatgatgtatgtatgtatgtaagtgccccgccatggtatgggttttttacttggcagtggaactaattctggatgggcgcggatttgctgctccgacgagcgatgaacgcctgaaactgagaataatttcacacgctggagagagcggtgtttatttattagaaattccatagtgaagaaaaccgttcacccgttatgccacgtcgcctttccgtcagatatgcatcgcacgactgtgaatttcctactgctctgattgactctgctagactgctctcgctacttctggaagggggttctttacctagctttcaccatcggtgattttgcggacgacggcctagggttcccaaaccaccgaccgatcgacgatgacatccttctccccggcaacataaggtatgtgcttcacttcgcctcgcatgtgatttcttccttctttcttctactttccatcctctctggcaacgctgcatagctaccaacacgcgtgtgaagagttctagccttctaggtgccttgctgaagttggagctctatctgcattgcatttctccaattcgcactgacaccttcacctcttgcgtccatcctagagatgttgtgatcgtcagttctgacttcgtttggttctcggatcgtcctccccacacctcctcatccattcttctgcaatacttccgtccaagtccccatccttacctcacgttgctctaatacaccacagtgatgtgtgaccgactacatgaggacctccattaaggggcatgggaaggagggttgagtgttgcgaacacgcgcacaggttgttcgattgaatgtccaactgattttttttgggttaacacgtttgcaggcttcattgctgcaaccgctactacaacagttttagattgtcaaataaagtagactgatgtggaccatgtgttcaagttgctcgatctaattctccaaacaaattatttgcttgacacttttgcatgacttgcttcatgcaaacgttaatgcaacacatttagaatgtattgttgatttttacaccaatcaccttccctattatatatccacacatataaaatgttgcatatgtatactaattgtgcttttgtagctcactccatcg

SEQ ID NO: 1852 - DNA, 3964 bp, Zea mays
acgaaaccggagtaccggacacctctcgcaccgcacccaccgctgctccaccttctccacgagcccggcaacgggaaccaaggaaaccgaagccgcgatggcgagcttcttcagggacgcggcacgagcgcagcagcgcgtcgtcgagggcgtccccttcccggcggtgctcgtcccgagcgctcgtgcgggctcctgcgccggcggggtcgacaagttcctggcggccgtgcgctgcgagagagcgtcccggctggagccgctagtgcgggacgcgggggccctgctgctgcgcgggttccccgcgacgacggccgccgacttcgaccgcgccgtcgacgccttcgggtacgaggagctgccgatcgtcggcagcgtcgcgccgcggaccaacgtcgtgggccgggtgttcaccgccaacgactcgccgcccgatcagaagatccccttccaccacgagatggctcaggttccaacatttccgtccaaattgttcttcttctgcgaagtggagccaaagagtggcggagagacgccggttgtaccgagccattatgtctacaagaggatgaaggagaaattccccggatttgtggagaaactggagaaggacatgattgtatatacaagggttttaggagagggcgataacccgtcctcgtcaatcggtcgtggatggcaatcgacatttctcactaaagataaagttgttgctgaggaaagggccgcaaagctcgggataaagctagaatggaccgacgacagcgtgaagacggtcatgggccccatccccgcggtgaagtgggacgagagccgagggcggaagatctggttcaacagcattgtcgccgcctacattgggtggaaggacgcccggaacgaccccatgaaggcggtgaccttcggcgacggctcacccctgcccgctgacgtcatcgacgcgtgcggccaggtcctagaggaggagtctgtggccgtgccatggcagcacggcgacatcctcctcatcgacaactgggccgtcctgcactcccggcgctcgttcgagccaccgcgtcgcatcctcgcctcgatctgtaaatgatgtgtgtagatgcgctgcgggtttgctgctccgacgggcgacgaaggcctgaaactgggaatactttcacacgttggaaagagcggtgtttagaatattagaggtgtgcgtgcaggcgaaataattggtatttcgccgctcaaaacgttgtctcctggttataattatcattgtatctatgagttgtgggtccatttgagtctacaaaatgtagcttgatggcaaatttgtgaaccctttcgtggtgatggcaaatatcgtaatctcccgtttatcggtgcccaatgaaacgaatccgtgtaaggggccattcgtttcttccggaacggaggcatggaataatttctagccggtttgtttctctaatttatactctctccgtttctttttatttgtcgttggatagtgtaattttatactatccagcgacaaataaaaagaaacggagggagtataagttttgattagctagaatgatttctggtccaatcctgaacaaacgaataaggcctaagtaatacacaatgatcgcacgcgagagattggaagtagcagcagaaggaaataatattgggagcgggccgtttggtcaacatgcctaacagtacgctgtatctctgtgggtctggggtcatgctgaatcttggcttctgttcagtggaccggcatttgttttgggcccatttcacttgggtgtcgttagtgtaatacacagtacaaaaacaaagctcatattttacacgaaactactgaagacatatttcgatttagtaatattaacattttctttagatgcttggatacttcaagtacaagctatagacgtgagcacaaactcgcaccacgtgaacgcaaacgcacacatactgacataacgtagcatatattccctttgtctgattatattattcgacttgccaatgttttggattatttagattcacagtatattctttgtatctagacgcaagtaatgtccagattgaccttatcagaatgctgctgccggatcaatcgaaagggggtgctggagtggaggaggaaagatctgtttgctcaggtctagatgtgcggaataaatgtgccatggccgatgctcagccggtaaattattatgtgtcaaaaaaaattatgtcctgcacccactcgttgtattagtttggtcgtatttagttttttgggcagatctgttcgcgttggtcgggtcagacaactcatgctcaagtctggatgtgaggaataaatgtgcatgtgcgagatgtgaggaactggagacgaaaataaataagaatatttttcttgggatagtcttttttccaaccatgactgtaaactaaaaaactatatctaagtgatcattctgttttataccatcatgtcgttgcaaccaaacacatcaagaggagtctgaggtcgaagctggtagccagatagcggcccgtaatcatctttcaagagaaagttcaattctgtcctgctgcatctgtaaaccacatttgtaacaattactgagcttgtgcaaactgcaaactagtcaggaacatatttacatgtttggtctcacgaccgtataggttgtttagatgctagttagaattattaaatatagtctaattataaaattaattacacagatgaggactaaacgataagacaaatttattaaacataattagtctatgattcactcattttattaatcatagactaattatgtttaattttgtctcattctttatagtcttcagcatagtaattggcgcggactgagctttggctaaacaaacactctcttggccaacatacggaagtgatagtagtgtggtttggtagggatgaaaaacggacggaaaacctctctctccattatgtttctgtttccgtattttatcaccgaaaacggaatcgggtctggaatagtcgggaacagaacaggagcgggataaacatgtgtacgaaaacaaacaggagagaaaatattatatggaaacttatattttaatataagcacacatgatattaatgataggctagcagggtaataacatgaaacaaattataatatttcattattgtttgcttgctagtggtgtacatataactacggttgatgtcatttgagcctttagaccacttgtcatttttttgaaagatcaggagggggaacctctgctgtagattttttattattactggaaaattacagttcataaaaaaacaatgagcaaattacacaaggaagatctaattaaggctgccattgctgaagccaattaggaatggaggaatcatatcttccccgcgatctgtggatgaccaaaagcaattcctttgtgaagtcatgcttgtattgctgcactgttgggtctttgttctcaaatagccatgcatttcggcacttccatatgctccatgtcatgaggataactatctccatagagaagggaacgttgagttgctgtttgagatttgtcgaagcctcctcgggattagtaattctggggggcgttatagcaatggaattccagcaggccttggcaaagttatatctgaggaaaagatggtagagtgtttcctctttttgccagatacagttttcgcacgagtatgactcaagtgtcatgtttttccttctcagcatattccttgtgttcaatctattttttagctataaccagtagaaaactttatgctttggttgtcatttgtttttccataataatttgtagatgtaatgagcctgggtatgtcccataagatgcctgtaagtcttttttgtagtaaaaatctttgaaccccaaaatatatttccatttgtcctttgaattgattatagtaatttgctccccagacttcatttaactccaatatactgctcaa

SEQ ID NO: 1853 - DNA, 2054 bp, Zea mays
ccgtccgggatttccggccctgcaatcctgcaccggcgcgaaagccccctcacggcctcacctccactccggtgatggccgcatctcctttacttctcagtgctcacgccgtccacggtccactagttgcatcggctagctcccgcataaagatccacaccacttgagcagcagctagctcaagggaaggagaaggctggaagtggaaagaagtgggttcttgcttgagctgagctcttgctgcccttggatctgtttgggagtggagaacgcagtatggggcgcggcaagatcaagatcaagatcaagaggatcgagaactctaccaaccggcaggtgaccttctccaagcgccgggccggactggtcaagaaggcacgggagatcggcgtgctctgcgacaccgaggtcggcgtcgtcatcttctccagcggcggcaagctctacgactactgctcgcccaggacctcgctgtccaggatcttggagaagtaccagaccaactccgggaagatactgtggggtgagaagcacaagaacctgagtgcagagatcgacagagtcaagaaggagaacgacaacatgcagattcagctcaggcatctgaaaggcgaggacctgaactccctacagcacagggagctgatcgctattgaagagggcctccagaatgggcagaccaacatgcgcgagaagcagatggactactggaggatgcacaagacgaatggaaagatgctggaggacgaacacaagatactgacttttaggatgcaccaacaggctgttgatctgagcggccgcatgagggagctggagatcggataccatcaggtccagcacgacagggatttcatttcccagatgccgttcaccttccgggtgcagcccaaccaccccaacctgcaggaagacgagtagctacagcctgctggatagtgatctgcatgccgctctgaactgaagctcctcacctgcagcttctatctcgcgtttcatcattcagcgttagctgggtatctttcttttcatggcaccctggatgaagtctgtcagtacgatgtggtctttgtcttgtgcgtctcttttgactttgctgggctgatttccgtgcacgcagctatgccgatccatcgccgcatcgcggacctcgaccccgccctcactgagctaggagcagacgaggcttgagaacgagcgacggagacctagccgaagcaggagctccccatggcgaccggcaacctggcgagcgtggtggtggctgtggacggcagcgaggagagcatgaacgcgctgcagtgggcgctcgacaacctccgcctgcgccccgacggcgagctcgtcgtgctgcacgtccagccgctgcccaacatcgccgcgggactcaacccggcgcccatccccttcggcggccccagcgggttggaggtgccggcgttcacgcaggccatcgaggcgcaccagcggcgcataacgcaggcgatcctggagcacgccctgaagatttgttccgataagaatgtggaggtgaagacggaggtggtggtcggggaccccaaggataaaatctgcgagattgcggccaaccgtaaggccgatctgctcgtcatgggctgccgtgccattgggccgctaaagagggtgttcttgggcagtgtgagcaactactgtatcaaccatgtgggctgccctgttgttgtgatcaaggggacatgatattccatcagcccagcattctttggtgtacttccattcaaggtttttgaggcttctgctgtgacatgtgtaatcctgtacgatatattactgcacattactatgcttttgttggtgctgctgagggatgaaagttgctatgtggtccctttcgttataaaggaggaagctttgtcggtcgtgtaatcgtggtaataagttggtcctgtggcggattcttgtgtatattcttgtaatcgttcaaagacatggttctgtctgaagtcccaacagcgcaaaattaccagagtctcggtttgtttgtttgaaaaaaacggccgcgaacgcccgccacc

SEQ ID NO: 1854 - DNA, 1657 bp, Zea mays
ctcgaggccggccgggatttccggccctgcaatcctgcaccggcgcgaaagccccctcacggcctcacctccactccggtgatggccgcccctcctttacttctcagatctcagtgctcacgccgtccacggtccactagttgcatcggctcccgcataaagatccacaccacttgagcagcagctagctcaagggaaggagaaggctggaagtggaaagaagtgggttcttgcttgagctgagctcttgctgcccttgaatctgttagggagtggagaacggagtatggggcgcggcaagatcgagatcaagaggatcgagaactctaccaaccggcaggtgaccttctccaagcgccgggccggactggtcaagaaggcacgggagatcggcgtgctctgcgacgccgaggtcggcgtcgtcatcttctccagcggcggcaagctctacgactactgctcgcccaggacctcgctgtccaggatcttggagaagtaccagaccaactccgggaagattctgtggggtgagaagcacaagaacctgagtgcagagatcgacagagtcaagaaggagaacgacaacatgcagattcagctcaggcatctgaaaggcgaggacctgaactccctgcagcccagggagctgatcgctattgaagagggcctccagaatgggcagaccaacatgcgcgagaagcagatggactactggaggatgcacaagacgaatgggaagatgctggaggacgaacacaagatactgacttttaggatgcaccaacaggctgttgatctgagcggcggcatgagggagctggagaccggataccatcaggtccagcacgacagggatttcatttcccagatgccgttcaccttccgggtgcagcccaaccaccccaacctgcaggaagacgagtagctacagcctgctggatagtgttctgcatgccgctctgaactgaagctgcaggaagacgagtagctacagcctgctggatagtgttctgcatgccgctctgaactggagctcctcacctgcagcttctatctcgcgtttcatcattcagcgttagctgggtatctttcttttcatggcaccctggatgaagtctgtcagttgttactacgatgtggtcttgtcttgtgcgtctcttttgactttgctgggctgaggtcttgtcttgtgcgtctcttttgactttgctgggctgatttccgtgcatgtagtgatgatgatgttggggcgaaggcggagacgctacacttcgctcgatgccttcgtcgccttcgtcgtctcgcttcaccaacgacgccaaagacgtcggtccgatgaggacttcgcgactggacttcgcgggtgtccttcgcccttctcccttgtgagacgaaggcaagactccgacgatgtctgctagcctcacgtcctcatcgggtccggaagcccaagggagattcggtccactgtaacgggccccgcagggttagccgggttccggcccctccggtattggccttttctgtaataacggtctgtaacctcccctggggaatattctaaggatactttgggttcccgagggcataaacgtcatttttttagcgcggtaggcactcgggcacctataaatacccccgtacagtaccctgaggg

SEQ ID NO: 1855 - DNA, 2466 bp, Zea mays
agtcagatttcaacatatattgcatgtaatgtatagacaggttggccagtaaaaagaaaaagaaaaaagataaaaacgtagggcctagtgatcagcacagcatgcagaattgcagatgcggcgcacatgcgaacgtaacaaacacagcaacacgcccacgctagcggtttccatttccggccctgcaatcctgcaccggcgcgaaagccccctcacggcctcacctccactccggtgatggccgcctctcctttacttctcagatctcagtgctcacgccgtccacggtccactagttgcatcggctcccgcataaagatccacaccacttgagcagcagctagctcaagggaaggagaaggctggaagtggaaagaagtgggttcttgcttgagctgagctcttgctgcccttgaatctgttagggagtggagaacggagtatggggcgcggcaagatcgagatcaagaggatcgagaactctaccaaccggcaggtgaccttctccaagcgccgggccggactggtcaagaaggcacgggagatcggcgtgctctgcgacgccgaggtcggcgtcgtcatcttctccagcggcggcaagctctacgactactgctcgcccaggacctcgtctgtccattgcccctctcattctttttattcttttgcttgtttattatcgtccttcttcttttcttgtgtgcaagcaaaactgatcgcaaagacccaaacttggttggaaaggcaaaactgagtaaaaaacacgattaagcgtaaaattgaggacaccaataaaaatgagggcaccagcctaaaaaacccaaatttggtttggtggcaggctgtccaggatcttggagaagtaccagaccaactccgggaagattctgtggggtgagaagcacaaggtgcccgcccttcagattcccctttcctcgacagtttgtttcagcgccgcgaacagattaacggttcaaaatttaacggttgaattgtttcagaacctgagtgcagagatcgacagagtcaagaaggagaacgacaacatgcagattcagctcaggccagtgtttctgattcagatctgctcccgatctctagctgcgcgcgcacttcactagctcgctgttcgtgtgtgttcttgttgtgattgtgctagcgtgtccgtgacctgtgacggtgcaggcatctgaaaggcgaggacctgaactccctgcagcccagggagctgatcgctattgaagagggcctccagaatgggcagaccaacatgcgcgagaagcaggcaataatccttcctcgtccagttgctcctgagcttattagtgtcgcttgcagcacacaagcacggcacagttcattaggggaagggttttgtttctgatgttgctttattctactgttgctgtagatggactactggaggatgcacaagacgaatgtacgatctctaatcttgaattctattctttgttcctactctatacatcctgggatacatccttttctttttcttttgaaagaagtcgttgagtaattttttttacagaaaagtttttccagcttcgggtcattaacagtcatttgtgattggttacagggaaagatgctggaggacgaacacaagatactgacttttaggatggtaattctcccccatctgaatagcagttgaaactttgcttgatcatccttcctcctttcaactccttagcataacttatcagtatgcaatattctaaacaaactcaatgttccgagctaaccgaagaaactgcacaaccacgctgagcaaatttccaaggacatgaaaattcttgtcttgggatttctagttggaacgcaattctgctcactgattggtattcaaggtgatttgtcatacttattaccaaacccaagaccaaactaaccagacaaatcaaagacgaattaggacttgttcatttacaccaatctaactttggattagtatagattggaattaaatctatgtcataattcatgtcataattcatgccccaaaataattcaagtctactcaaaaaaaatattcggttaaatccattatggattataacacaagggtttagaaaaaatttaaactatggaagacatggattatatccatagctcattaggtatggaacaaattcataaaaatattacacaagtttgtattagaatccatagattaaaaaaataactagctttgaaatatacattgattaaaatgttagatttaatctcaccatgggattgagtgtgaggtatggattcacccaatctatatcctgattaaattcatgatgggattgcatcccttgtaaccgtataaggtcgtgatttcgtatactattaccaacccaacacctggtggtctgcatattaattactgaaccgcataaacccccttagtgcttgttcagttagaattggattaaaggggggttagagaagataaag

SEQ ID NO: 1856 - DNA, 1188 bp, Zea mays
cactagttgcatcggctcccgcataaagatccacaccacttgagcagcagctagctcaagggaaggagaaggctggaagtggaaagaagtgggttcttgcttgagctgagctctgcctcttgctgcccttggatctgtttgggagtggagaacgcagtatggggcgcggcaagatcaagatcaagaggatcgagaactctaccaaccggcaggtgaccttctccaagcgccgggccggactggtcaagaaggcacgggagatcggcgtgctctgcgaaaccgaggtcggcgtcgtcatcttctccagcggcggcaagctctacgactactgctcgcccaggacctcgctgtccaggatcttggagaagtaccagaccaactcggggaagatactgtggggtgagaagcacaagaacctgagtgcagagatcgacagagtcaagaaggagaacgacaacatgcagattcagctcaggcatctgaaaggtgaggacctgaactccctacagcacagggagctgatcgctattgaagagggcctccagaatgggcagaccaacatgcgcgagaagcagatggactactggaggatgcacaagacgaatggaaagatgctggaggacgaacacaagatactgacttttaggatgcaccaacaggctgttgatctgagcggccgcatgagggagctggagatcggataccatcaggtccagcacgacagggatttcatttcccagatgccgttcaccttccgggtgcagcccaaccaccccaacctgcaggaagacgagtagctacagcctgctggatagtgatctgcatgccgctctgaactgaagctcctcacctgcagcttctatctcgcgtttcatcattcagcgttagctgggtatctttcttttcatggcaccctggaacctggatgaagtctgtcagttgttactacgatgtggtcttgtcttgtgcgtctcttttgactttgctgggctgatttccgtgcatgtagtgatgatgacagcgttaattaagactgaaatgtgcaattaagttgtagccagaaaaaaaaaaaaaaaaaaaaaagccgcgacggagacctagccgaagcaggagctccccatggcgaccggcaacctggcgagcgtggtggtggctgtagacggcagcgaggagagcatgaacgcgctg

SEQ ID NO: 1857 - DNA, 794 bp, Zea mays
tcgaggccggccggcactagttgcatcggctagctcccgcataaagatccacaccacttgagcagcagctagctcaagggaaggagaaggctggaagtggaaagaagtgggttcttgcttgatctgagctcttgctgcccttggatctgtttgggagtggagaacgcagtatggggcgcggcaagatcaagatcaagaggatcgagaactctaccaaccggcaggtgaccttctccaagcgccggaccggactggtcaagaaggcacgggagatcggcgtgctctgcgacaccgaggtcggcgtcgtcatcttctccagcggcggcaagctctacgactactgctcgcccaggacctcgctgtccaggatcttggagaagtaccagaccaactccgggaagatactgtggggtgagaagcacaagaacctgagtgcagagatcgacagagtcaagaaggagaacgacaacatgcagattcagctcaggcatctgaaaggcgaggacctgaactccctacagcacagggagctgatcgctattgaagagggcctccagaatgggcagaccaacatgcgcgagaagcaggcagtaatccttactcttccagttgctcctgagcttatttagtcgcttgcagcacacaagcacggcatagttcattaggggaagggttttgtttctgatgttgctttatccactgttgctgtagatggactactggaggatgcacaagacgaatgtaaagatgctggaagacgacacaagatactgactttttaggatgccccaaca

SEQ ID NO: 1858 - DNA, 1061 bp, Zea mays
  misc_feature (1018)..(1018): n is a, c, g, or t
atcctgtatatttctatatcgtcgaacccttctcaacgcctcccttttcgaggaaaacgaatgtgccatgttttataatggaaaaaagtctcgcaggctgcaggtgcagcacgcaacttgaccgatccatcgctgcatcgcggaccttaccccgccctcactgagctaggagcagacgaggcttgagaacgagcgacggagacctagccgaagcaggagctccccatggcgaccggcaacctggcgagcgtggtggtggctgtggacggcagcgaggagagcatgaacgcgctgcagtgggcgctcgacaacctccgcctgcgccccgacggcgagctcgtcgtgctgcacgtccagccgctgcccaacatcgccgcgggactcaacccggcgcccatccccttcggcggccccagcgggttggaggtgccggcgttcacgcaggccatcgaggcgcaccagcggcgcataacgcaggcgatcctggagcacgccctgaagatttgttccgataagaatgtggaggtgaagacggaggtggtggtcggggaccccaaggataaaatctgcgagattgcggccaaccgtaaggccgatctgctcgtcatgggctgccgtgccattgggccgctcaagagggtattcttgggcagtgtgagcaactactgtatcaaccatgtgggctgccctgttgttgtgatcaaggggacatgagattccatcagcccagcattctttggtgtacttccattcaaggtttttgaggcttctgctgtgacatgtgtaatcctgtacgatatattactgcacattactgtgcttttgttggtgctgctgagggatgaaggttgctatgtggtccctttcgttataaaggaggaagttttgtcggtcgtgtaatcgtggtaataagttggtcctgtggcggattcttgtgtatattcttgtaatcgttcaaagacatggttctgtctgaagtcccaacagcgcagaattaccagattcagagattcaaaanaaaaaaaaaaaaattataaaaaaaaaaataaaataaaaatagg

SEQ ID NO: 1859 - DNA, 908 bp, Zea mays
  misc_feature (730)..(730): n is a, c, g, or t
atttccggtcctgcaatcctgcaccggcgcgaaagccccctcacggcctcacctccactccggtgatggccgcctctcctttacttctcagatctcagtgctcacgccgtccacggtccactagttgcatcggctcccgcataaagatccacaccacttgagcagcagcaagctcaagggaaggagaaggctggaagtggaaagaagtgggttcttgcttgagctgagctcttgctgcccttggatctgtttgggagtggagaacgcagtatggggcgcggcaagatcaagatcaagaggatcgagaactctaccaaccggcaggtgaccttctccaagcgccgggccggactggtcaagaaggcaccggagatcggcgtgctctgcgacgccgaggtcggcgtcgtcatcttctccagcggcggcaagctctacgactactgctcgcccaggacctcgctgtccaggatcttggagaagtaccagaccaactccgggaagatactgtggggtgagaagcacaagaacctgagtgcagagatcgacagagtcaagaaggagaacgacaacatgcagattcagctcaggccagtgtttctgattcagatctgctcccgatctctagctgcgcgcgcacttcactagctcgctgttcgtgtgtgttcttgttgtgattgtgctagcgtgtccgtcacttggtgacggtgcaggcatctggaaaggcgaggancctgaactcccctccgccccgggagctgatcgctattgaagagggcctccagaatgggcagaccaacatgcgcgagaagcagatggactactggaggatgcacaagacgaatggaaagatgctggaggacgaacacaagatactgacttttaggatgcaccaacaggctgttgatctg

SEQ ID NO: 1860 - DNA, 3194 bp, Zea mays
gccgcccggggcggcagcggcggcggcggcggcggaggtgggcccaggcacgtgcgccggtcgcattccgggaaggccatcaaggtgaagaaagatggagctggcggcaaagggacttggggcaaactaattgagactgatgcagaggcatgccttgatcgaaatgatccaaattatgacagtggtgaggagccatatgagttagttgaggcccctgtttcaaccccactagaagactacaagaaatctgttgtccctttaattgaggaatatttcagcaatggggatgtaaaattagctgcttctgatcttaaagagttgggtcatgatggtttccactgttactttgtcaagaagcttgtttccacagcaatggataggcatgacaaggagaaagagatggcatcagtgcttctgtcgtatctttatggcaacgtggtcagttcaactcaaattaggctgggatttgtgctgctattagaggctgttgatgacttggctgttgacatacctgatgtggttgatgtgctcgcccttttcattgcacgtgcagttgttgatgacattctgccacctgctttcctcagcaatgcaaaagtgagtctgtcaggatcttcaaagggtatgcaggttgtacaaattgcagagaaaagctatctttcagcaccccaccatgcagagttaattgagcgacgatggggtggttcaacccacatcacagtagaagaggtgaagaggaggattgctgatcttctgaaggaatacatcagaaatggtgatacagctgaggcttgtaggtgcattagagaattggcagtgccgtttttccatcatgaggtggtgaagcgagctcttactcttggaatggagagtccagctgctgaagctcttattgtcaagcttctgaaggaagcatctgaagaatgtttagtaagctctagtcagatgatgaaaggattccaccgtgttgctgagagtcttgatgatctcattcttgacataccatctgcaaagtctgaatttcagttgttggtatcaaaagccatttctgagggatggttagattcttcctatgtgaactcaggtgtcaacggaagcgttgaagacgatgaacatgagaagctggctaggtacaagagggaggctgtatccataatacacgaatactttttctctgatgatacaacagaggtcatccgtagtgtcaaagagcttggttatccggaatacaatccgatcttcgtcaagaagctcataacaattgctatggaccgcaagaacagggagaaagaaatggcatcggttcttctcccttcattaagcatggagctgttctcgtctgaagacatcgccaagggatttgtaatgctccttgaatctgcagaagacaccgcgctggacatattggatgcctcagatgagctgggactgttcctagccagggctgtgattgatgacgttctcgcacctctaaacttggatgagattagcagcaagcttccaccaaactgcagtggggctgaaacattgaacatggcacgctcccttgcgtcggcccgtcatgccggtgagaggcttctgaggtgctggggcggtggaaccggatgggctgtggaggatgccaaggacaagataacaaagctcctggaggagtatgagagtggaggcgatgtaggggaggcatgcaactgcatccgtgagctgggtatgtctttcttcaaccatgaagttgtcaagaaggcgctcgtgatggcaatggagaagaagaacgagaggaccctgaacctgctgcaggagtgctttggtgaagggatcataaccatcaaccagatgaccaaggggttctcaagggtcagggatgggctcgacgatctggctctcgacattcctgatgccagggagaagttcctttcctatgtgcagcgcgcgaagaagagtggatggctcctgcctgggttcggtgtggcatcttcggcttgaacagctgggcagaagagaagtacgaagctgaagcggctcagcaaacccagtttggatgtgtgttttcgtcgttcgtggttgcccttgcgcctaggttagcggagcgagcccttcctggttgcggtggtggtggcttgtgtaggtctcgcatctgacatgttcatgctgttcttgtttcatttcatttaactctccatagaccctttttttttacatcaagctaaaacagagaagagaaaaaaaagaccatgttgtaaaagttctcccatgctccgcctgcattgcggccggttttttcatcctcatttagctgcaatcgtgcgttcctgccctctcatggccgccgtagctgtttttctatgccattggatgcttggattgtgattgctagtttgttactcttttattctttgtggaaatggtgtggcctggtgaatgcctggattgctaacaaaaaaaaaaaaaaaaaacggcacgagtctttcgatgctttctttgttttatgatgcgacgaatgctcatggacttggatttcagagactatggcatgggctttttctggtgtggtttcgaatttcatgatccaattcaaaattctgaaggattttaggaaaaatttgaatcatgcttgtgaaaaatgaatctgactcttccagaaagcccgtgctccaaacggcgcgacaagcagggttattagagcatgaaaacattcgataacttttaaactcccaatctaacacgccttgaattatcctaaacgacctgaaaatcctacgaaaaatggtttaccatcataatcctcagaaaaaaaaaattgaaacggagtaacgcctacggttccatttaaagcaaaacagatcttgaacagagttaccatttacgatgtgctatttaagtgcactagaaaagaaagcgccctatcgggcgccgtacagtccgaattttttgtattttgtccctttcttgaaaaaaaatcacgtttagcccttaaaaaattttaatgtcatttttagaccatttgctcggcgccatagcctatggcagacgacgtggcgccgacgtggcaccgagctcgacaccaagatctatggcgcggagctcggatatgtaatgacaaagctcgtctagctcaattgatagagtgtatgacttttgaccttgaggttgtgggttcgagccccatggtgggtattcaatagttttttttgtctttg

SEQ ID NO: 1861 - DNA, 923 bp, Zea mays
ccggccgggatagatatatcacatgccttggactatatccttagaaacgatccctcgaaaggattaattattcatgcatggcatgcaacacggcctgctggatgtcgatcaagctaggcggaccgggtcctgcggaaactgcatgcccaggcatggccgggccgggcttctcaacccccgccggcccggagcgtacgtgtagcgtcgagtgccggcctccccgttacatctccaagccaagcaggtccagagatctcgatcggtcctcttgcagaaacgaggaaagaaaacatgtcttctcgctgggttagggcggaggtgtacccgctgttcgcgacgacaggggtggcggtggggatctgcgtgatgcagctggtgcgcaacatcaccaccaacccggaggtgcgggtgaccaaggagaagcgggcggccggggtgctggacaaccacgacgaggggcggcgctactcgcagcacggcgtgcgcaggttctggctctccaagcgccgcgactacatgcaggccatggacaaggtgcccacggaccctaataagtagacgacgacgatataccccaatgcatggcaagaagatatatatatcagcacaacgcaactgcatgcgatgctgcttgttgctgcaattaatccactatactatatactataggagtattattaattccagttgcatcatgcatgatgatatacgtgtgtctctatatgcatgcgttggtatatacaattcagatatgcatggtgtatacaagtggtagctatacgcacgtacactacatgcagtcattaatttgtacgtcttcgcgtgcatttgggctgtcagcttattaattaaagttcatactatttactaaacggatctatacatgttcaggttcagcagtaaccaaaaaaaaaaaagcggcc

SEQ ID NO: 1862 - DNA, 1563 bp, Zea mays
cactcctatagggcgattgggatcctcgaggccggccgggacacggacacggcctctggctctggctctggctctgcacaccgccggcgcccgcccgctatttgtgtccacggcgacgatctgcagcggcgatggctcggcgacgggacgacgtagcgctggccgccatcacctttgcgatcgtcgccttgtgcgcgcggtatgcgtcggcagtgggcaccacaccccagtcatccttcagctacagggagggtgaccctaccgggcctacaaaatgggccacattgcagaaggactgggatgtctgtgacagcggcaccgagcagtccccgatcgacgtcgccaaggtggaggtctctgaggatttagacccgctgcagcagacctacgagcctggcgacgccgtcatgcacaaccggctccacgatttcatgctgaactggacaggagggaacggcggcctgacaatcgaagggaagaagtacaagctgaagcaggtgcactggcacgttccctctgagcacaccgtcaacggcacccgctttgacgcggagatgcacatggtccacgaggactccaccgacgccaagtcgaaagccgtcgtcgcggtgctgttcagcgccaaagcaggcaagtccagcaagctgctccgcgatctcaagccctacttcgagaggctcgctggtaaacagaacggcacggaggaagtgaagggccccgtcgtcgatccggcagcctggatagacaaggcctctggatactacgggtacgagggctcgcttacaaccccaccctgcactcaaggagtgctttggactatcatgagcaaggtagcagatgcatccaaggaggagatccactccatcgagtcggtgaaggaggcaaatgcacggccggctcagaaaatcaacagccgcgttgttcgctactacaaagcagcaggagccacagaagcgccggcgccggcgccggcgccagaagcaacctgatcgaggagaacgtgagccttgaagacgtaccacgatgcttctttgttcggcttcctatatatactcgaaagctcgtgtgctgagtattgacagtttctttggtgaaacaggttagaacagtagctcaccctcccgagagtatgggttgaaaatctttggcgaattgatgtctcgatgcaaattaaacaggcatgccatctttgtctaaacagaagttttacacactaagttccactcctatactactaccataattttagtaatgtaaatacttgaaagaattgcttaaatataaatgtttaaagacattatgaggaattgccaagtatcaaaggctcgatactcctctctagatctcattggaccacctgtgtaagggtatcgcttcgttttggttcgtataaggaccaaatgctctttatgtgctcgttctttgtcttttcattacagtgaatcgttcggaactgtgtacaaccttgatttgagtcactcacaaactctttaagtgatcatcacatttccaattgccatcaaaaccgcctatatgatgtcgatcaccaagagtaataccatg

SEQ ID NO: 1863 - DNA, 1013 bp, Zea mays
actcctataggggattgggttcctcgagggcggccgggacggccgcacaagcacatagccttatctgctctctctctctctccccagtccccacccgacgcgacgactccagttccaatccgtgctccgctaggtcaatcgaagagtccaaagatcccagctttcccatcccatggcgggcggcgacctcacgcctcctcctcctcctcccgaagagacgccgccggcagcggcggccgaggacctgatcgagatcgtggaggaagggtcggggcggctggacatcgcgcggtacgtggaccacgtgcgcgacctgtcggcgggcgccatcgcgacgttcgagggcacgacgcgggaccacttcgcggggcggcgcgtggtggagctccggtacgaggcgtacgcggccatggcgcggcgccgcctggcggccatactgcgggaggcccggtcgcggcacgcgctgcggcggctggccgtggcgcaccgcctgggcgccgtccccgccggcgaggccagcgtgttcgtggccgcctccgccacgcaccgcgccgacgccatggaggcctgccgctacgtcatcgacgagctcaaggcgtccgtgcccatctggaagaaggaggtgtacgacgacggcgaggtctggaaggagaaccgcgagttcctggaccgccactccgccgacggcgatgcgacggcgggcgggtgctgcgggagcaaggtcagggtccaggaggcttgacgctgatggatggcggcgcccggatccctctgtcgctccatcgcggtcgcgactcgcgacccattggagcagggggtttcatgaaattctatgtactacttactcgatctccgttgattttgttctccatcttctttctttctttctgagagagactgcagcttgtacttgcacttgcacaccatgaagatgaaaggcaaatagatgctctgataaaagtcataactcataatggaatagtagttcagttttaacaaaaaaaaaaaaaaga

SEQ ID NO: 1864 - DNA, 1970 bp, Zea mays
acccccctggatggcacggcgatcccctgaaggcgagccagtgaaggagctctacatatgcgcgactctggccatcgtgcttgccgccggattcgccaccgacgccattggcatccacgcgctctttggagcgttcattgtcggcatcatcgtccctaaggacgggccgttcgccggggttctcctggagaaggtggaggacctcatatctggcctgttcctgccgctctacttcgtgtccagcggcctcaagacgaacgtaatgaccataaagggcggtgactcgtgggccctcctagtcctcgtcgttgccaccgcgtgcataggcaagatcggcggcacggtgatcgcgtcgctcatcgtccgggtgccgttccgcgaggccctcacgctcgggttcctgatgaataccaaggggctcgtggagctcatcgtcctcaacatcggcaaggaccggcatgtccttaacgacgagactttcgccatcctcgtgctcatggcgcccaccccctccttcatcacgacgccggtggtcatgacaatctacaagccagcgcggcggggggcgccgtacaagaaccgcaccgtccagcgcgcgaacccgcacgacgagttccgcatgatggcctgcttccacagcacgcgaaacatccccaccatcatcaacctgatggagtcctcgcgcggcacgcggaagcgtggcatcaccgtctacgccatgcacctcgtggagctctccgagagatcgtccgccatctgcatggtccacaaagctcgtcgcaacggcatgccgttctggaacaggcggcgcaacggcgacggcggcggcgaccagctcgttgtcgccttcgagacgtaccagcagctgagccgcgtgtctatccgggccatgacggccatctccgacctggaaacgatccacgaggacgtcgtcaccagcgcgcaccagaagcgagccgcgctcatcgtgctccccttccacaagctccaccagatcgacggccacatggagtcgcttggcgaccagtaccagcacatcaaccagcgcgtgctccaccacgctccctgctccgtaggcatcctcgtcgaccgcggcctcggcggtgtcgctcaggtggccgccagcgacgtgtcatacaccatcgttgtcatcttcttcggtggccgcgacgaccgcgaggccctggcctacggcatgcgcatggtcgagcacccaggcatcgggctgcacgtcctacgcttcttgctacagtccggcggcgccgccagcgacgacgacgcgtcgttccttgaagagttccgaaccaaggtggccaacgggaacgactctgtccgctatgaagacaggacagtgggagggaaagaggaagtcgttgaggcgatcaaggcaacagggcggtgcaacctgttcctcgtcggacagggcacgccctgcatgccgctggttgactggagcacggacagcccggagctcgggccggtgggtacttacctggcgctgccggaattctcgacggtggcatctgtgctggtcatgaaacagtacgatccgatggcgaagcacgacgacttcgtcgaggaggtggccgacatagcggtggacgttgacacgccgggccccagtaaccggggaaccaatactagcttccatgccggatgatacgtgctggtgttagatgtattattaacatgtcgagcagacaagactgattaacattatgtaatgtaatctcaaagtggtgtaaatggatggatcgaggtataggatcccctggagtgtccaaccggcaatccaaaccaattccttttttcgaattatcatgatgtaattcccaaatgtataaaattcagtttttagtttttccttaaaaaaaaaaaaaaaaaaaaaaaaaaaaaaataaaaaataaaaaataaaaaaaaagaaaaaaaaaataaaaaagcttaataaatatataaatataaaaaataa

SEQ ID NO: 1865 - DNA, 1757 bp, Zea mays
gcacgagaccattacctagaacatcccgatcgcccccttccgttacatcccaccatttgctgttcaccttccctcccgtttgcctcctctcgctgtctcgtagcttctttcctccggcgacggctgggcgagcggccgccagtcgggcccttcgtcggcgacgagcatccacctgcgcggcgccccatcttccgctccttcccttactcgcgctcggcacacaggcgacggcggcggcggcgctcaggatcgggctatcaccgacggggtccggcttctccgcccgcctctcgccactcgcctcgcgccctcgcctccggtcctccgcacaccggccggcgatcctgcctctgtaggttttttgtgctatactttttagtggttctggccttcttgatacaatggtgaagctgacaatgatagctcgtgtcactgacggccttccactggcagaagggttggatgatgggcgagatctgaaggatgctgatttctataagcagcaagctaaacttcttttcaagaacttgtcaaaagggcatcatgaagcttcacggatgtcaattgagacagggccctactatttccactacattattgagggcagagtatgttatctgactatgtgtgaccgctcttatccgaagaaacttgcattccagtacctagaagatctgaaaaatgaatttgagagggtcaatggcaaccaaattgaaactgctgcaaggccatatgcttttatcaagtttgatacattcatccagaagactaggaaactgtatttggatacaagaactcaaaggaacctcgcaaaactgaatgatgaactctatgaggtgcatcaaattatgactcgcaatgttcaagaggttcttggtgttggtgaaaagctagaccaggtcagtgaaatgtcaagcaggttgacttctgatacaagaatatacgcagataaggctaaggacctcaaccggcaggcgttgattcggaagtatgctcctgtcgccattgtcattggggtagtattgatgttgttttggctcaagaacaagatatggtgattgtacagtacgaaggatactgggccctgttacaacaccggagaagaacagatggagataaaaaccaggtctattctggaacaagatgctttggtgacttgtatcccgtatctgcccattcaagcgattacttaaactgcccttttgctcctccctataagctagtatcaaagtgaattcgttggagtgcagacctgataagagcatctccggaagtctttcaaaattcactctaaattgtcattttgagagtcatttgcttaataactgtcattctgtttttttcactccaacagctttttatatcctgtttgcactaaggagtcattctctttctatattggactaccgatgaatttggagaagatggatatattcggatagctgttttttttaaaaaaaaagctgttggggggaatcttagcaattaggaaggttatagtctctagagaaactcatattttgtgcatccgttgaactcaatgtaatacaatataagggctctagagttctacatcggggttgtggaactcaatgtaatacaagagctgtggagttgactttacatcggggttgtaaattttagggtggaactcaatataaggattcaggctggtctgatgagttgactaaactctagcatgttttttatagctgcctaatatgtattgatttaaggtgtgtttggtttgttctttt

SEQ ID NO: 1866 - DNA, 1561 bp, Zea mays
ctttcgttacatcccaccatttgctgttcaccttccctcccgtttgcctcctctcgctgtctcgtagcttctttcctccggcgacggctgggcgagcggccgccagtcggtcccttcgtcggcgacgagcatccacctgctctgtaggttttttgtactatactttttagtggttctggccttcttgacacaatggtgaagctgacaatgatagctcgtgtcactgatggccttccactggcagaagggttggatgatgggcgagatctgaaggattctgatttctataagcagcaagctaaacttcttttcaagaacttgtcaaaagggcatcatgaagcttcacggatgtcaattgagacagggccctactatttccactacattattgagggcagagtatgttatctgactatgtgtgaccgctcttatccgaagaaacttgcattccagtacctagaagatctgaaaaatgaatttgagagggtcaatggcaaccaaattgaaactgctgcaaggccatatgcttttatcaagtttgatacattcatccagaagactaggaaactgtatttggatacaagaactcaaaggaacctcgcaaaactgaatgatgaactctatgaggtgcatcaaattatgactcgcaatgttcaagaggttcttggtgttggtgaaaagctagaccaggtcagtgaaatgtcaagcaggttgacttctgatacaagaatatacgcagataaggctaaggacctcaaccggcaggcgttgattcggaagtatgctcctgtcgccattgtcattggggtagtattgatgctgttttggctcaagaacaagatatggtgattgtacagtacgaaggatactgggccctgttacaacaccggagaagaacagatggagataaaaaccaggtctattctggaacaagaagatgctttggtgacttgtatcccgtatctgcccattcaagcgattacttaagctgcccttttgctcctccctataagctagtatcaaagtgaattcgttggagtgcagacctgataagagcatctccggaagtctttcaaaatttcactctaaattctcattttgagagtcatttgcttaataattgttattatgtttttttcactctccaacagcctttaatatcctgtttgcactagggagccattctctttctatattggactaccgatgaatttggaggagatggatatattcggatagctgtttttaaaaaaagctgttgggggaatcttagcaattaggaagggtatagtctctagagaaactcatattttgtgcatccgttgaactcaatgtaatataatataagagctctagagttctacatcggggttgtggaactcaatgtaatacaagagctgtggagttgactttacatcggggttgtatttttagggtggaactcaatataaagattcagggtggtctgatgagttgacgaaactcgagcatgctttttatagctgcctaatatgtattgatttaaggtgtgtttggtttgtctaaaaaaaaaaaaaaaaaa

SEQ ID NO: 1867 - DNA, 1261 bp, Zea mays
  misc_feature (864)..(864): n is a, c, g, or t
actttctttttatttttctcatgtgacaagcttttcaatcgcagatgcctacctaccccgctgctatgttcctcggcgacagcgacggggaaggcttgagcctggtcctgtacttcagggtgtccgaatgctacgacaaggaggtttccgaacatttcaaggagtctatgatgaggtttttcgaggacgaaaccgagaaggtgaaagggttcacgtcagaatccactgtgagctacagagatcggctgaagatcatggccggcctggtcaacccggacgacctccagctgggctctacggagagaaagctcgtccaggcgtacaacgagaagccagtcctctcgcggccccagcacagcttctacgagggagaggactaccttgaggtggaccttgacatccaccggttcagctacattgctaggaaggggctggactcgttcagggcacgcctcaagaacggcatcctcgatctggggttaacgatccaggcccagaagcagtcggagctccctgagcaggtcctctgctgcgtcaggttgaacaagatcgatttcactgaccaagaagttccaacaatagtcaccgttgatgacacctgacgcatttgatcaaaatggtcatcagacgtgcgagctattattaactgctgcaaggctagatccatgggattcagaggcgacacaagaactgatgactccacgccttggtttctgcctaatatgttcgccgatctgcctacttttaagcacgggctttttcttgtcttccctgtaactataatataataatgtatattatatacaagacgatacaaccctgcgggtgttggtcatgttcctaacctttttgcacactccgaanaaaaaaaaaaaaaaacttgcggcctgcaatatgcctgcttccagatgcagaaagacattgaacctgacaatattcaaatgcccatgcatcagacggacatgtacatccataataggattttgacagaaattgcggcgggtgcgcctgttgtaagcttttgttccggacattccggtattaaaagcaaaggtaacctgtttccggaaaagcgaaacaaaataaaggatccagacaaatcagtagccatacatacctcgacgagacacagattatcatcagcaactgtacctttatatatcctgtagaaataacatttacgaagaacaggaaggaagccgtgtatctacaaaccatgtctcatttacaggtttttaatcgagtatatacacttgggcag

SEQ ID NO: 1868 - DNA, 2415 bp, Zea mays
ctctgatcctagcttgtctcctggccctccgcccttccattgctgcgactcccggcggcggccgggatgtaccccctgaccttccgccccgccgcgtcctttccccaccattcccatggtggcccccctcgcctcctaaggcaccatctccgaggaccagggcggccaccacctacccggcttcgcattcggcagccccaatcggccgaccgcctttcggtccttgtgtgtcccctctccagcggcgccatacaacaaacagtacaatgccttcaaattctgccgtagtagtagttatcgccatctttcttgttgttatcctcggcgccagccacgcggtcaccggcgcccgtgtcggcaccatgatgatccggcagccttcttcgtcctcctccgtcctgatgttcagggaggcgcccgcgttccggaacggccccgactgcggcgcggacggccgggtggacatcgccatgacgctggacgctaactacctccgcggcaccatggccgcggtgctgtccatcctgcagcacacggcgtgccccgagagcgtagcgttccacttcctcaccgccgacgccgacgccgacggccacggcctctccgccgcgctgcgcgcctcgttcccgttcctcgacctgcgggtgtaccgcttcgacccgtcgcgcgtccgcgaccgtatctcgcggtcggtgcgccaggagctggaccagccgctcaactacgcgcgcgtctacctcgccgacacgctgccgcgcgacgtgcgccgcgtcacgtacctcgactccgacgtggtcgtggtggacgacgtccggacgctggcgtccgtggacctcgcgggccacgtggtggcggcgcccgagtactgccacgccaacttcagcaactacttcacggacgccttctggtcgcacccggcgctcaacggcaccttccacgggcgccgcccatgctacttcaacacgggcgtcatggtcatggacgtcgacaagtggcgcgccggcgggtacacgcgccgggtggaggagtggatggccgtgcagaagcggcggcggatctaccacctcggctcgctgccgccgttcctgctcgtcttcgccggccacatccgggcggtggaccaccggtggaaccagcacgggctcggcggcgacaacgtcgagggccgctgccggggtctccatccgggccctatcagcctccttcactggagcggcaagggcaagccgtggctccgcctcgacgcccgccggccgtgctctgtggactacctatgggcgccctacgacctctaccgttactcgtcgccggtgatcgacgagtggtgactggtgagccgtgacgtggtgtgagcatgcaccacctgaggagctactagcaaatggtaggacagttcgatcttgcagaggggaagaggcatcacaatgatgcatgcatgcatggctatctcttgatcttttaatttatataatactgtgcaattcaccctcttaattttgtatatatagatctatagatcctgttgtaaatttgtacagattattattagtatgcatggtggggaggctcatgctgacaaatgtatgtactattgtactgtatatctcgagttcatggtaatacaacacacagattctgcaaacaaaaaaaaaaaaaaatggccggccgagtgttatctcggaaagtacgtgtcaaactatttgccgagtgtgacaatcgttaaagaagtctcgtcgagctgtacatctacaacggtttcttttccgaatactttttatcagatacctggcaaagtcatctgatactctgtaaagaaaagtcgtcgtcacgatgctaattgacggagcctttgccgagtgttctctccgacactcggcaaagaagcctcctttgccaagtacctgctatatttgtcgagcctttgtcgagcttaacactcggcaaagaattggattctggtagtggtagtacatgttcttaaatactctcctatagtacttaacgaatgcatatgcatatttacatggctcttttttctgctttctgaaggataggacaagatctctgatatatttttactccgttcattctaaattgtatcatttgtaagttgttattggtttttcgcttgggaaaatcggtggtcggtgcactactttaaaaaaactaatgtaagagcaaggaaacctctagagataattgttagcagcttgaattagttgtaagtgttccaaacactctaactaaagtctcaaataattgttagttgtatgcctaactagtaactaataatcaatcaaatagctaggttagggaagttaaaatcaattaaaacctagcaaaagacaggattgccccttatcgtttcaacatggctctcgatctttacacaatgcttttcgactctatcgcccc

SEQ ID NO: 1869 - DNA, 689 bp, Zea mays
aacctcgagtctgagagaatggctaacactgctaagggtaaggtctgtgtcactggggcgtctggtttcatcgcctcctggctcgtcaagcggcttcttgagtctgggtaccatgtcctgggaacagtcagagacccagggaatggcaagaaagtagggcacctctggggcctggaaggcgcaaaggaaaggctgcagctcgtgagagctgatctcttggaggaagggagcttcgacgacgctgtgatggcttgcgagggcgtcttccacaccgcatcgcccgtcgtcaccggatctaattccaaggcatgctaaacaccaattctgtttctcatatttgcagcttcaggaaaggcctggacatatagcgacctgaaacatgttggtgccacttggcaggaggagatgcttgattcagcaataaacggcacgatgaacgtgctacgctcgtgcaagaagaacccatcgctcaagagggttgtcctgacatcctcgtcgtcgacagtgaggatcaaggacgaagccgacctgccccctaacgtgctgctggacgaatcgtcgtggagctccatcgagttctgcgaaagtctccagatatggtacgccgtcgcaaagatcctcgccgagaaggcagcctgggagttcgccggagagcacaggatcgacctcgtcaccgttcttcccgacct

SEQ ID NO: 1870 - DNA, 1293 bp, Zea mays
ggcacgagggccaactctccacctgcccaaccgagtcaccaaaaaggggtgacacaaaatccttatcgaaaacttcaatgtgcacaatataaactagctgggatcaaatacaggagcacctcgagtctgagagaatggctaacactgctaagggtaaggtctgtgtcactggggcgtctggtttcatcgcctcctggctcgtcaagcggcttcttgagtctgggtaccatgtcctgggaacagtcagagacccagggaatggcaagaaagtagggcacctctggggcctggaaggcgcaaaggaaaggctgcagctcgtgagagctgatctcttggaggaagggagcttcgacgacgctgtgatggcttgcgagggcgtcttccacaccgcatcgcccgtcgtcaccggatctaattccaaggaggagatgcttgattcagcaataaacggcacgatgaacgtgctacgctcgtgcaagaagaacccatcgctcaagagggttgtcctgacatcctcgtcgtcgacagtgaggatcaaggacgaagccgacctgccccctaacgtgctgctggacgaatcgtcgtggagctccatcgagttctgcgaaagtctccagatatggtacgccgtcgcaaagatcctcgccgagaaggcagcctgggagttcgccggagagcacaggatcgacctcgtcaccgttcttccgaccttcgttgtcggacctactctgtctcctgagctcggccccaccgcttctgatgtcctcggcctgttccaaggagagacggggaagttcacgacgtacgggaggatggggtacgtccacatcgacgacgtggcgaggtgccacatgctggcgtacgaggccgcgggcgcccgagggaggtacatctgcagcgcggcggtgctggactgcggcgacctcgccgccctgctcgcgcggcggttcccagcgtaccccgtcccgaggagcctgccccgcgcctacggcgagcagtcgtacggcttcgacacgtccaaggcccgcgcgctggggctggcggaattcaagggcgtcgaggagatgttcgacgacgccgtcgcctcgttcataggccatggccatctccccgccgccgaggaacgccggcacgcgtagcctcttggtctgaaactacatgaatgaacgtatcatgtactaattaaattatttaatacttttaactagcatctaatcatgccgtttagtctcaaaaaaaaaaaaaaaattaactgttatattatatttaaattttaatacccacaccaccaaa

SEQ ID NO: 1871 - DNA, 568 bp, Zea mays
  misc_feature (2)..(2): n is a, c, g, or t
anttcaatgtgcacaatataaactagctgggatcaaatacaggagcacctcgagtctgagagaatggctaacactgctaagggtaaggtctgtgtcactggggcgtctggtttcatcgcctcctggctcgtcaagcggcttcttgagtctgggtaccatgtcctgggaacagtcagagacccagggaatggcaagaaagtagggcacctctggggcctggaaggcaaaggaaaggctgcagctcgtgagactattcctcttggaggaagggagcttcgacgacgctgtgatggcttgcgagggcgtcttccacaccgcatcgcccgtcgtcaccggatctaattccaaggaggagatgcttgattcagcaataaacggcacgatgaacgtgctacgctcgtgcaagaagaacccatcgctcaagagggttgtcctgacatcctcgtcgtcgacagtgaggatcaaggacgaagccgacctgccccctaacgtgctgctggacgaatcgtcgtggagctccatcgagttctgcgaaagtctccagatatgggtacgccgtcgcaaagat

SEQ ID NO: 1872 - DNA, 1215 bp, Zea mays
ctccttagggcgattgggatccggccgggggaccggggggggcgcaccggtcaaacaggctcaggaggaggctctctcctgtcctacctgttcgctcccggctcccctccatctctttcgccacacgcgcgagagggaggagaggaaacagctagcagcgagcgaggaacgaagagggtgcttcgcacgtgcatgcgagatcgatcccgatcgtcggccggcgggaattgaactagcgacgacgtacgtgcgaccggggcgggcgttggattaattattccggcctgagcaatgggcaagatcgagtacggcgtggtggcgcgcggcgcggtggtgctggcggagcactacggcgcggcggcggcgggcggcaacgcgggcgccgtggcgcggcaggtcctggagcgcctccctggcggcggcgacgacgactgcaacgtgtcgtacacgcaggacctccacgtgttccacgtcaagcgcaccgacggcctcacggcgctctgcatggccgacgacgccgccgggcggcgtgtccccttcgcgttcctggaggacatccacgggaggttcgtcaaggcgtacggccgagcggcgctcaccgcgctggcgtacgccatgaacgacgagttctcccgcgttctggcccagcagatggactactactccaacgacgccagcgcggacaggataaatcgcatgaggggagagatggaccaggtccggagcgtgatgatggacaacatcgacagggtgctggagaggggtgaccgtctggaggtgctggtggacaagacggcaaccatgcaggggaacacggtgcgcttcaagcgccaagctcgccgcttcaggaacaccatgtggtggaggaacgtcaagctcacagctgcagtgatattcatcctcaccgtaatcgtgtacgtcctgctcgcctacatgtgtcgcggcttcaccataccgtcatgctttccgtaatctccatccgtcccggtgccagtgcggaccaccagccctagctctagctgcctcacaacttggttttccgggttctgtaacagcagcagcggtgctgcagttctctctcttgtacgagggaaacaacagctcattctcaagttctgcaacaaccagatctgatttttttttaaaaaaaagatggtagtcaaatggggaagctttcccacctgattttctatcattaaacacacgaacttctgg

SEQ ID NO: 1873 - DNA, 1092 bp, Zea mays
  misc_feature (18)..(19): n is a, c, g, or t
  misc_feature (158)..(158): n is a, c, g, or t
  misc_feature (408)..(408): n is a, c, g, or t
ttttttttttttttttgnnagccaagctgcgcccacgatctgtgatcttgtcgacgccgccgttacattagaacggttcgtaggaatcgattacacagttcgtccgcaaccacaacgcagcacgaagccgagcctgacgggcaccaccgcagggccgnaggcgcccgttgttgggcttgctgtgcaggctggcgcccgcgccgtagagcggcacctgcttccccaccacggacaccgtcaccgtccgcccgctcttccgcggctggtagaactccgccatctctccggaggcgacggtgaggtcgccgtagaagaggaggaacggcgtggccgtgacgtgcaggctgaagaaggtgccgcggttgcggaagcgcagccgcaccgtcgcgttgaccgacatcatcttcngtagggacgcccgtccggtccgtgccgccctggatgtggtacgactcgaacaccacgctcttgacgacgacgtggggcttgtacgacctgctggcgccccacagcacgatcaggaagaaggcgatcacggcgacgaacgcgaccgcgccgagcgcgtagcaccgccacggcgactccgcgaacgacccgccgcgcagggacgcgccgtcgtcgtcctcgtccccgacgctgcccgcgccgctgccgttcccgagccggcgccaggggacgctcaccaccgcggcgacgtcgccgccggagcggagctggtcggagaagagcagccgccccgtcgaggactcccgggagtggtgcgtgccgcccacgccgacaccggcgccgccgctcgagtggtggcggtggtggtggaagtggtagtggagcggcgactccgccggggtggtccccgccacgccgccggaggcgcccaggtggacgtccgggtgggaggcggcggggctgagcacgtagtaggccgggcggccgcgcggggaccgcggcggcgtggacgccgccaggctcgtcacgtcggagtccgtcttggcgtgcctggccatctctctctctcgggagccgcggggcggaatgcgcgtgggactgggactgcggctgcgggagaggggctcggcccggccggcctcgagg

SEQ ID NO: 1874 - DNA, 2837 bp, Zea mays
tgaaggcgccgcgtgcgggccagtaatgtgaaacaacccttgaaccttggttaatttaacgattcataatattcccgtcgctctccgacccacgtgtacatattctgtatactataaaatatggtcctagctgttcttgagctcccaccgtcccacgacccttgtgtgtgtgtgtgtgttttttggaccctcggcctccggccggtcttagaacccagttctttcatagtttcgttcttccgcgtttccacttattctttgaaggcagaggcagctatatcagtactcgagtgttctcgagtcctgctgcatcccagtttcccaacaagagcggcacggggatcctagagcagcagacattcgcgttgcaatggtgttctgcgcggatttcgctgccctccggccgtcgccggccgacgtccgtgtcgtcacgtccgacgggagcgccatccgtgcgcattgctccgttcttgtgagcgagcgaggctttcctgttcctttccgtgtgtcaattgatgcggaccgatcacccgacgctgataaggtttctcggtattcccgcgtgcgtaaattcgaccaaggccgcggcgtccccggtgctggagcggatgatcgagggcacgcgccgcgggtgggacgccggctgcaccgtccacgtcctcggcgcgcccgctgacgccgttgccgccttcctccgcttcctctactccagccccaggtaaccacggaagctaccactgccagcgcgtgccgcggtgcggcggcctgtccgtcccatttgcccccgccggaatcctccctatctcgctgatcggtggcgcgcgtgaggcagggcggaggacgcggtgggcgcgcacggggcggcgctgctggcgctggcgcacgcgtaccgcgtcccgtggctgaagcggcgcgcggaggccgcggtggcggcgcgcctgaccgcggagcgcgcggtggacgcgctgaagctggccgcgctctgcgacgcgccgcggctgtacctggcgtgcgcgcgcctcgcgggcaaggacctggacgccgtggagcggtccgaggggtggcgtttcgcgggccgccacgacgccgcgctccagctgaacctgctccagctcgtccacgacgcccaccaggtgcgtgcgtctctcgccttgctttgactccggcggcattgtttttggagattaattaagaaacaagttaggaaatgcattgtttttgggattaggaagaaacaagtttccaagtcatggcagcgtcagaactagcattttttttagaccaagtgtctgttcttttttttcccctgggaacaatctacatgacaagttcacagctgaatgccgacagttccatgacacagcagcttctgtatgagatagttcctgcccacctaaaatctattgaatttgcaccctagcggtatcccattgcctgtctgtttctttctgagtgatgcgatcctgaaatcaattcaacttgacactagagtttgtctttgtccccatcctgtggtacagacgcacagtccaaacgctactgtgcagtgtgcaccaaacacacacactgctgggtgctggcagtggcagtacagaaatccaaatcgaccacgtgtaccacgagtccacacaccccttcccatttcctgacgcggacacgtccgcctccctttgccctgacagagaaaggagaggtgggagagggagcgcgcgtcgcagcacgtgtacgggcagctcagcgacgccatggccttcctggaccgcatcttcgccggcgatggggagggatcgtccgccgcgtgcgccagtgcagcctcgtcgcgcgaggacggcggcgtccgccgggggctcgagcagctcatgcggcacttggccgcgtgcggcggcaggaccaggaagcccgccgcctgcccgcgctgcaggcgcgcgctccagctcctccggctccacgcctcagtctgcgaccgcgccggcggcgagccttgcaacgttcccttgtgcaggtaaatgcagtgcagacggattaccacacatcaatgtcgtgtaaagaaaaagatcccttttcgtttctttttggtgtgcatcaatgtgaacaagctgtagtctcgcgcagttggtattggtaccaacacaacacgagggaacagcgcacgattctgtggctgcaagtgtttcgtccctggagatgtatgtactccaagttctttttggtacaggcgtacagcagcacgtgaacggcatgaaagaaaaaaagaaactggaggctggagggccatggctactcctgagtcctgaaagtgcatgtgttatctccagcgggtagtggatgtgcatagtacatggtagatgcgagcttgtagaaaagaggacgctctcaggtgagggagagagaaacccgtcgacccgccgacacggggtacgggaagacgacagacgaacgttcattttacacgtcatcatccatgaactagggtgccgtttggttcacatatttgtaacgtaatgagtaaccgataacgttaaatcatgtttgttttagtccaaccgtaatcgcataccacattacgatttgatatcggcctattcaaatttgttaccgctgatactcaagcgtgaatcattaccgttaccatttacgttacattttgtgaactaaacaacattaatgattcacaacggtaataaatttgaataaacctgtatccatttttagtgtggtatctgattatattggacttaaacaaacatgatttagcgttatcggtatcacgttacaattatatgaaccaaacaacatcctaaataggacctactagctaggggcaatggatgtacaag

SEQ ID NO: 1875 - DNA, 1684 bp, Zea mays
ggcggggaatgctgttcatgatgaaatgctgacagcgatgttccaaacgtgataatgctaaattgctcgatgtcgaaaagaacacacagcgtttcatatcacaactacaaacgtttgtgaatctgaccataagttattccaagcaaggaaaatcagtgccaagtatagacagacagccaagagatgaagggcgagtctctaatgttaaactcgctttaagcaacaacaacgagcgaccaaattgcgacaagttcttcacacagaacaaccttcggatgaagatcatgcatgtcgagcaaaacgattaccctttgtatatcattccagcaggttccattctcgcccgtggccttggttctacttggagaacctctcactgaagattcctgcacgttgggcaaaaccatttccccttgaatctcgtttctggtgtaagacccacacacgtgtaatgaaaccattcacctcctccacaattctcattgtcacaagcaatcatgtcaccatatgaaatctggtggcatatacagtatgtcggttcatttggatcaattgtttgatccacatccatagatgtacctgctttcttgctgctacctggagggggcattaaatcaaagtccatacccctttccctgtcccattccctctctctaaatttttttgatgcttgaggtgtactaaaaccaaacctccttttctcatccctgctaaccaccggaactggaggaaggactgtaggttcatctggaggtatcttcccttcatgctttaaatcttctgcaaactggcccaagtcttcatcaaggcgttttatatggctctctatcaggtcataagcttggcgtgccagtaagactttctcggtgcaaagattcagagcattgtcctggctagcttcaatgtccttcttcatcctctccgactcatcatcatccatgtttgacctgtcatacccatgggatgatactcccagaatatactttatctgttctttggtctgacccataatgccatgtgccctgtcatcgagctcgcgcatggtggagagaatcctttgcaggtcgccggccagggtgctcgagtactcgaggtagtcgtcgacgtacacgccggtccgagcgatcgccatgcctgtctatgattgctcgcgtctccgggcagggttcgatgaatcgatgccccggtttggggaactaggggtggagagacgaaccgtaacgggacgggacggtcctcttctcgctggcgtttggttggatgtgaggagaagtgggatgggctcgtcccacaggcgaatattcaccgtagatgcgggacggggtcgtcccgcttgcagggcgtgaagcgccgtttcccgagaagacgggctcaaggacagcgtggtggtctccggcgaaggagcgggcgcgaagggacaagggggcgtggacaagctccggtgaggacggcgctgaatcgaccttcgacccttggctcggggaaacgcgagcacgcagcgactcggggaagcgctggggatcggaagcgcggaccggcacggggaatgtcgagcgaccggcgacgacggggaggccccagcgaccgggtgggctgtgggcggcggcgaatctacccgccgaggtcgcgataaaccaatgttatgtgcacggataaattcttccccggcggcccgagggtccca

SEQ ID NO: 1876 - DNA, 2188 bp, Zea mays
atcaactttaaataaaaatctcgtataacccttcactaactactatttctgcggacactaggatatgattcgcatgtgtcacaacaaccaaaatacgaaccactctcatttttcgagtgtagcccatatccactttctaagttacacggttacacctagaatagagcctatcacccacaaacggagaaggagctgatctcaaaaggaaccccataaacattcaccgaaaccttgcgttgatgcccgcctcgtctcgtcacgagactacacttgttgctgacatgagcaaacaaaccaaacagtgctgtgcggttgtgtttgtcatctgccatggatgtgctggcaattgtcaaaaaaaaaaacaccgagccggcaagcaggctgtttacctgtttctgctagcaagccgagatgtggcgaaatttagaaagcctgaggtgtcggccgttcacgattacctttatgttcacgttcttctgcgtgcaaacgttccattcattggcgcaattaatggcggccattcttggtacgcctctcttccatctttctttaccatgctgagttgtctgtcaagcacctccacccctcccgggagaccgtcctcgaccgcattgaccccgccgtggcacggcctcgaggccggcgacgacgcaggcgcgaggcgccggagggtccggccatgacgtcgtccgtgcggcagtggtggcgccgcgccgccgctgcgctcaaggacaggaggagcctgctcctggcgcgcctgcgcccgcgccgggccgggtcgtcgtcgtggcaccaccgggagctggaggcggccgtgatccgcgcgacgagccacgaggaccggtggatggactaccggagcgccgcgcgggtgttcgcgtgggcgcgctcgtcgcccacgttcatccggcccgtcatgtgggcgctggcgcgccgcgcgcggcggacgcggtgctgggtcgtggcgctcaagtcgctcatgatcgcgcacggcatcctcctccgctcgggccgcgcgccgcgcgccggccgcgtccccttcgagctcgctgacttccgagaccggtcctcgtcggcggcggccaggtccctggccttctccgcctttgtgcgcgcttacttccggtttctggactaccgctccctcttcgccgcgcaggagtacaccgacggcgatgacgacgccgaaaggtgctcggatccccagacggcctgtcttgatcggatagcgaagaaacagttcatgctcgagctgctcctacaaatccgcccgtacggcgacggcatggaggtgccgctggtcctcgaggccatggattgcgtcctcatcgagatcttccaggtgtacggcgagatatgcaccggcatcgcgcggttcctcatcagcggcgttcagggcggaccggcgatgctgacgacccgcaaggaggtcatggcggcaggggtgaaggtgctctggcgggcggcggagcagagcgctcagctctcgtcctacttcgacctgtgccgcgagctcggcgtggccaacgcgcgcaagctcccgacatcattagttcgcttgaaagacgacgacgtccgggacctcgagcggatcctcatgagtgagagtgacatccagaacgaaagcggtgaggaggcggaggcggaggcagaggcagaggcagaggcggcggcggacgtgaaggacgcggggtcaacgtcgacgaacactgcggtggtgatggcaacaacggaatgggtgacattcgacgaggagagaccaagcgctggcgttgtcgcctaccacggcgggggtcacgtctctaatcactggaaccccttcgtcgctgcgccgttagacggtagggaaggcggaaacctaatcgagcttttctagttttctaaccgaacgcaatattgttgggttaaaccataaccttttgctcttttgcgcccgcccgattgtacactatgctctttgtaaatagtaacgtgactcgtttggtccaaaaaaaaaaaaaaatcattctatggagtgcaaccctaccatgactacgtggagaatctcttgggcctttaacgtgaattatgaacaaataataaatcttctgtttaaaattacacttgcaaggacttgaaatttgagacttttgaattaaggccatactcaagtacatgccccgaatcatttttgacccaaaagataaag

SEQ ID NO: 1877 - DNA, 1013 bp, Zea mays
actccttagggcgattggtatcctcgaggccggccgggggccgaaggccgcatgatgcgtcgccgagccatgacgatgacaatagccgccgtgctctgcctgctcctcttctctggccgtctcgccgcggcggagaagactttccgcggaggcggaggcggaggctacggcgggttggaggccggtggcggaggcggcggcggcggctactccaccccgagcgaggcagcgccatccacgcctgccgctggggagacgacgaccccttcgtcaggcggcggttactccacccctagcgaggcagcgccatccacgcctgccgctgaggagacgacgacgactccttcgtcaggcggcgggggttacggcggtgcaaccggcaaggcttcctcaggcggcggcgggctggaccccgacggcgacccagaggttgggctgaacgggaaggcgatcgaggagatcgtgaacgagcacaacgtgttccgcgccaaggagcacgtgcctccgctggtgtggaacgcgacgctggccaggttctcgcagcagtacgcggagacgctcaagggcaactgccagcagatccactcgtcgtcgccgtacggggagaacctgatggagggcaccccggggctgacctggaagatcaccgtggacggctggagcgaggagaagaagaactaccactaccactcggacacctgcgaccccggcaagatgtgcggccactacaaggccgtcgtctggaagaccaccaccagcgtcggctgcggacgcatcaagtgcaacagcggcgacaccatcatcatgtgcagctactggccgccggggaactaccacggcgttaagccatactaaaatatatatcgacccattgcatatatatatgttgcagagctttttattttggcaacatatctagtgcatatggactgctggtatacatcatgcacatattaaatcctatcctttaatttaagatccattgtcttaaaaaaaaaaaaaaaaaaaaaaaa

SEQ ID NO: 1878 - DNA, 1820 bp, Zea mays
gattcccttgggattcaaccctggaccaaaaaaacctgaattaagttattaaaggtagcctggttctttcaacggcttgtcattattggcaagggttttgttgtggtcggtccattaaattccagtaccaggaagaaggttgctttgtgaaaccaaaattagactggtccgtcccggcatcaaggtcagggacacggcccacgcggaccctacttttttccttgttccgtgagatccgcggtcgcgctctacaacggcatgatccggggttgcgcttaccatggggccgcacgagcgcgcgctggagctgctcgccgaaatgccgcgccgccgccgtggccgttttgtttttccccataagaaatagaatatccaatcgaattgtcaagtgctacctgatttgaaaatgtttttccctctaggatgatctgatttcagatctcaccagaagaagcactacctggttattggaatccaaaattttttatgtactgttttgatcagtgaaattcacacttcgctagtccaacaagctgacaggaacgggttctagacggatcggacggcacacgataacagctgccggtgtcccggaccatcctgtccatccctctataaacggagtcctgtccagttgtgatcgagacccctcgcaaccgccggccgattcgagcagcgccccagcagcctctggcgaccgccggagcccgaggaggaggaggagggaagatctcgctcgatccaaggaggtgagtacaagatggtgagctcctcgtcgccggtggtcaacgtgtacccgctcgccaactacacgttcggcaccaaggagcccaagatggagaaggacacctccgtcgccgaccgcctcgcccgtatgaaggtcaactacatgaaagaaggaatgcgtacaagtgttgaagcaatcctattggtgcaagagcacaaccatcctcacatactgctcctgcaaatcggtaatacattctgcaaacttcctggtggacggttgaagcctggagaaaatgaaatcgagggtttgaaaagaaagttatgcagcaaacttgctgtgaactcgccttcctttccacctaactggcaggttggagagtgcgttgctgtgtggtggaggccgaactttgagactgtgatgtatccttactgtcctccacatatcactaagcccaaggagtgcaagaaacttttcattgttcacctatccgaaagagagtattttgctgttccaaggaatctgaaactgcttgctgttccactgtttgaactctacgacaatgttcagaggtacgggcctgtcatctctaccatcccgcagcagctttctaggttccagttcaacatggttagctcttagggtgatgatacaagaaaaccaatgtggccaaggcagctcttcggttgctgagctagctgatcaacgtaccctgactgattttatttcattgtgctggatttttttatatagactactactatctagacatgcatttctgattgtattgttgttgaattatcctgttatgtcgcatcccatgggcagatccagtctaggatatgtacacctgataacttagttaaaaaaaagaaaagaaaaccgaaggtagtgtgtgtatagatcgtactgtagtatgcatgtaaccggatcagatccgttttcaggtagattgctctaggttgggttatttattgcattaattgcacaagctagatgccatgtgtactattgtcgaaaaggggttgcaggtcaaccttgcgtagatgttaaatgcagtctcaaatattttatccgaaaaaaaaaaaaaaaa

SEQ ID NO: 1879 - DNA, 1095 bp, Zea mays
gaccatccctaaacgaagccctgccccgttctgaattgtgatcgagacgagacccttcgaccttcgcaacgcctccccagcaacctctgctccgccgcctccggcgaccgccggagcccgtggtggaggaggacgtggagagggaagatctcgccagatccaaggaggtggggacgagatggtgagctcctcgtcgtcggtggttaacgtgtacccgctcgccaactacacgttcggcaccaaggagcccaagatggagaaggacacctccgtcgccgaccgcctcgcccgcatgaaggtcaactacatgaaagaaggaatgcgtacaagtgttgaagcaatcctattggtgcaagagcacaaccaccctcacatactgctcctgcaaatcggaaatacattctgcaaacttcctggtggacggttgaagcctggagaaaatgaaatcgaaggtttgaaaagaaagctgtgcagcaaacttgctgtgaactcgccttccttcccacctaactggcaggttggagagtgtgttgctgtgtggtggaggccgaattttgagactgtgatgtatccttactgccctccacatatcaccaagcccaaggagtgcaagaaacttttcatcgttcacctatccgaaagagagtattttgctgttccaaggaatttgaagctgcttgctgttccgctctttgaactctacgataatattcagcgatatgggcctgtcatctccaccatcccgcagcagctttctaggttccagttcaacatggtgagctcttagaaggtgtccagcagtttactcatatagtcatccaaaacattgtttttgtactatagactgcactgttcgcagagtggagtttaaatatagctatgtggatgagtaagctgctgagatagacgtagggtgatgacacaagaagatagtgtggccaagacagctgttttgttgacttccgttgagatggatcttcaacatgctgagctagctgatcaacgtgccttgactggttttatttctttgtgctggattttttctatctagacatgtattcccaattatatttttggatgaagcggcccgtttcg

SEQ ID NO: 1880 - DNA, 1607 bp, Zea mays
cgcggaccctactcttctgcttgttccgtgagatccgcggtcgcgctctacaacggcatgatccggggttgcgcttaccatggggccgcacgagcgcgcgctggagctgctcgccgaaatgccgcgccgccgccgtggccgttttgtttttccccataagaaatagaatatccaatggggttgtcaagtgctacctgatttgaaaatggttttccctctattcagatctcaccagaagaagcactacctggttattggaatccaaaattttttatgtactgttttgatcagtgaaattcacacttcgctagtccaacaagctgacaggaacgggttctagacggatcggacggcacacgataacagctgccggtgtcccggaccatcctgtccatccctctataaacggagccctgtccagttgtgatcgagacccctcgcaaccgccggccgattcgagcagcgccccagcagcctctgctccgctgcctctggcgaccgccggagcccgaggaggaggaggagggaagatctcgctcgatccaaggaggtgagtacaagatggtgagctcctcgtcgccggtggtcaacgtgtacccgctcgccaactacacgttcggcaccaaggagcccaagatggagaaggacacctccgtcgccgaccgcctcgcccgtatgaaggtcaactacatgaaagaaggaatgcgtacaagtgttgaagcaatcctattggtgcaagagcacaaccatcctcacatactgctcctgcaaatcggtaatacattctgcaaacttcctggtggacggttgaagcctggagaaaatgaaatcgagggtttgaaaagaaagttatgcagcaaacttgctgtgaactcgccttcctttccacctaactggcaggttggagagtgcgttgctgtgtggtggaggccgaactttgagactgtgatgtatccttactgtcctccacatatcactaagcccaaggagtgcaagaaacttttcattgttcacctatccgaaagagagtattttgctgttccaaggaatctgaaactgcttgctgttccactgtttgaactctacgacaatgttcagaggtacgggcctgtcatctctaccatcccgcagcagctttctaggttccagttcaacatggttagctcttagggtgatgatacaagaaaaccaatgtggccaaggcagctcttcggttgctgagctagctgatcaacgtaccctgactgattttatttcattgtgctggatttttttatatagactactactatctagacatgcatttctgattgtattgttgttgaattaccctgttatgtcgcatcccatgggcagatccagtctaggatatgtccccctgataacttagttaaaaaaaagaaaagaaaccccaaggtagtgtgtgtatagatcgtcctgtagtatgcatgtaaccggatcagatccgttttcaggtagattgctctaggttgggttatttatcgcattaattgcccaagctaaatatatcccatgtgtcctattgtcgaaaaggggttgcaggtcacccctgcgtaaatgttaaatgcagtttcaacttttttttc

SEQ ID NO: 1881 - DNA, 1177 bp, Zea mays
  misc_feature (1075)..(1076): n is a, c, g, or t
cgggccggccggggcccggtctcccggtaccatcctggccggcccgggatccctaaacgaagccctgccccgttctgaattgtgatcgagacgagacccttccaccttcgcaacgcctccccactccccagcaaccactgctccgccgcctccggcgaccgccggagcccgtggtggaggaggacgtggagagggtagatctcgccagatccaaggaggtggggacgagatggtgagctcctcgtcgtcggtggttaacgtgtacccgctcgccaactacacgttcggcaccaaggagcccaagatggagaaggacacctccgtcgccgaccgcctcgcccgcatgaaggtcaactacatgaaagaaggaatgcgtacaagtgttgaagcaatcctattggtgcaagagcacaaccaccctcacatactgctcctgcaaatcggaaatacattctgcaaacttcctggtggacggttgaagcctggagaaaatgaaatcgaaggtttgaaaagaaagctgtgcagcaaacttgctgtgaactcgccttccttcccacctaactggcaggttggagagtgtgttgctgtgtggtggcgaccgaattttgagactgtgatgtatccttactgccctccacatatcaccaagcccaaggagtgcaagaaacttttcatcgttcacctatccgaaagagagtattttgctgttccaaggaatttgaagctgcttgctgttccgctctttgaactctacgataatattcagcgatatgggcctgtcatctccaccatcccgcagcagctttctaggttccagttcaacatggtgagctcttagaaggtgtccagcagtttactcatatagtcatccaaaacattgtttttgtactatagactgcactgttcgcagagtggagtttaaatatagctatgtggatgagtaagctgctgagatagacgtagggtgatgacacaagaagatagtgtggccaagacagctgttttgttgacttccgttgagatggatcttcaacatgctgagctagctgatcaacgtgcccttgaactggggttnnttcatttcctttgtgctggattttttttatctagacatgtatttcttattgtatttttgttgaattactgtgttacgtatcaaaaaaaaaaaaaaaaaaaa

SEQ ID NO: 1882 - DNA, 2095 bp, Zea mays
tgggaccctcgaggccggccgggccgggttgcccccggcaaatcggaaatacattctgctaacttcctggtggacggttgaagcctggagaaaatgaaatcgaaggtttgaaaagaaagctgtgcagcaaacttgctgtgaactcgccttccttcccacctaactggcaggttggagagtgtgttgctgtgtggtggaggccgaattttgagactgtgatgtatccttactgccctccacatatcaccaagcccaaggagtgcaagaaacttttcatcgttcacctatccgaaagagagtattttgctgttccaaggaatttgaagctgcttgctgttccgctctttgaactctacgataatattcagcgatatgggcctgtcatctccaccatcccgcagcagctttctaggttccagttcaacatggtgagctcttagaaggtgtccagcagtttactcatatagtcatccaaaacattgtttttgtactatagactgcactgttcgcagagtggagtttaaatataggtatgtggatgagtaagctgctgagatagacttagggtgatgacacaagaagatagtgtggccaagacagctgttttgttgacttccgttgagatggatcttcaacatgctgagctagctgatcaacgtgccttgactggtttcatttcattgtgctggattttttttatctagacatgtatttcttattgtatttttgttgaattactgtgttacgtatcatcccaggggcagatccactttaggtcacatgtacacctggtagcttttgttttttctttttccattttaaaaagcgaagttagtgtgtataaagcatatgcatgtaactggatcaaatcctcatgcaaatagcctgcctttgggagggtttgaggtactcggtttaggcgtttaggccctctccaactgattttccgtatacatcattctatggctatgtttagatactctcttattcaccttaatctatgtgtattgggggtgaatacgagagtacccaacttctgcactatgattgacatgtaggccctacttattatcttctactttcatcctatccacgaggcattcccctagtgttttaatgaggtgtttggtttgatgaatcactctatccaaaatgaagtgatgcatcatagatctattcctaaaatttgatgggatgactccatttcacgtattaatgctaaacaattaactatgaggaatgaggtggtgacggattaactcactctattacacaaaccaaacaaaaaattgagaaatgaacactaggcaagcagctactcccatgaggttcgtgctcaagatcccgctcacctgaagggacacggatcacatcgatcgcttcatgtgtaagtctctctgtctggggttcgtctccctgatcgaagctgctgcagcctcctcttactccgggccccaacgcctttacatatacataggttcccacatgcgcaggagcgtctctctatatatcagaaccgaagtatatatggtatggtacagtacaacgctgcctgcactgcacatgttgttcatggaacaaaacctaaacatttttatatatgtccgtttattaattacatgcttggcgtacgctgtgctccaggcccacgagaggcatctcggtgtttgccagcctgaggctcataagcatgttgttgcctgccacgacttattctagtccactcaatacaactatacagtacacacattgatcttgtagttgcgcacttgcgcatgcacattctttagtgtacaataaattgtaatcaaatacaaaaggctatgcctggcaccaactatacatcgtactcggtacggtacgggtcttggcgtcgaggtgagacacgaccccacgtacatagtggactgacacatgaacctaaacactcactccgtcacatcacttggcgtctaggggcacagtactagacgcccccgtaccgtttacggtcgactagaggttgctccttccaacacagaagttatatatcaatttatgtacagtatatatagagttatttattttaaatttatcaatagtatttcaggacacg

SEQ ID NO: 1883 - DNA, 4248 bp, Zea mays
cttaaaaaatggctcatcgtcgagagccatcaaggagccagagccgttttgctattaggagcagaagcacaaaaaaataggcttctactggctccttctatcctacatataataatgttttaggaaattacaatccataccaccatctttctatgagaaactgttttactaaataaattttaaaaacggttctggctcttctagagaagaaaaaaaaaccagagtcagagctgttttgagaatagtcggagcctgacacagggaaccttaaaacaaagctaaaattgcatcagggtaaccatcgcctttaacatgttgagctcagagcaggggcgttgaaacgataacagcctcgtcagttggcagagagcgcaccatgcgtgaagccgggcatcgctattcttggccaaaaccagcagccgcgctccaaaatccccgacccccgctacggctggcccatgcgatgcgggtgcctctcatccctcgccaccgtcctcgccgcgcacgcgcgtgtgcgcgtgcgtgcgcggggagctcgtgaaacctctctcctcccccttctccgcctccctttctctctcttcgcgtcgacctcccgctctgcccctccctggaaaacagcgtgccgggccggccagcctttcccatccgcgcgcgcccgggaataggggccgcccgcaccatcgacgccggccaattcacccgccgtcgtcaagtgctggcgccggcgggctggctccctggcaccggcgccgccgccccggacatggccggagcgccgtcgtcgctagcgcgcctcctcctcctcctcctgctagctgccggatgcctcctcccgctggtcgctgacgccgcgcggctcacgctgtccctcgcgcccgccgccgacgcgctcctcaggctcaaggccggcattaaggacgacggcggcgcgctcggcagctggtcccccgacacgagcccctgcgccgacggcgggcccagctggaagggcgtcctgtgcaacaaggacggcgtgcacggcctgcagctcgaggggatgggcctctccggcacgctcgacctgcgcgccctcaccagcctgcccggccccggcctccgcacgctgagcttcatgaacaacgagttcgccggcccgttgcccaacgtcaaagagctcagcggcctccgcgctgtctttctgtccgagaacaagttctccggtgtcatccccgccgacgcgttcgccgggatgggctcgctcaagaaggtggtcctgtccaataacgacttcactggccccatcccggcgtcgctcgccgacgcgcccaggctcctggagctgcgcctcaacgacaacaagtttcagggcaagatcccggacctgaaacaggaggagttgacggaagtcaacctcgcaaacaatgagctcgagggggagatcccggcgagcctcaaatccatgacatcggacatgtttgccggttagcaacattttctacaacatcatgcatgcatgatgtttggtgcaagtgcaatgtccacttgcatccatatgacgttgttgttctacaataatgcatgcgtgcaggcaacaagaagctttgcggcccgccgctcggtgccaaatgcgaggcccccccgacgccgtcaccaaaggcgcatccgcaggcctccgtcaaagaaggcaccacgccgtcacaagcagcagcagacaccgtggcatccacgggcgcgtcgtcagcagacgacccgaagcaagacgaaggccaggagcccgtcgagggctccatttcgttcggcgtctccgccgcgttgcttggcacgcttttgatcgccggcgtggcgttcatcgcgctgcggaggcggagggggtacaaaaccaagaacttcggcccgaccgcgtcgtcgtctcgcccctcggggccgccaagggtcgagccgcacccgccggcggcaaaggcgcccgccgccgccgggggcgtggcgcacggcggcggcgcggcgcggaaggcggagcaggggcgactgacgttcgtgcgcgacgaccgcggccggttcttcgagctgcaggacctgctcaaggcgacggcggaggtgcttggcgccgccaacctcggcgtgtgctaccgcgccacgctcacgacgggccagtccgtcgtcgtgaagcggttcaaggagatgaaccgggtgggcagggaggacttcgaggagcacatgcggcggctgggccgtctcagccaccccaacctcctcccgctcgtcgcctactactaccgcaaggaggagaagctgctcatccacgactacgtccccaaccggagcttggcgaacctcctccatggtgagtacactgttcagtgttcacctcgagctcgtcgtcgtcaccgatcatccctctaacctttggctggcggatgcatgcttggtgttggcgcgttcgttcgttcgcacaggcggcggcgagagcggcgggatgaagaaggcggcggtgcactgggcagcgcggctgaagatcgtgaagggcgtggcgcgggcgctcagctacctgtacgacgagctgtgcatgctcacggtgccgcacggccacctcaagtcgtccaacatcctgctcgacgcccaccacgggccgctgctgacggactacgcgctggtgccggtgatgaaccagtcgcacgccgcgcagctcatggtggccttcaagtccccggagcggaagcagttcggccgctcgtccaagaagagcgacgtctggtgcctcggcctgctcatcctcgagatactcactggaaggccgccgacctacgacccgcccaaggcggcggcgccctcaggcgagctgtcgtcgtcccagcagaagccggggccggcggcgggcaacaccgacctggtgaccgtcgtggggtcgacgccggagggcgagtggctgaacaccgtggtggaccgggacctgcggggcgaggaggaggaggacaaggaggagatggtgaagctgatcagggtcggcatggcgtgctgcgagagcaacgtggacaaccggtgggagctcaagaccgccatcgagaggatcgaggagctcaaggcgaaggagcgccccgacgaggagcaagcgacggtgatcgacgaggactacagcgatgttgccctcaactgatcatcgacacgaaccggccgggaatcgatcgatagggagggttgtgcgcaagctgatgatatgagcccaaaatgtgatgacctgcatgcatgccgagaccctaaacatggactagtactgtgtattcttatatacctttgctggttgttaattgccggtggtaggtttttggagagaaaagaagctacttatatataatcacacagatcttagtttgcttttctcagtgaacagaaatctattacaaagcatctggtggacaactggtgctgcaacctccccttgctacctcttagatctaatctggtactccatccattcaaaaatagtactctctctattcttttttatttatcgtcgtttagtttaaaaataaactagcgggcgataaatattcaagaacgaaaataatattcgttttatctcttagtttgtatgtttatatataaatggacgataataaatctaaacacatcaagtattaaattatagtactttaaaataattttaattgatacggagggagtatgaaataacaccttcagttcagatcgctcatatattagctatcatatctgcttgttccttcttcgttgttttctcattgactcattgtaacctctcatggggcggaccccagcccttcttggctattatcaccaggtggggccgtgggggagattctcccctgttgacaatcggaaaaagttacaaagccattaattgtgtgaatggacgatcaactattctaatttgtgccaattatcaagagtagggccacacaaaaaggttcgttctttgaaaatttcatcctcttattgtttttcagttttcacacatataaaccactattaaaatccgtcctttcaaaaattaaaaaaaaacgatcaaaaatcacatcgaaactagtagagaggtggtagataaatctgtcagcttggacagacgggtaactactactttttttaaagcaacgcagttgactttatttatttgtgatagtttacattgttgatcagaaaaatcttgctcaaaggaatggcagctcgctcatcacatggtcagctcgctcatcacatgattttttttgggaaaaaaattgctgcaggcctgca

SEQ ID NO: 1884 - DNA, 2044 bp, Zea mays
cccacgcgtccgcccacgcgtccgcccacgcgtccgcccacgcgtccgcccatcgcgtccggtcccgtccgtccgtgcgtccgtccgaccatccgtccgtccgcagcaatggtcggcggcatgtcaccgccgcggcggacgctgtcgatggggagcggcggcgccatgggacgccgcgcggcctctgccggcgtgatgggcgacagccccaagcgcgggctgtcccgatcgatgaccatgggcggcgagcgcacggtgaagcggctgcggctgtcccgggcgctgacggtccccgagagcaccaccgtgctggaggtgtgccgccggatggccgcgcggagggccgacgccgcgctgctcacggactcgaacgcgctgctctgcggcatcctcaccgacaaggacatcgctacgagggtgatcgcgcgcgagctcaagatcgacgagacgccggtgtggaaggtgatgacgaggcaccccatcttcgtcctctcggatacgctcgccgtcgaggcgctgcagaagatggttcaaggcaagttcaggcacctgccggtggtggataacggcgaggtggtggccatgctggacatcgccaagtgcctctacgacgccatctcccggatggagagggcgtccgagaaggggaaggcggcgatcgccaacgtcgcggctggcgacgacaagtactccatcgtcgaagctctcaaggagcaaatgttcaggccctgcttgtctgccattattggcgaagactcaacagtcgtcatggtgtcgcctggtgattccgtccttgcagctaccaagaggatggtggaagcgcatgcgacctcagccgtagtggccgtggggagcaagccgcaaggcatcctgacttcaagggatatcttgatgcgcctggtcgctaagaacctgtcagcggacgcgactccggtagagaaggtcatgacccctgaccctgaatttgccacggtcgacatgcctatactggacgccctacggaccatgcaggagcgcaagttcttgcatcttccagtgatggacagagacggctcaatcatttcaatcatcgacgtcattgacatcgcacatgccgcgatctccattgtggagagcagtggcggcggcggcgacggcagcgcggggagcgacgaggcggcatcgtccatgttccagaggttctgggactccgccatggccttgggccccctggacgacgagacggacacccagtcccagatgagcgaggcgtcgaggtcgcagatgatgatgtccgatgtccaccaccaccaccaccaccacgactccgcgggcggcggcagcgaggcggggttctcgctgtcgtccttctccttcaagctccaggacaggcgagggcggatgcaccgcttcagctgtgaggttcagagcttgacgcctctggtgacctgcatcctgcggaggctcggcgccgacatcgaccctgaccgcctaccgcaaatcctgtacgaagacgaggaccgggacaaggtggtgctcgcgtcggacgacgacctcgcggcggcggtggaacacgccaggctcgccggatggaagggtctgaagctgttcctggactactccggcaccaccgggcgcaggaaagcggtggccaccccacgtggcgccatggcggtgggcatgtccagccgggacgcgtgggcggcggcgtacagcggggtcgccgccggggctgccctcgtcactggcatcggcgtcatggcgtacctgcgaagatctgcctagctagtgtggtggcgcggcggcgcggcgcgcatattcgccaatgcaagagcaaggggttcctgtcctgccttcgaatcaccacagaggtgctagtatgtgtggattacgtacccaaccggtgtatgtgtgtattcttttctacacgaacatgtaccagggcacaagttttccattaagaagaaatgggtggaccaaacaaatccttcagaccgaagcgagctaggtcgaggaaacccggcgttcggcattgatagcgattatataccgatattgtttgatt

SEQ ID NO: 1885 - DNA, 1669 bp, Zea mays
gcacgaggggagacgacgtgaaaggagaccaagggccacgagatggctctgcgcggcaacctgcccgtgctgctccttttgttcgccgcggcggccaccgcgagcggtaagtcggcgaggctcgaccttttcccagcagcaccgggagcatcggtaaccgcgcgggcgaggggcgaccggcgccggcacgcgtacatctccgcccagctcccgtcgcgccggggcggaaggcagagggttgccgcggaagtggcgtcgtcgtccgcggtctccttgcctatgtcgtcgggggcctacgcaggcacagggcagtactttgtgaaggtcctcgtgggaacgcccgcgcaggagttcacgctggtagcggacaccggcagcgagctcacctgggtcaaatgcgccggtggcgcctccccgccgggtctcgtgttccggccagaggcctccaagtcgtgggcgcccgtcccgtgctcgtccgacacgtgcaagttggacgtgcccttctccctcgccaactgctcctcgtcggccagcccatgctcctacgattaccggtaacaccattacattacgcgccgttgtccatgcatgcatcattttttcttcctggcaatgtcactcaccaccaactgtgtgcatgcatggcaggtacaaggaaggatcggctggggcgctcggcgtcgtgggcaccgactcggcgaccatcgcgctgcccggcggcaaggtggcgcagctgcaagacgtggtcctgggttgctcctccacgcatgatggccagagcttcaagtcagtagacggcgtgctgagcctgggcaacgccaagatctcgttcgcgtcccgcgccgccgcgcgcttcggtggtagcttctcctactgcctcgtcgaccacctcgccccgcgcaacgccaccgggtacctcgccttcggcccagggcaggtgccccggaccccggcgacgcagacgaagctgttcctggaccccgcgatgcccttctacggcgtgaaggtcgacgccgtccacgtggccggccaggccctcgacatccccgccgaggtgtgggaccccaagagcggcggcgtgatcctcgactccggcacgaccctcacggtcctcgccaccccggcgtacaaggccgtggtcgccgcgctgaccaagctcctggccggggtccccaaagtggacttccccccgttcgagcactgctacaactggacggcaccgcgaccgggagcgccggagatcccaaagctggcggtgcagttcaccgggtgcgcgcggctggagccaccggcgaagagctacgtgatcgacgtgaaacctggcgtgaagtgcatcggcttgcaggagggcgagtggcccggcgtgtcggtcatcggcaacatcatgcagcaagagcacctctgggaattcgacctcaagaacatggaggtcaggttcatgccgtcgacctgcacccggtgatcgtaaagctgacctcgatggttttgttgatcagagcatttgaagggaaatgttttttctgaacataaaaaaatagaaaacgaaaatgatgctctgcataaatcaactttctgcacgagatacatattgatatcgggcccgatttgctatccttgcatcgaacctagtacagtacgcgcttaccgcaatgtatcggtgtcactcatc

SEQ ID NO: 1886 - DNA, 6002 bp, Zea mays
gcaggcattttctttctcatcttgctgaccaacaggccccagtcgcttgaggttttccctagcccgctcgctgaccgatgggtctcagggaccgagatcttatccccgacaatatatccacattcgttatcatgtatttgaatgttggaggaaaaaaggctaaaaataactatatcttggaatggagagagtaataattataattttttaacaaggcgagccaatccaatttagagtaaaaaaaccaactgaaatagaaaccgaaacggagggagtatactatgggtgtttgggacaactccagctctagaaaatttgatggaattggtagagcaggtcattagttgctttagaaaatcatggagttgtgaacctttagaagacatttaggatgcgtttggttgtaatgacagaacgagataatataaaatgatctcttaaatgatgttgtttggttcagggtgagagattggaacaaaactatcccagttttgtctctagttgtccctcaaaattggaaagacagaagatgacgtcatggaacgtctctgtcttgccggtccttagcagtcgcacaaccaaacacatccttagataagccattttatttattatttaaagtaaaaatatttttaaacctaattaaattgatactttacattagagctggaacctagagtcatcccaaataacccctataataacataaaatgctacgcttaagttttcacggaacatgaatgtaggttaaaagcagaaataaaaacaatagcagtagtgcgtgtgtccattccgagccggggcccgagctcggcccaaagggccaaaatcgagtggcagccagcagaggaggaaccgaggccttccagacgttttcctccagaccaggtcgaatcgcgcggctgcgggtccggacggcgcactcctcccgttttcccgtccccgcatccggacttccggagaagccaagaagcgcaaacaagcgggataaaaatcccggtcccggtcgccagccgactccaccgcacacgtgcccgggcagcccggccccgccacccgcacgccacgtaacccccgtccccctcctcgagcctcccgtcgcgtgtcctgcgttgcgcttgctatttatcacccccgtcctcctccgtcccaaggcagtcgcagttcacaactgcgactaaaaaccatctttggggcccttcgccgcgatttgcttcgcttctcggactaggtaagccgaaagttagcgtcttttttttctgtactgcataaatggaagttcagatcgcttggtttcgattcgggattcctgagcgcgctgtcctgctcctggtaccgacatcgccttctgaggctatagattctttttgtggttcttagggtttccccgttgaatctcggggccttttcacccgtagtatcgtcgtcttttctgtggctgtctgtgcgcgaaagctgctgcagctcccgggtgatctggagttattttctcggatattccttccaacccgatacttgcagtgggtgtgggtcccttcaatgagtagatgcatactacccgcgccggatttttcaccattcatcccatccccagagatttgggatttatcgatgccatggaggatttacttcaccatgcctctcgattcatcggaacgttggtttgcagtttgctatgtgctggtttgttaagctttgcgttgtaaagcacgcctccgatgtttttgccggaaattccgatgctttaccaaaaaagaaatgttcggcacctagtataggtcgtgctgcttttatacttgccgcttcttccgcattttactagatgcgtttcatacttcttcgaagtagtttggctgttacaaatccatccaaagaagaaaaagattgccgactgcgacgaaacacacactctgtgtgcgtttcgtttgggtacttttggtatttctctcctgatgatctaaagaagtagttgtttatattcttgatcttgtccttaacctgtagtgctgttaacttgcatctgcgtgtttgcgctgtgcctttttggtttgtgctgtagataggcgttaattgccaccttaacaatgaaatgatgtattgatgttcacgttcccattgcctcgatttcagagttgggaattttactatgatctcctgtgcgtattgctgattgtataaatgtttctatgacaagttcagttctaattactagacagacttttacagctgtacaaagacattatttgtaaatgattctatgagacttacaagtcagtgtatgtctattcattcgtattctaatgattgcaggttaagttgccttttcgattctcagaaaaagactggctctgcactcggataattttaaaatggatagtgcacagcagcccactggggaattgaacaattcgttcgatactcttatggtttctggaggtgaccagagtcgacagcctcaggatgctggcaatgaaacgagcttcacgaattggaaagacctccccatggagctgctcctgcgtatcatttcactagttggagatgacaggatagtcattgtggcctccggtgtatgcacaggatggcgtgacaccttggggtggggggttgcaaatctttcactatcatggtaagaattgtctttcaggcatgtccattccagtttaacatatgttatcttcagaagatgagtttatcaaatatcaagattttataaccgattagtttccatgctttagatttggatacaatagtacattagttattcagctatcctcggtttcttagatgtttaacctgatgtgttcataatgctggttgcagcagtgctattcagtcactaattctgtaatccgtatccatcatgataacctgtttggttggatctcttttcaagagctcattttctttgctgctgttgtttggcaaatgtttctgttgctgttcaatcatatgatgtagacagtcaaccatacgatattcttgctaataaattataaatgtaactgaaaacatggaaatttcatgtgctgatttctcggctgtgcagttgactagattaagtaaaaaaaaggaagccataaatgattgtacctgggctgtatggcaaccgaaatactgtgcaataacacgtgtggatcatacatactaacatagcaaactcctagcactaactttagtatgttattccataccttctgatacacagtagttgtgtatccacttgatcttccgaaagaactggtgtgaatttttttgatataacaaagtcatccggccccagagtgatatgtcttcctataacattcccagtttgttattacattctcagcttgcttcatgtttctgctatagttccttgctgtgctatgcaaataaaacagtatattttgtttacttcagttcctatactagatgaccacatggtctttttgaatgaccttttggaaagggaagtattttttgaccaagaaagtgtcaaattcaggtgccaggaccgcatgaatgacttggtgatatcactggctcacaaattcacgaagctgcaagttctatctctacgccagatcaggcctcagctagaagacagcggcgtggaggccgtggcaaaccactgccacgacctgcgcgagctggatctcagcagaagcttcaggctgagcgaccggtccttgtacgccctggcgcacgggtgccctcagcttaccaggctcaacatcagcgggtgctccagtttcagcgacgtggcgctcgtgttcctctccagccagtgcgggaacctgagatgcctgaacctgtgcgggtgtgtgagggcggcctctgacagagcgctacaggtactttcgtttgctgcagccttggtcgcttgagctcgcgttgatccctgctgttttggtggtgtgtcctgtcctgtgtaggccatcgcctgttactgtggccagctgcagtcgttgaacctgggctggtgtgatcgcatcactgacaagggggtgaccagcctggcttcgggatgccctgaactcagggccgtcgacctgtgcggctgtgttcttataacaggtgagttgctttcacgtgtgttgggggtcaaattctactagtacagaactacgctggaacttacctgacctgaccgctattttggctggcccaacgcctgttcgatcttcctgccgcagatgagagcgtggttgcgctggcgaacggctgccttcacctgcgctccctgggtctctactactgccagaacatcacggaccgcgccatgtactccctggccgccaacagccgcgtgaggagtcggggccggggctgggacgcgacagcgaagagcggcggcggtggcaaggaccgggagcgggacggactggcgagcctgaacatcagccagtgcacggcgctgaccccgcccgcggtgcaggcggtgtgcgactcgttcccggcgctgcacacgtgcccggagcggcactcgctcaacatcagcgggtgcctcagcctaacctccgtgcactgcgcctgtgcgctgcaccctcaccgggccgggcgagtcatcctctccaaccacgcctactgaacgcaatgcgtgaataggcggcgatgctcagatgtgtggataggccgttcaaccgtgagcgacggtgtccgctgtttatgtgaggtgcttgttttgtgtttaggcgtcaaggcgtgtacttggggtctctactctctagggaaccgtgtagaagcaaccgagttgagttcatcgtctgtaaaaacatggactgtatctgactatctgttgtcatgtcttttgagatctttaaaaaaaaaaaaaaaacgcggcccggcctctggagcagcgcggcgacggcgatagccactcctttggtgggggctctcagactatctccaaaccctatcatactcttatttctatcctgttcgtttagtttaatccatatcggtttctactatagaggaacaaacagtcaaacgaacgagaacaaacagtctgtaaaagcagtctaaacagtcagctttagaaacgaacagtgttacagtttatttatagtgtaaaacagcctgcatgcatttgctggagttggcctcactgtttttttttattttacctacttttcaaattttctgttttttattttagctcctttatcgatttttttacgattttttattttagctccttttcgattttttttaagtttatgccctgttaagccctggacgatttaattcctagtagcatcgggacttgtcgcgtgatgaatctgtattttcggattgaagggtcatgccatggcgacactgctttgtgtataaaattatgcattagtgaactagaagatattatgtactctcctgcagcaaacaattatgaatcagaagcaatatagatccacgccagaatatcatgatattcagtaaatcaagtcgtaaagcgaacttgctgagaatatatttgacatcatacgatgcctagctagtattgcagaagaataatacacttcggattatccaatagagtcatcatgtaattacatcaattttctgtacaacagtttgagaatcgtacaaagctcctgtataagtgtggatctggatcaatactaaacaggtatcttcttcggaaccagtccaagtatacctgtatacccaatagaatccgagtattttggttatcacaataaccaatatacaggtgtcctcttcagaaataatccattcatatactcataaatctgaaaattttggctatcacaatatgccaagtataagctcaatcattcattagggtaagctgtgtcgtgagttcaacaaagtataattagtatttggttgtattttgacccgtttagtggactccataagtttgacaagcgatggaagaggtctaggaacagggatattccttgacctgtaaaacctcttcaaacttgcattccaacatttcgatgatccaatatagcacaaaggttccttttgacaatcagttctttctgcac

SEQ ID NO: 1887 - DNA, 1730 bp, Zea mays
  misc_feature (1729)..(1730): n is a, c, g, or t
cattgggtacctcgaggccggccgggaagaagcgcaaacaagcgggataaaagccctggggcccctcgcgcgccgcctgcacccgacacgtgcccggccccgccacccgcacgccatgtaacccccgtccccctcctcgagcctcccgtcgcgtgtcctgcgttgcgcttgctatttatcacccccgtcctcctccgtcccaaggcagtcgcagttcacaactgcgactaaaaaccatctttggggcccttcgccgcgatttgcttcgcttctcggactaggttaagttgccttttcgattctcagaaaaagactggctctgcactcggataattttaaaatggatagtgcacagcagcccactggggaattgaacaattcgttcgatactcttatggtttctggaggtgaccagagtcgacagcctcaggatgctggcaatgaaacgagcttcacgaattggaaagacctccccatggagctgctcctgcgtatcatttcactagttggagatgacaggatagtcattgtggcctccggtgtatgcacaggatggcgtgacaccttggggtggggggttgcaaatctttcactatcatggtgccaggaccgcatgaatgacttggtgatatcactggctcacaagttcacgaagctgcaagttctatctctacgccagatcaggcctcagctagaggacagcggcgtggaggccgtggcaaaccactgccacgacctgcgcgagctggatctcagcagaagcttcaggctgagcgaccggtccttgtacgccctggcgcacgggtgccctcagcttaccaggctcaacatcagcgggtgctccagtttcagcgacgtggcgctcgtgttcctctccagccagtgcgggaacctgagatgcctgaacctgtgcgggtgtgtgagggcggcctctgacagagcgctacaggccatcgcctgttactgtggccagctgcagtcgttgaacctgggctggtgtgatggcatcactgacaagggggtgaccagcctggcttcgggatgccctgaactcagggccgtcgacctgtgcggctgtgttcttataacagatgagagcgtggttgcgctggcgaacggctgccttcacctgcgctccctgggtctctactactgccagaacatcacggaccgcgccatgtactccctggccgccaacagccgcgtgaggagtcggggccggggctgggacgcgacagcgaagagcggcggcggtggcaaggaccgggagcgggacggactggcgagcctgaacatcagccagtgcacggcgctgaccccgcccgcggtgcaggcggtgtgcgactcgttcccggcgctgcacacgtgcccggagcggcactcgctcaacatcagcgggtgcctcagcctaacctccgtgcactgcgcctgtgcgctgcaccctcaccgggccgggcgagtcatcctctccaaccacgcctactgaacgcaatgcgtgaataggcggcgatgctcagatgtgtggataggccgttcaaccgtgagcgacggtgtccgctgtttatgtgaggtgcttgttttgtgtttaggcgtcaaggcgtgtacttggggtctctactctctagggaaccgtgtagaagcaaccgagttgagttcatcgtctgtaaaaacatggactgtatctgactatctgttgtcatgtcttttgagatctttaaaaaaaaaaaann

SEQ ID NO: 1888 - DNA, 2274 bp, Zea mays
  misc_feature (355)..(355): n is a, c, g, or t
tctttgttccaatccaaaaacagcgccaagaattggaggtgctctttttattttgaaaaattgtgaaaatgggtttgtttgtgctaaaacaagctatcagggccactggcgtagaaaggggaggggggctagtagggccggcctggcgatggcctcaatggtttgtacaaacatataaatgtaggctaattatattaatactagtttttaagtagttaaggatataaaataacgattgattcaataaacattggttattttttgtttgtgcgttagataaaaccatgtagtctattaagttaaattatattgaactatatataatttattaaatattgtttatggtcttctctanaaaaaaaatcatatctacctctgatcaatgcatgtacaactctaaagcttttgtatcagttttcaaagagacggttgagactgcatccattcatataacggagtgcctataagttataaatgtaatacaacagcacacaataagttttacgtcagaaaggtcatgtaaaatacgacttctgtgcgaagacagtctcgtgattttttttaaaaaaaaaaattacctcgaaaacctctctcaaaaccagtattaataaatgggtcgtcaaattggaagtttggtgaaacaaagtagccaaagaaattgtattgacttgacccattcaaccacccacgcgctcctcatgattatttattttatttattcaaagcaaagtctcctgcttccttccgtcttgctcctcgacccttcttccttccccaccaccgcgttccaatcaatcccaatcgcgacccagccagaggcgagcgcgagaaaatccccattccccaatccccacgccacagcctcccttccctccccgtctcctccaaattcaatcgtctccaagcgccaatccgccccgtctccaaatcccaggcaggcaggcagccaaccagccatggagtgcgagccggaggagctgcagttcctgggcgtcgtcggcatctaccgcttctccgcggagatcctccgaggcccgcaccgcccgctcttcgcgcgcatcgcggccgccttcgcgctgcccctctccgcgctgttcctcctgcacgtcgccatctcgcacgcgctcttcacccacatcgactccgacgacacggccctggacgcatcctccccgggcaccgacacgcagcgccgcctgctgtcccgcctcgcctccgactggctcgccctgctcctcttcaagtccgcctacctcctcgcgctcctcctgctctcgctcctctccgtcgccgcctccgtgttctccgtcgcctccgtctactccgccaagcgcgacgcgctcaccttcccgcgcgtgctctccgtcgtgccccgcgtctggcggaggctcgccgccacgttcctcgccgccttcgcgctcctcttcgcctaccacgccgtcgccgtgctcgtcttcgtcggcctcctcgtcgccgcggacaacggctccggcctcgcgggcctgctcgccttcctcgtcgccgtcgcctacctgctcggcctcgtctacctcggcgtcgtctggcacctcgccagcgtcgtctccgtgctcgaggaccacaagggcttcgccgccatgcgcaagagcaaggacctcatcagggggaagctcgtcaccgcgggtgctatcttcttcacgctcaacgtcgtcttcgccgccgtcgagctcggcttccgcgcctgggtcgtcaggggatccggcgccgcgtcgtcaaggctcttgctcggcctcatcatgctcgccgcgctctgctgcgtcgtcatgctcgcgctcgtcacgcagaccgtcgtctacctcgtgtgcaagagctaccaccacgagagcctcgacaaggccaacatctccgaccacctcgaggtctacctcggcgactacgtcccgctaaaggcgtccgacgtgcagatggagcagttccaggtctgactgtgaatcccatagcttctctgtctttatcactgctcgccaatccatcctctgatgccggaattctcctgttaccaccggcagccaggtaatctgtaattgtgtacgtacagcaggcagcaggtgatgaacatacttgcgttaagtaggaagaattgggaatttttgtcttgggggtacaagaataatggggatctgtacttcccttagtctcttcctcaaggacatggttccttcccttgtttacatgatttataaacaggagatgaatggaattgggcatgccgaatttacaaaaaaaaaaaaaaaa

SEQ ID NO: 1889 - DNA, 742 bp, Zea mays
agccggccgggcggcaccgccatcggagtacgtacacacgtcctgctgtcccgcatgccaccggccgggggagaaaaccaacagccaagccaagcccacattgtttccgcagctaggtagaggggcaaaggaggagtatagcggagaggttgatgcgtgacggaggaggcgccatggacgtcgacatgcaagcccgcggtggcggtgctagccatggcggcgaacttgacgacgacggcaaggagaagaggacagggacggtgtggacggcgtcggcgcacatcatcacggcggtgatcgggtccggcgtgctgtcgctggcgtgggcgatggcccagctgggctgggtggccgggcctgtgatcctgctgctcttcgcggccatcacctactacacctcctgcctcctcaccgactgctaccgcttcggcgaccctgtcaccgggaagcgcaactacacctacactgaggccgtcgagtcctacctaggcggcaggtatgtctggttctgcggcttctgccagtacgccaacatgttcggcaccggcatcggctacaccatcacggcttctgccagcgctgcggctatcctcaagtccaactgcttccactggcacgggcacgacgccgactgcacccagaacacgggctcctacatcgtcggcttcggcgtggtgcaggtcatcttcagccagctctcaaacttccacgagctctggtggctctccgtgctcgcgaacgc

SEQ ID NO: 1890 - DNA, 1784 bp, Zea mays
ggggttcgcggagatccaggcggccacccagaacttcgacgagaaggccatcatcggcgtgggcgggttcggcaacgtgtgcccacgcgtccgcgacgacggcaccaaggtggcggtgaagcgcgggagcgcggagtcggagcagggcatcaacgagttcaacacggagatccagatgctgtcgaagctgcggcaccggcacctggtgtccctgatcggctactgcgacgagaaccaggagatgatcctggtgtacgagtacatgcacaacggcgtgttccgggaccacatctacggcagcgaggggaaggcgccgctgccgtggaagcagcggctggagatctgcatcggcgctgcccgggggctgcactacctgcacacgggcacggcgcaggggatcatccaccgcgacgtgaagaccaccaacatcctgctggacgacaacttcgtggccaaggtgtcggacttcgggctgtccaaggacgggcccgggatgaaccagctgcacgtgagcaccgccgtgaagggcagcttcgggtacctggacccggagtacttccggtgccagcagctgacggacaagtccgacgtgtactccttcggcgtggtgctgctggaggcgctgtgcgcgcggccccccatcgacccgcagctgccccgggagcaggtcagcctggcggagtggggcatgcagtggaagcgcaagggcctcatcgagaagatcatggaccccaagctcgccggcaccgtcaacccggagtcgctcgccaagttcgccgagaccgccgagaagtgcctcgccgagttcggcagcgaccgcatctccatgggcgacgtgctgtggaacctcgagtacgcgctgcagctgcaggacgccaacccgcccgagggcgcgcggcagggcggcgacggggacgaccaggacggcgccgcggcggcgggcggcggcggcgctgtcgtacccgcgggcggtgccgtgcccgacgcgtccaccgccgccgccggggagctcttccagcagctcgccgacatgcaggggaggtgaggtcgatcgccggtcgtacgtcaaaactctacacacactgcacactgtacgtggcatggcaatctgactgagctcgtctcgtgcacgtcgacacatcgatagatgcatgtgtactgcacccggtgaaaatttgaaacgatgaatattcactagaacacaaactgaacagagtggtgagtcctacgtacgtacgtgtaacaactagcaccggtcgatcgatacaatattcttcaacctgacacgtggggtctgcactaccggcgacggacgagggtgagctcgtcatattctcaaatttccaatatttaatatacgtgtgtgcgataatgtatttatttgtaatttcgcgattgtgtaatacttgggggatttgctatgtttcggtcgcctctaaaatacactatatttttagacaacgatctttatcgttaattagttcatgagcatgtaaagctaagattcattttaacgcaggaaaaaaaaacaagaacgaatggatacattgtctcttaaatgaaaatagaaagcgcccccgctattggaaaaggcgttttgtttagaaggtagtatattttgagtcaacgatcttcgcagctaatttatgagcatgtaaaaagatttattttgacgtgcaaagaaaaacaagcaaatgaaatggtggatacattgtctaaccattagaaaactgttatatttttaatgtcttgaagagaaggcagttcagggggatcctatagag

SEQ ID NO: 1891 - DNA, 2655 bp, Zea mays
  misc_feature (1701)..(1701): n is a, c, g, or t
  misc_feature (2267)..(2267): n is a, c, g, or t
cattggggcccgccgggccgccccggcccacattcgctcgctctacccgactaccccgcaagtcgaggccttccgctggctctcgctcgctcgctcgccccgcgactggttgcctctccgccccgaccctgccctgagaccggagacgaccgcgccccgcggtggcgctgcgacccgcgatacgatctgtgactgagaggggaggaattccagtcagtcgtttatgaatcctggggcctgtgcttactagagggagggcaaggcaagttaggatccgagatgagggggagaaatgactccgggaacagcaagccggttgtgctgtgctgtgtgatgatcgtgtgcctatgcctcctcttcttgtatttctcgggctccaatggacaggctgggagcaccgcatttgagtacgggaccaaattctcacggtcacttggatggggcagtgatgatggttctgaagagtccatttttggaaccggggatgcagatgatgtcaagcccaagagctttcttgtgtgtgatgaccggcactctgagctgatcccctgcttggatcggaacttgatatatcaaatgaggctgaagctggatttaaacctgatggagcactatgagaggcattgccctccacctgaaaggcgttttaattgcttgattcctccaccacatggctataaggtccctataaaatggccaaaaagtcgtgatgtagtatggaaagcaaacattccacacactcaccttgcaaaagagaagtcagaccagaactggatggttgaagctggtgaaaaaatcaagtttccaggtggtgggacccattttcaccatggagctgacaaatacatatcaaatattgcaaatatgctaaatttcaaagataacaatataaacaatgaggggatgcttcgtacagttcttgatgttggttgtggagttgctagtttcggaggataccttctttcttctaatgtgatagcaatgtctttggcaccaaatgacgtgcatcagaatcagattcagtttgcactcgaaagagggatccctgcatatcttggtgttttgggaacaaaaaggcttccgtacccaagtagatcatttgaactagcccattgttcacgttgtaggatcgattggcttcaaagagatgggattcttctgcttgaactagatagattgctcaggcctggaggttattttgcttactcctctcctgaagcatatgcacaggatgaggaggatctccgaatctggaaagaaatgagtgcccttgtagaaaggatgtgctggaaaatcgcagagaaaagaaaccaaactgttatttgggtgaaacctctggacaatgattgttacaagaggcgagcacatggtacaaagccacctctatgcaaaagtggcaatgatccagattcagtatggggagttccaatggaagcttgcattactccgtatcctgaacaaaagcactgagccggggcccacctagtcatttgatactaaggctgtaccgtacttttttttcgaacaatgcaggagccatacttgtgacattttgcttctctcatttgtcatacacgatttctgactttgggatacgaatataacactaaattagttcatttgttaattcgtggtcttatggttttttctgcttatgtcaaggtattgttccttttttgtagacaaacaattcttgaaatnactttttttttcaatatatagttttcgtttttgtcagtaatagctagccatatggtgtacattccctctgccccttttatttcactttctctaatcttggaatgcaagaatactgaataagtcattttatgttttcagaaatgcacagagatgggggaactgggctagctccctggcctgcccgattgacagccccgcctccccgtcttgctgatttgtacattactgctgacacatttgaaaaggacacggttagttgaccttacaatgtctatatgatcgtggcatgctgtttacattcagaactttcttatttgagtcttaagagctgcataaagattgctgatgtaattcttgctgtgcaggaaatgtggcagcaaagagtagaaaactattggagtttgctgggcccaaaggtaaaaccagacactattagaaacatcatggacatgaaggcaaactttgggtcatttgctgctgcactcaaggagaaagacgtatgggtgatgaatgttgtgccacatgatggaccaagcaccctcaagataatctatgatagagggctnataggcagcaatcacgactggtatgtgttaagaacctataagtttattcattggtattattgaattttgtacagctaagagatatcaacacggtaccattttgccatgccttatgcccttatgttttagtggtcattagaagtgcaaattgcaactttatattgatggtgaatgccatatctaaaaaaaccttgacccgcggaggtaagacagccctccggcattgtattaagaagaagaccttacgtgggtcgagaaaactatcaaaccttactccacccgtgggcagagacaccacagcccatgttacaacttacaagagcacagctgaatttttatgatgaaacactgttgagcctgttgtgcttgtcttttcttattagatgtg

SEQ ID NO: 1892 - DNA, 2642 bp, Zea mays
ggtaccctccggagttcggccggggcaagtcgaggccttccgctggctctcgctcgctcgctcgccccgcgactggttgcctctccgccccgaccctgccctgagaccggagacgaccgcgccccgcggtggcgctgcgacccgcgatacggaaattccccgtttaattgcatattggacatgtcttgtggcgtttgattggagaatttaattcttcccaacgatttccgttcttcggaggcttccatcttggtttcagttctgcaggctgtgtgtttgtgatctgtgactgagaggggaggaattccagtcagtcgtttatgaatcctggggcctgtgcttactagagggagggcaaggcaagttaggatccgagatgagggggagaaatgactccgggaacagcaagccggttgtgctgtgctgtgtgatgatcgtgtgcctatgcctcctcttcttgtatttctcgggctccaatggacaggctgggagcaccgcatttgagtacgggaccaaattctcacggtcacttggatggggcagtgatgatggttctgaagagtccatttttggaaccggggatgcagatgatgtcaagcctaagagctttcttgtgtgtgatgaccggcactctgagctgatcccctgcttggatcggaacttgatatatcaaatgaggctgaagctggatttaaacctgatggagcactatgagaggcattgccctccacctgaaaggcgttttaattgcttgattcctccaccacatggctataaggtccctataaaatggccaaaaagtcgtgatgtagtatggaaagcaaacattccacacactcaccttgcaaaagagaagtcagaccagaactggatggttgaagctggtgaaaaaatcaagtttccaggtggtgggacccattttcaccatggagctgacaaatacatatcaaatattgcaaatatgctaaatttcaaagataacaatataaacaatgaggggatgcttcgtacagttcttgatgttggttgtggagttgctagtttcggaggataccttctttcttctaatgtgatagcaatgtctttggcaccaaatgacgtgcatcagaatcagattcagtttgcactcgaaagaggaatccctgcatatcttggtgttttgggaacaaaaaggcttccatacccgagtagatcatttgaactagcccattgttcacgttgtaggatcgactggcttcaaagagatgggattcttctgctcgaactagacagattgctacggcctggaggttattttgcttactcctctcctgaagcatatgcacaggatgaggaggatctccgaatctggaaagaaatgagtgcccttgtagaaaggatgtgctggaaaattgcagagaaaagaaaccaaactgttatttgggtgaaacccctgaacaatgattgttacaagagacgagcacatggtacaacgccacctctatgcaaaagtggcgatgatccagattcagtatggggagtgccaatggaagcttgcattactccgtatcctgaacaaatgcacagagatgggggaagtgggctagctccctggcctgctcgattaacaaccccgcctccccgtcttgctgatttgtatgttactgctgacacatttgaaaaggacacggaaatgtggcagcaacgagtagaaaaatattggagtttgttgggcccaaaggtaaaaccagacactattagaaacatcatggacatgaaagcaaattttgggtcatttgctgctgcactcaaggaaaaagacgtatgggtgatgaatgttgtgccacatgatggaccaagcaccctcaagataatctatgatagagggctgataggcagcaatcatgactggtgtgaagccttctcgacctatcctcgaacatatgatcttctccacgcatgggcagtcttctccgacctcgataaaagaggctgcagtgctgaagacctgctcctcgaaatggaccgtatcctcaggcctaccgggtttgccatcgtgagggacaagggcactgtcatcgaattcatcaagaagtacctccacgcgctccactgggaagcagtagcggctgcagatgccgagcccagctcggaatcagaggagaacgagatgatcttggtgatccggaagaagttgtggctaccagaagcaggctcgcacacgtgattcccttcccggcgtctgcagctcagaagcgaggcgccagctgcaccagccatgatttatttctagccttaatgcacacatggagatagatttattatttacgaggatacggaaaatatgtggcaggcctggattaaaaaaaggctattttttctcattctcgacagatatgtgacttgatgtttgttctctagtttggttaggaaataaacattctttttcgtcttaatgttgaggctcatttaggtgtttgatgtccatcaatggaagtctgatgtagtctgtagctagtgtatttagtgtttccttgaaagaactcctgtacccggatacatggtttgcactaaagcctcaagcctgcgggtccctcagctcgagaccccctcatgcagatctcaacagggataaccctccaatataaacaggttccagcccc

SEQ ID NO: 1893 - DNA, 1430 bp, Zea mays
tcgaggccggccgggaagcagtcgccgcgtacaatccgatgtaaacgaacaaggcctaagacgtactgcagcggcagcgcaccacatctgaccctaccaccatggcatccgcggggacgacggcggtggtgcccgaggtggccctgcggtcgggcaacgcgaggacggcgatgccgatggtcggcatgggcacggcgtcgttccctctggtgcacgaggccgtcaaggacgccgtgctctccgccatcgaggtggggttccgccacttcgacactgcctccatgtacggcaccgagaagccgctgggcgacgccgtggccgaggcgctccggcgcgggaccctgcggtcccgggaggatctgttcgtgacgtccaagctgtggtgctcgcagaaccacccggacctcgtgctgccgtccctccgggaaacactcaagaacctgcagatggagtacgtggatctgtacctgatccactggccggtgtgcctgaaaccggggccgcccgagctcccgaccaggaaggagaacgccgtgccgctggacctcgcgggtgtgtggcgcgccatggaggagtgccagcggctgggcctcgccaaggcgatcggcgtgagcaacttcaccaccaggcacctcgacggggtcctggccgtcgccacggtcccgcccgcggtgaaccaggtggagctgaacccggcgtggcagcagcggacgctcagggcgtactgcgccgacaggggcatccacgtcgcggcctactcgccgctgggagggcagaactgggacgggcagggcagcgccgtgctggactccgaggtgctcgccgcgatagccaaggcgagggggaaaaccgtcgcgcaggtggcgttgcgatggatacatgagcagggagtgacatgcatcgtcaagagttacagcaaggagaggctgaggcagaaccttgggatattcgactgggagctgaccgacgaggagcggctcaagatcagccagatcccgcagaggaaggttgtccagactagtagcttgttctcgcaagagggtgagttcacggctgttgatccagcggaacttaatattttagaggaatagggggaaaatgacccgccacacatacactgcatcagtgttgctgcatacaaaagtgtatttcgtagaccatttgaataaggctgttggaaacggtgacatctagtgctgtttggtttcgttgccgggacggtaacatctacagttaatgctgcaatccattaacggaacggaggggaatggatagcgctcgtttatgagtggtttcattactgtataagactgtttcagcaacatttactaaatttcattctctaaaaaaaaaaaaaaaaatttccttttaaaaaaaaaaaaaaaaaaaaaaaaaaaaaaaaaaagaaaaaaaaaaaaaaaaaagcggcc

SEQ ID NO: 1894 - DNA, 1335 bp, Zea mays
acataccagcacgggctcaaggctctggctcgcgcacccctgtccctgttcgatccgcaccgcacacctagacgcacctccaactgcagcgcgccatacttgaccgcatcagcatggcatccacgggaacgacggcggcggcggcggcggtggcggtgccggaggtgaccctgcggtcgggcaacgggaagccgatgccgatggtgggcatgggcacggcgtcgttccccgtggtgcacgaggccgtcagggacgccgtgctggcggccatcgaggtggggttccgccacttcgacacggccttcctgtacggcaccgagaagccgctcggcgacgccgtggccgaggcgctgcggcgcggcctcctgcggtcccgggaggagctcttcgtcacgtccaagctgtggtgctcgcagacccacgcggacctcgtgctgccgtccctgcgggaaactctcgagaacctgcagatggagtacgtggacctgtacctgatccactggccggtgtccctcaggccggccggcgggccgcccaagttcccgaacaggaaggaggacgcggtgccgctggacgtggcgggcgtgtggcgcgccatggaggagtgccagcggctgggcctcgccagggcgatcggcgtcagcaacttcaccaccaggcacctggacaaggtcctggccatcgccgcggtcccgcccgcggtgaaccaggtggagctgaacccggcgtggcagcagcggacgctgcgggcgtactgcgtcgaccggggcgtccacgtcgccgcctactcgccgctgggagggcagaactgggacgggcggggcagcgccgtgctcgactcggaggtgctcgcggagatagccagggcgagggggaagaccgtggcacaggtggcgctgcgatggatacatgagcagggagtgacgtgcatcgtcaagagctacaacagggagaggctgaagcagaacctcgagatattcgactgggagctgaccgacgacgaccggctcaagatcaaccacatcccgcagaggaaggttgtcgaggccagcggcttgttctcgcaggagggtgagttcacctctgttgatcccgcggaactgaatactgtggaggaataggaactggactggaaaatggcccccgcctgtcggtgttgctccgtataggaaccgaataacaacgatcgccctcggtgtttcgagctatagttacagtatggttccgtaaactttgtatgaattttctgatctaaataaagtgggtttttataaagaactagcaaagtgcccatacggtgctatgatttccacgtatactttaagtatagattat

SEQ ID NO: 1895 - DNA, 4930 bp, Zea mays
tatttcatagtactctgagaccaacaactatcttaattctcacatgtctggttatccaaaattgcctcaggtcagcagctcaatcatttctaccaaaactggatagctgaaatgggttgtactaggggcgaagccaggggcaggcttttattgttgttatctaatgtattaagatgatggttagtgaatctgataccaataactttactgtctggcttcaccctgattcgaagtacgatatttcctacgtatagccgtgctcttttgcgtagggcccttgaacaggaaaatttagataccaagatttcaatctaaatttgatgtgaacaaaggacctgcgatgtgtttgcaggctgcagcggacacgagattttctttcaagccagcatgcgggcctacagatttgattgcgaaaggcgcggtccatcaaaccaaaccaagcccgctactagtctaacggtaatatataacgttgcgcaaatcaaagagacgaaatcaagcagcggaagacgccgcgtagcgccgtagcctagcgagggacagcgccaggactgctctgctctgcccctctgccgttgctgccggctgtgtcttcctcctcggccatcccggagaacacgcgttctctctctcctctgctacaactgccttgtccttaccctctccaccactgcacctcgtgtcacttccccaacctcttttgtccgttacatcacacacccaaagaagctgtccacgccgcaatgcagcggtcgcgcacacagcacgccgaacatcacccaggaggaacggcaacgcacacgccctttcgcacacaggagctggaggcgcccctggatccgggatccgacccggagtaccgggacttccagtttcggttcatcccggaggtgttcgagctccagatgggcggcggggtgaggaatggagacggcaaggtgacggcggagaaggttcttgggttcgagttcgacaaggtcaggatcagcattgcgtccagcgacgacgaggtggacggagaagcgccgccgaggagctccttctccggggcgagccacccgccggagccggtggacgagatagacaccgtctttgtcgctgtcgacggccgggagaagccggtccagaagccaatcatctcgtgggacgcgtccccgccgccgagcggcgcggcaagcccgcacagcagcatcgacagctccggcgccgccgccaccaccgtgacaatcacaagcctcgcgccgagctgcaccgtcaccagccggagcgccaagaccagcgtcagcagcagcgcggccagcgacggcagcggctggagcaacggcaccggcaccggcgccggcggcagcgccgggaagccgcacaagggcggcgaccccaggtggaaggccatcctcgcggcgcgcgcgcgcgacgggcccctcgcgatgggcagcttccggctgctgcggaggctcgggtgcggcgacatcgggacggtgtacctgtccgagctgagcggcggaggcgccggcaacggcggcgcggcgaggccctgctggttcgcgatgaaggtcatggacaaggcgtcgctggagagccggcggaagctgagtcgcgcgcagacggagcgggagatcctgcagctgctggaccacccgttcctgcccactctgtacgcgcacttcgagaccgaccgcttcgcctgccttgtcatggagttctgccccggcggcgacctccacgcgctccggcagcgacagcccggcaagcacttcccagagcacgccgcaaggtactcgtccgagtcctgtttgattctttgcttcatcagaccggtaatgtggttttggaactgcaaacagttgtattgtatgacgtgagtcaatcgtcattcccgtattgcactattgcggtgtaattttcgctttcagttgcaagcttgcggctgtgggttagcgttttttgcttattagttctctgaattttgaaacaaattgatcttcccatttgtttaagcatcgctcccaatcgcatacccatatactctaacaagactacaggagtacagaacagtatagagctccagatctgtcttgcagttcatgtcttgctagttattttttttaaaaaaaaaatgtcgtgctactcgtagactgctagttagagttgtttttttgttattattacttttaaaaggagtgctataagtgatgctatcgtctttgctttcctcactgtctctactagtcatgcttaacaaactgatgcctaaattagcatagacgcaatgtttaatgcatgtctcgtgctgcaggtcgtctctcctggattaggatagacacattgtttattactcctatatcgtttgcgcattttcatcattgcttcttgaactattctttgccggagtctgaaacttcgaataaacagaatggtcgccaattctggggtgtatgatctctctctttttttttcttttctgccaggttttacgccgccgaagctgctccttgcgccggtgcacctgcatatgcttggagtggtctacagagatctgaagccggagaacgtgctcgtgagagaagatggccacatcatgatctccgacttcgacctctcccttcgttgcgcggtgtcgccgacgctggtgagatcttccctgaactccgacgccaggaacgcgcaggctgcctgcatccagcccacatgcttcatgcccaagctcttcggccagaggagcaagaagagcagcggcgccaagaaatccaaatccaagggcggcgagcccaggcagcagcaggctcccacgggcctgccggagctcgtcgtggagccgacgggggcgcggtccatgtcgttcgtggggacgcacgagtacctggctccggagatcatcaagggcgagggccacggcagcgcggtggactggtggacgttcggcatcttcctgcacgagctcatgtacggcaagacgccgttcaaggggcagacgaaccgcgccacgctgttcaacgtcgtcggccagcagctcaggttcccggactgccccggcacgagcaacgcgagcagggacctgatcagaggcctgctggccaaggagccccagagccggctgggcgtgaagaggggcgccgcggagataaagcagcaccccttctttgagggcgtcaactgggcgcttatccgctgcagcactccccccggcgtgccccgggccgtcgagcccgtggcgttggcgccgcccgcgccagctaagccagcgccggtggaaagagcggagatcaacagcagcagcaatagcaagaggatggagatcaacagcagcagcaacagcaagaggatggagatcaacagcagcagcaagaggatggcaggaaccggttctgagtccggggggaagttcctagacttcgaattcttttagctagttttgagttaacgatacttgttgcagttcaagacgaattgtaggtgtagttccatactggagtgctagcgtttggcatgtctgaccggtcccaagtctgtgttggttgttgagacttgagagttgcggctcgtcccatgtcactagacactagtagttacttagtcaaagagtaagccatgaagtttgagtagtcgaaggaacgatttgtcatcatgtctgtttccattacaagttatatagccttatcagatttttttttactacatgatcagcaacgaaatacaccatgtagtttgcctaagcattctgtactgtaccaaaatgtgaatgtcccataatatgaagtggaacagaggaagatacagagttaccgaccacctcaataaacatacgctatacgttagtatacggtgcactacacgaccaggttttctgctgcgccgatgaggcccatgccggcggcggggctcctgtgccgcatgagcacgcgcagctgcgcccgctggcactcgaggttggacaccagatccacccgctcctcgcgcgggcgcgggcgcaggcgcaggcgcgcggccctggggaactccacgaaccccttgatccccctccggatgtgcgggttctcgccgccgccgccgggctctcgccggtgcggcttaccgtgctgcgggctctgttgcccgccgtgctggctcgccgacttgctgccgttggggctgctgcagcagctgctcttgttggcgtcggcagtggcctggagctgtgccacggcgtcgtcgatctcccgcagcttctcgtccagcgcggccctggcgtcggcgagcttcatctgcacccgctcctcgcgccacagctcggcgacgcgcagcatccgccgctcctcctcgacgccctccagggcgcgctccgcctccgcgcgcgcggcgccggcctcctcccgcagcgcccggcactcggcctccgcggcctcgctccgccgccgctcgtcggccagctccgcggccagcgcctcgctcagcgcctccgccttgcgccgcatgcgccgctcgaactccagctccgccctcaggtccctgatgcgtgccacgcagagctccagctccgacgacatggcgccgtacccgtacccttggtcgacctcctcgtcgtccagcgcaatgatcataggagggggctcgggactcctgcggacttggcaaggagagggcgagcagcaggatgaggagagatgggtgcccctcggccgcgtgggtgttctaggtaatggtctcggtgcccaaggtggagagccggcagcaccgtggccatgattggcctccacttgcaccgacgccatattttccgagctcgggatctagtattttatccgcccgtcctactctatactcgataacaagggttgggaaagtgatccatgcaaaccccaaggtctggtcaccagctcctccgagcttcgtctttgtgagctgtaaaagagtaggagatggtcacgtcttgctctccacatgcatatgatcc

SEQ ID NO: 1896 - DNA, 841 bp, Zea mays
catggcccccgccgcggccggccgggaagcagtcgcaccccctctctgtctctcgcatctagtctagacgttgtactgcagcggcagcgcaccacatctgaccctaccaacatggcatccgcggggacgacggcggtggtgcccgaggtggccctgcggtcgggcaacgcgaggacggcgatgccgatggtcggcatgggcacggcgtcgttccctctggtgcacgaggccgtcaaggacggcgtgctctccgccatcgaggtggggttccgccacttcgacacggcctccatgtacggcaccgagaagccgctgggcgacgccgtggccgaggcgctccggcgcgggaccctgcggtcccgggaggatctgttcgtgacgtccaagctgtggtgctcgcagaaccacccggacctcgtgctgccgtccctccgggaaacactcaagaacctgcagatggagtacgtggatctgtacctgatccactggccggtgtgcctgaaaccggggccgcccgagctcccgaccaggaaggagaacgccgtgccgctggacctcgcgggcgtgtggcgcgccatggaggagtgccagcggctgggcctcgccaaggcgatcggcgtgagcaacttcaccaccaggcacctcgacggggtcctggccgtcgccacggtcccgcccgcggtgaaccaggtggagctgaacccggcgtggcagcagcggacgctcagggcgtactgcgccgacaggggcatccacgtcgcggcctactcgccgctgggagggcagaactgggacgggcagggcagcgccgtgctggactccgaggtgctcgccgcgatag

SEQ ID NO: 1897 - DNA, 3083 bp, Zea mays
  misc_feature (788)..(788): n is a, c, g, or t
  misc_feature (847)..(847): n is a, c, g, or t
  misc_feature (2965)..(2965): n is a, c, g, or t
ttgtcatattgattaaatttctctagtgtttgtgattttagtcaaaactgtttatccaccctcctctagccggtgtcctagatcttacaccgactcctctagccggtgtcaccgatgccttatgtttcgacaaatgaattagctctcgttgttatattaatgaaaactttgtaaaaaagcaaaaacagctcggtcgcttcgttttgccatatgtccatcaaccatcaaaccatcgtcagtatacagccgactgacccgtacaacatcgtgcagctactaatgtgcgacaaaactcacatccaaacgagtctgttgacataaagggatacatccaaacgggaaaaatatccttgctacaacaaacatgatcgtctttggccttttgtccattacgagtgattgtaaacataaaccagtatggatagtgatcgtgggttctgaaattcgatcgtttcaagctcctgaaacgcatcgtctttctctaggtggtgtgtactgttgtttgaagggcagttgtcgatcacagcatgaatccaccgtccatcacatatttgatgtcgtcgacgcgtagtaccatagtgacgtcaatccttacaacacaagtggaacagtagtcagacgaatgacgaggagcgtggaaatctgacagcgtgtgggcacgcaaacggtttgtacgtgttgtacgtacctgaggcgaggatggcccagcgaagcgcggcgacagcgggcagcgtggcggcgaccgaccgtgctgcgtcggccgaggagtcgcagttggaggtggagtnccagtccccgcagaggcacaggtcggcgtggctctccgtgtcatggccacacgccccgncccgtggcgcggcacgcgccgcagaatccgcggttggactcgggcagcgtccacgacacccggatcccgtacgcccagcccgcggcggcgccctcggcgcgcacgggcgcgaggctgtacgcgctgctgtacccctcgcactcgagccggctgacgttcaccgcccggatggcaccccagggcagcgcgcagcactcgggcggttgccccgcggcgtcgcccgacgacgggccccgccgcccgccgccgccggcgtagtagtcgtcccaggcgaggcagccgaggtagtcgccgcaccccatcccagacacgttccggcaggggaggtggcggtcggggaagccctggaacagcggcgaggtggcgcggcagcccaggaggaggaacacgttgtccgagtccggcgacaggtacggctcccgccacggctcgatgacgaagccgttgccccgcccagccggggcgaggtccagcgcgcggcagtcggacatggccgggtcgtgcagggtcaggccccggtacgcgtagtcgacgtcgaccacgcggtaggagcccgaggggaggtggagcatcagcgcgccgttgatgcagaagagcaggtcccgcagccccgcgtggccgcacccctcgtgcagcgcgaacgggtagtccaccgtgatgttgccgcagaacgaccggcacgtagtgatcggtacgttcgcggccgcgacgacggagcccgccggcgccgtcgtggtggtgcacgcgcatagcagggcgagcaacgcggccaggtagcgacgcggcggcgccattgccttgccccggtgcgagcaagatgccaaagtggaagcggggagtggcaggaattgaacacctacagagggccttgggggccggttgtgctaagaacagatcgattccttgcttcctttggaagagggagtgttgggcagcatcatttgcttttagttaccgacgttttttctttacctttcttttgattttgtttaatgccacacacagcttcatcgtgtgccctactagcactggcacagtagctctgactacgctccgctgctcttgaaaacgagatcggcgcctgaaaggacgagaatgcagccgccgccgctttgagcgaggccgtctttcgtcagcttctgtatagcacggaaaacaaatgaaatgatcgatctgggatcagatcatggaaagctgtgctccctcgcttctttcgataaataaagaggaggagaatccggccctttctcttttctcccttctctagaatagaataaaaaaggtcaccgtggcccgtgggctgtgatttgtgaacgagaagatccctagaaggctagaacagtgtgagaggaaaggaatatggtctccgccactacagtgtcacttccccaacctcttttgtccgttacatcacacacccaaagaagctgtccacgccgcaatgcagcggtcgcgctcacagcacgccgaacatcacccaggaggaacggcaacgcacacgccctttcgcacccaggagctggaggcgcccctggatccgggatccgacccggagtaccgggacttccagtttcggttcatcccggaggtgttcgagctccagatgggcggcggcgagctggggtgaggaatggagacggcaaggtaacggcggagaaggttcttgggttcgagttcgacaaggtcaggatcagcattgcgtccagcgacgacgaggcggacggagacgcgccgccgaggagctccttctccggggcgagccacccgccggagccggtggacgagatagacaccgtctttgtcgctgtcgacggccgggagaagccggtcccgaagccaatcatctcgtgggacgcgtctccgctgccgagcggcgcggcaagcccgcacagcagcatcgacagctccggcgccgccgtcaccaccgtgacaagcctcgcgccgagctgcaccgtcaccagaaagaaagaaacctgatagttacaggccggataatgcaacgtctaagatatttctccccctaaccttgcaaatctcaaagtcaccttaaactaatttcatgaacacatttctaaaacgatgaatttggtaagggcttcgtgaataaattattgagantatcacataatttggtttacatgatgtttacttcaccctttttttaatttatgggataaaacaacttaggacaaatatatttgttatgttgttcttgatgtagtctgtctatatttgg

SEQ ID NO: 1898 - DNA, 692 bp, Zea mays
tgaatacataccggcacgggctcaaggctctggctcgcgcacccctggtccctgttccgcaccgcaccgcacacctagacgcacctccagctgcagcgcgccatacttgaccgcatcagcatggcatccacggggacgacagcggcggtgccggaggtgaccctgcggtcgggcaacgggaagccgatgccgatggtgggcatgggcacggcgtcgttccccgtggtgcacgaggccgtcagggacgccgtgctggcggccatcggggtggggttccgccacttcgacacggccttcctgtacggcaccgagaagccgctcggcgacgccgtggccgaggcgctgcggcgcggcctcctgcggtcccgggaggagctcttcgtcacgtccaagctgtggtgctcgcagacccacgcggacctcgtgctgccgtccctgcgggaaactctcaagaacctgcggatggagtacgtggacctgtacctgatccactggccggtgtgcctcaggccggccggcgggccgcccaagttcccgaacaggaaggaggacgcggtgccgctggacgtggcgggcgtgtggcgcgccatggaggagtgccagcggctgggcctcgccagggcgatcggcgtcagcaacttcaccaccaggcacctggacaaggtcctggccatcgccgcggtcccgcccgc

SEQ ID NO: 1899 - DNA, 1410 bp, Zea mays
acaaccgcacaactacaaggcgtgcggtccacgaggccggccggtgaaacggcggccgaggccgcaagcttctcactggccgcaagcaaaccgaacgaacccaaccgaagcgagagctgagcaaggcagaggcggcgtgaccggcgatggagcggctgcagcggatctttggcgcctccggcatggggcagccgccgacggactcgccgctgctcgattcctccgagcaggtctacatctcctccctagcgcttctcaagatgctcaagcacgggagggctggggtgcccatggaggtcatgggcctcatgctcggcgagttcgtcgacgactacaccgtcagggtcgtcgacgtcttcgccatgccgcagagcgggactggtgtcagcgtcgaggccgtagaccacgtcttccagacaaacatgcttgacatgcttaagcagaccggcaggccagaaatggttgtaggttggtatcactcacatcctggcttcggatgctggctatcaggcgtcgatatcaatactcagcagagttttgaagctttgaaccccagagccgttgctgttgtgatagaccccatccagagtgtgaaggggaaggtggttattgatgcattccgcctcattaatcctcagaccatgatgcttggccaggagccacgtcagacaacatcaaatgttgggcacctaaataagccatctattcaggctcttatccatgggctgaatagacactactactcaattgcaatcaattaccggaaaaatgagcttgaggagaaaatgctgttgaacttgcacaaaaagaaatggaccgatgggctaattttgaagaggtttgacactcactcgaaaaccaacgagcagactgtccaggaaatgctaaacctagccatcaagtacaacaaggcagtgcaggaggaggacgaactgcctcctgagaaacttgcgatagcaaatgtgggtcggcaagatgcaaaaaagcatttggaagagcatgtgtcgaatttgatgtcatcaaacatagttcagaccctaggaaccatgctcgacacggttgtcttttagtctactaataatattgttgtcccaaactgaaacatagccacactatcgaagcacacgtgcaatgagcttgacgccggatacattttggttctaaggtttgtttatgaatggatttgtctacatttcattgttgttaaacttcctgccttttctatcaaagcttcagtgcgttctagttatgtttaagccaaggtggctccagatgtcagttgggatgtcattgccctgggagaactgtgtaatgtgattatgacctgtggcagataacttattttgtttcttctacatgcattgacacgaaaaaaagtgatcttgtaactagagggggggcccggtaccc

SEQ ID NO: 1900 - DNA, 1414 bp, Zea mays
cattgggaccctcgaggccggccgggacgatttttctcccttcgggtccgcgtggccgcaactcgcaagcaaatcgaacgaacccagccgaagcgcgagccgcgagctgagcaaggcggaggcggcggaaccggcgatggagcggctgcagcggatctttggcgcctccggcatggggcagccgccgacggactcgccgctgctcgactcctccgagcaggtctacatctcctccctcgcgcttctcaagatgctcaagcacgggagggccggcgtgcccatggaggtcatgggtctcatgctcggcgagttcgtcgatgactacaccgtcagggtcgtcgacgtcttcgccatgccgcagagcgggactggggtcagcgtcgaggccgtcgaccacgtcttccagacaaacatgcttgacatgctcaagcagaccggcaggccagaaatggttgtaggctggtatcactcacatcctggcttcggttgctggctatcaggcgttgatatcaatactcagcagagttttgaagctttgaaccccagggcagttgctgttgtgatagaccccatccagagtgtgaaggggaaggtggttattgatgcattccgcctaattaatcctcagaccatgatgcttggccaggagccacggcagacgacatcaaatgttgggcacctaaataagccatcgattcaggctcttatccatgggctgaacagacactactactcgattgcaatcaattaccgaaaaaatgaacttgaggagaaaatgttgctgaacttgcacaaaaagaaatggacagatgggctaattttgaagaggtttgacactcattcaaaaaccaacgagcagactgtccaggaaatgctaaacctagccatcaagtacaacaaggcggtgcaggaggaggacgaactgccacctgagaaacttgcgatagcaaatgtaggtcggcaagatgcaaaaaagcatttggaagagcatgtgtccaatttgatgtcatcaaacatagttcagaccctaggaaccatgctcgacacggttgtattttagtctctactaatattgttgttccaaactgaaacatagcccactctatcgaagcatgacacatgcaatgagctcgatgccggatacatttttggttctaagatttgtttacgaatggatttgtctacattctgttgttaaactccctaccttttctatcaaagcttcagtatgttctagttatattgaagccaatgtgggtccacattgtcaattgggatgtcattgcccctgggagaaattgtgtaatgcgattatgacttgttgcgtgggccgcgtgtgatggcttattttgtttgttccccatgcgttggccccaaggcccccaggcccatatttgagtgatcttgcaacctc

SEQ ID NO: 1901 - DNA, 1237 bp, Zea mays
cctcgagggccgggcgcggccccagataccggtcgcggaaacggcagtcgcaactcgcaagcaaatcgaacgaacccagccgaagcgcgagctgagcaaggcggaggcggcgggaccggcgatggagcggctgcagcggatctttggcgcctccggcatggggcagccgccgacggactcgccgctgctcgactcctccgagcaggtctacatctcctccctcgcgcttctcaagatgctcaagcacgggagggccggcgtgcccatggaggtcatgggtctcatgctcggcgagttcgtcgatgactacaccgtcagggtcgtcgacgtcttcgccatgccgcagagcgggactggggtcagcgtcgaggccgtcgaccacgtcttccagacaaacatgcttgacatgctcaagcagaccggcaggccagaaatggttgtaggctggtatcactcacatcctggcttcggttgctggctatcaggcgttgatatcaatactcagcagagttttgaagctttgaaccccagggcagttgctgttgtgatagaccccatccagagtgtgaaggggaaggtggttattgatgcattccgcctaattaatcctcagaccatgatgcttggccaggagccacggcagacgacatcaaatgttgggcacctaaataagccatcgattcaggctcttatccatgggctgaacagacactactactcgattgcaatcaattaccgaaaaaatgaacttgaggagaaaatgttgctgaacttgcacaaaaagaaatggacagatggactaattttgaagaggtttgacactcactcaaaaaccaacgagcagactgtccaggaaatgctaaacctagccatcaagtacaacaaggcagtgcaggaggaggacgaactgccacctgagaaacttgctatagcaaatgtgggtcggcaagatgcaaaaaagcatttggaagagcatgtgtccaatttgatgtcatcaaacatagttcagaccctaggaaccatgctcgacacggttgtattttagtctctactaatattgttgttccaaactgaaacatagccacatgcaatgagctcgatgccggatacattttggttctaagatttgtttacgaatggatttgtctacattccgttgttaaactccctgccttttctatcaaagcttcagtatgttcccgttacccttaagccaatgcgggtccacattgtcaaa

SEQ ID NO: 1902 - DNA, 1383 bp, Zea mays
tgtgcggcgctcgaggcggcggtccgggatttaggtgacctatagaaagccggccgccccccggacacgatttttctcactagtcgcaactcgcaatcaaatcgaacgaacccagccgaagcgcgagctgagcaaggcggaagcggcgatggagcggctgcagcggatctttggcgcctccggcatggggcagccgccgacggactcgccgctgctcgactcttccgagcaggtctacatctcctccctcgcgcttctcaagatgctcaagcacgggagggccggcgtgcccatggaggtcatgggtctcatgctcggcgagttcgtcgatgactacaccgtcagggtcgtcgacgtcttcgccatgccgcagagcgggactggggtcagcgtcgaggccgtcgaccacgtcttccagacaaacatgcttgacatgctcaagcagaccggcaggccagaaatggttgtaggctggtatcactcacatcctggcttcggttgctggctatcaggcgttgatatcaatactcagcagagttttgaagctttgaaccccagggcagttgctgttgtgatagaccccatccagagtgtgaaggggaaggtggttattgatgcattccgcctaattaatcctcagaccatgatgcttggccaggaaccacggcagacgacatcaaatgttgggcacctaaataagccatcgattcaggctcttatccatgggctgaacaggcactactactcaattgcaatcaattaccggaaaaatgagctagaggagaaaatggttgttgaacttgcacaaaaagaaatggacagatggactaattttgaagaggtttgacactcactcaaaaaccaacgagcagactgtccaggaaatgctaaacctagccatcaagtacaacaaggcagtgcaggaggaggacgaattgccccttgaaaaactttcgatagcaaatttgggtgggcaaaatgcaaaaaagcatttggaaaagcatgtgtccaatttgatgtcatcaaacatagttcagaccctaggaaccatgctcgacgcggttgtattttagtctctactaatattgttgttccaaactgaaacatagccccctctatcgaagcatggcacatgcaatgagctcgatgccggatacatttttggttcttagatttgtttacgaatggatttgtctacattctgttgttaaactccctaccttttctatcaaagcttcagtatgttctagttatatttaagccaatgtgggtccacattgtcaattgggatgtcattacccctgggagaaattgtgtaatgcgattatatgacttgttgcgtgcgccccgcgtgtgatggcttattttgtttgttccacaaaa

SEQ ID NO: 1903 - DNA, 613 bp, Zea mays
gtcgtcgtcagagcgtgaccccggccctgacgctgacggggaggaggagagtgatttcatccatgtcttgctctcccttcagcaagagtacaacctgacgagagatcagatcaaggcgcagctggtggtcatgttcgaagctggcactgacacatccttcatagtgctggaatacgccatggttcagctgatgcgaaacccccacctgatgaccaagctacaagccgaggtgaggagcaccattattaataatggaacagagatagtcaccgaggacgagctccacagcctatcctacctcaaggcagtcgtcaaagagacgctgcggctccacatgccggctccactcctcgtgccccacctctccatggccgactgcaccgtacaagggtacacgataccgtcgggaacacgaaccatcgtcaacagctgggctctcgcgagggaccccagctgctgggagagagccgaggagttcatgcccgagcgcttcatggagggcggcagtgccgcagccatggacagcaacaaggggaacgacttccagtacataccgttcggcgcagggagaaggatgtgccccgccatcagctttgcgaccgcagcctatcca

SEQ ID NO: 1904 - DNA, 1600 bp, Zea mays
gttctgggaggttggtctagcaggccaccaggtcggcccgaggctttgccggcaggaacggacctcttatcataggccgtaacggcccccccggcccatccgacgggcagaagcagagcaccaccaccatacgccgccaccgcaagcagacgtccccatggccatggcttccaccgccaccgctgctgcttctctccgcctcgccttccctctcctctcctcgccggcttcctcctcctcgtcctctaatacccttcgcttccctctccgccgccgcagcgccgcccgccccatcgccgtcaccgccttcaagaagctctccgaggcgtcccccgtgcccatccctcaggagcccaccgagcccctcctggtcgacgaggacgctctgcccccaaaggccggggtctacggcgtctacgaccccgccggcgagctgcagttcgtcgggatttcgcgcaacgtcagggccagcatcgagggccaccgccggaaggtccccgccaacctctgcgcctccgtcaaggtcgcggtatcagatgaggagacaccagatcgatctgcccttaacaacgcctggaaatcatggatgcaagaacacatagcggccaccggcaaggcgccaccagggaatgttgcaggaaacaacacctgggttggtggcccccagcggcctccagacctgcggctgacgcccggacgccacgtccagctgacggttccgctggagcagctgatacaccggctggtgaaggagaacagagtggtagccttcatcaaggggtcaaggagcgctccccagtgtgggttctcgcagagggtggtgggcatcctggaagggcacggcgtggatttcgtaaccgtcgacgtgctcgacgaggagcacaaccacgggctgagagaaaccctcaaggcgtacagcagctggccgacgttccctcaggtcttcgttggaggggagctcgtgggcggctgcgatatcgtttcgtccatggctgaaaagggggagcttgctgccctactaattcagaaatgaatgctttaccctacagtgacttgaattgcttcgatggttgtctgatccacacgtagtagcacggagatccaagttgttgtacctgctgtgcatgttggatgtggtacgtcccgagtttgaaaagcgtgtgatgtggtatggacgtgtggtttgcctgctgtttataggtagaagttgcctgaggacgacacacatattttttgttttatttatttgtggggatcggagagcgatcgagcctctgtttggttggttggatgtacgtagatggatgaaagagtcggccacagtttatataatgttcggatgaaagttaagtagagacgagttaaacactggagtagttttttgtagcgatgtggtaccaaaaaatcgaaggatggtgtcgtctccgtctcattctactttgatctcaatccatgtgctgttcatttgaggggattttccctttattttctttattggaaaatataaaaaaaggagaaaaggccggccactgggccgctaccaggcgctcggccgagcagcccagcagcggctggcgccggtcaggggtaccgagctcga

SEQ ID NO: 1905 - DNA, 2652 bp, Zea mays
  misc_feature (789)..(789): n is a, c, g, or t
gtgcccttgcatttatcaatactggtgtcgacgatggtgtaataaatattaccattccacttgccttcataccgattttttccttttgtgttcattttcatacctttgcgaggctgtatggtattcattggagtggaggaggggattgctaaagcattggtgacattggtattgggttttggctgcttgcatatgggattataaggtgtggtttctatcgaattacatgaggggacatctagaacgtttgacatcatgaaggtggtctgcatctctttattgatggatttgttgcacaatgtgctgctggtggatttctttttcttgcgaaaagccttgaggggcaaggtatccatgggatcaatggaaggggtccccaaaacattagaaatcatggctttgggctgtggttgtggcatgtgaggtttttcaaaccttgggctttgttgtgtctgactgttaggtggtttacattgttcggtctcagtagccttttgatgttggtttttggaaatgtcaagaagatttttatggtggtggtaggaagaagttggtacaggcaagcatagtgaaggttgggatccatctccattgatgaagtcatcaatttgtaggttggatggcacagatattccttttttcgcatgcaaacgacgcaaccatgatggtgtgctggtggcagtatgattcatagacataattgcatcgagcatcaactgacaacatggcatctttattccctccaaccaaaacactggtgaaactagatgactgaggaggccaggaatnaagggaagcggactctaaaaaaataaatgagcaaacatataagggaatatatataaaaaatagccaaatactttataagatgggaccttctagaagatactacatgccttttttgcattgacacatgtcaattgttttgttttcatgcaatacacaaaatataacatagtactagaataaacaaaaaaaataactggttagaatataataccttgagtggacccagtgttgagggcctaatagaaatgtgctttccaaaaaaaacctattcacccactcttggcgtagggtcacaagagcgagagattggaaaggcttgctcacccaatcaccggtgcacgctagcggtgcaatagataaaagaggaataaatccaatttattatcatagggattcccaaacctaggggctcctagtataataatttctggcgcaacttttctcggagggattggtgcacatatatcgtgaggagaatccctagcctccacacaactagcagtatggtattaattgatgtttcacctttcacttccacgtgtggacttaaacactaaaatctattacataacatagactaatgacccaaattagaatatttgcaactgagtctaatggtctatgccaaatacattgtagcaacccttactagatatcaaatgctcaactaaaaagttttccttctccagtttatatgccaacatttcggcagagacaattaaatttaactcatgcctagagtttcttatcccttcatgagtttatcgaagaaagtctcataaattgtgatgtttaacaatcatgcttatataggtatgttttttaagagtagtacacaggacaaatgaaacacattaaggaatttaacaaaactgcttgcctagtgggacagacacgaaagagacgcgtgacactcatcgatatggttctataaacatgttcgctttgcatgaaccccccttgctgtcaatatgttcattgagaacggaagataaataaataaataaataaataaataacaaaagttgagactgggccacacaaggctgttttcgcaggtgggtttagaaggccaccaggccggacaactttgcctgcagaaatggacctttgttatgggccgtaacgaagcccacatcctatccgacaggcagaagcagagcacccccaccactcgcctccaccgcacgcacgcagacgtcccaccgtccccatggcctaccatggcttccaccgccaccgctgctgcttctctccgcctcgccttccctctcctctccgcgccggcttcctcctcgtcgtcctccaatacccttcgcttccctctccgccgccgcagctcctgccgccccctcgccgtcgccgccttcaagaagctctccgaggcgtcccccgtgcccatccctcaggagcccacccaacccctcctggtcgacgaggacgccctgcctcctaagcccggggtctacggcgtctacgaccccgccggcgagctgcagttcgtcgggatttcgcgcaacgtgagggccagcgtcgagggccaccgccggaaggtccccgccgacagcaacgcctccctctggccacggcatgaactactaagcgtgtacatcattatattattattgcagtttcttctcccaatttacaaacagtttagcctcgccttggaactaaaccagtacttacctttgggctagctttggtatgtaagtatgagggatcgttaatttgggcaaactgagacatgctaatttgggttactaaggaaggcatggtttaattagtcgtgtgtcctcgtcctctctgccttttgttggcgacctaaagaaaaggaggggacaaaatgcacagtacattatc

SEQ ID NO: 1906 - DNA, 424 bp, Zea mays
tcgaacgaccgaccggtcaggtacaacctgacgagagatcagatcaaggcgcagctggtggtatgcatgctgtatacatatatgtgtatatgataccgcccgcctcacctaccacctacacatgcacatactgtctgtatcgtcatctatctatctatctgcaggtcatgttcgaagctggcactgacacatccttcatagtgctggaatacgccatggttcagctgatgcgaaacccccacctgatgaccaagctacaagccgaggtgaggagcaccattattaataatggaacagagatagtcaccgaggacgagctccacagcctatcctacctcaaggcagtcgtcaaagagacgctgcggctccacatgccggctccactcctcgtgccccacctctccatggccgactgcaccgtact

SEQ ID NO: 1907 - DNA, 1203 bp, Zea mays
gccggccgggctccggatccgacaggcagaagcagagcaccccccccggccgccgcggacgcaagcagacgtcccaccgtccccatggccaccatggcttccaccgccaccgctgctgcttctctccgcctcgccttccctctcctctccgcgccggcttcctcctcgtcgtactccaatacccttcgcttccctctccgccgccgcagctcctgccgccccctcgccgtcgccgccttcaagaagctctccgaggcgtcccccgtgcccatccctcaggagcccacccaacccctcctggtcgacgaagacgccctgcctcctaaggccggggtctacggcgtctacgaccccgccggcgagctgcagttcgtcgggatttcgcgcaacgtgagggccagcgtcgagggccaccgccggaaggtccccgccaacctctgcgcctccgtcaaggtcgcagtatcagatgaggaggcaccagatcgatctgcccttaacaatgcctggaaatcatggatggaagaacacatagcggccacgggcaaggcgccaccagggaacgttgcaggaaaccacacctgggttggtgccccccagcggcccccggacctgcgtctgacgcctggacgccacgtccagctgacggttccgctggagcagctgatagaccggctggtgaaggagaacagggtggtggccttcatcaaaggatcaaggagcgctccccagtgcgggttctcgcagagggtggtgggtatcctggaagcgcacgccgcggatttcgtgaccgtggatgtgctcgacgaggagcacaaccacgggctgagagaaaccctcaaggcttacagcagctggccgacgttccctcaggtcttcgtcggaggggagctcgtgggaggctgcgatatcatttcgtccatggctgagagaggggagcttgccgccctattgattcagaaatgaagacttgatttagtacagcgacttggaataaatgtttgcttccatgggtgactgatccgttgcttgcacacgtagcatgccatccaagttggtatctgtggctttcggaaaggaaagaaagaaagaaaccgttgctgcgtctggacagtccggtatcaatttaattatatatatatatacacttattagaatatatatatatatatttatatacttattagaataaaattaaaacatgtg

SEQ ID NO: 1908 - DNA, 4944 bp, Zea mays
  misc_feature (903)..(903): n is a, c, g, or t
  misc_feature (3023)..(3023): n is a, c, g, or t
caaatcttcgtcagggggttccgcgccatcatatactgagaggcctcaccaggacatgctcaagcatcctccattagacgattgcctggccaatgtgtatgcttacaggaaggcaaaagggttgtgttacaagtgcggcctcacttactccaagggtcacaaatgtgccgacattgtgcaactacactgggtggaagaaatttggaaccaattcaccccatccgagtctgaagaacctgtggatacagtgcctgccgaattgcatgttgtagtcatgtctcaagccgctcatggcgaagtctctgcaactaaaacaatgaagtttctgggttccattcaggggatcgacctgctgattttattagactccgggagttcccatacattcatcagtgcagcagtggcgtctcagttaaccggttgttctcagctttgccagcctttatctgtacagattgccaacgggacgcgtctcatctgctccacagaattccctaatgccacttggtacctcaatgactatcagttcacctccacactgaaagtgttaccactatcctcctatgatatgatagttggtatggattggctacaattacacagccccatgttcgtccactggaccgacaaatggcttactgttccctatcaaggcaccactgttaaacttgtcggtcttcaacccgggggtacccaatgctcagttatggagatccttttggggcagagcaatgaggcagttatggaggtatattcagctgaacacatctcagagaaggatcagtctattattcattccctgctggtgcccctgcaggacctacttcttcggttctctcatgtgtttgttgtcccccagggtcttcctcccgagcgtgactgcgaccatcacattccactaantccaggcgcacgcccagtccaaatgagaccctgtctctatgccccagctctgaaatcagaaattgagaaacaagtggctgacatgttgcaatctggcatcatagaacgcagcaagagtgagttctcttcgtccgtaattttaggtgaagaaaaaagatgacacgtatcggttctgtgttgattacagacacttgaatgccttgacagcaaaaaccaaatttccagtgtcggtcatcgacgaatttttggatgagttacatggggcagcatggttttctacccttgatctgcgagcagggttccatcaaattcgtttggcacctcatgatcagcacaaaacagccttccaaacccaccacggccattttgaattcaaggtcatggcctttggcctctccggagcaccggctacctttcaaggagcaatgaatcgcaccttggcaccattactcagatcctgtgtgttagttttcttcgatgatatcctggtatacagtactacctgggaggatcacttacatcgcctagagctggtgttgaatctgctcgcacaggatcgttggcagatcaaactttcaaagtgttcctttgccagacagcaaatttcatacttggggcatgttatctcccatcaaggggttgctactgatcctgccaaaattgatgctgtcacgtcgtggcccctccctactaactgtaaagaactaaggggattcttgggcctggcggggtactatcgcaagtttgtgcgccactccaagccacttactaccctattgaagaaacatgtattgtttgtctggaccagcgagcacgatcaagcatttcaggcattaaagtcagctctttcttctgcgccggttttggctttacccgactttaccaaaccatttgccatggaaacagatgcttccggcactggcataggagctgtgcttacacaggagggccaccccttagcatttgtcagtcgcgcactgggtgtcaagaatcagggactttccacttatgagaaagaatatctcgctatcctcttagccgtcgatcaatggcggccatacctgcaacatgctgagttcatcatttatacggatcagcgcagtttgtcacacttgactgagcagcggctgcatacaccttggcaacagcgagtcttcaccaaattactgggcctccaatacaagatcgtgtttaaaaaaggcgtcgaaaatggggctgcagacgcattgtctcgacgccctcctgttggcttagaagttttcagcgcctccactgctgtcccacaatggctttctgaagtcatccagagctacagcaaggatcccaaagctaccaagcttatcaccgaattatcagtccagacttcttcccaaggaccatactcgctccagcaagggttgatccgctataaaggtcgggtctgggtaggtgacaatgttcctattcaacgtcagattatgtcagccctacacgacagtcctcttggaggtcattccggatttccagtcacataccgccgtatcaagcaaatcttcgcctggcctaggctcaagcaatctgtctgtgactttgtggctgcctgttctgtctgccagcaagccaaaccagatcgcgctaagtatcccggccttcttcagccattacctattctcgaccaggcttggcaagtggtatcgctggatttcatcgagggtttaccacgttccggttcagctaactgcatcttagtggtggtggacacatttagcaagtatgctcatttcattgggttgcttcacccattctctgccctgaaagttgcgcaagcattcatgaccaatgtctacaagttacatggtctcccccagtcactggtttcggacagggaccgcatcttcaccagtcatctatggcaggagctgtttcgtttatccggtaccaagctccaaatgagcactgcttatcacccccagagtgacggacaaacagagcgtgtcaaccaatgtcttgagacatttcttcgcagtttcacacattcctgtccaaccaagtggttttcctggctgcccctagcagagttttggtataatacctgtcctcactcatcgttgggtatgtccccatttcaggtcatgtacggncgcgctcctcgccagtttggattagtccctgcagatgcggttcacaattctgatctggccgaatggttagctgaccgggaactaatgcttcgggtgattaagcagaatctgttaagggcacagcaaagaatgaaacaccaggccgataaaagcagatctgaccgtgagttctctgtgggggattttgtgtatgttaagttgcaaccctatgttcagggatcagtggttgtccgtgcctgccataagctcagcttcaagtactttggaccctttcaaatcattgctcgcattggcaaggtcgcctataagctgtccctgccagcatccgccacagtgcatccggtgttccatgtttcacagctcaaaccatgcacaccggcgcccaaactggtcagtcatgctttaccaattattaatcttgatgtccagtaccctgcacagaccatcgctccgtctctcgtggtggtacatccgtcgaccaagtccttgtccgctggtctggcctcgacgccaccttggcgacctgggaggatgtcgaagccctgaagtcgacgtttccagatgctggcgcttgggggcaagcgccaactcaagcaggggatgtcagcacctcaacagcacccgtcgagaaggcagctgagacagtggacgctgcgccaatgggccgtcgcgagagaaggccaaatgtccgctatgccggcccagagtggcggctgtaataggcgtgagtgtgtgtgggagtgacaggaaagaagacagtattgttacatttcgtattctgtactgagtagctactttcctccaccctaaaccctctgtttctacctttcttctacctcgcgacgccgtcacacgcggtggttgctaacagaggactgcttcgtgctcaaggtggaggcggaggcgtccagcctgcgcgcgcgcaacagcagcagcgtcgagatcatccggcacacggtgtggggctacttcagccagcgcacgggcctgctggtgcagctggaggactcgcacctgctgcagatcaggtccagcggcggcgccggcgggagcgtcttctgggagaccaccatggagtcccgcctcggcgactaccgcgccgtcgacggcgtcaacatcgcccacgccggccgcaccgccgtctcgctcgtcaggttcggcgactgccaggacggcaacaccaggacgcgcatggaggaggagtggaacatcgaggaggtggacttcaacatctggggcctctccatggactgcttcctgccgcccagcgacctcagggagggcaaggagagccaggacgtcgccgtcgtcaaggccgacgcgcgcccgccgccgctgaggataccggcggtcaccgtgcgcgtcgggccctcgcaggtggctgccgtcaacatggacgactcgaactcgctcgtcgcgaggtcatgactactcgtcacgtaccgtacgtacgtacgtacttgcagtgctgagtgaagagcatgtatttgtacgtgacacttgtgttactataagatcatacatgtcgcaagatctgtaaatatattggaggttgagatctttttttccccgcttcgagaggtgtgtgtttacctcagctagaattgaggccagaaatagtgcgatcgataatctgagctacatattccgcgtagctgtgttgtaaattctaatgaactagtaatacctacaaaaaaaaaaaaaaaacccagttctgtccagtcccaatactagagtacgtaatgtatttttccggctcatatgctgcagctattctccctctccctctctctctcatagaacaactttgaagccgcgtcacaattgttgcagtcctgaaaaagcttaaccctactgaatacattgagaaatgagagccttcagacatccagaaaatataagttcagcaggggtaccgagc

SEQ ID NO: 1909 - DNA, 2128 bp, Zea mays
aactcccatgcgcgctctcggaaacggagtggatatatgggaacagacgagcagtagcactacacagacagcacacaccaaaaggtctggggctcgcaaaagggcaacgtgcagtcgtatgtccacacgcgcgacgaaatctggaccaagatagttttttttttctcaaattttttaacaggtgtagcagcagtaccagtacgtgagcgtgcggccacgaccaaacctgtcgcgaaatcaaggaagggccccacctgccagctgctcgcacgactcgtcaaaaccgtgggtaccccccgggccggccgggagtactgggagtgggagggggaggcacaggcaccataacgcgcgcttcagttccggaggcctcaccgcctcacgcaggcacgcacatcacacaacgccagcgagaaagagctctcgtccgcaccacggcgcaaccaacggggagaagaggaaggcagtgagctgtcccgcgcgtgcgcgccccgcctcccgcccgcccgtctgatgaggaagctctgcccgaacctcgagcgcgacgacgcgctggacacggtgctggaggtgcccatccccgaggagatgttctccggcggcggcggctcccgcggctccaccaggttcggctgcaccaacgtcaaggcttggatgcggtcgcacgccgccgaccggtccggcgcgggcgagccgtgctccatgacccgcggggagctgcagctcatgctgggcgtcatcggcgcgccgctcatcccgctgcccgtctaccacgccaaccagtcgccctgctccgtcctctgcgagcagctcaaggccgatcccatcgagtcgtcctccgccaagtacatcgtgcagcagtacatagcggcgtcgggcggggagtgggcgctgaacaaggttaagagcatgtacgcgatgggcaaggtgcggatgacggccgcggagctcaacagcagcgacgccgacggccacggcggaagcaccggaaacgggcaccaccgcggcgggaagaagggcagcaagggagggggcggcggcggcgagatcggcgggttcgtgctgtggcagaagaagccggagctgtggtgcctggagctcgtcgtgtccggctgcaagatcagcgccggcagcgacggcaaggtggcgtggcgccagacgccgtggcaccagtcgcacgcatcccgcggtcccccgcgcccgctccgccgttcgctccagggcctcgatccgcagctgaccgcgagcctgttcgcggactcggtgtgcatcggcgagcggagcatcgacggcgaggactgcttcgtgctcaaggtggaggcggaggcgtccagcctgcgcgcgcgcaacagcagcagcgtcgagatcatccggcacacggtgtggggctacttcagccagcgcacgggcctgctggtgcagctggaggactcgcacctgctgcagatcaggtccagcggcggcggcgccggagggagcgtcttctgggagaccaccatggagtcccgcctcggcgactaccgcgccgtcgacggcgtcaacatcgcccacgccggccgcaccgccgtctcgctcgtcaggttcggcgactgccaggacggcaacaccaggacgcgcatggaggaggagtggaacatcgaggaggtggacttcaacatctggggcctctccatggactgcttcctgccgcccagcgacctcagggagggcaaggagagccaggacgtcgccgtcgtcaaggccgacgcgcgcccgccgccgctgaggataccggcggtcaccgtgcgcgtcgggccctcgcaggtggctgccgtcaacatggacgactcggactcgctcgtcgcgaggtcatgactactcgtcacgtaccgtacgtacgtacgtacgtacttgcagtgctgagtgaagagcatgtatttgtacgtgacacttgtgttactataagatcatacatgtcgcaagatctgtaaatatattggaggttgagatcttcaaaaaaaaaaaaaagaaaaagtaagtttaaatcagctagaattgaggccagaaatagtgcgatcgataatccgagctacatattccgcgtagctgtgttgtaaattctaatgaactagtaatacctgtaactctg

SEQ ID NO: 1910 - DNA, 6338 bp, Zea mays
  misc_feature (4038)..(4038): n is a, c, g, or t
  misc_feature (4361)..(4361): n is a, c, g, or t
  misc_feature (4419)..(4419): n is a, c, g, or t
cctggacaagcgaacgggcctggattgctacttgactaaggccttgttcgtttgtattcgattgcacctggaatcgttacagctaatcagagtttatataaattagagaagcaatccggttaaaaatcgttccgaccaaccaatccggcacaaacgaaccaggcctaataggttgcctatcgcaccaaaatatggtgacctcgtaaaatagccacttgaatttgtccgcgccaaatcacgtaagcggaagccaacaaaagtgcaatatcaaataatgagaacccaggtagaaaaatctgagctggaagaaatagctcccacaagcaagtggccacctttgagtggatgttggaagaaatagcagccacaagcaagtagtcacctgtgtcatcttattccgatcctagcccctcccgtctggaattcctcgcttcctcctcccttctctagttctctgatcctcagcacttagcatcaagcttagcacaccggcgagatggcctccacctccaccttcctgtccaccctcgccagcaggtccgcggcagccgatagcctgcgcagcgccgtgccgtccttcgccaagatcgtcaggttcttgcccgcgcaggcgcagatcagccgcaggcggcgcgcggcggtgctgcccacgccgagggcggcggtgtcgggcaccgagaaggcgccgtcgagcaagcacgagcgcgtggtcagggtgcacagcacccaggagttcgacgacgcgctcaaggccgccaagaaccggctggtggtggtggagttcgcggcgagcgacagcgaggacagcagccagatctacccgaccatggtgcagctcagccgcacctgcggcgacgtggacttcctgctggtcctgcgcgacgacgagtcggaggccaccgaggagctgttccgccgggagggcgtcacgaaggtgccccacttcaacttctacaagggcgccgagaaggtgcacgaggaggaggccatcggccccgagcggctcgcgggcgacgtcctctactacggcgacagccactcggcggtggtgcagctgcactcgcgggaggacgtggaggcgctcatcgacgagcaccgcggcgacaagggcaagctcgtcgtgctggacgtgggcctcaagcactgcgggccctgcgtcaaggtgtaccccaccgtgctgaagctgtcgcggtccatggtcgacaacaccgtcttcgcgcgcatgaacggcgacgagaacgacagctgcatggagttcctcagggccatgaagatcgtggaggtgcccactttcgtcttcatcagggacggccagatcgtcggccgctacgtcggctccggcaagggggagctcgtcggtgagatcctccgatacaacggcgtcagggtcacctactgaagtgaagtagtgaacaacaaaccagtcagagtcagagcaagcgcaagccgacaagcaacgcttcgatacaaaattgaagacgatacaaaattttagattactgcgacgtccatcgacgattggtcgatgtttagactgtttattgtgtaccattaccatacttgcccgttaatcgctactattcaatagtaatagtaggcttttgtagggctagcagctgcttgctgctttgcaactttaatcttgtttggtgatctatcaggttgattgtccaactagtgtcttgcaaagttccaagtttacatgttcctgcagtcgagaaaaaactgtaatttttcatttcacacatgacaagattttgtttcaaccttgccaattgtcataccccgaaaaacctataaaacaaacaaggttccaggttcaccaaacatttctcagacccatctagaaggtctgaaaatatcgcaaacatgcattttttttttccccggagacccatctctgcaaaggacaataaagcgtgccgagtgccgacactcgacacctcgttaaaaacgaaaaatagaaactactaaaaaaaaggcgtggcgacgatgtggctggaaaaatatcaagctccagctgcgggagttgcattgcaccgtatccaccagttttacacttcacaggaaattatgcatcacattcacatattgctttcacaactccaagatctgtttgctagggagtacgggtttgttcgttttgttggagtccggttctattcaagactagctgtatgcccgtacgttgttacggcgacaatatattataataaaatccactaatatgcagaaacattaatcatcattctatatattacattatttcacttcaattagcctagtttaggtgattaagaatggtggaagcacggaggattttcttcctgctagcgcttgcagtgtgcttgaaggaagactggtgaaggaacagaatgctgaaggtcgggtcgctgttagtaaagtgaaggagttggtagaaggcttctctagtggcagtgtctctcgagactttatcagtagcagggttgggcagatgatatttgatgaatctgaagtgttgttcatgagtggtccatatggagattctgttcaatacaagaatggtgaacccacaaaacagtttgcaaagtgcgatggtgtgagaatcctctctaactcaagtatgatagttatacaccgagtctcagtctttattacatcatctgttggcattggaaacaagattccagcagcattactgtacaacgttcgtgatcactatggcaggcagaacaaaggcagtgtgcaacttggaataactggactgacacaatggtggctcaatgcttttagttcaggaaacagtggtatggcagttcagtcacagccaaacattcaaaggaactccatgaacaaattaaggggattatcgtttagaatggtgtacgataaaggcaaggagaatatagtggctgatacattttcacaagggggttcacttatggctacgtatggtgaccttgctattcaaatagatatacctaaatctattgtgactaattcctatgctctggataagttgccaatagtgaccatccacagtccacatggggttgtgtactcagttcagtggggcaaagttaaaaggctccatcagttcgggaagcagtgtttagtttctgagcaagcgaaagaagagcaacagctctttggtgggttctggcatttgttttcagtgctacaggggatctgggagggcctaaagtcagattttcttgaggattttctcatacctgaaggctatgattttattatgatgcttcagtgtgttgcccaggaccatctcccacggtggaaaaccttgctaccatttgttgaactgtggtaccgccctgataagaatgctagcaacccagaagcatcagaactcttcaaagaagttgcatattcttataacatcttgtcagatccagagaaacaaaggcagtatgataatgttgaatttgaagcattagaaaatgaaggagtggatatggaaattgaattgtcccatcttggaactgtgaacaaatgtttgcagcatgtttttttgcaaacttggtgttcctctgaagaccataatattttctactgtgctggaaaaggccatgaatggtacagttacggtgagaccactccctgttggaacatcagctatgggaaaagttgataagcaatgtgctcattttttttggcgtaccaataaatgaagaacaagcacattctggaaggaagatagtcaaaagactggcaagctaacatcggcacgcatgtatttcttgcatattcagagatggttgtttggactaaaaaaagaaatggctagggctcaatggcactacaatgcagcgaaggcttgtttcttttctattgccttgcttggggacaagcaagttttggcgaggaggcatatgtcacggccgatacctaagcacaaccacgacggaggagacaggaggcggaatgtgggtgtgtggcgtatgtaatgtttgaattgattgtaactgagttgggagtgggccgcgacggcgggtgtgagtggcccggactgtttggacgcctatataggctgccggnatgtaacaacgaaggacatcgaatgaataatagaaacatttccagaatactgtcatccttgtcatcctgagtctttctcaggtacgacaacgagctcacgtcccgacgacgatcgccggtggccaggggtgtgatagacctcgaagtgcgaggctttggggagaggtggtgcaccagctgacataccactcgattgccgctcgggctagagagcgacgacgatgaagtcgttcccgagggaccgacgtcgggggtcaggctatacagcctctatggtacctcgtcgcgaaggatcaaagtgatcccctcgtcgccggaagaanaagcgtcattaacagccatagaaaaatggagcgatctggctggtggggcgaccacganggccagtcgacttctgtaccgtcaatcgtgtccgggcatgagggcgcactagagacaagacttggacgagcagtccgctcgatcgaacaacaacaacggaggtgtcttcatctggtgaagtctgcggttggcaagcagggcacgacccctatccatggagggggcagtaccacatcggacagagcggttgctggatctcgaactctcgcaaccggtctgcagcccgctacgacaaaggcggtcacacccgttaatcaagacatggcgttggtggttgttgcggcgttgctggggccgacgccgagatcgccaccagtccggcgaacacgctcagggtcaaatgtggctcgtgtgtccttggtgtggtgcttcttggcatggcggcagcacgcaaaaggcggcgtgcaacgacatgagcacctcgccgctgatgatgttcgccactcaaagaccgaaagaagaaagtgagaagggcaacagagaaatctttgaagaacattgtatacccgatggttttcctcctccctattattgtcgtcagtgaaaccttctggcttgccttcggttcttgtgcgatggagttctttggcctttcttccactctggttttgtgaatgtagtgctgataacgtgttacgtgaaactattgtatgagaatggacagcgaatgaatctcgtgccttttctctattgcattaatatttgtacaaggattaggaacatgaggagtttaacggcgagggacatgcccactcgcccgttcacgggaaaggcggcaacgttaggggtcacgacccttgagaatagcaactgagagcagtttgctaaatgcttacgctaaatgcttagactttgcaactcttcacctttttcacttaggtaataccattttttcaaggtattttcgtctttttacgtaaattagcttatttactcaagaaaaaatagaatcccttgaaaaaatagagttgtcaaactagctataaactagaagtatcccagcccaaaagatatcaaaacgcatttttaaatataaaataatcatatatgacgtccatttacgcatatgcagcaaacttgataactaaagtttaataattacattgactaaccagcgaggcaacagacttttggaaactcaaactgctacaatgttttgcgttgagatcgcagaaaccatggagcaagataaaagagcgaattgatgaaaaccaaagcattaaaagagcgaaatatttttttttgtggggacgggtgggatcaaatgtgtaaaaaaaactcgcaaaaaaaggtggcgtcagaaagcaagataactaagatctgccgaaataaatactcaacattgcgagtcaatggaaagcacatgtaactttgacaaggaccaaacaagaacaaagacaacttagcgaatgccaatatataagttaaagagaaacagttggcgtccatagagtgatgtaaaatgtaaatacatagaaacttgttaaacagataacatggaacttgtacaaaaaaacagctggattcagcacaactttgtcattcagactcagttccaaattctggttagaacaccacccagcgagttaacgtgacatcacaccagaaatttccagcgcctgatgaaattttactacataaactgaatttagataacaataaacagcaatctggaaaagactaaccacagctaaccaaagcaactcgacattttctccacacaacccaagataaaaggtcagtaggtcacagcaccacaaaattacttagatatgcaagtctatgcgaaacctagtataaacgtgcgtgtcagtaggatgctacatcccaaacatcatagtgaaggaaacaagtgtgcatcacacctatacccaacaccaagaatgaaattggtcttaatcctgaacatcagtgaccca

SEQ ID NO: 1911 - DNA, 4017 bp, Zea mays
ctaatatcatttgaccacataaacttcaaatataacaacaatattatttcgtgtcgggctgtgctttagactcctatttttgaaccgtactcgtgctggcccgaaaagaccagcccatattcccagcactactcgcaacgatgtcatcttgcggacgtttcgttgtgaactaccggtagaggtcgcaaaatttacttggtttcataggatttagattctattctaaaatactttacgctcttacctttaaatatatacttttttatcaatttttttttctttcaatacatgtctttgccactctcgttttccaaggcggaacgtgaatgtctgcacgcaggggggatattctggccgcaggttcgttggcggacagcgaaagtgtagcagcagtagttgccagtatgatcagctagctagcaatggctactggcgctggagttagctgattgcggcatatcgttccttgttctctcttcagtttaggagcaacggttggcccggttcgggcgggcgattgtgatttaggcacctgccattggactcctgcgtctacgtgatgccgggctacggccttgcgggcatatcacgtacaacgagtagcggttagagaggataccgtacattatacgagcacaacagcggaacggcgaggtgagcaggcgtagcagcgacgcgacgggaaccgtgctcgttccgtagtgtagtctgccctccgccgcgtgggaactgactcgagaccgcaaacgctgcgtgtggccacgtctgtacgcgccccgctgccgccgccgtggccgttcgtccccggccgtcttggagcgagtcagcgtccgtcgccgtccgcgttccgacgcctccgtctgagacgaagccaactggagcattatagcgtgcgtgacatctatctgtggaccagtccacgccacgcttcgcatggaactcgagggcgatcaaattaataatcagacagacagacagacgccccccagcttgcattccctgctgtgctggcctaaaactgggtacagagactccaaaaaccgtgccatttgtcatcgtttttatttacgaggcgatgagtgggatcccattacggaaaaaaggcaggaggggattcctgcgccggaaagccaactgtggcgccactacgcactgtcctccatccttccatatgatgcatgtaaccaaagaaacttgtggcgaaaacgggaagagagatgacaggatggcacgagcaaaagaggagcgcagctgaagggacgaagacgattgcgaccgcccgtctttcggagaacgatcaggttgtacaggctgcctcttgcttcagccccagcactactagctagctaggaggagcgacacggacgggccggcatcaggtgctgatcttctaccaacaacagcggataaatagtcgtggttctgaaagcttgcccgcaccaaaaaaaaaaacatggctccgcaggcgcggaaaatggagtgcttctgcagaaacgcgtcgggtgggtcgttggaacggcaacgttgagccgacgcgcccttcttcgtgccgaattcgctgtcaacgagagctttcaacggtaacgatgatgtgcctgccagggaagcgtccgagcaagaacaaaacagtgcgcgccatagcccacagggcgggtgaaaactaccctgcaccgcatatatatatgagtagctaagcatggagttgttattatttaaaccttaagctacccggccatgccaatccaagctatggaaaagatcaagaagtacgggtatggcctatccaaagcataaactgggcaccaccgcgcgcatataggatgatcatgttggaggtggcaaaaatggctgtagcatgaactgggcttctggtgatctgtaggaagcaactgacaagcttccggttacagttgacctatactgtgtgccatgagtacttcacctgctcaagtttgtagacgggtaaaaggaaatattagtacggtagtaccgtcaactagagccgacaggtcaacctctaatagcgtgtttggctggaggagtgatgaattctatagaaactaaataaaataaaatgtaaggactaaaaattagtcctagaaactaaatatctctagtgtaaatctttttttaaagaacagaccaaacaagaaagacgttaaaacgcactgattaaaaccgagtctctctctggtcgtcgtctccgcgtccactctcttcaccatctccacccctaaagcccaccgattaaaaccgagtctctctggacgtcccccgcgtctaccttctctatctccacccccaactccccaagagccgatcagaccatttgtaccgacccccgagaggcgaccaggcagtccggaagcgcgtccgtccgttggtgctgctggtgccttgtggtcgagcgatgtcgaacgccgccgacgtggaggcgggcgcccaggcgagggcggcgccggcgacgacggggatcaagccgcccccggggcggtacaacaacatgaccagcaacgggccgtacacgccaccgtcgccgttctactacgaccccgcggcggcgcacgggcggcaccactggtcgtggctggtgccgctggtggtcatcgccaacgtgctcatgttcgtgctggtcatgttctacaacaactgcccgcgcagcggcggggactgcgtcggccgcggcttcctccgccgcttctccttccagccgctcaaggagaaccccctcctcggccccacggccgccacgtaagaatcgccacctctcgccgcgcgaattcatctccttcccttccatccagcacaatccgctggactcgcgacgcctctctgggtctcatctcatctcgtctgatctctaatctcccacgtcgtcgtcccgccgcgcgcaggctgcagagatacggagccctcgactggtacaaggtcgtgcacgggaaccaggcctggcggctggagtcgtgcacctggctgcccgccggcctcatccacctgctcgccaacatgatcagcctcatcttcatcggcgtccgcctggagcagcagtttggattctgtaagccccccaaacatctgacgcctcggcctcgctctgttctgccaagaacagacaggctcctccgctgtgcagctgcatgcaacgcacacggacgcggctttctgaccggcatttcccccctcgtcctcctgcagggaaggtgggcctggtgtacctcgtctctggcttcggagggagcgtgctctccgtcttcttcatcaggaagggcgtctccgtgggcgcctccggcgcgctcttcggcctcctgggagcgatgctgtcggagctcatcaccaactggtccatctacaccaacagatttgcagccatgctgaacctgatcatcatcgccgccatcaacctggcgctcgggatactcccgcacgttgacaacttcgcgcacatcggcgggttcgccacaggcttcctcctcggcttcgtgctgctgatccagccccagttcgggtggctggagcagcccttcggtgccaagaccaagtccaagtacaaggcatatcagatcatcctcctgcttgctgccctcgtcttgctggctgcagggttcgctgttggattggtaatggtgttcagaggagagaacggcaacgatcactgtagctggtgccactacctgacctgcgtgccgacgtcaagctggaagtgtgacaattgaactgatcagagattagtgacgggttagcatgcttgcgtcgtacagaagagaacatgcgtccccaccacgagagacaatgtcaagatagatacgtgcccctcaccttctatgacattgtcaatgtattgctttcaagtttgatttttaaagtctgcattgtacagaattctcctgcctccattggatccaaatgaggagtttattggtattttttcttgtatatgttaaaaaaaactctgtaaatcactctgcctgtgttctggtttatggttttattcattgattccctctgctgtgtcaaaaa

SEQ ID NO: 1912 - DNA, 3460 bp, Zea mays
gaatttttaatgaaaataaaatacaaatgaaacccccacacttggaatagcataatacctcgtttcgtgtagatattggagcacagaattagaaattagaattggatttccagaattctatttttggttgcatatggcattgagatttagaatcagagactcaattctctggaattggactataactagaaactctttctcatgatacagaacttcattcctgtattgaatgtaattagaccacacaattccaactctaatccagtgacatccaaacaatagaattaaaattacatctcatttcagtatcatgactaatttaatattgaacctaattcaattccatgccctacaacatcaacctccaaacggagcagttagagtcacataaaaataaccagggcaggaaaattagaaaattttaaaaatgaacacataattagaagttcagttatatacaaaagtgacctgggctgggcctgagcctggggcttgctggatcagaccgaaacaacatccaggtctgctggaggcgccatacagtcccggatcccggtggtttacccctgcggcctccgccgctccgcggctctgcctcttcctccgcttctccttgccccgcgtgcgcgaccgacgccgccgccgcctccgccctaagagtcttcgtaggacactccgtcaggaattcttcgggacccttcgccggcgacgagtacatccaccccttcccttcatgctatgctgaaaccaatcactcaaaccctaacttcagctatttgtattcggttcgaatctaattaccagcatgtacatgtattatgcctaccaacatcgattttgttttgcaaattttattgggtgtacatgtcttttactgggtccgcgccttgactcgatttgagtctgtatatggtcttggtggctaattagccaaccacataccgcagccagaccatggcagcaacccctgtgtggattggtcagtaagcacacctatattaactcgtgttgtgccaatcgaaggtgtcaccctgcctagtgtggttccttatctgacaccaactcacaactcggcatgaaacaactgatttttatagtttcctgtagatcaatatgaaagtgttttcctcgcaaaaggggaaaaaagaagagatactgaaatttagtgcctatagtgttcttctggacccagaccctagaccaccccactcaggttggagcctccggcactggctctgcctttttttactgttcttttagacctgatgctgaatgactaattgactattctcgttttgatattctgtaacgtcttcgcgttttatcttgaggtttgtggatacagagaagcatggtgactcattagccacttgcatgcttcacctagatatgattttcgcggctgtcttatataatggtctcatgggttggagacagtgctgtcttattgcatattcacggaagagtctgaacagttaaggggtaccatttaactgcttcttcttttcagctcaatactagtaattttttcgctattaatctgagatatcctcagtcctaactttaatctagtactgttgatatcatgcattgcccttattctttgaaactttgaaaaataatgagggactatatgtttcacaattcttgcatacacctaggggtgataatgggctctaaatttcacactacgaattttaaggatcgtatcattttaggatcagactctatttcaattcatttttaaactaaaattaattaagagttcaaacgaatcgtgaagaaacatttggatcgtaatccattaccacccctacatacaccggtccctttcatagtttttgtgtcttgacaatgaaaacgagaggatcttttggtgcactattttctatgtttgtgtgttaacaatgaaatgagcatctgatgcactatgtttcaatgctatattttatcttagcaccagtattcaattatgcctagagccctcgacattttatgacctgtcaatgttgagtgggcataatatctcctgacagacaatgttatgatgtcatacttttactcatgatggttggttggaatatgcatttttgcttattctaaattttataaatactctaatcattgagatatagtaccgatgtggttcctgaaagcctagtccttgtatggttgcactgcactctgtcaagccccagttacaaacatatttttaaacaagtcacttagggtgtttaaagcgagtttcagttccctttgggagtactgcatgtttggcatttttctgtgtgtttcttttgggtgatgtagctttcatacttttattcgtacgtgaatggttgattggaatatgcattttttattattctaaatttgagaaatactccaatcattaggatacaataccaatgtgactcctgaaagcctagttcttgtatgattgtattgcactctgccaaacccaattgagaagtagttttgtaaacaactaacctttgggtgatgaactggtttctctcgtgctatggcttacatctgtttgcatcatttgcagtctgacgtgacgatgtctggtcatacccaacctgaaggaccacaccaacttgattcaaaacatgctgcaaattcatgccgaaagaatgtacccggtacatcgttcgtctcagatttgagggatcacatccacgagttcatcaatgcctctgcagatgaacaccggacatgcttcacaaagactctcaaaaggatgttcgatatgtcaaagactgtcactgatagatcctctgaagcagaggaagctggacccgaaagtgtcttgccacttcagaccacagtgtcgcggtagaagtttcgccacttcatattgcctccgtagaaataggataaagctagaaagcctcgccctccgcggatggagaaatttgttattttgtcactctcaattttgactctattaggtctataactggtcggatcatctgtgtctatgatttgtgggtctgattacatattgacaaagcccacagataataatagcaaaattaccaaaaaaaaaaaaaaaggaggccagttgcccagactaatacgtttgtacattgaatgcaataattttagattatatggcttctggattttgattttcaatgactaatgaaacacaatatctctggaacaagagtcaacaggattaaattattaggaaaaattaaaaaaaactagtattcaactgcttccataaatctgtctcaactttttgatagccccaaaaccccccctaatttgtagttacagatagtgcgattttccctcttataaaggctagtttagaaatactattttactaagggatttacattttcctaaaaacatttagtttattttttcttggaaaaattgagatttccaaactagccctaatactattttccattgccacatgatcacgaatcccactgccaca

SEQ ID NO: 1913 - DNA, 775 bp, Zea mays
ggcttgctggatcagaccgaaacaacatccaggtctgctggaggcgccatacagtcccggatcccggtggtttacccctgcggcctccgccgctccgcggctctgcctcttcctccgcttctccttgccccgcgtgcgcgaccgacgccgccgccgcctccgccctaagagtcttcgtaggacactccgtcaggaattcttcgggacccttcgccggcgacgatctgacgtgacgatgtctggtcatacccaacctgaaggaccacaccaacttgattcaaaacatgctgcaaattcatgccgaaagaatgtacccggtacatcgttcgtctcagatttgagggatcacatccacgagttcatcaatgcctctgcagatgaacaccggacatgcttcacaaagactctcaaaaggatgttcgatatgtcaaagactgtcactgatagatcctctgaagcagaggaagctggacccgaaagtgtcttgccacttcagaccacagtgtcgcggtagaagtttcgccacttcatattgcctccgtagaaataggataaagctagaaagcctcgccctccgcggatggagaaatttgttattttgtcactctcaattttgactctattaggtctataactggtcggatcatctgtgtctatgatttgtgggtctgattacatattgacaaagcccacagataataatagcaaaattatcaatcgctcccgctgaggaggccagttgcccagacaaaaaaaaaaaaaaaaaagcttatcg

SEQ ID NO: 1914 - DNA, 1193 bp, Zea mays
ttgggtacctcgaggccggccggaattgccgggctccagtgctgggcgttgtatgagaggtgagcctcccggtggagcgtgggtggtgctgggtgccggggatgagctgcaacgggtgccgcgtgcttcgcaaggggtgcagcgacgcgtgcgtgctgcggccgtgcctgcagtggatcgacggcgccgaggcgcagggccacgccaccgtcttcgtcgccaagttcttcggccgcgccggcctcatgtccttcctcaccgccgtccccgagccgcagcgcccagcggtgttccagtcgttgatgtacgaggcggccgggcggacgatcaaccctgtgagcggcgccgtggggctgctcggcgcgggcagctggcagctgtgccaggcggcggtggagacggtgcttcggggcggcgccatcgggccgctgcccgagttcgacgggggccgcgacaacacgtttgctctggcggcgacggcgaggcgggccgtggggtgctcgacgttctccacggcgaagcggggggcgccgacgagggcgaacgtgggggcggcgcctcccgtcccgccggagccgtcgtgcgacctcgggctgtggctcagccccgggtcgtgcccggcgccgggcgagcggcggcggcggcggcccggcacgccgtccatgacctccgaggagtccgtgacgacgacgagcggcggcggcggcggtggagggagggagcccgagctgctgaacctttttgtctgagactttagctacaccgacggcctggctaaaaggccagcggccgatcatgtttcatgtggcgcccctcggcgcgcggtgtgctgtatgcttgatctgatcccggcgaaaacgtctgtctagctagcggcgtctcgccggcgaggtacctgtagtcttcttcttccttttttgggcgcgtagaaaccatgggccaccaccgcccaccggtgccggcacctgcctgcctgactccgtccgtcaactgtttattttgtttcttcccaactttgttggcaagcacaaagcagcgttaccgctccgtcgctgaataatacaattgtaaaccaagggtaaaaaaaaggcggcggcacgcgcgccaccgccgccgcgcgcactctacgcgccgtcgagaagagtccctttcggtgccgtgatcctatccgcgccgcgacccggggctagggt

SEQ ID NO: 1915 - DNA, 1580 bp, Zea mays
ctgcagtgcacaagacaataacccacacgtcattcttagataaataatctatatgtatgtgcgaatcaaccaaatagatttctttacagagactattaaaatggaatcaacgaaacattatttttttctttttttaagtcactgtatccagtcaacctgtttgtactcatcgaggatatataattcaggtctgctatacgaaatttcattcatgtaacggaacacaccctaacaccgtgcgtaaaagcggtaagccataacacagttcaagagatgtgttgattagacgcctgactactgaattaggtttctgctagcactcatgtattctttcaggttaaaagcaaaggcaatttcgagagtaaacaactgatataaacttcaaagtggagttgcgcaactcccccccccccgcccgcgccaactttttaaagttcattcagtttctgcttcgcgtagcctcgtgccaggaaagcgacgaatgctgactggaaaggcgaagcactcgttcactgtccaccagtcgcgcgcacccaccactctccggtcttaggcacacggaggactacaaggttccacggcgcagggcgtcgtcctgggcgcggggggcgttcgtacgtgggcgtgggccacctccgcccgatgtgcggatccacgcatcccgcaaaggcgcggaaaggagtggcgcgcagcgacacgccaaagcacgcgccgggacggggcgagcgcgcggcgcacccgccgcaccacccgaggcgtgcgcccgatccccatccggcggtgcgcgatcgccccgaccgaacgcggagacacggagccgccccccgcaccccaggagcctggagctgctgagaggactttaccgcctcgctaacccacgtacgccgagagccggtatcctcaccaccacgcctagctaaccggacccgaccccttggttagctcgtggtcgtgggtcacccgagaccccccagcccttggttgcctgcgcggctgcgctgcgctttatatactaggcctccgctccgggtggccattggccgggctccagtgctgggcgttgtatgagaggtgagcctcccggtggagcgtgggtggtgctgggtgccggggatgagctgcaacgggtgccgcgtgcttcgcaaggggtgcagcgacgcgtgcgtgctgcggccgtgcctgcagtggatcgacggcgccgaggcgcagggccacgccaccgtcttcgtcgccaagttcttcggccgcgccggcctcatgtccttcctcaccgccgtccccgagccgcagcgcccagcggtgttccagtcgttgatgtacgaagcggcggcggcggcggcccggcacgccgtccatgacctccgaggagtccgtgacgacgacgagcggcggcggcggcggtggagggagggagcccgagctgctgaacccttttgtcttagactttagctacaccgacggcctggctaaaaggccagcggccgatcatgtttcatgtggcgcccctcggcgcgcggtgtgctgtatgcttgatctgatcccggcgaaaacgtctgtctagctaaaaaaaaaaaaaaaaa

SEQ ID NO: 1916 - DNA, 2142 bp, Zea mays
ccctggctggctccgcctcctccgttccgtctcatcgctccttcctcgtcagttgttgccaccacccctccctcccatcctctccgcgtcgcccccatcccatcttggcctggacacctgggctgcctcgctccgtttccgcgctcgcggacgcgccgagtcgccggccgaaccagtcgcccgcccgccctccctccctccctcccgccgctaccagcgtcgatctgcgaccgaagagcgattcagaggcagggtgagggggggagacgagttcttgtcggtttcattcttggccgccgacttcacatgccaacaaccccaaggagcagaagccaggctaggaccactaggccttggatcttgtcagggatggactttgctgattcgagacggaagcctaatttcacggggaagattgccgtggctgctgccctcacggtcatgtgcataatcgtgttgaaacagtcccctagtttcagcggcaccagcgtgttctctcgccatgaaactggggtgacccatgtgttagtaacaggcggtgctggttatattggctcacatgctactcttcgtctccttagtgacaagtacagggttaccattgtggataacctatccagagggaacatgggagctgtcagagttcttcaacggctatttccagaacccggaaggcttcagtttatttatgctgacttaggcgatgccaaagctgtgaagaaaatattttcggagaatgcatttgacgctgttatgcactttgctgctgttgcttatgttggtgagagcacaatggagccactcaggtactaccacaacataacatcgaacacattgacagttcttgaggcaatggcagcatataatgtaaatactctgatttactcgagtacgtgtgcaacctatggtgaacctgatacgatgcctattgtagaaacaactcctcagaatcctatcaatccatacggtaaggcaaagaagatggcagaggacatcatcctagattttacaaaatcaaagaagcaatcagacatggctgtaatgatcttaagatacttcaatgtgattggatcggacccagaggggcgactaggagaagctccaaggccagagctacgcgagcatggacggatatccggtgcttgctttgatgcggctttgggaatcattccagggctaaaggttcgtggaactgattactccactgcagatggaacttgtattagggactacatcgatgtcacagaccttgtagatgcccatgtcaaagctctcggtaaagctcagccaggcaaagttggaatctacaacgtcggaacaggccaaggtagatcggtgaccgagtttgtagaagcttgcaagaaggcaacgggagcttccatcaaggtcgaatatcttgcccgtagacctggagattacgccgaggtatacagcgacccgtcgaaaatcctcagggacctcaactggacagcccaatacacggatcttggccaaagccttgcccaggcgtggaaatggcagaaggcgcacccgaacggatatgcgtcagcctgattcagagctcaaaaggttgagagactcatcactcagattcatccaaggggtccgtccatgtgcagtcaatatagccttcagacgattggttcttcaccatagaaaaaacgtagcaacagcaacagaagagtcgtgattcttttattgcagagctggaagaagacaagagtatcgcagggagaatacactacctgttccttgattagtttcatttatatgtataggtcctcttttcgttggtgtcattttagtacaatttggtttaataacacacaaggaaatcgtgttgtagatagggtagatcaaatctcgtgtatcgaccttcgtcttcgtggtggtagaatgaaaggatatataaataagttggtgtatgtttctgttcccgtcaagtctacacaaggctgcttgcctgcttctgccaggtccagcgagttgagctcttaaagggcatgtacaatctagacactacgtacttcaagtataagatacaactaaaacacaacataatacagtggtcatgtctaaaacatgtgtcttatcatattcattatattaatcagagcattcaataaattaaagtgatcaatc

SEQ ID NO: 1917 - DNA, 1647 bp, Zea mays
aaagcgcgctgctccccacccatcagctctcgtatccgcagcgcccggaatggcggcaccctcccacgtcctcccgttcctgtcccccgccggcgggtgtgccgcctcctccgcccgcgcccactctggctaccgcgctggtctcctgcgctgctcggccgcggccggccaggcgggcttcttcactcgcctcggtcgcctcataaaggagaaggccaagagcgacgtggagaagctcttctccggcttctccaagacccgcgagaacctctctgtcgtcgacgagctccttacttactggaaccttgccgacaccgaccgcgtcctcgacgacctcgaggaggcgctgctggtctcggacttcgggcccaaaatctcattccggatcgtcgacacgctccgcgaggagatccgcgacggcaagctcaagtctggcgccgagataaaggccgcgctgaaaaggtgcatcctggaactgctgacgagcaagggcggcaactcggagctcaatctcggattcaggaagccggctgtcatcatgatcgtgggagtgaatggcggggggaagacgacctcgctagggaagcttgcttacaggtttaagaacgaaggagtcaaggtattgatggcagcaggtgataccttcagagcagcagctcgtgaccagctagaagtttgggctgagagaactggttcagagattgtcgttgacaatgacaagaaggcacagcctccagcaggcagtaaagcgcgggaagcgtgaagggtttgatgtggttctatgtgatacatcaggaagacttcatacaaattatggtttgatgggagagctggtttcttgcaaaaaagtcctagctaaagcgcttcctggtgctccaaatgagattttactggttctcgatggaacgactggcttgaacatgttacagcaagcaagggagttcaatgatgttgtaggagtcactggattcatcctgacaaagctcgatggcactgcgcgcggtggctgtgtggttagcgttgtggatgaccttggcatcccggtgaagttcattggggttggtgaagggatgggaagacctgcaaccttttgacgccgaggcatttgttgaagccatcttccccatgattttgggttttggagagataattcatgcttctactgtaaagctttggactctgccgttgctttggctcgttgtgcgagtttttttctcgttgggaactacgatagtggtaggaagcacagtgcccgagtcaagatgaactggaactggagttggggcaaacaaagtggagcgtccagcttggaacctaagggctggtttggtaatcagagaattggataggagaaatctccttattgaagactagtttggtgagtagagaaatgcaggggatggaaaatagagggggttcttcatctatgggtcctcttcatttctctggtcactaaattagtcctggatggattcttctcccatagatcccctaaaatttcccacccccccaatcagtcttaaactgttgagttgcaccaggaggattcagagaaagaattggagaatatactcgatcctatttttttaaactccagttgtaacaaaattcttggatgtactgaatcgatccaaatctgtgccgcct

SEQ ID NO: 1918 - DNA, 2069 bp, Zea mays
attggggcccccctccgccgcacctgcacctgcctgcctccgtctcctcctccttcagttgttgccaccgcccttccctcccttcctctccgcgtcgctcgccgtcccatctttggcctggacacctggcctgcccccccttcgcggacgcgccgggtcgccggccgaatccgccctcccgccgctgccaacgtcgatctgcgcccgcccgcccgcccgccaagtgagattcaaaggtaggacgacgggggggtcgagttcttgtcggtttcattcctggccgccgacttcacatgtcaacaaccccaaggagcagaagccagggtagtaggaccactaggccgtggatcttgtcagggatggactttgctggttccagacggaagcctaatctcacggggaagattgccgtggctgctgccctcacggtcatgtgcataatcgtgttgaaacagtcccctagtttcagcggtaccagcgtgttctctcgccatgaaactggggtgacccatgtgttagtaacagggggtgctgggtatattggctcacatgctactcttcgtctccttagtgacaagtaccgagttaccattgtggataacctatccagagggaacatgggagctgttagagttcttcaacggctatttccagaacccggaaggcttcaatttatttatgctgatttaggcgatgccaaagctgtgaacaaaatattttcggagaacgcatttgatgctgttatgcactttgctgctgttgcttatgttggtgagagcacaatggagccactcaggtactaccacaacataacgtcaaacacattgacagttcttgaggcaatggcagcacataatgtaaatactctgatttactcgagtacgtgtgcaacctatggtgaacctgatacaatgccgattgtagaaacaactcctcagaatcctatcaatccatatggtaaggcaaagaagatggcggaggacatcatcttagattttacaaaatcaaagaagcaatcaaatatggctgtcatgatcttaagatacttcaacgtgattggatcagacccagagggacggctaggagaagctccaaggccagagctacgcgagcatggacggatatccggtgcttgctttgatgcagctttgggaatcattccagggctaaaggttcgtggaaccgattactccactgcagatggaacttgcgttagagactacatcgatgtcacagatcttgtagatgctcacgtaaaagctcttggtaaagctcagccaggcaaagttggaatctacaatgtcggaacaggccaaggtagatcagtgactgagtttgtagaagcttgcaagaaggcaacaggagcttctatcaaggtcgaatatcttgcacgtagacccggagattatgccgaggtatacagcgatccgtcgaaaatccacatggaactcaactggacagcccagtacactgatcttggccaaagcctcgcccaggcgtggaaatggcagaaagcgcacccgaacggatatggaccagcctgattcagagttcaaagattgagagagactcgtcacgcagatccaaagggtccatgtgcagtcatgtagccttcagacagttggttcttcatcaccatagaaagatagcaaagagcaacagaagagtcctgattcttttattgcagcgctcgaagaaggaaaaaatatcacagagaaccccctacctgctccttgattagtttcaaatatatatatataggtcctcgttgacattttaatataatttgatgtgtgctgaggcgctatataataacacaaacgaaattttgttgtagacagggtagatcgatctcgtgtatcaacttttgtggtggtagaatgaaaggatataaataagttgatgtaaaaaaaaaaaaaaaaaacaaaatagagtttacataaggctggttctgccaggttcagcccaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaagggccccta

SEQ ID NO: 1919 - DNA, 1909 bp, Zea mays
aaagcgcggtgctatccacccatcagctctcgtatccgcagcgcccggaatggcggcaccctcccacgtcctcccgttcctgtcccccgccggcgggtgtgccgcctcctccgcccgcgcccactctggctaccgcgctggtctcctcattgggtccctcgaggccggccaggcgggcttcttcactcgcctcggtcgcctcataaaggagaaggccaagagcgacgtggagaagctcttctccggcttctccaagacccgcgagaacctctctgtcgtcgacgagctccttacttactggaaccttgccgacaccgaccgcgtcctcgacgacctcgaggaggcgctgctggtctcggacttcgggcccaaaatctcattccggatcgtcgacacgctccgcgaggagatccgcgacggcaagctcaagtctggcgccgagataaaggccgcgctgaaaaggtgcatcctggaactgctgacgagcaagggcggcaactcggagctcaatctcggattcaggaagccggctgtcatcatgatcgtgggagtgaatggcgggggaaagacgacctcgctagggaagcttgcttacaggtttaagaacgaaggtgtcaaggtattgatggcagcaggtgataccttcagagcagcagctcgtgaccagctagaagtttgggctgagagaactggttcagagattgtcattgacaatgacaagaaggcacagcctccagcagttctttcgcaggcagtaaagcgcgggaagcgtgaagggtttgatgtggttctatgtgatacatcaggaagacttcatacaaattatggtttgatggaagagctggtttcttgcaaaaaagtcctagctaaagcgcttcctggtgctccaaatgagattttactggttctcgatggaacgactggcttgaacatgttacagcaagcaagggagttcaatgatgttgtaggagtcactggattcatcctgacaaagctcgatggcactgcgcgcggtggctgtgtggttagcgttgtggatgagcttggcatcccggtgaagttcattggggttggtgaagggatggaagacctgcaaccttttgacgccgaggcatttgttgaagccatcttcccatgattttgggttttggagagataattcatgcttctactgtaaagctttggactctgccgttgctttggctcgttgtgcgagtttttttcttgttgggaactacgatagtggtaggaagcacatggcccgtgtcaagatgaactggaactggagttgaggcaaacaaagtggagcgtccagctttggagccctaagggatggtttggtaatcagagaattagatagggtctatagcggagaaatctccttgttgaggactagtttggtgactagagaaatgcaggggatgagaaatagaggggattcttcatctatgggtcctctacatttccctggtcaataaattagccctgaatggattcttctcccatggatcccttaaaatttcctattcaccaaatcagtcttaaactgttgagttgcaccaggaggattcagagaaagaattgtagaatatgctcgatcctattttttaaaactccagttgtaacaaaattcttggattaactgaatcgatccaaatctgtttcgtttctaaaaaaaaaaaaaaaaaaaaaaaaaaaaacagagctggaagaagacaagagtatcgcagggagaatacactacctgttccttgattagtttcatttatatgtataggtcctcttttcgttggtggcattttagtacaatttggtgtaataacccaaggaaatcgtgttgtagacagggtagatcgaatctcgtgtatcgaccttcgtcttcttcgtggtggtagaatgaaaggatatg

SEQ ID NO: 1920 - DNA, 2250 bp, Zea mays
cccctaaaacaccttaagagcccccatattaaacaccactgtacatgccctaatgacctagtactaatcactggcggccaagaccagggatgatagctcgtgcgggccccacggctcccatgacccggcatcggcacgtgggccctcgccacccaaaaatccacgagatcaacatttctcgtgttttcgcttggcccgcgacggcccacgtgtccccaagcccacgtcaccgtcgccgcccatgccccacctaccggtactatctactctctctctcctccggcctccgccttcgacaagcgcgcccacccgcgcgacagcgggcgcgcgcggctgcgactgctgctgctgcttcttctccacttctccttccttcccctataaagcaaggaatagtcgcagcttgccccagcttcgcaagctttccgctaaatccctgccattagtagcaagcaagaaagcagtggtagtaggtgccacccacacggttttcacggctgccggctgggagcgaccgaggagatcgtcgtcacgctcgatggaggccctggtggggaggtactggggtctggggggacggcggtgcggggcgtgcggcgggtcgccggcggcggcgcactgccggacgtgcccgggcggcgcgtacctgtgcgcggggtgcgacgcggggcacgcgcgggcggggcacgagcgggtgtgggtctgcgaggtgtgcgagtgcgcgccggccgccgtgacgtgccgcgccgacgccgccgcgctctgcgccgcgtgcgacgccgacatccacgacgccaacccgctggcgcgccgccacgagcgcgtccccgtgcagcccatcggcgccgccgctgatcccgccgcggagaaggcggcgctgctgttcggccttgccgcggaagggaaggacggcggcgacgcggccaaggtcgtcgtcgacgccagtaagctggacctcctgttcgcggacgacgtggtcgacccgttcctcgcccaagacttcgccaggttcccgcacgccgacagcgtcgtgccgaacgatggatccagctgcggcgccgctgtggacttcgactttggtggcggcgtcgccgtcgccgccaagcagccgtcctacagctcctacacggcggcgtcgctgggccacagcgtaagcgtgcctttttagtgaagtggttctgtcaccgtgctcgtgattattgtttttctattcctaatcttcctttggttttggtcgagcagggctcgtcgtcggaggtcggcctggtcccagacgtgatgtgcggccgcggtgggagcgtgaccggcggcgtcatcgagctcgacttcgcgcagtccaaggcggcgtacctgccttacgctgcaactcctacccacagcgtaaggccatgtgctctgcgctcccagtcccagctacagaacagtctgctttgctttgcgatcaaaacgcgaagagcacgtaagtgcatgcatggagggtgcaccgatctgaacttggttttctggtaatgtccagctgtcgtctttggacgtgggcgccgtgccggagcgcagtgacggggtcatggcgggcaggctcgcgacgccgacgccggcgacggccacggagagcagggaggcgcggctgatgcgttaccgcgagaaacggaaaaaccggcggttcgagaagacgatccgctatgcgtcccggaaggccgccgccgggtcgcggccgcgcatcaagggccgcttcgccaagcgcgcggatgacaacgacgccgacgccgacctcgacgaggctgccgcgccggctccgccggcgcggtcgcagccgcagccgcagccgcagccatcgtaccgctacgtgctcgacttcgccgccggctacggcgtcgtgcccacattctgatgacgcgtgccgtgtgagtgttgccgcgcgcgtcgcgtgccccatgttttcacggattgggccggcgcgcgtgcgagccatgctgcatgcgcgcctacgtgtttgctggagcggcgagctcctagttggcgatcacatgccgttttgggctagccatggttaaattagcaggctagcgtgtactgctgctgcgtttgtttgctggggcgaccagttctactaatagtacgtagtaccgtgtaattttgggtcaggaagagatgcttagcatctgtttcgattgatcgatgtagtattatgctataattggaaaggcctctcgatctatttgcccgttgcgtgcatgtgcttaatccactccc

SEQ ID NO: 1921 - DNA, 4427 bp, Zea mays
  misc_feature (3376)..(3376): n is a, c, g, or t
  misc_feature (3401)..(3401): n is a, c, g, or t
gatttcatggtaggggacttagacgtggtaccactaccgcctacaggctacagcccaccgcggcaccgctgaagacaccccaaaacctatcccaatcggccgcgcctccgtccgtggctccgcctgccggcgacccctcagatccgcgcgccccgtaccacctcccgccgcctcactgccagatccggccctggctccgcaaaatcctgcgacatcgcagacgagccgggcgggagagcggaggtaggtcacagcagccatggcggccgcagaggagaacagctcgctgttcctgatttttatactcaccatgatcgcgctgcccctcgtgccctacacgatcctgcgcttgtgtcgcgctgcctccgagaaggcgaagaccatccactgccgctgctcgggttgccaccgctccggcaagtaccgcaagtcgatctacaagaggatatccaacttctccacgtgcagtaacctaaccatccttctgctctggattgttatgatattcctggtttactacataaagcttgttagccgtgaggtccaagtttttgagcctttcagtattcttggactggaagctggggcatctgaatctgatatcaagaaatcatataggagactttctattcagtaccatcctgataaaaatcctgatccagaggctcataaatacttcattgaatatatatccaaggcatatcaagcattaactgatcctatatctcgtgagaattatgagaaatatggtcaccctgatgggcggcaggggctgcaaatgggcattgctttgcccaagtttttactaaatattgatggtgcatctggtgggataatgcttcttggaatagtcggattttgtatattattgcctttgatgatagctgttatttatttgtcaagatcatcaaaatatactggaaactatgtcatgcatcaaactttgtccacttactactactttatgaagccatctcttgctccaagcaaagttatagatgtcttcatcaaggctgcagaatatatggagatgccagttcgacgcagtgatgatgaacccctgcaaaaattgtttgtagctgttagaagcgagttaaatctggacttaaagaacattaagacagaacaagcaaagttctggaagcagcatccatcactagtaaagatggaactgctgattcaggcgcatctcacttgtgagtcattcgctttgacgccagcacttcttaaagattacagacacatgcttgaacttgcacctcgtcttctggaagaactcgttaagattgcagttttaccaaggaatccccatggttttggatggctccggcctgcactcagtgttattgagctttctcaaaatattatccaggctgtaccattaagtgcacgaaaagctagtggtgctaactcggaaggaatagcgcctttcttgcagctgccacatttcacagaagcaaccgtgaaaaagattgctcgcaagaaaatccgtgcattccaagaactttgtgacatgcctgtggaagatcgtgctgcattgctcacacaagttgctgggctttctgaagaacaagctcgggatgtagagtttgtactggagatgattccttctattgaagtagacatgaaatgtgagactgaaggtgaagagggcattcaagagggtgatgtcgtgaccatgtatgcttgggtctcgctacaacggcgcaatggactgactgctgctcttcctcattgtcccaacttcctgttccacaaggaagaaaacttctggctgcttctagccaacgtggcatctaatgatgtctggttgtcacagaaagtcagcttcatggatgaggccacggccataactgcagcatcaaaagctatacaagagacccaggaagcactaggtgcaagtgcaaaggaaataggaaatgcagttagggaggcagttgacagggtgaagaaaggcagtaggctggtaatgggcaagttccaagccccagcagagggtactcacaacctcacctctttttgtttgtgcgacgcttggataggctgtgacacgaagaccagcttcaagctcaaggtcctgaagcgcagccgtgctggaacaagaggccatgtgcctgaagaagggccagtggctgctgcagaggatggtattgaggaggaagaggaggaagaggaagaggagtatgatgactatgagagcgagtacagtgatgacgaggaggacgcgaagaacaagggggaagggaaggggaaggttgtgaacggatcggcccatcaaggggctgaatctgatattgattcaggcagcgatgagtaattctatactgtgttatgttgagaaaggaacgtagaggttgacaccatctgtttttttttttaaaattgaacgtatcccctccattttatagatggtcatagttactcagttttgtttactaataagttgagattgattggttacaaaagagccgagcaaaactagcttactatctcgagttgacctgaagactgcatggtcattctccaaagtgcaagcgtttcacccatgcctatcacctgtgtggtgtatgttcctcacatttattccgaatggcactgctgatttcttaaatttctggatcacctaattattattgttagacccatcatccaaaatattgttttacactgtagactacatagtttgtagaatggagtttgaattatccaaaatattgttttactatagactgaatagtacgtagaatgaaatttgaatgtggaaatattgttttgtattataaactgcacagttcttagaatttagaatggagtttgaatttgacggtaagtaagctgatgaagatagccttattacaaggagatagtgatgtaagaaaggttgctattaaaaattaagtctatttgtacgttattaaaagtctattagaactaatttggtgacaaaagaattggactagatttatggagagaaaatctttgctatttaaaattgaatccctatggatccttctaatttccttgtcgggcttcatggataatctaattgcatgtctatgtatagcatgtctttatactcttcatactaaggaatttgttgatctcatttataagatgtttggttggaggatacaaatggtagtctcataattttcaacctactaaaatatattttctatattttctttgggtacgaccttattctatgggacaattgcgtaagtgttcctgttttaggatgtaactcaagatttaccactgttttttagactttgcgtgtgtcggctacctaggaacaagaaatccaaaagtagacccacaacctccttttgacccattagccgaccagccctctgttgagcaatccagcgaggcngagcggacgactaggtcctctttcnagcaagattgcgagatggagcgaccaactctccgccgagcagccctacgaggcggagcaggtgaccaagaccccgccgagcaatcgcgtgaggcggagtgtccgactaggtcccccaccgagcaaccctacgaggtggagcgactgaccaactccaaattgagcaacactgcgaggcggaggttgagagcacctagagggagggggggttgaacaagcgatcctgcgaaattaactctaaacaacacaaacttggtttataatattgttagtgagaactaaaacaaagttaggatgagaagagagaagaaaggagaacgcttcacttgattgctgctttaagatgagtattaaacttagaagcaatattgcaagtaagcagagaactcaagaagacagtaatcataataagtaaaatggacaagatacaacaattcgtggtttggccaattcatactccacgttgtggtgacctcctttagtcaagggttgcactcaacccctctcaagtgatccaaagatcaaacttgagtgtcaaagttgtcttccttatattaatatcacgttgtgaggaatctccacaaattggagtctctcacgccttacacaaatgattagaatcaaattcggagtaaggaggggagtagaaacgcaccacaagagcacaacacaacaacaacacacacacaagcaaaagagagcacccgataaaaaacgacagagtcacacctcaagaacgcgctcaaatctttctctaacaaatcaacaacgtggtcacaaaagttccgagttgtggtgtgcacaaagtatgcttgggtaacatctccatgcgcctagagggtccttttatagccctaatggacctaggagccgttgaaccttcatgtggaaggctcttgttgtcttctgtccgctggtgcaccgcattgtccgatgcacaccagaccccgcacaatctatgatttgtttccttaaccagccgagctgaccgttgctcggtcgcttggcacatcagactgtccggtgg

SEQ ID NO: 1922 - DNA, 2464 bp, Zea mays
gccggccgggtcgcggcccgaggccccactccgtcgcgccctcgcgcctcctcaacttcgtctgcccgcgagccgggaaacatttccctcagatccaccggccctggagctcccgccgctccactgtaagacccgcccttgcctccgcgaaatcctgcgacatcacagacgagccgggggtggtggtgggggtgggggagcggaggtaggtcgcagcagccatggcggccgcagaggagaacagctcgctgttcctgattttcgtcctcaccatgatcgcgctgcccctcgtgccctacacgatcctgcgcctgtgtcgcgctgcctccgagaaggtcaagaccatccactgccgctgttcgggttgccaccgctccggcaagtaccgcaagtcaatctacaagaggatatccaacttgtccacgtgcagtaacctaacaatccttctgctctggattgttatgatattgctggtttactacataaagcatgttagccgcgaggtccaagtttttgagcctttcagtattcttggactggaatctggggcatctgaatctgatatcaagaaatcatataggaggctttctattcagtaccatcctgataaaaatcctgatccagaggctcataagtactttgttgaatatatatccaaggcatatcaagcattaactgatcctatatctcgagagaattatgaaaaatatggtcaccctgatgggcggcaggggttgcaaatgggcattgctttgcccaagttcttactaaatattgatggtgcatctggtgggataatgcttcttggaatagtcggattttgtatattattgcctttgatgatagctgttatttatttgtcaagatcgtcaaaatatactggaaactatgtcatgcatcaaactctgtccacttactactactttatgaagccatctcttgctccaagcaaagttatggatgtcttcatcaaggctgcagaatatatggagatgccagttcgacgcagtgatgatgaaccccttcaaaaattgtttgtagctgttagaagtgagttaaatctggacttaaagaacattaagacagaacaagcaaagttctggaagcagcatccatccctagtaaagatggaactgctgattcaggcacatctcactcgtgagtcatttgctttgaccccagcacttcttaaagattacagacacatgcttgaacttgcacctcgtcttttggaagaactcgttaagattgcagttctaccaaggaatccccatggttttggatggctccggcctgcaattggtgttattgagctttctcaaaatattgtccaggctgttccactcagcgcacgaaaaactagtggaggtaactccgaaggaatagcacatttcttgcagctgccacatttcacagaagcaactgtgaaaaagattgctcgcaagaaaatccgtgccttccaagaactttgtgacatgtctgtggagggtcgtgctgcattgctcacacaagttgctgggctttctgaagaacaagttcgggatgtggagcttgtactggagatgattccttgtattgaagtagacatcaaatgcgagactgaaggtgaagagggcattcaagagggtgatgtcgtgacaatgtatgcttgggtctcgctacgacggcgtaatggactgactgctgctcttccccattgtcccaacttcccattccacaaggaagaaaacttctggctgcttctagccgatgcggcatcaaatgatgtctggttgtcacagaaagtgagcttcatggatgaggccactgccataactgcggcatcaaaagctatacaagatacccaggaagcactaggtgcaagtgcaaaggaaataggaaatgcagttaaggaggcagttgacagggtgaagaagggcagtaggctggtaatgggcaagttccaagccccagcagagggtactcacaacctcacctccttttgtttatgcgacgcttggataggctgtgacatcaagaccagcttcaagctcaaggtcctaaagcgcagccgtgctggaacaagaggccatgtgcctgaagaagggtcagcagcagccgtagaagatggtattgaggacgaagaggaggaagatgaagaggagtatgatgactatgagagcgagtacagtgatgacgaggaggatgagaagaacaaggggaaagggcaggggaaggtcgtgaacggatcggcccatcaaggggctgaatctgatatagattcaggcagcgatgagtgattctacactgtattatgttgagaaaatcatagaacttaaccccatctattttttttaatttgaacatatccctattaagttgcatgcatcaatctaacccaaaagtttaatccgataagagttgtgcaattcacttatattatattccaaaaaaaaaaaaaaaaaaaaaaagtcgacgcggccgc

SEQ ID NO: 1923 - DNA, 1103 bp, Zea mays
cctgttgtccgtccgattccggtcgcccacctcccatttttgcagtgccatttaagaacactgtgaaaaagatgctcgcaagaaaatccgtgccttccaagaactttgtgacatgtctgtggagggtcgtgctgcattgctcacacaagttgctgggctttctgaagaacaagttcgggatgtggagcttgtactggagatgattccttgtattgaagtagacatcaaatgcgagactgaaggtgaagagggcattcaagagggtgatgtcgtgacaatgtatgcttgggtctcgctacgacggcgtaatggactgactgctgctcttccccattgtcccaacttcccattccacaaggaagaaaacttctggctgcttctagccgatgcggcatcaaatgatgtctggttgtcccagaaagtgagcttcatggatgaggcccctgccataactggggcatcaaaagctatacaagatacccaggaagccctaggtgcaagtgcaaaggaaataggaaatgcagttaaggaggcagttgacagggtgaaaaagggcagtaggctggtaatgggcaagttccaagccccagcagagggtactcccaacctcccctccttttgtttatgcgacgcttggataggctgtgacatcaagaccagcttcaagctcaaggtcctaaagcgcacccgtgctggaacaaaaggccatgtgcctgaaaaagggtcaccaccacccgtaaaaaatggtattgaggccgaaaaggaggaagatgaagaggagtattatgcctatgagagcgagtccagtgatgccgaggaggatgaaaagaacaaggggaaagggcaggggaaggtcgtgaacggatcggcccatcaaggggctgaatttgatatagattcaggcagcgatgagtgattttcccctgtattatgttgagaaaatcatagaacttaaccccatctattttttttaatttgaacaaatccctattaagttgcatgcatcaatttaacccaaaagttttatcccaaaaaaaaaaaaaaaaaaaaaaaaaaaaaaaaaaaaaaaaaaaaaaaaaaaaaaaaaactcgagggggggccc

SEQ ID NO: 1924 - DNA, 1481 bp, Zea mays
cattgggacctcgaggccggccggggcgtggtcactgccgccgctcggtcttgtgcttgtccaggtccaaccgtccaaggaaaaaaaatgagcacgaacctgggaggagcctcttgcttcggcttcggcttgactcagctgcagcccgccgccgttaggctccggttgccgcctgctcgcgccgcggacacttcgtcctcccagtcgccggcgcgcctgacggcggtgctggagcaggtggaccagttgctaagccaggggaacgacatggccgcgctctccctcgtgcgcagtacgcaggggggtgacggcgggctccgggcctttggcgccgccaggcaggtacctcaacgactttataaattggatgagcttaaactgaatgggattgatacttctgctttcctatcacccgtagatctgacactaggatcaattgagagaaatctccaaatcgctgcagttctgggagggctttctgtatcagctgcattggaactttctcaactccaaatcctgtttctcatactaggtctactatctttgtggtccgtggactttgtatattttggtggtggggtgagaaacttggttcttgatacaattggtcactatcttagccagaagtatcacaacagagttatccagcatgaagctggtcacttcttgatagcttacttgcttggagtgcttccaaaaggatacacaatcacaagcttagatacacttatgaatcaaggatcgcttaatgtgcaagctggagcagcttttgtggactatgagttccttgaagagatcaatacaggcaagctatctgccacgatggttaacaagttctcgtgtatagcactagccggagttgcagcagagtatcttctgtatggacgtgcaggaggaggattagccgacatcaataagcttgatggattgctcaagggtttgggtttcacccaaaagaaagctgattcacaggtgagatgggctgtgctgaatactgttctcatactgcgtcgccatgaaaaagctagatcgcagcttgcagaggcaatgtctacagggaagtcggtgggctcttgcatccaagtcatagaagagtgtataagcactgacgatatttaacgtggatatgttgctgaccctacgttgtctcaatggcatgttatcaacaacaaatcaaggcttgtcaatccaaaagaggatttgagtattaaatccactcttaaggctagtttgagaaccttatttttttaagagattttcttttttttttaagataaattagtttattttctcttgagaaaatagaaatctcttggaaaattggagttgctaaactagcccttagtcaaaaatgactagtagagaatttaatcttcaattgccttctggatttacgcaaaaaaaaaaaaaaaattctatgttagggctggtttgatggacagtgaattggattcccttgctattcccaatcctgtctaccg

SEQ ID NO: 1925 - DNA, 1055 bp, Zea mays
agcggatctggttccgtggaccgcgagaaggtgagtaggattacaggaaatccaatccaacccgcgccggctgcgtggccactgccgcccccccgcctcgtgcttgtccaggtccaaccgtccaaggataaaaaatgagcacgaacctgggaggagcctcttgcttcggcttcggcttgactcagctgcagcccgccgccgttaggctccggttgccgcctgctcgcgccgcggacacttcgtcctcccagtcgccggcgcgcctgacggcggtgctggagcaggtggaccagttgctaagccaggggaacgacatggccgcgctctccctcgtgcgcagtacgcaggggggtgacggcgggctccgggcctttggcgccgccaggcaggtatattttggtggtggggtgagaaacttggttcttgatacaattggtcactatctcagccagaagtatcacaacagagttatccagcatgaagctggtcacttcttgatagcttacttgcttggagtgcttccaaaaggatacacaatcacaagcttagatacacttatgaatcaaggatcgcttaatgtgcaagctggagcagcttttgtggactatgagttccttgaagagatcaatacaggcaagctatctgccacgatggttaacaagttctcgtgtatagcactagccggagttgcagcagagtatcttctgtatggacgtgcagaaggaggattagccgacatcaataagcttgatggattgctcaagggtttgggtttcacccaaaagaaagctgattcacaggtgagatgggctgtgctgaatactgttctcatactgcgtcgccatgaaaaagctagatcgcagcttgcagaggcaatgtctacagggaagtcggtgggctcttgcatccaagtcatagaagagtgtataagcactgacgatatttaacgtggatatgttgctgaccctacgttgtctcaatggcatgttatcaacaacaaatcaaggcttgtcaatccaaaagaggatttgagtattaaatccactcttaaggct

SEQ ID NO: 1926 - DNA, 4543 bp, Zea mays
cttgcatgcctgcagcaatttggcatggacctgttacctaccatgacacaggtcagtcttgtcttattaatgttctctttgatgttgttaatggtaatgctgatgaggtattacgggacattgttgctatcatgttggtgtgatacttaaggacttcaataccttgaacaggtgtatggctctagtgtaagtggaccaatacggcacaggtgcttatctgtcattgggaaattaatgtactatagctcagctgagatgatccagtctctccttagcacaacaaacatttccaggtgcttaacacaatatatttcatcgagttatctcatgttattagaaactatcttatcacatgaattccaaatatttgtttcaagctattaacttctatatcaaccattgcagctttttggctggcattttagcttggaaagatccacaagtgttgatccctgctcttcagatagcagaagttttaatggaaaaacttccagagatttttttgaagatgtttgtgagggaaggcgttgttcatgctgttgagtcacttatatgcccagaattatctggtcaggtgactcctcatgtggattccattacatcttcacataataggcgcaaccgccgtagaaataatgctgtgaacactggaaataacttgcctgatggaccaaaaggttccaattctatgattgccaattcacccccaagcatggctgaagttccaaataatagtcttcgtgctttagttagtaatcatgcaaagtcatttaaggataaatatttcccttccgagcctggctcaagtgacattgcagttaccgatgaccttcttaaactgagggcactttgtgcaaaactgaatacaacagctgacactatcaaaacaaaagctaaaggaaaatcaaaggtagtgtctgacaatagttttgatgtcttgtgcaatattgaggagcaattggatgatataatagctgaaatgttgtctgagcttagcaagggtgatggtgtttcgacatttgagttcatcggaagtggagttgttacggctttgctaacctatctgtcatgtggaacatttgggagggaaaaggtgtctgaggcaaacataccaaatttgcgtcatcaggcagtcagacgatacaaaacatttatatcttttgcacttccaaatgataaagatgggaataaaactcctatggcattcctagtccataaactgcaaagtgccctatcttcgttggaacgtttcccagttgtgctcagccattctggaagggcatcgactttgggaggatcccgcctgacaacaggtttaggatctctgtcgcagcccatcaaattgcgtctttgtcgagcgcctggtgagaagtcacttaaggatttttcgtccaatgttgttcttattgactcattagctagtctggcagctgttgaagattttctttggcctagagtccagcgcactgaaccagtattgaagcctccaatgtcatctgcaaataattctggatctggagcagcaagctccacagcttgtgcgccttcaattccatcagaaactcaatctgtccgtcgcacatcgttaagatcaaagtcatcagctgccaccagtggtgcaattaagaaggattatcaggagggaagcataaacacctcaaagggaaaaggaaaagctgttcttaaattgagtttggatgaacctaaaggcccacatactaggaatgctgcgcgcagaaaagctacttcagagaaagatgttgaactgaagccatcacatggtcacatcacttcagaggatgaagatcttgatgcttctcctgttgagattgatgatgctttaattcttgatgatgatgacgaggatgtcccagatgatgaagatgatgatcatgaggcggttctccgaggttctcttccttcctgtgttcctgagagagtgcatgatgtgaaattaggagatgctgatgattctagtgttgcctcattggcaaatgataaccaggcacagccctcatctggttctagtacaaaaaatacttctagcaggggattggacactgctgaatttagaagtccagccacatttggttcacgaggtgcaatgtcgtttgctgcagctgcaatggctggattaactccagtaggtggtcgtggaattagaggtagccgagatcggaatggccttccattgggtgctcgtgcaactgagcattacaacaaattgatatttacagctgctgggaagcagctgaacaaacatttgactgtatatcaagctgttcaaagacaagtagttcatgccgaggatgatgaagatcgattcggtggatctgatttacctgatgatggtaaccacttctgggatgatataaggggtgatgtgttcactataacgtatcagaaggctgataacacagcggagaaggggtctgttggaggttcagcttcagtgccaaaatcttccaaatcagattcttgcagaactttgtctgaaaaacagtgtacttctcttcttgatagtattttgcaaggagagcttccctgtgatttagagaaatcaaaccaaacctacaatatcttatcactattacatgtgttggagggtttgaatcagttatcacctcgtctgagactgcagtcagcctgtgatgattttgctgaaggaaaagttgctacattaaatgggctatacgatgttggagctaaggtaccctcaaaggagtttatcaacagtaagatgaccccaaaacttgctcggcaaattcaggatgttcttgcactgtgtagtggcagtttaccatcttggtgttatcagctgacgaaagcttgtccttttctgtttcctttcgaaacacgaaggcaatacttctattccacagcttttgggttgtctcgtgcacttcatctcttcagcaacaaccgggcaatgataataacactgcttttgaaagagaagtcaggattggtagattgcaacgccagaaagtccgtgtttctcgtaaccgtatcttggattctgcagctaaagttatggagatgttctctaatcaaaaggctgtcctagaagttgaatactttggtgaagttggaactggtcttggtccaactttggagttttatactctcttaagccgtgagctgcaaagggttgacttaggattgtggagatctcattcttcagataattctgggatgcaaattgatgcgaatgctgatgatttaataagaagtaaaaatcatgaatcagaatcacttactgagagcaggaacatagtacaatcacctcttggattatttcctcagccttggccacctactgctgctgcatcagaaggtagcaaattcttcaaagttgtcgagtatttccgcttagttggtcgagtgatggcaaaagcattgcaagatggaaggcttctcgatttgcctttgtcgacagcattttacaaacttttgcttggacaagaacttgatttatatgatatattatcttttgataccgagttcggaaagacattgcaagaactgcaaattctcgttgcacgtaaacaatttttggactcctgctctagtgagagccaaaagatagatctatgtttccgtggtgctcccgttgaagatttatatttggacttcactcttccgggctatcctgaatatgttctcaaggaaggtggagagaatgcagaggtcaacatttgtaacttagaagagtatatttctttggttgtggatgctactgttaagaccggcataatgcggcaagtagaggcatttaaggcaggattcaatcaggtgtttgacatatcatcactgcaaatattttctcctcaagaacttgattatctgatttgtggtcgctgtgaactttgggagccggaaacactgcctgaacatataaaattcgaccatggttatacctctaagagtcctgcaattgttaattttcttgagatcatggcagaatttactcctgagcagcaacatgctttctgccagtttgtgaccggtgctcctcggcttccacctgggggtttggctgctctaaatcctaagttgaccattgttaggaagcactcttctgtggcaaataataattcaaatgcaactggagcgacagagtctgcagatgatgatttgcctagtgtcatgacttgcgccaactatcttaaactaccaccatactccaccaaggctatcatgctaaagaaactgctttatgcgatcaacgaaggccaagggtcatttgatctttcgtgaatctcaacactaacataggtattggtccacctagaaatctgcgtcattgttacccagagttagtttctacctcattcatgtatgacataggttaaactcagctctccggagtcccaccgaaggtttggagcccgtacctttgggtgtggatgtctatactctcttttcttcggttgtatattcttgcggatctttatagtgaataatagtaataaattgttttgcgcttcttactatgctaaaaaaaaaaaaaaagggggggccctccgttgttaccactgct

SEQ ID NO: 1927 - DNA, 2528 bp, Zea mays
ggccgcacaagcaaaggcgggggagagagctccgtgcagtcaccgtcgtgttcggaacgagcgagagagcgggagacgagtcgcggcgcctctgctgtgctgtcttcttctccccctctgctctgcttcggctcctcacgcggcctcgccgagacccgcagaacagggggttcagacttcttggtgagagcgatatgagtgtcccaggtcaatgctcatcccagccacaatttatcaccagcgttgggaggagtaaccgctccaatggccccggcactcctcttatcgaaagcatagatgttgatcaaattgttattccagagaaaaacagttggaagaacttattctcatacatagggcctggatttctcgtctcaattgcatatattgatcctggaaactttgagacggatctacaggctggagcacagtacaaatatgagcttctttggatcatacttgttgcatcctgtgctgctcttattattcaatcacttgcagccaggctaggggttgtgacagggaaacatcttgcagagcattgcagggctgagtatcccaaggtcacaaattttgtcttatggattcttgcagaacttgctgttgttgcatgtgacattcctgaagtaattggaactgcttttgctctaaacatgctgttcagaatcccagtatgggtgtggtgttctaataactggactcagcactctaatgctcttattgctgcagcaatatggggtccgtaagctagaatttctgattgcatttctggtgttcttaatagcaacatgtttcttagttgaacttgggtattctaaaccaaatgctccagaagttgttaggggcctttttgttcctgaacttaaaggaaatggagctacaggccttgctatctcattacttggtgctatggtgatgccgcacaatctttttctgcactcagcattagtattgtcaagaaaagtgccacggtctgttcatgggattaaggaggcctgcagattctatacgattgaaagtgcatttgcccttacagttgcttttctcatcaacatatctatcatatctgtcagtggttctgtctgtggttcaggtaatttaaacccagaagatcaagcaaattgcagtgatctggacctaaataaggcttcatttttgttaaagaatgtccttggaaactggagctcaaagttgtttgcagttgctttgttggcatctggtcagagttctacaattacggggacatatgctggacaatatgtcatgcaggtttttggaacttataccttatttcagttctagttcgcaagttgaatggcaggttgttttatgatgcatattactcgaggcctttgatgttgatcagaagtaatcaagcatttgcttgcttgcaacattagtttgtttagctgttagatatgaaaagtacagaaaataaattagtacataactcttagatttgcaatgaacaagcttgggcttatgagtttcagtgccaacctccaaggttctcttggtcagctagattgcagagaaaaaggacagatacggggtaagcttaggtcaccaccattattaatgtctcccattatttaatacagtacgctgctaattgtcttcccttgtctcaaataacgcgttgaatcattttaattatttttattgttttgcctaaaggaaaactaagtaatcaaccaagcattttggacttgtgaaactccaggcccgccgggctaacattttctcacctaatctaggggtttttagatcttcggatgaaaccctggatacgcaatcttgtcacgaggtccttggctatcctgccaagtttgatcgtgtcaattattggtggttcttcagcagctggccagttgattatcattgcatcgatgatactgtcatttgaactcccttttgctttagttccactccttaaattcaccagcagcaaaacaaagatggggcagcatacaaattcaatattcactgctgtgctgacatggatgatcggctcgtttattgttgtcatcaacacctactttctgataacaagctttgtgaaattgctcgtccacagcgggctgaccaccatttctcaagtattttccggtattttcgggtttttgggcatgctgatttacatagttgcgatcctatacctcgtctttaggaggaacaggaagtccacccagccattgctggagagcgatgctgagcttgcagtatcgggtagcagtgctgatgccggagcagaatgctcgctgggccatttgccccgtgaggacatctccagcatgcaacttccgcagcagcgttcagcttctgatctagattagataacagctgccaggaaaattaatggttttttttgttttctatatagtatagtaattaccggccagggtacgtcaggtattggcttctgttcatcctactgatgatgcttaaggaatgtatacaagaggacggatatctatgctgccaaacaaaaaaatggggcacaaaagaatttagtgcctgtttttggg

SEQ ID NO: 1928 - DNA, 2606 bp, Zea mays
attgggactcctccgtgactccgtctccctggggtcacgggtccgcgccgcctcagatccgggcaacccgttgcgacaccgccttggtgcggctgcggtggtgggcagttccgtggtactgcggcaggcacgccaaagacagtttctcttttctttcttccctgctgcccatggcggcggcctggcggagaaagattgaactcttgactcttctcactgccatagcagatgtatgcacgcacgcaaacgttcctttcggttgcgtcagtagcctaacagggggttcagacttcttggtgagagcgatatgagtgtcccaggtcaatgctcatcccagccacaatttatcaccagcgttgggaggagtaaccgctccaatggccccggcactcctcttatcgaaagcatagatgttgatcaaattgttattccagagaaaaacagttggaagaacttattctcatacatagggcctggatttctcgtctcaattgcatatattgatcctggaaactttgagacggatctacaggctggagcacagtacaaatatgagcttctttggatcatacttgttgcatcctgtgctgctcttattattcaatcacttgcagccaggctaggggttgtgacagggaaacatcttgcagagcattgcagggctgagtatcccaaggtcacaaattttgtcttatggattcttgcagaacttgctgttgttgcatgtgacattcctgaagtaattggaactgcttttgctctaaacatgctgttcagaatcccagtatggtgtggtgttctaataactggactcagcactctaatgctcttattgctgcagcaatatggggtccgtaagctagaatttctgattgcatttctggtgttcttaatagcaacatgtttcttagttgaacttgggtattctaaaccaaatgctccagaagttgttaggggcctttttgttcctgaacttaaaggaaatggagctacaggccttgctatctcattacttggtgctatggtgatgccgcacaatctttttctgcactcagcattagtattgtcaagaaaagtgccacggtctgttcatgggattaaggaggcctgcagattctatacgattgaaagtgcatttgcccttacagttgcttttctcatcaacatatctatcatatctgtcagtggttctgtctgtggttcaggtaatttaaacccagaagatcaagcaaattgcagtgatctggacctaaataaggcttcatttttgttaaagaatgtccttggaaactggagctcaaagttgtttgcagttgctttgttggcatctggtcagagttctacaattacggggacatatgctggacaatatgtcatgcaggtttttggaacttataccttatttcagttctagttcgcaagttgaatggcaggttgttttatgatgcatattactcgaggcatttgatgttgatcagaagtaatcaagcatttgcttgcttgcaacattagtttgtttagctgttagatatgaaaagtacagaaaataaattagtacataactcttagatttgcaatgaacaagcttgggcttatgagtttcagtgccaacctccaaggttctcttggtcagctagattgcagagaaaaaggacagatacggggggtttttagatcttcggatgaaaccctggatacgcaatcttgtcacgaggtccttggctatcctgccaagtttgatcgtgtcaattattggtggttcttcagcagctggccagttgattatcattgcatcgatgatactgtcatttgaactcccttttgctttagttccactccttaaattcaccagcagcaaaacaaagatggggcagcatacaaattcaatattcactgctgtgctgacatggatgatcggctcgtttattgttgtcatcaacacctactttctgataacaagctttgtgaaattgctcgtccagagcgggctgaccaccatttctcaagtattttccggtattttcgggtttttgggcatgctgatttacatagttgcgatcctatacctcgtctttaggaggaacaggaagtccacccagccattgctggagagcgatgctgagcttgcagtatcgggtagcagtgctgatgccggagcagaatgctcgctgggccatttgccccgtgaggacatctccagcatgcaacttccgcagcagcgttcagcttctgatctagattagataacagctgccaggaaaataaatgttttttttgttttttatatagtatagtaattacagaatagggtacgtcaggtattggcttctgttcatcctactgatgatgcttaaggaatgtatacaagaggacggatatctatgctgccaaacaaaaaaatggggcacaaaagaatttagtgcctgtttttgggaagtgatgtgaactgaatcctggaaggggcaaaaaaaaaaaatgttggaatccaattgttgaaaattcttcattctaaacatgaggccgttggtaaaaaatgtctacatgctgtaaacatactatattttgacattattatcacagttaatatatactggacatgctgtttt

SEQ ID NO: 1929 - DNA, 911 bp, Zea mays
cccacgagtccgcccacgcgtccgctgtgatagtgatggggaagtgcgcactcggagcataaataatggtagctgtttgacatgtgttaaggtgtttaaggcgaggtgctactcagatgagatttcaacctcgtaagggaaagtatctagcagctgcctcagagaaagcaatctacatacttgatggggagacacaacatgcttgtagaagccccttgcaggggcacaataagaatattcaatcgctttgttgggactctgctggtgaatatctggcttctgtcagtgaagactcggtcagaatatggtcattcagttctggacgtgatggtgaatttgtgcacgaattgaatcgcagtggaaatcagttccactcatgtgttttccacccaacttatcaatccttgttagtgattggttgttacgagtccttggaactttgggacataagggagaagaacaccatgaccttcaacaatgcgcatgacggtttggttgcagccctggcagcatccagtgcaacagggaaggttgcctcagtaagccatgataggactctcaagctctggaaatgacttgtatgaaacccatgttggacttctgtattctggctgttagatgatagacaaacaagactttgccaaaaatgaccacatgacgaaaaggttgctgacaagatactctggagccgcgtgggctcaagaactaacagtgttttgttttgtggtcgttgtatgctgttcagtatgccactgaagcttgtaacttgtaactcgtaatagaaactttggttgaagaaagattgtacctcggacaagtggcaaatatttattctctaaaatattctgcattttgtttttcgaccgtctattttaacgtaattgagcctgaagcatagttttattgccggt

SEQ ID NO: 1930 - DNA, 801 bp, Zea mays
agatttcaaccgcgttggggaaagtatctagcagcggcctcagataaagctatctacatacttgatggggagacacaacatgcttgtagaagtcccttgcaggggcacaataagaatattcaatcgctttgttgggattctgctggcgaatatctcgcttctgtcagtgaagactcggtcagaatatggtcattcagttctggacgtgaaggtgaatttgtgcatgaattgaatcgcagcggaaatcaattccactcgtgtgttttccacccaacttatcagtcattgctagtgattggttgttacgagtctttggaactttgggacataagggagaagaacaccatgaccttcaacaatgcgcatgacggtttggttgcagccctggcatcatccagtgctacagggaaggttgcctcagtaagccatgatagaactctcaagctctggaaatgactttataatagcgatcggtgtgaagacgattttctaccaaaaatgaccacatgacgcacatgacgaaaaggtagctgacaagatactctggagccgcgtgggctcaagaactaacggtggtttgtgttgtggttcttgtatgctgttcaatatgctattgaagtttgtaactcctaatagaaacgttcagtcaagactccaagattgtacctcggacaagtagcaaatatttattccccaaaaaaaatctgcattttgtttttaaaaaaaaaaaaaaaaaaaaaaaaaaaaaaaaaaaaaaaaaaaaaaaaaaggaaggaaaaaaaaaaaaaaaaaaaaaaaaaa

SEQ ID NO: 1931 - DNA, 2277 bp, Zea mays
  misc_feature (331)..(331): n is a, c, g, or t
tgcaggggtctctaagcccgcaacggctgattccaaatggctccctacgcgctgcagcgcaaggggaggccgtgtccgtcccccagatcaaggggagcagtgtagcgcccccttgcgtagtgcttccctatttaatagttgaaaaaatagtaataaaagatgaatatggttagataatgatattttatagttatagtggggtataagaggataatataggggaaccactgcgggagataaaaagataggaggtgaaatgttaatgatatgacaaaaaatgatatagaagaaaaaatttagagaaacccgcttggtagtctaagaggggcgncgaaggaagcaacgagaggcggacgggatcacgggatggcagcgagccggcgacgtagggtgtgtttggtttaaggaatcactacatctaaattgaggtggtgcatcatgggttcattcctcaaatttggtgggatgacctcattcctcattttagtactaactaactaactatgaggaatgaggtgatgatggattaactcattctattccataaaccaaacaaaaatagtgaagagtgagaagatgatggactagctcattcctcaaaccaaacaccctagtagggatccggtcgcaacggagggagcaagtggcggcaaaggcgaacagagcggatgtgatagagcagagaaagacggggaagagagagaacatgggtggcccacccatcagtgctgacatgtgggccctacatcgccacgtcagcaaaaaaacatccagaaaacccactcgaggggtcattttgcccagttctggatagttggagccttggaggtgcaaagtatccagttttgcagttctactaggttgtaaattaggcaactgtggcaaatacaaagtttttttttgtttccagatatgctaggtcgccagatatcattttggcattcatattacgccataaagttgttggcacataatgtacctattgcgtcttaattcgacgaaacggtggtggtattaactaagaaaaaatatttcattaacaaacacatcgttaacctactctgttaccttctttgcagaggcccaaaagcaaacacaatgccagctgcctacaaatacgccgcctccattcatgtgtgcacggcactagcagcgacacaataattaatcagggctcatcatctcgcaatctctatctaggtcaaccatgacgaacggcttcctgtttcgggagtacatcggcgcgcagttcaccggcgtccagttcagcgacgtgcccatcaactccaagctcgccttcaacttcatcctcgccttcgccatcgactacacgccggtgaaccagcatcccacgccggcgcccaccaacggcgtgttcagcccgttctgggacacggggaacctgtccccggccgccgtggccgccatcaaggccgcgcacccgaacgtggccgtcatggcggggctcggcggcgacagcgtgcaggacatcgtcaaggccgtcttcaccccgacctccatcgactcgtgggtggccaacgccgtgacgtcgctcacgggcatcatcaacacgtacgggctcgacggcgtcgacgtcgattacgagcacttcgcccgcggcgctgacgtgaacaccttcgtcgagtgcatcggccgcctcctgacgcagctcaagaagaacatgccgtggatcaccacctccatcgcgccgttcgaggaccccgtggtccagaagtactaccagccgctgtggcgcaagtactccggcgtcatcgactacgtcaacttccagttctacggctacggcgacaacaccgacgtcgccacgtacgtccagttctacgaccagcagtcggcgaactaccccggcggcaaggtcctcgccagcttcatgaccggcaacaccaccggcctgatctcgccggacctcggcatcagcgccgccaaggagctgcagcggcagaacaagctgccgggcctcttcatctggtcagccgacagctccaagaggagcagctttggcttcaagtacgagatcgaggggcagcagatcattgccaaccattgatctcggatccgaatatcgtatggggctggggcctcgccacgctgtgatggatgaaatataaaatgaatttatcaaggaataggcacgctgctacgtgtactatttctatgaatgatgaataaataaagagattgcattgagcaatttgtatgctaataatgtttcgcaaggttctctccctacactggtacgtcgtctcctcccgtaac

SEQ ID NO: 1932 - DNA, 1478 bp, Zea mays
cattgggtacctcgaggccggccggggtgcacggcactgcttagttctttccaaagagagagagaaacaatcaggggtccatccatttttgtcagccatgacgaacggctatctgttccgcgagtacatcggcgcgcagtccaccggcgtccagttctccgacgtgcccatcaacgccttcgttagcttccacttcatcctctccttcgccatcgactacacgcccgtggggcagcagccgaagccggtgccgaccaacggggtgttcagcccgttctgggacacgggcaacctgtcccccgccgccgtggccgctataaaggcctcgcaccctaacgtcgccgtcatggcggggctcggcggcgacagcgtgcaggacatcgtcaaggccttcttcaccccgacctccgtcgacacgtgggtggccaacgccgtgacgtcgctcacgggcatcattaacaggtacgggctggacggcgtggacgtggactacgagcacttcgccgacggcgccgacgtgaatacgttcgtcgagtgcatcggccgcctcctgacacagctcaagcagacgatgcccaacatcgccacctccatcgcgccgttcgaggacccagtggtccagaagtactaccaggcgctctggagcaagtactccggcgtcatcgactacgtcaacttccagttctacgcctacggcgacaacaccgacgtgcccacgtacgtcatgttctacaacaaccagttggcgaactatcccggcggcaaggtcctcgccagcttcaagaccggcaacgtgaccggactgctctcgccggaccaaggtatcagtggggccaaggagctgcagcggcagaacaagctgccagggctgttcatctggtcggcggacagctccaagaagagcagctacggcttcaagtacgagaccgaggcgcagcagatcattgccaaccactgatcgatctgcgatcaggacttagcttaacaagggatcacacattttacaataaataaatgataacctctcaggtcaacaacaattacttgcaggttaaggagttcggctgttgatttaaggacagaatgatggtgagtgaaaatgcaagtttaaagaaaatcgtcattattctgtcctttaaacttgtactagcaaagtaccagtgtgttgttacgatttacatttatgtttaagtatacaataaaaacataaacacatgtgtgttatgttggttggatatatgtaaatatgagtttagagccaacaatcatggtttaaatctccatttatgtataattttagcatttttactatttaaatgtgggcagcacaatgacaatgaaaactggggaacaaggaaaccggtgctccggcctaatagagatttatgcataattgttacatttttactatttaaatgtggggggagcacataacggttttcattgtggaccgggaaaattgttgtttttatataata

SEQ ID NO: 1933 - DNA, 827 bp, Zea mays
cgtccagaaaagtgattccttgtcggatccggccttgcacgcactctcggcggcctccaatttgatacaccttgggttccgcgggaatatattgtcaagctttgggcttttacagtttgtaccccctgtcacactctgtgtgttggatttaagcggctgttggatcttaacaggcgatgctatttcaacattccgtaagcgtcatcctacgattgaattgagacatgagctcctgcacgaagttgaggaaaattttgttggtggttcccaatttcgtaaacctagacgcagacgatctcctcatgtgaaagcagaagttggaaacagttttgctggctcaagtaggctacacgatatccgttttgtagatgaaaggataaaatacagcaaggaggaatttgtggagctgcaaggccttgctaaaccaaattcgttaatgcttggcgtgtggcttccaccagaactgcgaaggcccaaatgatagttttggatcttgattccttacgcatttactgccagcatatcataatcttccttgagttattcttgatatgacagacttttgagaattaagcatcaagcatgtcactcagttccaaattatagttcactttggttttgtcctaggtcaaacttttctagctttgacctatgcattcaaataaatgctgtaccaaaatgtatttcgtgaagaatctaaagaaactgatttgatgttctaaatgacggtacactttcctttgcgcccggtcaaacataaagaagtttgacttatgaaaccaaagttaactataatttggaacaaagggagtacactggagttatct

SEQ ID NO: 1934 - DNA, 2655 bp, Zea mays
gaattgctgatcctggcacgtacatggttcgcattcggtttgccttctaaaaccgggtgtaacagcgtatgatggagagtctaaagcaacctactcttggcctgctcacagtggcggccctgagggtggggtggaggggccaccgtcctaggcccctaatgatatagagccacgaacctagttatacattcagtaattagactattagacacaatagcttaatagtaaaatatcgaataattagcagccacgaagcgttcacaagcctgtcgtatttaaacatgttaaaagaacttttaagataatactataatatgtatctttttatttatttgttgcttggtatgaatatttttagatgtgtcttgagtttatatattggtactatttttatataacaatagtttgatggacctctattttaaatttgtcctgggcccctaaaacctctggtccgccgctgcctggtcaacgtgtcgccctactcgaccgacaattacgcaaataataatttcgaaacaattaaatattggaagagcatctaatatggatgaaataattgtaaatccaacattaaaaagacaaattgatgagtatgataaaaaaaatgttcaagatgaagtgagatgagtgtacattcaaattcaattttttattgtacggtcactaatttctatatgcaatattgcatctgctttacagccttgtctagttattttaagattttgtttggtcccacgtgatttttttttgtcctgcttatgcaactgatcaaagctatatatactacctgccatatcgtttcatgctggagaagaacatcgtgatcgtgaatcacgcacaacatgttgtgattgggacgactccaaaatgagatgatggtcgacctacccccaaaacaccagcggagacgaagatgcctccacacagcgcgtcaagattcctccacctagacacaaggcaggccacatttttagacgaaaatgacaggtccgctcagctcgagtgtgcacagcgctgcaggtgcgtgttgtatacgtggacgcatgctttgcctcgagatttggttcctcgatcgtaatcgcacgaggatgacaaggaaattgtacacgttaatcaattaaactaacaacaactacaataaataaagaatacgaccacagcagcactcgtcaaccgcgtggtctctttaaataacccgcgcgcggctactgcagcttcctggccggcacagccaactaaagagaaggagagcgtgtgttcgtttcgaggacgcacacacagacgccatggaggtgacaccaaaccacaccctgaccgtgaccgggtgggcggccatgaacgagtccgccggcaaggtggagcccttcgtcttcaagagaaggtacggtttgggtacaaaccaaaggcggcgtccattcgcttccagtactgatgatctgctggccggttgggcatcatatgatgcagggagaacggccctgacgacgtgacgatcaaggtgcagtactgcggcatgtgccacacggacctgcacttcatcaacaacgactggggcatcaccacgtacccgctggtcccggggcacgagatcacgggcgtggtcaccaaggccgggcgcaacgtcacgggcttccgcgtcggcgaccgcgtcggcgtgggctgcatcgccgcctcctgcctggactgcgaccactgccgccgctccgaggagaactactgcgaccgtgtggcgctcacctacaacggcgtcttctgggacggcagcgtcacgtacggcggctactcgcgcgcgctggtggcggacaagcgcttcgtggtgcgcgtccccgacgcgctgccgctggacgccgccgcgccgctgctgtgcgcgggcgtcacggtgtacagccccatgaagcaccacggcatgctggggcaccccggcgccagcctcggcgtcgtcgggctcggcggcctcggccacgtcgccgtcaagctcgccaaggcgttcggtctccgcgtcaccgtcgtcagcacgtcgccggccaaggaggccgaggccagggcccggctcggcgccgaccgcttcgtcgtcagcaccgacgacgcgcagatgcgggacgcggccaggtccctcgactacgtcatcgacaccgtctccgccaagcactcgctcggacccatcctggacctgctcaaggtcagcggcaagctcgtgctcgtcgccgcgccggaccagcccgtcgagctcccctccttcccgctcatcttcgggaagaggaccgtcagcgggagcatgacgggagggatcagggagacgcaggagatgctcgacctctgcgcccgccacaacatcacctgcgacatcgagctcgtctccacggacgggatcaacgccgcgctcgcgcgcctcgcgcgcaacgacgtccgataccgcttcgtcatcgacatcgccggcgactccacctcaaaactatagttcattcaattcgttgcattaccattatgggcaccaaacctattatcatctatcaatatcgtcaccagtggcaggcatggcctctggttgcttgcattttgctctctatccatatcaagtgtgtgtcagcatgggccagcgtgcatattgcgccattgcttgcagcaaataaacgttcatatatacacatgtgc

SEQ ID NO: 1935 - DNA, 1371 bp, Zea mays
cattgggtacctcgaggcattccatcacagattcacagccaactaaagagaaggagagcgtgtgttcgtttcgaggacgcacgcacagacgccatggaggtgacaccaaaccacaccctgaccgtgaccgggtgggcggccatgaacgagtccgccggcaaggtggagcccttcgtcttcaagagaagggagaacggcccggacgacgtgacgatcaaagtgcagtactgcggcatgtgccacacggacctgcacttcatcaacaacgactggggcatcaccacgtacccgctggtcccggggcacgagatcacgggcgtggtcaccaaggccgggcgcaacgtcacgggcttccgtgtcggcgaccgcgtcggcgtgggctgcatcgccgcctcctgcctggactgcgaccactgccgccgctccgaggagaactactgcgaccgtgtggcgctcacctacaacggcgtcttctgggacggcagcgtcacgtacggcggctactcgcgcgcgctggtggcggacaagcgcttcgtggtgcgcgtccccgacgcgctgccgctggacgccgccgcgccgctgctgtgcgcgggcgtcacggtgtacagccccatgaagcaccacggcatgctggggcaccccggcgccagcctcggcgtcgtcgggctcggcggcctcggccacgtcgccgtcaagctcgccaaggcgttcggtctccgcgtcaccgtcgtcagcacgtcgccggccaaggaggccgaggccagggcccggctcggcgccgaccgcttcgtcgtcagcaccgacgacgcgcagatgcgggacgcggccaggtccctcgactacgtcatcgacaccgtctccgccaagcactcgctcggacccatcctggacctgctcaaggtcagcggcaagctcgtgctcgtcgccgcgccggaccagcccgtcgagctcccctccttcccgctcatctttgggaagaggaccgtcagcgggagcatgacgggagggatcagggagacgcaggagatgctcgacctctgcgcccgccacaacatcacctgcgacatcgagctcgtctccacggacgggatcaacgccgcgctcgcgcgcctcgcacgcaacgacgtccgataccgcttcgtcatcgacatcgccggcgactccacctcaaaactatagttcattcaattcgttgcattattatcatctatcaatatcgtcaccagtggcaggcatggcctctggttgcttgcattttgctctctatccatatcaagtgtgtgtcagcatgggccagcgtgcatattgcgccattgcttgcagcaaataaacattcatatatacacaaaaaaaaaatcggctcggtgtttc

SEQ ID NO: 1936 - DNA, 1496 bp, Zea mays
actcctatcggcgggtacctcgccccgcgccggccccgaacgccagttaccactcaccagtcaccagtctccactctggagtctggaactcccctcatcctccacatctccaccgcatcggaactaggaaggcgaagccgaaggcgcggcgcggcgcggcacggatcgagcgatggcggtggcccctcctacggcggcggcgctggagcagctaagcagcagcaagatgttcgacggcttcaatctccgcttccgccaccagagcgccacccttggctgcgccatgactttctccatctacctgcccccgtccccggcgtccaaccttcccgtgctgtactggctctcgggtctcacctgcaccgacgagaatttcatcataaagtccggcgcccagcgcgccgccgctgcccacggcatcgccctcgtggcacctgacacctccccacgtgggttaaatattgaaggagagtcagacagctatgattttggtgtgggtgccgggttttatttgaatgccacaaatgaaaagtggaaaaactggcgcatgtatgactacattgtgaaggaacttccaaaagttttaagtgataactttgaacaactcaacacgtcacaggcatcaatttttgggcactcaatgggagggcatggcgcgctgacaatttacttgaaaaacactgataaatacaagtcggtgtcagcatttgctccaattgccaatccgataaactgcccttggggtcagaaagcattctcaaattacctgggctcaactaaatcagattgggaggaatatgacgcaacctgcctgattaaaaagaacagcaaagttcccactactatcctaattgaccagggggaggccgacaagttcctggctgagcagcagttgctacctcacaagttcgaggaggcgtgcaaggccgcaggggctgctctgaccttgcgcatgcagcctggatatgaccactcgtactatttcatcgctacgttcgtggacgatcacattgcgcaccatgctcagtttctcaagagcgcctgactgtaaatgtgtagcgtgaggaagacaaggaggcagcctagcatgggtgttttatctatgccgacagtgttgtctcgtgtggcagcttgaggagaggtgaacagcacaccccacatgcgaaataagatggaagatttgctgttcctgtccattgacattgacgagctcgaatgggactgatgttgcaccgaatgtagtttccctgtcattcgctatgcgcaattatgttataacggccctggtgcaaggaatgattgcccgagtgcttgtgtgtgcggcgcgcgcggttgactcttcttggcattctgcagggggtgtacaaatctgtatggatcagagcttggtttagtgttgtcctcctgttcgaaccagaattgagcgcggacggtccggccctgaggccggacggtccgcggtccggacggtccgcgcctgtgggccggacggtccg

SEQ ID NO: 1937 - DNA, 5576 bp, Zea mays
  misc_feature (3840)..(3840): n is a, c, g, or t
acagatccgagtagtgccgttgccgtgcctgcccaaccgcccttttttttctctccagatcccctgtgccggctctgatacttgttcagcacttgcatccctttttttctcaggtctctgggttaggtttggtaccatccaaaaggacatgcaaggaccgcgcagcaagcggacacagtagtctggaagctctcgcgtcaggaccctcttccgatatatcccccggcccttctgaaagcagggatgatctgtgctaaaccgcgcttaagtaacattaatggaacctgcgaaggggaacagaagatactacactacactacacgccagagcaagcaataagatgactgacgtacgcaccagagaatttctagtttacgctcgccgccggccagaccgatcagtaacaggcagcggacttgcggccagtgattttttttttttttttgacgaactgcggcctttttataccctccacgcgccaagacaaccatgtgcagccaacaataatgtggcggtatttacaattcggttattcagattcaggctcgatcgatcgatcgatcaaagtgctctcactactacccactcggtaacaacctctgatgaaaacgttggcgcgtggcgtggcgattgtactgtccggccggccggcctgcctgccttccgatcgtgccttgtgtcttgtcaggaagccaagaattataatttgtcctcgatcgatcgcactcgcagcgaacggccaatgatggcttgccgcccgcccgcccgccgcaactgatcagtactggtggtggagaagaaaccatatggcgcgcgcgtggtggcgtggcaatggacatgcatgcatcccgcgcgtgggctagctagctgtgtctggctccgacgagccagcaggcgcccggcggcacggcacggcgcggcacggcttcagcccacaacgtgcaggcggatcttcttggcggccctaggaggcggcgaggacctgtccgcgggggcggcggcggcgccgcgcgggacgaacaccgtggagaggttgagcggcacggggaagaagaaggcgcgctgcaggcggcagcagcgcttcctccccctcttgctgccgggcgccaccggcttccgcggcgccggagggcacaccgtggccggccgcagcaggcacggcgacgccgtcggggtcacgcacgcggcggagtcgatgtccagtaggccgccgcccaggcccaggcgcggcagaagggagctcgcggccgtcggcgtgacgcagcccgtgtcggcggcgtccgggccgtcggccgccgccgcggtctggaccggccggagcacggccaagtcggagaggtcgagctcgacgcccatcgggtgggtaatctaacactcagatggagaggccccggcccccgaggcgcctgcacaactggctaggtcaaggaagataagatctgcccgcaggggtcgtctcgtcgtcgtgtacgtgaattgtgacgaacagggcagcactaggtcgcaggcggtgtgctcttttgtagcggcggtagtgcaaaggaggagggagggagggaggcaggcaggcaggcgtgatggcgaggggatatggaggtgatgatggtggcaatggggagagagatgagcaagcaagcagctaaaggcaacagaattatatgcaggcaggcaggcagctgcaacagcaacacaaaaggccgcatgacattagaggagagagggaggggaggggcaaggggaaggggtggtgcatatcattgtggtgggggggcgaatatgagagagagagagagagggaattccagagagagagccagcggtgaaacttttaggccttaattaggatcgagtagatcgcacctcgtcccatccatctccatcacgcactgcctgcgcaccagggaaacatacagggtttttaattttattaatatacggacgagatgccatggatcagctgagcaacaggcagagggtgggcagatgggacgtatacgccgccggccggtgcgctgccggagagttttactttacagcgccggtgaccgatcgtcgatcgagccacacaaataaaacaagcccgcgcacaacacgacgcgagaatgttcctaaacccttgcggcgtgctctctgcatcgtcgtcccgtccgtagccaagtgtgtgaaataatgcatgccgctgtagtatgtactactttgctagctcatctgtctgtctgtgcatgcgtaggcagtgctaaaccattgcatatgcacagactcagctgtgtcgtacaaggcacactggtcataatcggtgctagcttccaagggggttagatggatctaatcaattccccgcctctcgatctctggctttggtggcgtggtggtggtggtgcgcgtttatgtgtcctggcctccaactactaactgctgctccttttaatttgtgcgtcactgtacatacccattaatgtatacagtatatcaatatgctagtagagtagtagtaataaccacatactacgtcatttcctccggtggctagttagtttccgtgccgcatttgcaattgatcactgtaactacaggaacggaccgctaagctttaacactgcttgccattcgtcgtcggctacgagaaattaaaactgacggaaacaaatcaagtacgtggcgatggtgaaagggaggctaggcgcgcggtcggtggtgtaaaaaaaaaaagaactggtgcggccaaataggagtttggaaggaagctttaactggctggctccttgggtgcttcatgtggcctgtgtcatggctagcaacgacaggcggtgcttttaattcctctctctgtcctcgttccctcccttaattttaccccctctctctatgactctatgtatacatacatactatgaggccttttcagttttcactgggacccctgccgctgccaggtgggtcccgagcatattattgttgccgtatgcaccgtgcggcagggccctggctggtaatttccagcaggcctgcgctctgcgccaattatgggtccatcctggccgtccagtgccatcccatccgtccgcatcgcctgacagcccgattgttctgtttgtttttttcatggctgcaggtactagtacagtagtggtagtagctgggaaggttattgctacaactacaaactagcgggcttgggttcttctactagcgggcttgagtatcccaccgcaaacgtcttagcaatacttatctagaaatagactacagaaggatgatattttctatgaaccaatcatctgtggtagagacaacgcaagctgataggtggaggaaactcatttttatctcttcttcctcttaccttttgtacccaggggcggatccagcccatttttgtggtgtcatgtgacatcaatggattttagtaatctccattaaaatgtaggtttgttagcacttaaataggttgatgatactataatttaatggagatgacaccaatgattattttatctagatccgtcctgtttgtaccctccacctatttgacagagtgggagctcatttttctctattcttcttcttcgtcctcccttctcctatatcctccaggcctccacctttatattcaatgtagttttaagagtgggagctcatttttctatattcttctccttcctcctcccttctcctatatcatttctatagtaaaagagcactcgtctctaaccattattggcttacgttataaaaaaaaaccgtagtgatgtgcgtgcaactaattagtatgccatgaatttcgcaattccacactgcaaaagaggataaaataccagcgtaatggaattcatatttcgntgaagaagggataaccgaataataaagaggccggatcgtaacaggctaccagccttgaattgatgaattatggcatgtcagaacttaaacgcgggtggcctatacggatacagtatacattacggccggccccgagcaacgcaggatatgtccccggaccaggcaggacgaccccgcccggatcccgtcccggcggccagccgatcgatcgagagatatatgcatggcgatggcagctagctagctagcgtggccaccactcgtgccgtcgcatttgcatgcatgcaggcaggcacgtaggttgctggacgccgtacggaccggccgggcaccaagcatctgctgcgttatcgcggacggcctttccttctctgttctgcaagaaatattaatggcgtagagccgtagatgcatgccacgacgacatgtttggtcgttggcgagacgacgggcggaccatgcatgcatgctgcatgcatagcacgccgcgcgcacgcgcacgtatcgttacggcgagcctttttaaatgcatatatgtgtgagcttgcgtgcctgcagccgcaggcacaagcgagcgatctagggctccaggcccggccagacgacgaattacttctaggtttcagtgccgctccagcttcattcacctacctacctaccatgatgcatggcatcattcttccaccgcctgccctgccctacccgcggccccatggtaacttcgacgacgccctcgtcgagagcatcactgagcatgcagtacgtgcaggccccgtttgccgtggtgtaacttcgacgtcatctcgacctctcggatcatcactgaggcctgctccgttgggaaattttctctctactataacagtgtaactattggtgccggcatgcgttatactaacacaaacagcggacgagtttggcacgagtacgtggtcgttagctagctttaactactcttcacgtaattactgcttctgctaacatgcatgcacgatgcatggcggcatgtggaacgggcagcgctggtctgtccccggctggctggctggctccctgtagccaataaaaaacacccggggacaggaaaaggacggcaggaacgacgacagcgcgagtggagggccacatcaatcgccaacagcttcagtgcatgtagatgtaggctccagtgtgccagcacgtacgctgcttcgttgggttcattcacaaagtacgttcttcctccggtcgatctcttgactcgatctgcctttggatccgtcgtcgatcatccatctcttgcctttgttcaagcaacgagaacggcgcgcggtcgatcaatataatgtaggtcgaaatttcacagaaacacttggaatttctacgaccgtatccaatttagattcaacttcaaatctctctctctctctctaaacgaagggaggcggaaaaagcgagcagagaagtttagacacggccgcctgtgtgcttgactgtacaaccagcttggccaactgtgtgctatgaatgaatggtactgattgcgatgcttcttctgtgggtctagcgagccccctccataaatttctcgtggccatctttgctgggagggaccaaatcaattcgatcgctgccatggacgtacagtacagccgcagcatgctgcaggcttccccaactaatccgtcgacccatgcatcatccaaacgtgaagctgaaggacacccatgcttgcatttcatttaattatcgggacc

SEQ ID NO: 1938 - DNA, 1036 bp, Zea mays
cattgggtacctcgaggccggccggggcactcaagccctgcccatcagcacaaccaccaccaccaccgcctggccgtaacgtcacacgctcgcctccttccatggcgcccaggaacgctctccccgccgccagcgccgtggccaacggcatggtgatggagccgaggttccgcggcgtccggaagcgcccgtggggcaggttcgcggcggagatccgggacccggccaggaaggcgcgcgtgtggctcggcaccttcgacaccgccgaggccgcggcgcgcgcctacgacgccgccgcgctccacttccgcgggcccaaggccaagaccaacttccccgtcgcgttcgccgcgcttccgccgccgccgccgcccaagaagccggccgccgtgaccgtgagccccagcagcagcagcaccgtggagtcctcctcctcctcctcccgggactcgcccgccacgccgcccaggcccgcgtctccgtcccagcaggccccgtcgctcgacctcagcctaggcggcacaccggccatggtggccgcccagccgttcctcttcctggacccgaggctcgcggtgaccgtggccgtgccggcgcccgtgccctaccggccgaccgcggtcgccgccggtgccaacaagcatgctgcggcatcctgccgtgaagaggagcagagcgacaccgggtcgtcgtcatccgtggtggacgcctccccagcggtcggcgtggggttcgacctcaacatgccgccgccggccgaggtggcgtaggtggaccgaccgccgcagcgcccggtgacacgagacgagacggctccgagaggtcgcgtagatgattagaaacaagctgtattagtacgaggttgggttcaatttgccgcgatgggttactgctagccaggtgtacatagacctttttgcatcggcagctaatacctatttgccgatgttacaaaaaaaaaagagcgaaacgttttgtagttcgttgtaatataaaaaaaaaaaaaaaaaaactacgagggggggcccggtaccca

SEQ ID NO: 1939 - DNA, 1070 bp, Zea mays
ctcgagccggccgcattcggtgcctctcgagcggccggccggggcactcaagccctgcccatcagcacaaccaccaccaccgcctggccgtcgtcacacgctcgcctccttccatggcgcccaggaacgctctccccgccgccagcgccgtggccaacggcatggtgatggagccgaggttccgcggcgtccggaagcgcccgtggggcaggttcgcggcggagatccgggacccggccaggaaggcgcgcgtgtggctcggcaccttcgacaccgccgaggccgcggcgcgcgcctacgacgccgccgcgctccacttccgcgggcccaaggccaagaccaacttccccgtcgcgttcgccgcgcttccgccgccgccgccgcccaagaagccggccgccgtgaccgtgagccccagcagcagcagcaccgtggagtcctcctcctcctcctcctcccgggactcgcccgccacgccgcccagggccgcgtctccgtcccagcaggccccgtcgctcgacctcagcctaggcggcacaccggccatggtggccgcccagccgttcctcttcctggaccccaggctcgcggtgaccgtggccgtgccggcgcccgtgccctaccggccgaccgcggtcgccgccggtgccaacaagcgtgacgcggcatcctgccgtgaagaggagcagagcgacaccgggtcgtcgtcatccgtggtggacgcctccccagcggtcggcgtggggttcgacctcaacatgccgccgccggccgaggtggcgtaggtggaccgaccgccgcagcgcccggtgacacgagacgagacgagacggctccgagaggtcgcgtagatgattagaaaaaagctgtattagtatgaggttgggtacttgatcgttcaatttgccgcgatgggttactgctagccaggtgtacatagacctttttgcatcggcacctaatagctatttgccgatgttacaaaaaaaaaagagcgaaacgttttgtagttcgttgtaatatgtaacatattacccgctaattaaatagagatcgactgtcttgtgctt

SEQ ID NO: 1940 - DNA, 4319 bp, Zea mays
caccaaaagaggaagaggaatacccaccatcactcactcacattgtcacgtactgtgtctacgactgtgcaagtatagtgtcacacattgagacacactgagagagagagatggtgtgcctatgcacgtatagtgtcttactagtaggctctatatatgcgtggtgtgggctgccgtgccgtaccatcactgctctcctgccctcctctttataaacagcgcgcccctcgggcgccgccggaacttgcttcaatactagctcgctcaccactcaccagtcaccagtctagcaagcaacaacaaaggcgtaggaggaagcttgttttggaccgagcaagcgagccagccgagcgtgggagagagagaaagaggaattaattgatgggcgaggaggccagctgcgacgccgtcagcctgacggaggccggcaccaacgccaagccggtgggcaaggaggtcggccgcgagccggctgcagcccccgccgccgcggccgacccccggctgcagggcatttccgacgccatccgcgtcgtgccgcacttccccaagcaaggtgcgtgcatgcccttgcccttggcctcctcgtgttcattctttcattcctctccaatctccatccacgcgctgctctccgattgatcacgccgccgcttgccagtaacgctgaccgttcttttttttttctgcttcgcgcgctcttgtgtatgtgtgtgtgtgcatgcatcatgcgtgcgccgttggggggcttgcggtcaggcatcatgttcaacgacatcaccacgctgctgctgcgccccagggtgttcaaggacgccgtcgacctgttcgtcgagcggtaccgcgggatgggcatcgacgccgtcgccggtaagcagcagaacccgacggacacctcccctagtatcgtcccgcccacctctctctgccgagtgccgactgccgagtgccgagtaggcagccttgcggtgactggagcggcacgtcgctgtcgtcccggccgtgcgcgtgcagccgcggggggagctgactagctgagctgtgggcagagttctgagattccgtaaaatctctgagatcaccctggtccttttgctcccccgggcttttgtcgtcgcgcgcgcccgcacctgccccgggtccgttggcacatgactgacctgggccgacgcgactttccaggcttttccgcctcgtccggtacgtggccccccttgggaccgcgtgatcggacggttgcgtgcggccggcgcacgggatcgggcggtccggggacgccggcggtacacacccgtcgtcggtttccgcgggtggcgcgccctgatgtcacgcggctccgctgtcgctgtcgctgtaactgtttccgagattttgctctgcggctcgctggatcctctgtccgcttccgttccgcgggccgtgttcccgaatttccattttttttttatttttctttacaagcgggacgtacaaatcgagcgatttgcgctggctctgataaattgttgggttcacttggacattcctgtccagggattgaggccaggggcttcgtgttcggcccggcgatcgcgctggctattggcgctaagttcatacctctgcgcaagccaaggaagctcccaggtgagagattccatgaccatgcatgttctgtttttcttcttcttcttaacccatctccacactctgcactgtacccagctgttgcttttgtcgatctagtgcccagcctgtggcgacaccctgatcaagtatatgtttagcgaggagggttcttgcttagcccataatctctgacaccgccagagttgtttgtctggcctgcatgcagttgcagtcccgtgaatgggatattaaaagaaaaatgcaacagacggtttatacgagaccgatcattcattcattccccacttctgtccacaatgttgtagaatcatgtgctgacaccggctctcggaaacaattattattattattattggaaggtgaggtgatctccgagaagtacgttctcgagtacgggactgattgcctggagatgcgtgtcggggccatcgagcgatccggcgagcgggtgctggtcatcgacgacctggttgcgaccggagggacactctgtgctgcgatcaggcttctaggtacgtgagcggctcggtttcaactctactactactatgcattcaaattcaaacgaagtagtatccagtactgctgcttgcgttggaactgcatgtgccagcacatagtagcatttttttccccccttctcagttaaacgtagtagttagttggcctgagaaatgtggacaatgatactactgtaaagtaatagtgagtattagcccttttttatgtttgagctaattactactacaaattgctttccagaacgtgctggagccgatgtggtcgagtgcgcgtgtgtcattgggctcccgaaattcaaggtaccgcgttgctggattcacaactaatctgaactactgatatgcaaaaccagctgtttattattaaaatctagctgacatactgccatatactactgtactagcctgtattacgtattatgataacgttaggttccatatgctgtactagcctgtactagacatgctcggatgagattgtaaaatctgggtttcagatataaaaaacaatctatatatgttgtttcgtggattctgtgtctgtgtcttagaatcctctagaatcatggggtcttaaaatctatgtggatccgaaggctattatattactatatatatcatgtagcccatgatttgattatgaacaacggcgaggaacagcttgctttgttatatagagtactaacaacatgaacatgtctgctctcttgccgatacataagatcactcatcaatatatctgtaccagctgggcatccgtagacatgatgactatacatgagattccggtcggcgtcgtttgttattgcctaaataattaaaactatagaaggtacaccactacgtacatgtgccagtctgcttattttggtcatcatatatactattactttgttttaatttagcacgggtctgctgtgttgtaccatggtctcaggagtgacaagatactgtgtagtataggtcccaggataaacaaagctgagacagacgtagtcctcctagttttgcttcttgtgtccgtttcagtaaccggccggtcgcagcagcaaaagaagcattcgttttcacttttatccaaatttcaaactggttgatttgggaaaaaatgatttaaattacgtaacttccctgcaggatttgtacaagttgaatggaaaacctgtatacgtgctggttgagtctcgtgaataatcggagaaatgacaacttattctcaggtgtcagagtgatcagggatattggctgtttactccttgctactgcgattgaacagtggagggacgacatggacaaggacaagtatattcggtgcatcactaagtcttggtgaggggagagattgtagtgttttaggctgagtagtgaagagcctgtagttctgcacggaacatgatggttattagttgatgcaacagcgttgctgttctattattgtttgttgaattttgtggctttggtttgaagcctagcctgggctcaaacagggatatgcatggcgcttgagtgaacaacttcgacagcaacacacacatgcttaatgtcagggaagtagctaggaacctgctacttgttacccgtacgtagtgtcatggaactcataaggtttagtggcaaaattcataaaaatgacacgggaaacgaacacagcacgcgtagcaggggaaaaaaatgcgtagatagatatacttcgtactagtaaaactatcacacagctcgtattttgagcctcggtatccactaaatattgggggcgtagtattcgcgtgagcagtgaataaatgcgtagcgggaggaatggtgtggtgcatgtgagcatgtcacctcgctcgcaggctcgcatcctccatgcatgcggcactggcgtaagcaccagcgaacctcgttcaggatccccaggcgtccaggcgatgtgttgtcgcatcgacccgtaggtgccgcaggcctacgtacaccctagcccgtgcggccgtgcccctgcaggctactgtagcgcggggagcactgcagactgcactcgggcctcggggacaaggggggcaaaggccagtgtacgtgtagtgtacgtgtagcctacgcacggcacacatcgcgaggttgccggctcggcagacgccggggggtggcgtgcccccgctgccagcaatatgcctttccggcgccaaatcg

SEQ ID NO: 1941 - DNA, 4700 bp, Zea mays
  misc_feature (3922)..(3922): n is a, c, g, or t
tagtatatatatatctattttactaatttaaaccatgctatttaatatatttttaagattttatattataatttagagagcaaatttatgtttatagctagactcgttggctcggcgagccagtagcgaggcgagtcgaaccgctatatcaagctcgtcagatgaacgagctcgactcgttacacgagcgagccgcagcgagcgagtcggctcgtttccatcgtagtgcagcgctatgtcctccccttctctctggttgcatacgaccaaacgctagatgaagacggaactgttcctgtcctgttccctcggacgtggacgccattatttgttggtttagaacaaaaatagtaaaatagatgataaatagagttggaaaatgatatttatgtaggaggagagtttagggaggaagaagaaaagtaaacgatgaaaattaggtgaggttaactgtatagtaggtatacagtaggtatataggaaaaacttaagaggatccggtagggctagtttgggaataatgctttcacaagggatttcaattttaccaaggaaaacaaactaatttctcttacgtctcgtttgaatcattagaattgaattccattctaacaataataatttaggcattatattaattaacctaattcgattttatgcaaaatatatttatatactattattagaaagatgtcggagatatttatgtgctatatttttactatgaatgtgtgaaactaagagtgtcatataagttatagaatagaaataaattcaactaatatataaaattatttctcatcattcaccctatgaatttgaattaaacttatatcttaattttggaaagtggtggaatgacaaatttcaaactaagggggtgtttggtttctagggactaatgtttagtccctcaatttattctattttagtccctaaattactaaatatagaaactaaaactctattttagtttccatatttaacaatttatgaattaaaatggaataaagtgtagggactaaagtttagtccctataaaccaaacaccccctaaataagttattttattgaatgaatttaaactagccattaaaaaaagttaaaactgtaccgtggcgtggcacggattgccacgactgacacgtctatttggacatctatgcttgctgtagagcccgtcagcccggtcgagagcaggaggaccggatgccaaaaaccaagtggaaatcgaggacgtactaccggagcagttcctggatcgatcactgacgcgatcgcgtcctcctggtaagggcaaccgcacttgcaaaatgccagtaacatggctcccccccccccccccccacacacacacaccacctgggccctggctactacctccatcgatactgtagcggactagcggctgctcccagccacagggcggtactgatgaatagtaaacaacaactgtctggaaaacagtaacgtggcaacgatgccagcgcgagcgcgtggcctttcatcgcatcccctgcgactactccaaactgtataatcacgaagttggcgccggcgtcggagatcagaattcagaaatcacccttgggccttgaccgggataaaaacgtcgagaagcgtttttctcactgatcgaggagtttggcgacgatggatcatctcttccggcgggttctgtccgtcctttccagatcgcaaatatttcccgcgccgcaccgcactgcactgcgccgggggctcctcgtcttggcctccctcgaggacgagcagtggtggcacggcagcccacagcacgcatagcccccgtacgactatgcgctagtacgtgcataggcataggcatagccgcataggcacacaatctctctctctctatatatctcggtgtgtgcgctgtgcccctactacttgtacagttgtagtacgtgacaaatgtgagccagggagggttactgggggcgtgcctctttctcttttcgtgaaaagcttcgcgccctggccccagtattgatgagcagcgcgcctaggcctagccgtttcagagaggaaaagggaaagaaaacggggagcgcgtttcgtttacttaacagtggcctagtagggcgcagccgctgctccacttggggctagcctaggcagtagccaccggaccgcaccgcaccgcacggcgtccggatttgaagcgcttgtgtgggtacacaccctccactccaccacggctcgtcgggttgggcctgcctgcctgcctgccgtgcagtgccgcgccgcgccggtgtcctactagattagcagtaccacggcgtcaccaccactgcacttatgtcacccaacccaacccaacccacccggccagccccccgttacttcgtcccaggttttcggcatgaccgtgccgccgtactgcttgatcgccgtgtccgcagcccgttggccgcgtggacggtaacgtctgccccggtttaatttctcccgtcccgatccggcaacccgaggcccgggctggtgcttctcactagtcagtactcagtagtagtagtagtcactccattccccccacccggctagtagccctgctctgctctctgcctcggctatatatatgcgccgcgggcccccccccccaagcaggcaacaataaaggcggggtcgaagaggagcttggagcttggaccgacccgagccccatcgagcgagagaggaaataatgggtgaagaggccagctgcaacgccaccggcgcgatgcaggccgccaccaacgccaggccggccaaggagaacggccgcgcaccggctgtggcggaggtggtggcccaggaggcggccgctgacccccggctgcagggcatctccgacgccatccgcgtcgtgccgcacttccccaagcacggcatcatgttcaacgacatcaccacgctgctgctgcgccccagggtgttcaaggacgccgtcgacctgttcgtcgagcgctaccgcgggatgcgcatcgacgccgtcgccgggattgaggccaggggcttcatatttggcccggcagtcgcattggctattggcgccaagttcatacctttgcgcaagcctaggaagctccccggcgaggtgatctccgagaaatacgttctcgagtacgggaccgattgcttagagatgcatgtcggagccatcgaacggcctggtgagcgcgtgctgatcaccgacgacttggtcgcgaccggagggacgctctgtgctgcaatcaggcttcttgaacgtgctgaagctgatgtggtcgagtgcgcatgcctcattggcctcccaaaattcaaggatttctacaagttgaatggaaagcccgtctacgtgctggttgagtcccgtgaatcagataaataagaaattatgggacataggaaagctggcggttcattccttgctgttgtgcttgagcagtggagggacatcgagaagccaaccatgggggtgcgttagcgttactaaggctagctgctaagatcgacttggtgagaggagagattagaagtgctgggggggcgttagtcttgtaggctgagtagattttcagagtactgaagagcttgtagttctgccaggaacatggttattagttgaagcaagaatgttgatggtccattgcttgttggattttgtggttttaatttgaagggcgcaaacatggctggatcagcttgacggaagaacttggacatcaataccttagcatcaaatactagggaagtaggaacctgctacttgtagcgtgttattcctatctccaaaaaaaaaaaaaaaatagtgacaaaattcacaaaaaattggcacgcgaaacggacacaagtcgtagcagaaaaaaacgtgaatatactatctaaaaataaaaataaaaaccaggcgcatgggatttaacagccctctgtttcctcntcgcctgccttgtcgtctgacgagcggcacgcgcgcgcggcgcatcgcatcccatccatggctggcgccatgatgggtggaaatcccgcgacgggcattgattgtgagaaccgcagggcagtagtactacgcccataaatgccgagtgctacgtgcatgtcacctcgcatcctccatgcatgccgcactgtcgctggaaccagcggacctcgttcaggaatcaggatccccagacgacgaacctcgttcaggatccccaggcgacgtgttgtcacatcggccatcagcagcagatggcgcaggcctacacctagcccatgtccccgctcgagccgagatgacagctccggaagtccgaagccgagccgttgggtagtgtactgctgggctgattttttatttaactttgttttaaaaaaaatatgttgacgtccgggactaataacgaattagaaactagtgacctataccgctgaattagatctaaaaaagtcagcgttggtactcccttcgacccagaaaaaaatgtcgttttgattttttaagaacaagtttaacgggatcgtctcattaaaaatataattattatttattttcattctgatttagtttatcatacaatttactttaattatcaactgatttttttctgtgttttcacaaatattttgaataaaacaagtctgccaaatgacttctttatgggacagagggagtataacattgaagttacaaaatttggtgtcatagatcgtattggaccataaatagcattgac

SEQ ID NO: 1942 - DNA, 1058 bp, Zea mays
accccggcacttgcttcaatactagctcgctcaccactcaccagtcaccagtccagcaagcaacaacaaaggcgtaggaggaagcttgttttggaccgagcaagcgagccagccgagcgtgggagagagagaaagaggaattaattgatgggcgaggaggccagctgcgacgccgtcagcctgacggaggccggcaccaacgccaagccggtgggcaaggaggtcggccgcgagccggctgcagcccccgccgccgcggccgacccccggctgcagggcatttccgacgccatccgcgtcgtgccgcacttccccaagcaaggcatcatgttcaacgacatcaccacgctgctgctgcgccccagggtgttcaaggacgccgtcgacctgttcgtcgagcggtaccgcgggatgggcatcgacgccgtcgccgggattgaggccaggggcttcgtgttcggcccggcgatcgcgctggctattggcgctaagttcatacctctgcgcaagccaaggaagctcccaggtgaggtgatctccgagaagtacgttctcgagtacgggactgattgcctggagatgcgtgtcggggccatcgagcgatccggcgagcgggtgctggtcatcgacgacctggttgcgaccggagggacactctgtgctgcgatcaggcttctagaacgtgctggagccgatgtggtcgagtgcgcgtgtgtcattgggctcccgaaattcaaggatttgtacaagttgaatggaaaacctgtatacgtgctggttgagtctcgtgaataatcggagaaatgacaacttattctcaggtgtcagagtgatcagggatattggctgtttactccttgctactgcgattgaacagtggagggacgacatggacaaggacaagtatattcggtgcatcactaagtcttggtgaggggagagattgtagtgttttaggctgagtagtgaagagcctgtagttctgcacggaacatgcatgatggttattagttgatgcaacagcgttgctgttctattattgtttgttgaattttgtt

SEQ ID NO: 1943 - DNA, 7607 bp, Zea mays
  misc_feature (633)..(633): n is a, c, g, or t
  misc_feature (5944)..(5944): n is a, c, g, or t
  misc_feature (7425)..(7425): n is a, c, g, or t
tagccaggccgacgagattttgggggcagaggaggatttcgccctggcgccgcggcggggctggccgtcgatggacgatggcggcctcgggagggcgatgatcgagcaggcggatgcgcctcgggagggcgaggttccagcacacgattgagcgggcgggtggtcctcgggagagcgacgatcgagcggcggtggttgcgatggacgatggcgcaagatggatggacggtgcagatttactggaggcagaacaggcagaacggcagaaccgtcagaggcagactacttttgctgtcttaataagtagtacagatattatcatggttgaatatggtagatatgctagtgtgtatagtgatacatgagtcgtttgtgcgtagtttttttatcttgatggtttgcatagagaagatatgcctaatagattagatttattttcgcttttgttgttgcatgaattaggacatatgaggtagttgtcggtatagtcgcacaactttttttgtccctacaggttgttttttagacattataaatcgttatatttcaccattaatcatgttgacaatcgtgtgaggtgaaatgataacagtgcacccaactcagatttgttgtcttttaaaacctaaaagntacaacacttttagtccatatggtgatagcaatcgttagaggcaacttgccactcacatagccacggtgggggcacggtggtagtggttgagtggtttaccataccagagaggtgaaaaactagttgctagatagcacttagtccttgcatagattaaggagagcgatagtattgatcgggtgctctaactagaattagtggcactatcagatatctcggtaaagcatcgagattataatcctttctttatattaatcatttatatttaaacaatttcttttaagtatttatatcactagaattttcatactagtctatgattggaacttggtgtgcagaacttttgatcgaactataaggcataaggaacgaagttgagcttgattacttgttttaatttgtgcaagaaaatttggagacgcccaattcatctatatcttgggtattttgatcttttagctggcacgccggtgctgtagcattttgtctccgtatgtgtggatgctacgaagatgtgctgctatggatacggccggtgttgattagcaatgagtgtgagaagaatcatgggataaacatgttgttgcttgtgatagaacccttctctggtactgtgttatatacctaataataatagttgggtcgtagcttatatttataacattgtcttgatcgcacatagtcaatattatgcgtagcttatcccgtatccgttttcgtatggacggagcaacggaggactctgctcggcgcagccaacgaggcaacgaagggttgagagtggcagcgcagcacggccgccgaagccgaacaggtgcattcggggcttgtacgtgggcgttgcgtctgccaggacgtaagtgatagtctgtggagtgtggagtgaggacttgttttgtctaacgcatgtgccaacttggtgtagatcaagcttgctgatccaaatccgacttttatacgagccaaggcaacgacgtgttaggtggtgcacagcgtgacatagcgagtgacagcagagaggctgctataggcacgcacgccatgtgtgcagtatactagtagtactagtatttacggaacatagaggctgtgttgtgcttatctattagtaccagtagtggtggtacggtggtagtcttctaattgtctagctacatgaggtttttgcaaggatagagtcttcttgccattgttagcacgtcttagaagtcatatgctcatccacaaagcatcgctctgggagtgcttttttatttttaaacaaataaaaggcattgttgggagagggtaactgatcgaggtctggacaacaaagaaaaatcctgttttaacgacagactttaaaaaaaatgacagaacttaactaccgattccaatttctttactacagcttatatatcatgtgcgtgaacgtactaacgcgagactgtgacagcgcaagtgtcaacggctgctcccactgccattaacccatctagaaaagaaaagaaaaattctccgcaaccgcgtgcctatctggtagatgcagaagatccatgcaacccggtgccacttcagccgacggaagctcatacgcgatgggttattttaactgaccccctcgaggtgcccaggctgttggaatcttccatgcgcgctgttgcgggcccacccaccgcgtggtctgcgcccgacttgctagttgctaccggttcggttctggtttgttttggacttggaaccgtctgcctggccagaacagggggcgacggggagccgaggaccaccgctcaagcgtttgcatgtttgcgcatgtgcttaaaatgcctcgcagagtactaggctactagcgcagacaccagacaaactgctcatcctcctcttcctactactaccgcgcagcaccgtagtaatatataagcgccaacaaagtttgtgacatactacgtacttcagttttcagtgtgcacacactagttaaaatatggaagcttaatttgttggttcgcaaaaagaaaaataaaacctgctgtaattcgttgttttttttgcttgcttattactcgatccgggtccgtctgcccgcccgcgcgtccagcgttgccggatcaagccgggtatgcgtggatcggttcgagatatgtatggatccgcaaccgacgacgaccgcatctcacatccacagcgacgcaggagccgcgcgccccggtcagtcctccctccccacacctctcttttctcgcacatactagctggcctgtacctgtacacactctcctaccctaccacactcgcacgaccagtcgtcgttctcgttccaccgcaccgcaccgctcagctcagcggcaggcaagttgtgctgcccggcttcccctttgcatcctctccgtgtcttcgcctccacgttgaccacgacctcttccctgcagccctctcgccgcctccgtccaccacccatgcacccacccgaacgagactactcaactcaacgtctcaacccaacccgtctctagccgccactccaccggcttcccacccactgccgccgcgcccccacctgtgactgtgccgcgtgcgtgcccacgccgcgaccacctcactacccccacctacgacgcaacttcccacgccccatcacacacccgccaccgctttaaaaccccctcgccacccccctcactcaatcacactcgcacagtctcaccacagcgagcgagagcaaggcgcccaagcaaccaccgcgagaacaagtcgcagccaaacagccccgtctcccagcgaagcttgagcttgcattattctaccatgtcttccatggagctgctccacgccgtcgtcccggagaagcagagcgaggaggaggtcgcgcccgcagcgacgaccacgagcagcagcgccaccgccacgggcggggacgagggcgcccacgtgctccaggggtgggccaagaggaagcgctcgcgccgccagcgatcggaggaggagaacctcgcgctctgcctcctcatgctctcccgcggtggccaccaccgcgtccaggcgccgccaacgccggtcccgtccgcggcgccggccgccgcggagttcaggtgctccgtctgcggcaagtccttcagctcctaccaggcgctggggggccacaagaccagccaccgcgtcaagctgcccacccctcctcctcctcctcctgctgtaactgtcccggcagcagtgcccgtcccggaggcccccgccccgaccaccgtcgtcgtcccgccgctgccgccagtcgaggtcggccgcgagccggccacgtcatccaccgccgcgtcctccgacggggcggcctcgagcagagtccaccggtgctccatctgccacaaggagttcccgaccggccaggcgctcggcgggcacaagaggaagcactacgacgggggcgtcggcagcgccgccgcgtccaccgacgtcccggcggcgcccgccgagacgtccgccgaggtcgggagctccgccgcgcgtgcgttcgacctcaacctcccggccgtgccggagttcgtgttccggtgcggcaagcccggcaagatgtgggaggaggacgaggaggtgcagagccccctcgccttcaagaagccccgcctcctcatgaccgcgtgaaaccgctgcgcgcgcgggcggcggatctcatctcatcacccgtccaagattttggtccgcagctgccgagttcagcggtggaagtggaacacactattcgttcattcatttcgtatggtgccagtagcgctattgtttgatttttgtggctgctcctcttgtacagtaccgagtgcgagaaaagatgcatagtcatcgtatacataccaatacaataccgtacctataggtcttcctattcctgtggaagagtagaacttgtatccttattagctgtcagtacactacagttcatacacacttggttctcattatcagagatcattggtgaattagtggttttgtatcataagcttattgtaaatgatggattggagattagtatggaatcagatacccatttgttccaaaaaaaaaaaaaaactctgtagatgcagttgcagatgctctttccgttgccagctcgaaccatccctttggctggcttgcttccatggtaagaaacggagcagtctgcttcgcctctcagaagcaacgtcctccctcatatcctacctttttttttctttcgtcgtcctcgcgtactcagccagtgacgtccatcaatcccggctggcgataacattaatccggttccacgagcgtccaccacttgctgcggttgcggagcagcgacgccctgcgcccgccgccacaagtgggaacagcaaacctggggccgttgcggcttcgggaacgccgacggacggcgcccactagcgggtggaacgcccgccgacagcgacgtcgccccgcccgcccgccggccggtgttgataagtgcgtgccgtgccgactggcggccggatcgctttcgacgcaacagttcgcagcggccagccgcatttggtggtggaatggaacttggaagccatgcggaaaatctaggtgcgtctcgcctcgccccgtgccgtgccgtgcgtacgtacgtgccatgatgcttcccgcccacttccacgccgaaccgtccgcggcgctggctgcgtcgcgagtgacgcgcacgacgtggtggtggtggtggtggtggtgccgacgtgcgccgggtgcgtgcgcgtggccgcggctcggtcgcgtatgtagtgtatgggcgggcgttgaagaagcgtgcctggcgagttggcgtcgacgacggggcgggagttccgcatgcttcacgtggcgtcctcgcgtcctgcggagcggtttcactggacatggcgtgggcgacccgccaccggtcccgcgacggtggtgcgcacgtctctgggagagttggcaagttgggcagctcggtgcgttctggatgctgcaggaggatatgttcgcaccggccggcagtttcgtcccgggcttgccttgccatcttccgttcttttttgtctttgggtccacgccatggtgacgcacgccatgttttcatcgctgattaggtcagttcgctctacgatgggatggattcccggagctgccatttggagcaccagtgctgctgcccaacatggcaagtccaaaagcaggagaattccgatccacccttccaactgatgatctcacgaggttgacgagtcgtgaaatggttcggctacatgtgctgggctaagcaaggccctacattagctctcgatcaggttaaataggccaggaatagttgaagtgccatcctcattccgattgcanaattgtcgcttcagcggcccgtcttaccccaaggcctttccccaaggcctttcccgcgcgctgacgacctgggatccgttgtctcttctcactgctcccgagcctctttcttctgtatgggccttttacccttttccagtgaatttctcggctcctcaggtccatacaaacgccggcccgctgcttccgcggagaccgccagtccagtactccagtagctagagttgggccaccccgcgaactccattggccgcagaacttctccgaagcaggttttgtccctggcttcatgatttttccggcttgtactgtcaattgtctagtgctagagcgccgtaagagacagccttgtgatcgtgaagagtgtgtgtaatgttaacagttattactaataattgatttaatattaattaaaaggatgtctttccccatactctttctcagacttgtaattgtagctgtctatttaggctactgtatatattacagcagtgtttaatgtaaacatagagggagaatcattttgcatcaatcgcttgtctgttgctctctaacgttatcacgcaatctgctctcctatgtatttcgatgagaacataaggctgtggatgacgaagatgaacaagaacgtcttcagaggatgttgacagcaatgatgttcaggaccgcgactagctaacactccaatcggagatcaaagtcctcgtccttcactcccatggacggtggccttcaacatctgcaacacagtggtcgtcgtccacatcaacagaagtaataatgcaggcttccatgatagattgctctactgcgttcgtccggcaacatcgaaaatgaaggatgcaaatagtttatcggactttgctgaatgagagtgccaattggaaaagaacacgaaaggattgcaagtctcaatcctagaagggtgtgtaatgatgtgttctcccccccaatttgagatgttctcatatccctttagagcttgtttgttagaacttacaagagagttgaaggctatttcaatcctcttttaaccaaacgagcccttaagaatgtaacagcactcgcggcggcagtgctcgatgcctcgatcagaggctgagcccgcatgcctgtggatctcgcgcgctcgagctctacggcgggactgtccgccagtgccctagcggcctggtggctggctccgtgcgaacgactaggctgatggcggtttctccggtgtgttaggcctagaaatggcaacaggactcgatccttgattttccgttgggactttctctattaggatttactccgtatttggtttgacgttgattgaactgaatcagagaagattaaatttcttgttaatcaaaattaaataggagaggatttaatcctcctaatcctctttgatccttattcaaccgaacaaaaccttagggtggacatgacataagttactttctacgagcattaaaataaataaaaatatagttccngtcacgtttgctaggaggacagggatgagaaaccatccctaatctccgtttcccgttaatcgcccgcaaatttcttttgatctaaatttttctattgttatattaaaaatatactaaaaatcaatacatagtctattataaaatagcaaattaaactttatataaatcacttataagtttaa

SEQ ID NO: 1944 - DNA, 2285 bp, Zea mays
atcacactcgcacagtctcaccacagcgagcgagagcaaggcgcccaagcaaccaccgcgagaacaagtcgcagccaaacagccccgtctcccagcgaagcttgagcttgcattattctaccatgtcttccatggagctgctccacgccgtcgtcccggagaagcagagcgaggaggaggtcgcgcccgcagcgacgaccacgagcagcagcgccaccgccacgggcggggacgagggcgcccacgtgctccaggggtgggccaagaggaagcgctcgcgccgccagcgatcggaggaggagaacctcgcgctctgcctcctcatgctctcccgcggtggccaccaccgcgtccaggcgccgccaacgccggtcccgtccgcggcgccggccgccgcggagttcaggtgctccgtctgcggcaagtccttcagctcctaccaggcgctggggggccacaagaccagccaccgcgtcaagctgcccacccctcctcctcctcctcctgctgtaactgtcccggcagcagtgcccgtcccggaggcccccgccccgaccaccgtcgtcgtcccgccgctgccgccagtcgaggtcggccgcgagccggccacgtcatccaccgccgcgtcctccgacggggcggcctcgagcagagtccaccggtgctccatctgccacaaggagttcccgaccggccaggcgctcggcgggcacaagaggaagcactacgacgggggcgtcggcagcgccgccgcgtccaccgacgtcccggcggcgcccgccgagacgtccgccgaggtcgggagctccgccgcgcgtgcgttcgacctcaacctcccggccgtgccggagttcgtgttccggtgcggcaagcccggcaagatgtgggaggaggacgaggaggtgcagagccccctcgccttcaagaagccccgcctcctcatgaccgcgtgaaaccgctgcgcgcgcgggcggcggatctcatctcatcacccgtccaagattttggtccgcagctgccgagttcagcggtggaagtggaacacactattcgttcattcatttcgtatggtgccagtagcgctattgtttgatttttgtggctgctcctcttgtacagtaccgagtgcgagaaaagatgcatagtcatcgtatacataccaatacaataccgtacctataggtcttcctattcctgtggaagagtagaacttgtatccttattagctgtcagttcatacacacttggttctcattatcagagatcattggtgaattagtggttttgtatcataagcttattgtaaatgatggattggagattagtatggaatcagataccccatttgttccaaaaaaaaaaaaaaactctgtagatgcagttgcagatgctctttcccttgccagctcgaaccatcccttggctggcttgcttccatggtaagaaacggagcagtctgcttcgcctctcagaagcaacgtcctccctcatatcctaccttctctttttctttcgtcgtcctcgcgtactcagccagtgacgtccatcaatcccggctggcgataacattaatccggttccacgagcgtccaccacttgctgcggttgcggagcagcgacgcccctgcgcccgccgccacaagtgggaacaacaaacctggggccgttgcggcttcgggaacgccgacggacggcgcccactagcgggtggaacgcccgccgacagcgacgtcgccccgcccgcccgccggccggtgttgataagtgcgtgccgtgccgactggcggccggatcgctttcgacgcaacagttcgcagcggccagccgcatttggtggtggaatggaacttggaagccatgcggaaaatctaggtgcgtctcgcctcgccccgtgccgtgccgtgcgtacgtacgtgccatgatgcttcccgcccacttccacgccgaaccgtccgcggcgctggctgcgtcgcgagtgacgcgcacgacgtggtggtggtggtggtggtggtgccgacgtgcgccgggtgcgtgcgcgtggccgcggctcggtcgcgtatgtagtgtatgggcgggcgttgaagaagcgtgcctggcgagttggcgtcgacgacggggcgggagttccgcatgcttcacgtggcgtcctcgcgtcctgcggagcggtttcactggacatggcgtgggcgacccgccaccggtcccgcgacggtggtgcgcacgtctctgggagagttggcaagttgggcagctcggtgcgttctggatgctgcaggcatgcaaga

SEQ ID NO: 1945 - DNA, 1772 bp, Zea mays
gtatctgatattctgatcatggccaccaccacatctccagttctcctcggtcctcgccgcggcgccggcatgtctctcgctctccaagccctccgccgcagccgccccctcgtcgggttcctcccccactcctcccctctctccacctcagcctcacctcccgacgcccacgagctcctccgcattgaccgcatcctaaccaaccccgccgccgccggcggcggcagcctaccctcgcaatcccagcaacacccacgcgccgccaccgatctacaccagctcctccgccgcgccgccggcctcaccgcagcggagtccgcctccctcctccgccgcctccctggcgcccagccccacccccgcctgggccgcctcctccaggagctcgcgggcctcggcctccataggggcgaagtcaaggccgccctggcgtccgaccaggaaggtctcctctccatggaccccggcgaaccgtcccggctcctcgacctcctgcgcgacctccggtgccgggaggcggtgagggaccggatcctcgcccacggcgctctccgcgccgccgtcgccgcccggcggcgggtggagctcctccacgcgcgcgggctgtcccgccacgacgccctgcgtgtgctcgccgccgagccgcggacgatgctgtactcgccggaggacgtggagaggaagctggagttcttggtggaaacaatggggtttgaggtcggctggctagtgcagtacccggagttcctgggcgtgaacctggacaggtgcatcatcccgcggcacaatgtggtggagcacctgaaatccgtcggcgggctcggagaccccgttgaaatgaagcactatgtgaggctcacccgcaggaggttttacaacatgtttgtgaagccgtaccctgagtgtgagaggatatttgggggcctggtcagggagagggacgagatggcgaggcggcgacatccgaccggcctatggaaactgtttaagccagcgaagcatgagagaactcaggaggatgtgcagaacatgaagtctctcgtgggatcactgaaatgagtaatgttatgcccaagggaacattggtggtctcaaacaacagcaaatgctgaaccaatgatgtattgtgatctttcgcttatgcacggataccccagactagttctgataaccaagaaggaccatttgagaatttcatgtttgaggtgacatgctagggcgcgaagaggtgtgggtggtgttgtgaaaccataactgttcatgaagtgcttgtgtggtgacagaagtggcagttattctgaacggacatagatcatgttcaatattctcaaaaatatcttgctaaggcatttcaccgcagattgcaagattaaaatttgagcaattctagtattctgatcagcatttctttcactggagagtagcagataacaagttcaggaaatctggcagctgatggaatggttacctcaagatttcgatgggatggatagagcagcagcagaagctcattgcatattttcttttgagaaatttatgatgatcagaagattctgctcagaagatgagcgtgctaatttaatacagaaatgttttcttgtgtgtacatcgtggcactggttagtttagagacatttcgctgctttctattgtttagtgttatgtgattaccttcttacattcttgttcaaacactagtgtaattcattattcatgacttctttattggtgcatcttaaaaaaaaatattgcatttaaaaaaaaaaaaaaaa

SEQ ID NO: 1946 - DNA, 2633 bp, Zea mays
agtacgtcgcggtgaaagaagcaatcgcatacatggcagattgcttgaatactaattgccatctaataaatagatctggactgttcatttcggcttaaagtcagttgtttgaactgctacccctgtaatcaatagagacaaaaacattgtagaatcaatagaaaccatacagataaggaacacgcatgctagcaggctccaaagcacctcacacttctaaatgtatggcacaaatcttgcatgtctaattgtaatatggttcgttgtttagcacaaacgactaaacgagacagaaaaaaaaaagatcactactgcactcataagtacaaaactttgatcagggagccatcaacagcacagtgatacatgggaatattcatatttcatgtcagcttcattcgacatgaaataatgattacgtgtaacaagatgaaaatgcactgcattctgaagtaggaagacaatgggaataggttaagtacaactaataatacttctttaatatcagcagcatctcgtgtcatcaactaggatcgaaactttactagcagtaacatctcatattgtttgagtgtcatcaactggtaaatgaaaacacaagtgacagcattccgtaggatatttctttttcaagaaactactacacgactatcagtcggccatgccttagtagaacctccgacgacacagcgaagaactatattgacaaactttggatttcattcttctattcacaccttggacacgatctatttcagagttattatagtcataagtcagttcctgtagtggtggaattgtctctgcagcaaagaacataatatgtggcatccttttgtcaccatggtcccggagaacattttgtgcttgaagatttggtgaacagctgtggctgatgaaccttccgatgtttccatacacagatgcatctatagtgaagcgcacatcttccatggcctgggagcaagagctagaagagttcaaacctgaaacatttgatagcaacacactgctaacattctcgtcatcatagttaaggcctacatcaaacaagtaattgttgttccttctcttgtcagccgccttttgatgctgcagctcaccgatatactcacatatgaagctgccagcaggaatggaccatagagatcttacgccccaacctgtcttggttgtcctgaatacttccagtggtattttcgtatcatgctgactgaccctgttgcggcacgacggaggacatttacaagatgaaccacactcaaatatcacagacttctcattgagaattgcgccacttaagtcaaatgggatttcccctccattcttcacagcacaggcacagctctcagagtctgagcaaccattggtgcagtcacaaccctgattgtgtttttctgtaagcccaaatggatatctaattctagtggtgtattggaaaggtccaggttgcacatcatcgactgtattaatgacacagatgggagtggcttccttcccttgagatatatcagtcatgcacaggcctggacggcttttgaagctcttcaatcttttagctatgtgcataggaagttctggttgcccatgaatcttttttaacttgtacttaaacacccttgaacctggtttaccatccatccagaaatccaccactaaatacaatccatcataagtgtattttgggattagtttggcccccgaatgactgcctcgatcggtattccgacacttaaatccatgaatcactcttacaggaggctttggtttgatgcaattctttagtgcaagggtccccacacttaagcttttgatcctcatctttcttcttaacagcagacttcccgccagaaccagtgtatatcagttcacctgagcaacccaattcatcaggataacctccagaagcaacaatgcttattgcaataagcatgccatttctatatgtggtggtggaaatgcctctccggtactcactatgtagaccagcaatagcaagctgagctctgtatagaaactcatcaccaacttcaactccaggaacttgtcccacaataggaccatgtttagtaaaacctggtaacgccttcattactttagcagcttcattgtcaattctcatcttcaatgaacgctgctccatagtttgtacaagcgtcctgcatacaaactcaaacatcctgcacaacattttaaatctgctcctagcatctgcattcatgtatctatattgcctttgacacctcacagaaggcaggcctgatgaactattgaggtaaagctcgagatttctttcatttaaaactatttccctaaatatgtcatgaattttcaagttggaagccacctcatcatcccgtttgctcttactacccgaggcaaacatcctctgttgatgacctagagcttttgccttcaccatcctcttgtgaccaaagaaatccctagttgtggcagccttctttttgtgtgtcatgggcatggggcacatgtctggagacatgggagcttgcataactcgatccttagtgagctcaacagagtcctgaatcccatttgttgttacccacctttcgcgtacggtttccttcttgcctttggaaaatggtataaaagagcatctgtaacaaatt

SEQ ID NO: 1947 - DNA, 875 bp, Zea mays
cccgcattgggtacctcgaggccggccgggagataagcgttccagatcgtactggaccaatctgccaccacacttttgatcacacacagacacaggaagttgagatcagaaaaatgcaggctgccgctactgccgccgggttctcggccgtgctgcccgccaagggcaggccggcggcgaggagcagggtggtggcccgtgtccccgccacaaggaggagcgtccgcgcagctgccgtcgtcgcgaccgaggccgcgcagatcgactacagctcaagcgtctcggtgttcccgatggaggcctgcgacctgcttggtggcgacgcgtgcaacgggcccatgttcccggaggccaagcccgcctcggcggcggcggcggcgagcaggagtgtggtcggggtggacagggactacctgtcctacgacgagccaaagacggtgttcccgggcgaggcgtgcgacgacctcggcggcgagttctgcgaggcgccgtaccaggacggcgtctccagggagctggcgcacgcctgaagaccctgatccatccatgtctgtccaccacgctatgtacgtatgtgtagcagatggtttacatctacgtgttagagcccggagagctggagaagctagctagcgtgcttacagaataacagcagccaagcaaagccaagggtgtgtatataataggcatgccttgggttgtgtcagctgcgactgtatgtatagtttaaacgaagatgaaatggtactgatggtgatatacattcctgtatattacgataaaaaagcgagcaaaatagattttgcctcgatatcagatagctttccactaccataaaatattatttctaccgaaaaaaaaaaaaaaaagcgggc

SEQ ID NO: 1948 - DNA, 4396 bp, Zea mays
  misc_feature (1221)..(1221): n is a, c, g, or t
  misc_feature (1677)..(1677): n is a, c, g, or t
  misc_feature (2236)..(2236): n is a, c, g, or t
  misc_feature (2412)..(2412): n is a, c, g, or t
ctgctggaacggggacggatacggagaggagagagaaactgttggccgtgctaaatacggatacggagagggagtctgctggagttggtcttaggggggggagcgtcagccccatgggattgacgtgcggacacgagcgaaggagagaagaagctttggttccacgatactaatgcacaaaagaaaagtgggtgagaagaacccagatgcttgcctatagtatcaacagaagaaaaagacggcactacgcctgccaaagttgtagttcatatgtataggatttatgggcatgtttgtaaatttacacgaagttgtatcctgccactataatatagcaaatattgatatcttctctttgctagttgtctcttaaaaaatgatgtccgatgtctatatgcttagtgaggttatgttcaacggaattatccgccaagcgaattgcactctcattattatatagcagtggaactttactcagattgtagccaaagtcccgaaggatttgtctcatccaaagtagttgcacgcaacagtggcctacggcaacatacttggcgtcggcggtggatagggcaacaaaattttatttctttgaggtccaagacattagggaccttcccaaaaactaacaagtctctaatgtacacttcttatcaaccttgcacccgacataatcaaagtctgaatatccaatcaagtcaaaggtagacctcttacgagactgcacatctactcccctacccaagtcgacaagccagtctacgccacagcctataccagatccttcgcccacacgccaacaagacaaggcgaaggtgagcatggccaaaagagctcgcaccatgatcaagggaagatatctgcccaccacaggggaagacctcggtccacctagctctattcgctgctccacagtccatattattgcatttctgggcccacttgtcgaggtctagctcccttgtacgtgcttcccttaggctataaaagggagggcacttgcgttgcaaggggagatcacttgaaccctcgtcaagctctctcgagctctcctgagctgggggctcactcgaactccctcgaaggcatatccattcagacctaggctctctcaagctctcaacaatacgatccacagtggagttgagtgttacgctccaatggcctgaaccattttaaatccttgtgtgcttttgtgttcatccatctgaccaggtaatncctagacagcccctgttcttgggattaggcaagtacatttcgccacccgaccagagtatactctccaacaattcccattgactttgatgtaattttgaagttaaaccaaagccatcagttagcttatgaaattatatgtccatccataggatggtcattgaagatacgattcgtataagtttggagcatctaatttacttcagcctagtattggatcgtgagaagcgcttgaactttgtatgtgacgatacgcaaagaaaaatattacactttatcttagtcaaaaggtatagaaatgtatgagttgaaaaggaactcaaccccttttttatagctcgttcgatcgctcgttctcctttaactagagaggtggtactatttggagcgttgttgcgtgcggcatcctctggtgttggacttgggtggtcacgacctatttgtggggtgacaacccantaagagctcgttcggttcccttttaatccatatgaatcggaggagattgagagggtttaaattcatataaagtcaaaatccttcatatttttttgaatcccttccaatgcatgaagcataggaataaccgaacgaggtccaatgccgtgcatgttttcaaaagagtcaactttttaaaactttgatcaacaattcaacaaaaaaacatatatttttagtgtatacatgttatatacttgaatttgtatttaaatatactttaatatgatgcttagtctatatttattgatgtcatatttaaaaaaattaatgatcaaagttgcaatgtgaatattttgttaaaaatatataggctttattttatgggatgaagggagtaataagaaagcgcaggggcgccatggtagaagcacttcggttgctcttcacttgcctgagagtatagttgcccaaacgggcagctcagtccgacccggcacgagcctgttagacccgacagctaatcgggtcgtgcccaaccagcccacgtgctgcagatacggcccaagcacgccagacngctagtcgtgcagggccaacccgttaatctgtctaggctgtctgattaaatcagaaagatagcaaaaattcagtgtgatagagggatcgaactcgtgcgctcgtggaacaaggctagcaaaatccagtgtgagggggttcgaactctcgccctcatggaacaaggctacaagacantacattagtcgtgccgggtcaacccgttaatctgtcgaggctgtctgattaaatcagaaagatagcaaaaatccagtgtgatagagggatcaaactcgtgcgctcgtggaacaaggctaggaaaatccagtgtgagggggttcgaactctcaccctcatggaacaaggctagaagacactacatgaacgaagctaaccggtagaactccagtgcgattattgtaaataggtaatataaaatcttaatatatgtataagatttattataaaataaaaaatataatcatgtcggtcagccggctctgcgagctggctctcgtagtggacccagttcggcactattaaatgatttgtgtttaaccctaaaccagcccgtcacacacggcccgtttgataccggagagccacgttagtacaggttacagtacagactacaggatagcaacacatcacatggcgagcgagagagagagaggagcccgcgccgcgccctgcaggtccggccccgtacgccgctcgctgtataggagagtggcagttagctgcaaccaaccacttccgtggcgcgcattcatggcaccattaacacttcttccgagatccatttcttcacagctcatgtctccaatcgcagagatcaccctcgtccggtcctcctcggaatccagctctaaagagaagttaagaggacaacctcacatcatcaccatttccccgagtcccaatcccgcctatcgtcaaatgcttggttgcaggcttgcagctggccgcccagttcgtcagcgacagacgagcagtgcgccaaaatgttgatcaaacaagcattcactatggcgtatttatactacagtagcaggagtattaaccagccgagaaccaaccaatgttcacccattaccatcgatgcgtacgttacgccgagccgaatggaaggtaattgccgcccaaaaggaagaagagaaagaaaaaaaaaaagaaaaccaaacaaaggtgcagtgcccccggcagctcacggcacggtgacggtgaccacgcctccagcggcagcgcctggcaacccgaacggcagccccccgatgcccactccgacgcccacgccaatagtgacgcccgcgtcgccacacccggctggccgcgccccggggatgcggaggcagctgaggccgccttcccccgggaactcgtcgcactcgggctgcggccgctgcatgtcccgcccgggcacgcagttgcccacgaagtcgaacacgccgcggctccccagctgccggtcgcagcgctggctgatcccggagaagaagttgaaggacacggacaggttggtgatccggcgcaggtcgcacagcaggtccgggagctcgcccgtgagctggttgtgcgcgaggttgagcacctcgatccccgacaggcacgagagcgtccccgggaggtgtcccgacagcgcgttgtagctgaggtccagcacctgcatgctggggaggaagcccagcgcctcgggcacgcagccggtcaggttgttgttcaggaacagcacctcgcggacccggccaccggccccggccccggcgccggcgccgaactcgtaggccgccgggacggcgccggtgaagtggttgttggccagcgtgatgaccgtggcgggcgacgcccacagcgtgtccgggatctggccctcgaactggttgtcgttgaggaacacggcgtccagctccttggcgaacacctcgggcgggacctccccggagaaggcgttgaagcggaggtccaggtacaccagcgacgggatgagcagcgtggacgccgggaacgggcccgagaagaggttgttgctcaggtccagctccgtcaggtactgcaggtcccggagcgtgtcggggacggcgcccccgagccggttgctgttgaggtggaggaaggtgaggtgcgccaggagggacaccgcgttggggagcgtgccccttgagatggcgcggttgaggtcgat

SEQ ID NO: 1949 - DNA, 956 bp, Zea mays
ccggccgggagggaacccctcctggccctgcagtatataaccattggggacctcgaggccggccgggaagcgttccagatcgtactggaccaatctgccaccacactttgatcacacacaggaagttgagatcagaaaaatgcaggctgccgctactgccgccgggttctcggccgtgctgcccgccaagggcaggccggcggcgaggagcagggtggtggcccgtgtccccgccacaaggaggagcgtccgtgtagctgccgtcgtcgcgaccgaggccgcgcagatcgactacagctcaagcgtctcggtgttcccgatggaggcctgcgacctgcttggtggcgacgcgtgcaacgggcccatgttcccggaggccaagcccgcctcggcggcggcggcggcgagcaggagtgtggtcggggtggacagggactacctgtcctacgacgagccaaagacggtgttcccgggcgaggcgtgcgatgaccttggcggcgagttctgcgaggcgccgtaccaggacggcgtctccaaggagctggcgcacgcctgaagaccctgatccatccatgtctgtccaccacgctatgtacgtatgtgtagcagatggtttacatctacgtgttagagcccggagagctggagaagctagctagcgtgcttacagaataacagcagccaagcaaagccaagggtgtgtatataataggcatgccttgggttgtgtcagctgcgactgtatgtatagtttaaaccaagatgaaatggtactgatggtgatattccgtgttttacgatacaaaggctagaaaatagattttgcctggatatcagatagctttcaactaccacaaaatattatttctacctgaaacattgaccgcgttgatttatttcaactactgcacaatattatcctacaaaaaaaggttaccgcatactaggttagctgt

SEQ ID NO: 1950 - DNA, 2260 bp, Zea mays
ctcactcgacttgcgccgtatgctgattcttgattcgatgttctgttctgctgcgatagggcctttcaagaacgggcggcggcgctttacctgacgcaaattgcgccggtctcctgccttgctgcgcgcttgggggttgggctcaggaatgggggtagagcaggggctgcgtcgcctggctcgattcccatctctctgaacttagatggatgcatctgtaaacaccaagaagaaggttagtttctgtgggaacactggccacagccgctgcggtgaagttcatttagctgctgtgtgctcaggtcgtatgcgaagcaaccccttctcgcttcaggtttggtttgcatttccgttcaagtataaaggaagtagtatttgccattttggcatagcatttgaatagcacaggaacctagaaaacagtgttccagcagtactacgttacactggtgttatactattatagaaaacatggtggatgtggaactgttttataaggatactagtgatcacagcattagctctgaggaagaagatatgcttgtcaggagctgtagcaatctcaatgtgagctttggatatcattgtgattcttatcagagcttttctcctgaaaatgatcatggaaatggcatttctcctaaggacatgtttgggactaatacgatgatggggtcacggaatggctcatttacttgtttgtccggtgctgctattagtgcaaattttacattggcaaatacaaatatttgcaatggtcttattggcgaagaaattttaccagaactagattctccaaactccttcagaaaaattatttcatctccatcaatgtcaagattggactcgttctctacctcacaaggcagtcctgtgtcaactgagagctctatatttgagatcagtaaaaatctttggaggtccagtgccccaacaactgtatcatccaattttctgactaatacagaggtgaaaatggctggcggagctgctggagaggatagagtccaagctgtgtgctcagagaaaaatggatggctgatttgtgggatatatgatgggtttaatgggagggatgcagctgattttcttgcggtaactctatatgataacatagtatattacttatacctgctggagaatcggataaggcaacaaaatggtttgtacaattcatcagaaagctctcttaatggtctcaaaagtgagttaacactagccatgagaaattcagaaaatgaaggcataaaattttctgaaacatttcgatctggtgtactgaattgcctttctactgctgttgagcaagctgagaatgactttttatgcatggttgaacaagagatggatgatagaccagatttagtttcggtagggtcttgtatcctggttgttcttcttcaaggaacagatctgtgcatcttaaatatgggggacagtagagctgtgcttgcttccatgccatatgtagaaaatggtgctttgaaggctactcaactgacagagacccactcgcttgaaaatcctttggagtaccaaaaacttttagctgaacatcccaatgattcttcagttgtcaggggtaacaaaataaaaggaaagctgaaggttactcgtgcttttggagttggctatctgaagcagaggaagttcaacgatgcactcatgggcattctgcgagtccgcgatttgagcagccctccatatgtttacacaaatccacacacattgagtcacaaagttacagaagatgatttgtttgttgtgcttggtagtgatggcttatttgatttcttcagcaatgatgaagttgttcggttggtttatcaatttatgcatgataatccaatgggggatcctgcaaaatatcttattgagcaacttatactcaaagcagccaaggaagcagctctaacagccgaagaattgatgaggatacctgttgggagtaggagaaagtaccacgatgatgtgactgtcattgttatcatccttggaaatgcacagaggacgatgactgcatcaacttccttgtgaaagaatggagaggtagagaggcgggggctatcagctggtaaatttttgtgggtttttgcatacgtgtcttccaaatcacaagtttttttgggggggaatcgcgtggtagtcaataaaccaaataaaaatgtatatattgtttcgaaatttgggaagtgaacagaaccttttgtcaaatcacagggtgcacctggattcgtttgacctaaaaaaaaaaaaaaaa

SEQ ID NO: 1951 - DNA, 2480 bp, Zea mays
cattggggtcctcgaggccggcccccgggttttccgtcccccatcccctccgcaccgcagctgtctcttcctctcctggtcttcgtcctgccactcctccacctcaacttgctctgctcttctcggattacggctcggggttggtcattggcggacagggcgtttcaagaaagggcggcggcgcttttcctgacgcaagttgccccggtgtcctggcttgctgcgcgcttgggggttgggctcaggaatggggggagagcaggcgctgcgtcgactggtcctgttcccatctctctgaaacttagatggatgcatctgtgaacgccaagaagaaggttagtttctgtgggaacactggccacagccgctgcggtgaagttcatttagctgcggtgtgctccggtcgtatgcgaagcaaccccttctcacttcaggtttggtttgcatttccgttcaagtataaaggaagcagtatttggcatggcatttgaatagcgtcggaacctagaaaacagtgttccagcagtattacgtcacactggtgttatactattatagaaaaacatggtggacgtagaactgtttgttaaggagactagtgatcacagcatcagctctgaggaagaagatatccttgtcaggagctgtagcaatctcaatgtgagctttggataccattgtgattctcatcagagcttttctcctgaaaatgatcatggcaatggcatttctcctaagaacacgtttgggactaataccatgatggggtcacgaaatggctcattcacttgtttatctggtgctgctattagtgcaaatttcacactggcaaatacaaacatttgcaatggtcttattggcgaagaaattttaccagaactagattctccaaactcctttagaaaaattgtttcttctccatcaatgtcaagattggactcgttctccacctcacaaggaagtcctgtgtcaactgagagctctatattcgagatcagtaaaaacctttggaggtccagtgcaccaacaactgtatcatccaattttctgactaatacagaggtgaaaatggctggcggagctgctggagaggatagagtccaagctgtgtgctcagagaaaaatggatggctgatttgtgggatatatgatgggtttaatgggagggatgcagctgattttcttgcagtaactctatatgataacatagtgtattacttgtacctgctggagaatcggataaagcaacaaaatggtctgtacaattcatcagaaagctctctcgatggtcttaaaagtgagttaacactagccatgagaaactcagaaaatgaagacataaaattttctgaaacatttcgatctggcgtgctgaattgcctttctactgctgttgagcaagccgagaatgactttttatgcatggttgaacaagagatggacgatagaccagatttagtttcggtagggtcttgtgttctggttcttcttcttcatggaacagatctgtgcatcttaaatatgggggacagtagagctgtgcttgcttccatgccatatgtagaaaatggtgctttgaaggctgctcaactgacagagacccactcacttgaaaatccttcggaataccaaagacttttagctgctcatcccaatgattcttcagttgtcaggggtaacaaaataaaaggaaagctgaaggttactcgtgcttttggagttggctatctgaagcagaggaagttcaatgatgcactcatgggcattctacgagtccgcgatttgagcagccctccatatgtttacacaaatccacacacattgagtcacaaagttacagatgatgatttgttcgttgtgcttggtagtgatggcctatttgatttcttcagtaatgatgaagttgttatgttggtttatcaatttatgcacgataatccaatgggggatcctgcaaaatatcttatcgagcaacttatactcaaagcagccaaggaagcagctttaacagccgaagaattgatgaggatacctgttgggagtaggagaaagtaccacgatgatgtgactgtcgttgttatcacccttggaaatgcacagaggacgatgactgcgtcaacatccatgtgaaagaatggagagctagagagacgggctatcagctggtaatttttgtgggtttttgcgtacgtgtcctccaaattacaagccctttttttgttgagattggcgtgtggtagtcagtaaacccgaataaaaatgtatatattgttttggaatttgggaagtgaacaaaaaccttttgttcaatcgcaaggtgggcatggatttgtttggcctacttttgtacatacatgaattaaaacatggaggctcgtacttgagccaatgaatccatgagcagagcggtggatcgttccagtttccgtttgcaaaaagcggctcgagagtcttctagagcgagccgcgggccctcgtgg

SEQ ID NO: 1952 - DNA, 2366 bp, Zea mays
cgtccgcccacgcgtccgcccacgcgtccgacaagcaccagtttggctcgtctcggcctcggcgcgtgcccccgacccgttgctgaccccgctccccggtgatctgatgtcggcggcggcacgcgcgccaccgccgccgcgcgcactctacgcgccgtcgagaagagtccctttcggtgccgtgatcctatccgcgccgcgacccggggctagggttcgcgcggcgcggcctcgcgaggggaatgttcataaccattgcctgttgacatcgtctagtctgaattcaaattctttgctatgtcctccatgcaattgtgctcaaatggctttggccgacacaagaattgcttaccagcctgaagttgacaagcatgctggagttctggtatggaagctttgatactatttttgcatgggatgagtcctcttctcttgtcctgacaaatgttttgtattcatctgcaggcctatgaactggttcaagggaatcttgttcagtggaattcatttatggacaaatcaatacctgatccaccaacagctgttcttcttcatggcatccttgggagcaggaaaaactggggatcttttgcgaagagattggctcaggaattcccaatgtggcagttcctcttggttgatttgcgctgccatggcgactcaacatcaattaagaagagtggaccacacactgttgcctcaactgctcttgatgttctaaagctgataatgcagctcaggctaacccctccgggttttggttggtcacagctttggtggaaaagtggccttgagtatggtagaacaagctgcaaaaccacttgctcgtcctgttagagtatgggttcttgatgctactcctggcaaagttcgggccgggggagatggtgaagatcaccctgctgaacttattgaaccccgccgaagaatgcctgagcaggtttcttcaaaacaggaggttgttgatgctcttgttaaaggacaattttctatggacgttgcacggtgggtggctacaaatctacgtcgaaccagtccattgggtcagcgaccatcttcaagcttctcatggacttttgatctaaatggcatctctgagatgtacaagtcttatgaggatactaacttatggaggattgtagagaatgtaccaagggggttcatattaattttctaaaagctgaacgaagtttgcatagatgggctctcgaagacctccaaagaatttatactgcggaggaattagctgcagatgagggtggaggagttgaaatgcacgtgcttgaagatgctggacactgggttcatgcagacaacccagacggtctctttagaattctttcgtcaacctttcgaatcgaaactactataagaggaatgcaggactgaggatcaaacctttatcgatccaatgacaatagaggggaggcatttctgaatcgattctactgtaagaggaatgcaagaggatcaaaccttaattgacaatctgagaggaggcgctgacactatcagaagatgtgtacattacaagcagggaggtggagccagcatttttctgaatgataggcgtctttgttcatttgttcattctttctttttttttttttacaaaaaaaagagtatgtaacatgagttatacaactaggctgttcttcgagaaacaacctgtaactgtctgtcatatacttgacgaatgagaagcgttttcgtacctgttttagcctgaacggttcagttgtgagatctcgaattaaactgcctgatttgcagagtctagaaaaaaaaatgttcctgatagttgcctagagagggagggggacggggttgaatagacgacagtacttgattcacttagaacaacatgaacaattgtcgaaatataaaactaagatcttttcttgcagatgtgttgctttcaaataatgcagaataaacttatatgatgtttgaatgcactagagctaatagttggcagttatccaaaaagttatagtaattttcctaatctttccaaaaagttatgaatcactctttttggtggtttaaatcttcggttataggtatttgaagtatggattctgaatctgtctaaatctggacagatgcatctttttcgtgttgattgaccttgataggtacgctagacatcccgcgtaaaggatcgatgtgacgttggagctaaagcacaagacgatgagttggtggacttatccagaagacaatggactgatcaagggtacgttcatcaagcgggtgccgtctaaccgaaaacactaatctaatgttggattccaggttgcaggagttgtttggaaacaatcactgcatttacccttgattacccttaaaaaaaaaaaaaaaaa

SEQ ID NO: 1953 - DNA, 1712 bp, Zea mays
  misc_feature (699)..(699): n is a, c, g, or t
attgggacctcgaggcggcgggttgcaggccgccacgccccagttgggctcgtctgagagagctcacgagtccccccgacccgttgctgaccccgctccccggtgatctgatgtcggcggcggcacgcgcgccaccgccgccgcgcgcactctacgcgccgtcgagaagagtccctttcggtgccgtgatcctatccgcgccgcgacccggggctagggttcgcgcggcgcggcctcgcgaggggaatgttcataaccattgcctgctgacatcgtctagtctgaattcaagttctttgctatgtcctccatgcaattgtgctcaaatggctttggccgacacaagaattgcttaccagcctgaagtcgacaagcatgctggagttctggcctatgaactggttcaagggaatcttgttcagtggaattcatttatggacaaatcaatacctgatccaccaacagctgttcttcttcatggcatccttgggagcaggaaaaactggggatcttttgcgaagagattggctcaggaattcccaatgtggcagttcctcttggttgatttgcgctgccatggcgactcaacatcaattaagaagagtggaccacacactgttgcctcaactgctcttgatgttctaaagctgataatgcagctcaggctaacccctcgggttttgggttggtcacagcttntggtgggaaaagtggccttgagtatggtagaacaagctgcaaaaccacttgctcgtcctgttagagtatgggttcttgatgctactcctggcaaagttcgggccgggggagatggtgaagatcaccctcctgtacttatcgaccctcgcgtccgcagaaggttgcctgagcaggtttcttcaaagcaggaggttgttgatgcttttgttaaaggacaattttctatggacgttgcacggtgggcggctacaaatctacgtccaaccagtccattgggtcagcgaccatcttcaagcttttcatggacttttgatctaaatggcatctctgagatgtacaagtcttatgaggatactaacttatggaggattgtagagaatgtaccaaggggtgttcatattaattttctaaaagctgaacgaagtttgcatagatgggctctcgaagacctccaaagaatttatactgcggaggaattagctgcagatgagggtggaggagttgaaatgcacgtgcttgaagatgctggacactgggttcatgcagacaacccagacggtctctttagaattctttcgtcaacctttcgaatcgaaactactataagaggaatgcaggactgaggatcaaacctttatcgatccaatgacaatagaggggaggcatttctgaatcgattctactgtaagaggaatgcaagaggatcaaaccttaattgatccagtgacaatctgagaggaggcgctgacactatcagaagatgtgtacattacaagcagggaggtggagccagcatttttctgaatgataggcgtctttgttcatttgttcattcttttttttacaaaaaaaaaagagtatgtaacatgagttatacaactaggctgttcttcgagaaacaacctgtaactgtctgtcatatacttgacgaatgagaagcgttttcgtacctgttttagcctgaacggttcagttgtaagatctcgaattaaactgcctgatttgcagagtct

SEQ ID NO: 1954 - DNA, 2510 bp, Zea mays
gccgtggcagccggtttgacccgcccccgagcgttataagctgtttctccgggaacgtcttgtcgcgcaagtcgctcgcgccggccgcctccacctgcttgctcggtctcagattcccgcgcgcgaaagcgtggaccggacagccggcaggcgctcctttctttcattccctgtcgtggtctctcgtgctctccgtccgttctaacttctgcggcgcgcgaaggtactgtgggaatcgctgctctttccttgattccggcggcggcggaggtgcgcgggttccgttcgtcgcgccgtgggggtgcgagggaggcgccgcgcgcggcctcggattcgatcggacacagcgtccgtcgcgcggcggcggcggcggtggccgacgacggatggagtcggtgaaggggtgggtggccgccgactacgcggcggagcccatggcgtcggtgcagcactcgttgcgcgtcgcctacgtggtcttctccttctgcgccgccttcttcctcggcggcatcaaagcggtggtggtcgggcccgttgccgccgccgtgatgatagtgggcaacgtcggcgtcatactcgtgctcttcccggcgcacgtctggtgggcaatctactcgctcatcaagaccgaccgcatcaacgcgggcctgaagctagccgtgctcttggcgctacccgtgctgttcggcctctgggctggggctgggcatcttgggcagcgcgctggtgggtctcgggtacggcttcttcacgccgtggatctccaccttcgaggcgttccggcaggaaagcgaggccaagaagttcgtgcacggcattgtggatgggacgtggggcacgatcaagggcagctgcacggtggtcagggacttcgcggacatctgcttccactcctaccctgtctacctcaaggagctgcgcgagggctcccagaatcgtgagccccattccataaggttgctggacgtgccctcatgcatagtcgtcgctctcctcgggctagtcgtggacataccactttacacggtgattgcgctggtcaagagcccctacatgctcttcaaaggctggcagaggctgctgcacgaccttataagccgagaaggcccgttcctcgagacggtctgcgtgccgatcgccggcctggctatcctgttctggccgctggtggtggtcgggagcgtcctgctggccatcgtctccagcatctttgtggggctctacggagcggtcatcgttttccaggagaggtcgtttcagaggggcgtttcgtatgtcgtggccatggttgcggagttcgatgagtacaccaacgactggctctacctccgtgaaggaacagttctcccaaagccgtcctacagaaagaggaaaccgtcgaactccacggaattctcggtgagaacaaacgcctccggcggcaaaggagctgaccaccctcctggccccagtgaagcaccggcaatgttggttccgaatctggcgcctgcgagatcagtgagagaggctatacggcaggtctacccgggccggccctcgcggcacatgatgaagtcatgcgagcagcgggggagggacctcctgaaccagaacgtgataacggccgcggggctggcggagtggctgaggggggcgaaggagggcgggcaccacgagaccgtgagcctgggcctgccgtcctactcgctgctgtgcaccgtgctgcagtcgatcagggccgggtccgggggcctggtgctgggcagcttcgaggtgaaccagcacaaccggccgcaggaccggctgctggactggttcttccaccccgtgctggtgctcaaggagcagatacaggcgctgaggatgaccgaggaggaggtcaggttcctggagaagctgaccgtcttcgccggcaacgtcgcgggcgctggcgctggcgggtgggagaacggcgccgggatgatggtggtgccccaggaccctgtgaggctggcgcagatccaggccataagtagaaggctggttgggattgtgaggagcctgtccaagttcccgacgtacaggaggaggtacaggcacgtcgtgaagctgctcatcgcctactccgtcgagagggagagctcgggcaggtcgtcggcttcagggcgctcggcctcctactttgagataacacagctggacgtgtagtatagtttgggaagcgttctccgattgtaattaagctgttaatttctaggatcaggtagtagctgtcagtgccttcgtgtgtttgaagcctagctggtgaggtttttgtagaacactagtgcatggttacaggagaaaggcgctccattgcagatgctgatcaggcgcgttcacgtgccaaaagcttcagacaattgtacacattctcttttgttctgtatatagcctgtaggttcaatgcacatgtgttgttcttttctctctccctctcttccaaagctggagccttttgtgacacggccatcccctacaattttagcttgttgatttttttttcaccaacc

SEQ ID NO: 1955 - DNA, 735 bp, Zea mays
aaccctaactcattctttcacttctccagccgtcacagacaaccggccgccaggaagcatggccgaccgtgccctgctaatcacctcctccctttctgtctttcaatttgttcctgtcgctcactttcgttcggccgccaggaagcaccagcggctggctctggccgactgcgccctgcacagagccacacagccgcccactctctgtttggtttctgtttttttttcgtttctacttgccgcactattactcggtcgccaaggagaactagacatttgcactgtgcaattgaactcgaatttagtcctcatttactcgaatcccttactgtgtgtttaaatatatgagatggatatcttgtaatgggatcgagttttggaggaaaaaaattgtagatccgggccccgcgatatttctgttattttctgtgatgattttagtgcatctatgcacattcacgcggtttaaaaaaaaattagggttctaaccgtaattttattctgtgactttttcttatctgttcttgaccgtggttcataatcacgagtctcttttgtctctgttgacagatgtaccgattagggttaggtcataaaccctaaccctagacggttatgtgagagctctctggtttgaggccgagacacattgtgtctcttatcagtggccagacctaatccttaagggttaagggaaaaccctaacccgagagcatcaactatttctttctattc

SEQ ID NO: 1956 - DNA, 625 bp, Zea mays
aaaaaaccctaattcattttctctcctacttctcctgccgctccaacaggcagccgccaatcctcctggccgaccgcagggagtgtggccgactgtgcctgcatttccctggccgcctgttcttttgcttctttcttttcttcagccgatggaacttgtgtatgttgtttttttttttgtttttttttgttcggctgaatcatacgtacggcttttggttttctccactgaggagctttctgctaactcgttcgccggacgtaacggtttttttttcctctccttttagaatcaggcgctggttccctttaccagagatggtcagccgattatggggcgccgtcattaatcttttaaagcttggatctagacctcatttactcgaatcccttactgtgtgtgaatgaatgtatgagatggatatcttgtaatgagatcgagttttggaggcaaaaaaaaaaaaaaaatccgggccccgcgatatttctgttattttctgtgatgattttagtgcatccatgcacattcacgcggtttaaaaaaattagggttctaaccctaattgtattctgtgactttttcttatctgttcttgaccgtggttcatcatcacgagtctcttttg

SEQ ID NO: 1957 - DNA, 1390 bp, Zea mays
  misc_feature (1284)..(1284): n is a, c, g, or t
  misc_feature (1338)..(1338): n is a, c, g, or t
  misc_feature (1348)..(1348): n is a, c, g, or t
  misc_feature (1353)..(1353): n is a, c, g, or t
cctgccgggaaccctagctcatttctttcattctctccagccgaaacatctggccggtggcgtttctctttgccgcacagccgccctatggcatgctgttgtccttcgctccctcgtttgtttttggttctagcatctacagtcgaccatcttttctcggttggtactttacgcatggccatctttgccttggtgttgcacctactctctgtttctattttctttcacttcttcaacaattttctagccaacgtgttctctgtacacgtccgcttgcaatggaggtgcgtgctgcatacatgcgcatgctccttttctctctgtttgtgtttttttttcttttttttcttttcttttctttttcttcagctgcgcaagacataccggccgccagggagatttgctcctggccgaacgcgcccgagtgcctcggtacggccgttcctgcgcggcagggcgggaccccgcggactctcccgccggcgagtgcgtcccctaggttgggcacgccgccgtcggtggtccctgccagccggtagttggcaaccgaagcttcatcaagcagagagtatcatatctacctctcggtgtcccgccgcccgccggctgggatcataactagtggcattgtcatcatcctggtcatgaaattcgtcaccagatggatcgaggtgacacgagaatggcagatggagcgcgcgcggctgcaggccttggagatgcaggcggcggcggcggcggctggcgcgccaatgatccagcagccggcggcgaatggctcggcggcgccgccttacgctattgctgccaaccacgtcgtggagatgggcgccgtgaaccggttcctggacgacatactgcgggagaagcccgcgcggttcacgccggagaacctccgcgagttcactcgcaactacgcggagcggctcgggtccggcggattcggcgtggtgtaccgcggcgcgttcccgaacggggtgcaggtggccgtcaagatcctcaacagcacgctggaccggcgcgccgaggagcagttcatggcggaggtgggcaccgcggggcgcacctaccacatcaacctcgtccgcctctacggcttctgcttcgacgccacgaccaaggcgctggtgtacgagtacctcgagaagggctcgctggaccgcgtgctcttcgacctcgagggcgacgcgctcggcttcgacgcgctgtccggcatcgtggccggcacggcgcgcggggtgcggtacctgcacgaggagtgccagcaccggatcatccactacngacatcaggcccggcaacgtgctgctcaccgcggactacccccccaagggtggncgacttcggnctcgncaggctctgcaaccgcgacagcacccacctcacgatg

SEQ ID NO: 1958 - DNA, 3549 bp, Zea mays
tatctttgccgagagcatggactcgccatcccccctcgcgccctcccacatccttctgtcatataagacatgtgaaatttcatgtgacaaaaatatctgtatgagtcatgggtgttggagggggttggagggattaggggcggttaaatctctttctatttaaaattgaatagggagaaatttataatccccttcaatatccctcaattcacgtctaatcgaacaagctctaaggtttataggatggttaatattgttagagtttatggaacaaggttgatctatgctgcaataaaattttaaagctccgataagatgaaggaggtttatgctgcaataaaatggattaggggcgctccaatccatttaaacctttctatttaaactttccactaaactttcaacataaacctccgacttgtaaataagatgaaggaggtttatgttgttgtatgctgaacaatctaggcccctttatccctggcatcgacatggcgacgatgcaccataagattagtgtctttgaacctgcatggattggagcgaataaggatcttgggcaacaaccacgcgactactcgccaaattaagctgcactgtaaggttctacagtatttatcaagccttcaacctcaatctcaaatatcgggagtctattgcaattacctatattcatttgtgtcagggcatgcttagctggatttgagtctcatgctaaagtggtattgttagcattttcttgctaattatacaacaataagtcaaactattttagtgatttcgttgatcttaacagctactatgtttcatcagagggaaaatatcggattaaacatcactagaagaaaaaaaaacatctactctttttgcaaagttcggttggaagttctcgagccgaattaaagttaagtctctttttattcggttttttctttctttcttttgtctaggtcgtgcgtttgcgcgtttgtttttgatgagttgtgtgaagtgtgaacctaagggcttttaattatggacgtacagggctgcgtacatctgcgatcattatctgtttggtgaaatatatatctgcggattaaaaaaaatacccaacggtgcccacttcatcggttcggatgacaacggcttgcgatgctacgaaggtctatcggtccaactcgactaacgcgttgaatccttttaataaaagaggggaaaatgcatgacaactccatgttcacactaaccatttttctactactacctcctcataaatatatgacactgttgattttttcgaaaactttaactaattatcgtatttaaaatatttattcaaaaaatataaaaatgttaagggaaacacaaactactttaagtgataaaaaaattaaaaaaaataaatgataacttattattctttaataagatgagtgattaaagttttttctaaaaagttaacggtgttatatatttataaataaggagggtactaactagtcaaatacggcgacgtctctgtcaatgtgtacttgtcttgcatcaacagcacactgcacacctcgccaagatgctctctagtcgattggatggtaaacgtttactcatgatatagaacgtctttgctctttacataataattgttatcttgttagataagactacgtacgggccaagctagacacacacctgtttgcttcgattactacgtgtgcaaggttttcaattcggcaagggaattgaactggacgtgcccaaagtccaaactgcatttcagctaatcaacaggtcaagggctacacctaaacacgagagaggtgcgtctacgtccaaagtgcacaacacctcgaactcgctcgttcatttgggttttgttttccattgcaggtagttggcaaccgaagcttcatcaagcagagagtacatatctacttcacgatgaacaacctcgctttaggtaggcgatcgacatgcgttaatataatttagctagcagctctgtccaataatgcttcgagtttctgatacccccgtaatgaattcttttagcccttttgccaatcctgatgatgcagctgggatcataactagtggcattgtcatcatcctggtcatgaaattcgtcaccagatggatcgaggtgacacgagaatggcagatggagcgcgcgcggctgcaggccttggccttgcaggcgccggcggcggcggctggcgcgccaatgatccagcagccggcggcgaacggctcggcggcgccgccttacgctattgctgccagccacgtcctggagatgggcgccgtgaaccggttcctggacgacatactccgggagaagcccgcgcggttcacgccggagaacctccgcgagttcacccgcaactacgcggagcggctcgggtccggcggcttcggcgtggtgtaccgcggcgcgttcccgaacggggtgcaggtggccgtcaagatcctcaacagcacgctggaccggcgcgccgaggagcagttcatggcggaggtgggcaccgcggggcgcacctaccacatcaacctcgtccgcctctacggcttctgcttcgacgccacgaccaaggcgctggtgtacgagtacctcgagaagggctcgctggaccgcgtgctcttcgacctcgagggcgacgcgctcggcttcgacgcgctgtccggcatcgtggccggcacggcgcgcggggtgcggtacctgcacgaggagtgccagcaccggatcatccactacgacatcaagcccggcaacgtgctgctcaccgcggactacacccccaaggtggccgacttcggcctcgccaggctctgcaaccgcgacagcacccacctcacgatgaccggcgcgcggggcacgcccgggtacgcggcgccggagctgtggctgccgctgcccgtcacgcacaggtgcgacgtgtacagcttcggcatgctggtgttcgagatcctcgggaggcggcgcaacctggagctgcagcaccccgccgtgaccgtgagccaggagtggtaccccaggtgggtgtggcagaggttcgaccaggggaagttcggcgacgtcatggcagcgtcggggatccacgccaaggacggggagaaggcggagcggatgtgcaaggtggcgctctggtgcgtgcagtaccagccggaggcgaggccgtccatgagcagcgtcgtcaggatgctggaaggagaggaggagattgcgcggcccgtcaatccgttcacgtacatggcgagcgtgcacatggtttccagctccagcagcggcgacggcgacggcggtagcgctgccgcctccagctattcgtccaaagaactacggggaggcactaggagtgccgctaataatcagggcagatgaacacatgcgttccttttctttgtcgtaatacattgataccatcagttggttgaatagtgctgcttacttcagctatgatccacttggcttgcaattcaagatgtttgcaacatggaaatcatagaatgtcatttaatcaaaaaaaaaaaaaaaaaaaaacccccccacatcaaaaaaaaaataggtcc

SEQ ID NO: 1959 - DNA, 1460 bp, Zea mays
cattgggtacgacacacgaaattctcaggtcccggtcccgggtccaggcacccttctcgctcggttgctcgggagctttccccttcctgttcctgaagcttccgacatccgaccgcctcctcctcctcgttctactcgccgccccttctagaatcatccagaggcgtgccggtgaagcgcgagagcggtgaggcatggcgatgcagacgggggtcgcgacctccaaggtcctcatcctcgtcggtgcagggatgacgggctcgatcctgctgcggaatggccgcttatctgatgtgttgggagaactccaggagattatgaagggtgtaaatcaaggaacttcttcgggtccctatgacattgcacttattcaagctcagattcggaatttagcccaagaagtcagagatttgacattgtcaaagcccattaccatactgaatggcaaatctgactcgggaggcagtttatcatcctacatactgccagcagcagcagttggagcaatgggttattgctacatgtggtggaaggggttgtctctctcagatgtcatgtttgtcacaaaacacaacatggcaaatgctgttcagagcatgtcaaagcagttggagcaagtttcatcagcactagctgcaacaaaaagacatctaactcaacggcttgagaatttggatggcaaaatggatgaacaagtagaggtctccaaagctattagaaatgaggtcaatgatgttaaagatgacctgtctcaaattggatttgatgtcgaatcaattcagaaaatggttgctggattggagggaaagatcgagttacttgagaacaaacaggacgtggctaatactggtatctggtatctctgccaagtagcaggcggtttaaaagatggaataaacaccaggtttttccaggaaaccagtgagaagctgaagctctcacattcagctcaacctgaaaacaagccagtgaaggggcttgaatttttttcggaaagcaccatggaacagaaagtagctgactccaaaccaattgcggtgacagtcgacgctgagaagcctgagaaaaccgctgctgtaatgggcaccacagtgcacaggtctatcaggttctcatatcggaaggcaggccttgctttgtgatcaaatcctctccgcttgagatgcacgtggccttcctggttgcttttcttttttggcaacaaccttcctggttgctttgtctgatggtcagaaaacatggaagaataacctgcaactggagtgacagaatttcttttccccgcagtagacaggtgtgcgttatttggtctgatttgaaactatcttcagtccgctatcaatttttttccttggattttgattcattttatgtttcgacttgttgccttgtatactgtaaaggcattggaaagaatacataaaacacgaatgttttttttgccaaaaaaaaaaaaaaaa

SEQ ID NO: 1960 - DNA, 759 bp, Zea mays
  misc_feature (591)..(591): n is a, c, g, or t
attgggtacctcgaggccggaagaaacctaggctttctactctctcagccgaaacctctggccggcggcttccttctctctcagccgcctgggagatgtggcactgccgaccgcacctccctctccctttttttgttcctgccgctcactttcgttcggccgccaggaagcaccagcggctggctctggccgactgcgccctgcacagagccacacagccgcccactctctgtttgctttctgtcttttttattcgtttctacttgccgcatggacatttctgcatgcacttggctgcatggccatctctgtcatgattttctccctttttttattcgatccccacttcacgtgatgtatgcttgtaagaaatgaataatatgtaatgggaatcgagatttggagggttttgaagcaaaaaaaaaaaaaaaaaaaaaaaaaaaaaaaaaaaaaaaaaaaaacataagcaagcaaaactcacaaaactcctaccccacacagaagcggcggcggcggagcaaacgcaggcgaaggcgagggtgtgaggaaaggagcaccagccatggtgcacgtcaacttctaccgcaactnatggtaagacgttcaagaaaccaaggcgtccttatgagaaggagcgtcttgatgctgaactgaagctggtcggtgagtatgggctgaggtgcaagcgtgagctttggagggtccagtatgcactgagcaggatccgtaatgctgcaaggcacttgctcacccttgacg

SEQ ID NO: 1961 - DNA, 649 bp, Zea mays
aaccctaactcattctttcacttctccagccgtcacagacaaccggccgccaggaagcatggccgaccgtgccctgctaatctcctccttttttttcttttttctgtttgcctacgcgcagcatagttctgttcttttcgtatgcgtgttcttttcgcatgcctgttgcatgcatgttacttctctctctgtttctgtttcttttttttgtgcgcagtctcatcggaccgcagggagcaccggcgcttggccggtggcgctcggccagagcggccttgcagccgcgctcggctagaggagcggccctgcagcccctcccgcctgctacgagataactacaggaccattccagctaacagtgtgcatctgatctatacctcctaactcgattccccctatgtgaatgcttgtacgagatgtaattatctgtattttgggatcgagtttggaggtaactatacgtggatctgtttcctatgggtgttctctgtttattttgatgcggtccaaacagctctgtgcgttggaccatacctgatgcacttgatttttaagatttatagtgcactttttactcgatctgcttttctgattcctactgaacgtttcttaaataaaatccgaaccatatgcaaaaaaaaaaaaaaaa

SEQ ID NO: 1962 - DNA, 1459 bp, Zea mays
  misc_feature (272)..(273): n is a, c, g, or t
  misc_feature (280)..(281): n is a, c, g, or t
attgggtacctcgaggccggccgggacccttactgctcccctgcgcttgctcgggagctttccccttcctgttcctgaagcttccgacatccgaccgcctcctcctcctcgttctactcgccgccccttctagaatcatccagaggcgtgccggtgaagcgcgagagcggtgaggcatggcgatgcagacgggggtcgcgacctccaaggtcctcatcctcgtcggtgcagggatgacgggctcgatcctgctgcggaatggccgcttatcnntgatgtnngttgggagaactccaggagtttgtgaagggtgtaaatcaaggaacttcttcgggtccctatgacattgcacttattcaagctcagattcggaatttagcccaagaagtcagagatttgacattgtcaaagcccattaccatactgaatggcaaatctgactcgggaggcagtttatcatcctacatactgccagcagcagcagttggagcaatgggttattgctacatgtggtggaaggggttgtctctctcagatgtcatgtttgtcacaaaacacaacatggcaaatgctgttcagagcatgtcaaagcagttggagcaagtttcatcagcactagctgcaacaaaaagacatctaactcaacggcttgagaatttggatggcaaaatggatgaacaagtagaggtctccaaagctattagaaatgaggtcaatgatgttaaagatgacctgtctcaaattggatttgatgtcgaatcaattcagaaaatggttgctggattggagggaaagatcgagttacttgagaacaaacaggacgtggctaatactggtatctggtatctctgccaagtagcaggcggtttaaaagatggaataaacaccaggtttttccaggaaaccagtgagaagctgaagctctcacattcagctcaacctgaaaacaagccagtgaaggggcttgaatttttttcggaaagcaccatggaacagaaagtagctgactccaaaccaattgcggtgacagtcgacgctgagaagcctgagaaaaccgctgctgtaatgggcaccacagtgcacaggtctatcaggttctcatatcggaaggcaggccttgctttgtgatcaaatcctctccgcttgagatgcacgtggccttcctggttgctttttcttttttggcaacaaccttcctggttgctttgtgtgatggtcagaaaacatagaagaataacctgcaactggagtgacagaatttcttttccccgcagtagacaggtgtgcgttatttggttggaattatctccagtccactatcaattttttttccttggattttgattcattttatgtttcgatttgttgccttatatactgtaaagtcattggaaagaataaataaaacacgaatgttttttgtcaaaaaaaaaaaaaaaaaacggcacgagcgcgtggg

SEQ ID NO: 1963 - DNA, 891 bp, Zea mays
atgttgttgggcaaaaagacatctacttcaacggcttgagaatttggatggcaaaatggatgtacaagtagaggtctccaaagctattagaaatgaggtcaatgatgttaaagatgacctgtctcaaattggatttgatgtcgaatcaattcagaaaatggttgctggattggagggaaagatcgagttacttgagaacaaacaggacgtggctaatactggtatctggtatctctgccaagtagcaggcggtttaaaagatggaataaacaccaggtttttccaggaaaccagtgagaagctgaagctctcacattcagctcaacctgaaaacaagccagtgaaggggcttgaatttttttcggaaagcaccatggaacagaaagtagctgactccaaaccaattgcggtgacagtcgacgctgagaagcctgagaaaaccgctgctgtaatgggcaccacagtgcacaggtctatcaggttctcatatcggaaggcaggccttgctttgtgatcaaatcctctccgcttgagatgcacgtggccttcctggttgctttgtgtgatggtcagaaaacatagaagaataacctgcaactggagtgacagaatttcttttccccgcagtagacaggtgtgcgttattggttggaattatctccagtccactatcaattttttttccttggattttgattcattttatgtttcgatttgttgccttatatactgtaaagtcattggaaagaataaataaaacacgaatgttttttttgtccaacaaaaaaaaaaaaaaaaaaaaaaaggagagtaggtgactgggaaaagaagacctgcaaatggtatgcactgaaacatatgaaaagagaacatcaataagattttattttt

SEQ ID NO: 1964 - DNA, 2460 bp, Zea mays
gggggggggcataagtcaggctcaagagtcaagtcgaagcccaaacgaaaagaaaaaaaagcctgatgtcaggctcaattcagggccgaaatggccaaaataaggtaatggttttcgggtcaaacctgacatggtacttgaacaggtctagtggcattaactgatttagggaaattcactgtacctcaaattctaagcatataaatttggcatgaagaaaacttcagttttgtgtaatctggttcggaaacgcactaaattttagatgtgtagatctcagaatcctaaccgtttctttaggcgttttcaggtactcgattttccaaatggaaagaagaagaaaaagtcaggtcataccaaaaaaaaaacattcgaattatcatcatcacacaagtcccatgaaacactcgtgatgaggcatagaccctcagcgtaccaaacaaacaatcatcgcaacctcattttttttctgtagtttataaatccagcgccgagtgggacgtcaggagtgtaattattatctcaaccgtctccccccgatggaattttttgttgttgtggtaggtatcctgtcaatcgcccccgtgattcgtgcggccactgtgttagtttaggcagcgaattgattgggctatgtttaatcgacagtcatgccgagatgatgttgtttatcatggaagcacaccgtaaactaaaaccgccaactgcccggccaatgacgtattacccacagcaccgagcatgatcgcttctctgtttttactgatcggtcggcgtcaatctttcgctgctgccgtcgccagcaatgtcgtgttcctccggtccctgcgcttccaatttccctgggaagcggctggctcgcccggatggaatgattccagatttcaggtccatatcctcgaaaagctggatatcggccgcagcaaacaccaccacaaaccccccggcgcgcacaggagcgctcgacacggggtcgccagcgccgggcgacccctctcgtcgccatcacgccccaataattcactgcccacgcccgccatcgccaccactggcgtccgcaccgcagcccgccaataataacgctcccaaagcagaggccgaaacccgcgacgcgcagcgcagggccagtggcgacctccagctccagctccagctccacacgcgggcgccaccaaggagctgagccgagcccggcactgtcggcggccatgtccgcgccgcgtcgccgcatggccactgcctccccgtcgctccgcttcctcggcctgctcaagcaacccgacgacgccagctcccagtcccacggcgtccaggagctggagctcgacgagcgcgacgtcgtctggtcctccggcagcgcgacctcctcgtcctcgacctccgcggcctcctcgccgtccccgaccgcgtccccgaccgccagcctcgggaggccgatttccgcctcgtcccgccacttccccgccggcagcatggggctgtccgcgctcctcgccgacgccgacgaccaccacgcgcccaccgcgcccgtcccggccgccgcgcgcccggagaagcagcacgccccgcgcccgtgccaccagtcggcccccgtcgccgtgccggcctggcccaaggcgatgacggccgcggacaggcgccgccgcgaagcggagctgcaggccgcggacgacgaggacgacgacggcgagcccgtggtgccgccgcacgagatggccgcgcggcgcgctgcggcggcggcgtcggtcatggaaggcgccggacgcacactcaagggacgcgacctccggcgcgtgcgcaacgccgtgtggcgcaccaccggcttcctcgacctgtgaaaaaggacgttccttgcctttggaggtttcgtttcgttcgttcgctggccacgtcactccactccactccacttgagctgcctgcctcggatcggacggaccttggccgctgggcagcttcttcttgcgtagcgtagtgctgtgccagctgctaggcactgaaaaaaggtgggagtttccttactaggtttggagtactactaggggcgttatatattgagctaaatttgctggggaagtagccgcaggtgcttcggtattttcatgtaagagaactgctgtgatcagtctgcaactagtatgttttaagatgtctgcaactctttggcaaagaattttctctggagatgatgcagcatgccactgctaaacctgtggtctagtgtgcagcagaacagatgtgatgtgttcatagcttttgtattccactgtggctaatagagtgcctttttcaaaaaaaaaaaaaaaaatcggcacgcgagcaaggtcgtcggtgcaattgcaaatagcgcgcggtatttagagttttatcacttcataatgttttcttgtaaatagttttgttagttggtttatttgtttatatattttttctatcaccgtttgtctccacataccatcg

SEQ ID NO: 1965 - DNA, 2198 bp, Zea mays
aaccagcacaacgaagtcccgcgcacgcaaagaagtcacgtccaaactgaaggtgacaacatggagtccgcgccgtcaacggcggcggtcatggagcgcgagcgcctcacggccgagctggccttcgcggaggccgacgcagagcctagcagcttcgtcgtcaagatccggtgtcggctgccggacttcgcgcgcagcgtcaacctcaagtacgtccgcctcggcctgcgctctggcgccatccctgcgccctcctcatgggtcccgctcgcgctcgcgccgtcgctcctcgtcgcggcggcatactcgctcgttggcgcggacaagttctactcactcgacctgctcacctgcatcgcgtggctcgccgcggcggtgctgctgctcaccgtgtatttcctcatgcgcccaaggccggtgtacctcgtggacttcgcgtgctacaggccgggcaacgagcacgccatctccaaggagggcttcctggacatgacagagagcacgggctgcttcaacgcggaggcactcgagttccagaccaagatcaccaagcgctccggactcggcgatcggacgtacctcccgccgggcatccaggcacggccgccgcggctgtctatggaggaggcgcgcgcggaggccgaggccgtcatgttcggctgcctcgactcgctattctcggccacgggcatcgacccacgccgcgatgtgcgcgtgctcatcgtcaactgcagcctcttcaacccgacgccgtcgctggcgtccatggtagtgcaccgctacaagatgcgggaggacgtcaagtcgttcaaccttggaggcatggggtgcagcgcagggctcatcgccgtggacctcgccagggacatgctgcaggcgaaccccgggtgctacgccgtcgtggtgagcaccgagaacatcacgctgaactggtacttcggcaacgaccgctccatgctgctgtccaactgcatcttccgcatgggcggcgctgccgcgctgctgtccaaccgccgcgccgacgccgggcgcgccaagtacaggctgctacacacggtacgcacccacaagggcgccgcggacgagtgctacggctgcgtgtaccagcgcgaggacggcaccggccgcgtcggcgtgtcgctggcgcgcgagctcatggccgtcgccggggacgcgctcaagacgaacatcaccaccctgggcccgctggtgctcccgatatcggagcagctcaagttcctcaagtccctcgtgctccgccgcgccctccgctcccgcggtgtccgtccgtacatcccggacttccggcgcgcgtttgaacacttctgcgtgcacgccggcgggcgcgccgtgctggaggaggtgcagcgcagcctggggctcagggacgcggacatggagcccagcaggtgcaccctgcaccgcttcggcaacaccagcagcagctcgctctggtacgagctcgcctacgccgaggccaagggccgcgtccgccgcggccaccgcgtgtggcagatcggattcggatccggattcaagtgcaacagtgctgtctggcgcgcgctccgcgacgtgccgcccgtgcacgccgacggcgccggcggtggcagcaactgcaacccgtgggtggacagcattcagagctacccgccaaaagagtacatctgatcgccatcttctttgtggtgaattaatcacgtcctgttggatcagttgtactagccgcgacgcagtagtgcacgagaactgtatgtatggtgattttttttttgtttcttcatcaggtaggagctgaatcttctttcttctacctttacatacagtagtgcatgcgagaacaaggcgttgccacgcattggattaccgagtgctgtggcttcttaatgattgcggaccggtagacgtatttaaattgagattatggtaagtatggtagatgaacaacaaaaaggagcagttgtagaatgtgaatgcgtgtaaattattccaccaaagattgtacttctatgtcagaatggtttttctttttaaaaacaaaatcgaagtcggccgtccaccaaagggatttttttacatctccacgaaagagattgtttgcaggctacctatgttcatgccatacgatttaagatgttacgcatgtggcggttatttatttgattcagggtgtgtcgacaatcatttatatgtgtggtagg

SEQ ID NO: 1966 - DNA, 4363 bp, Zea mays
cccaatccaggcgggcaatccccacaggccacaatggcgtcgctgctgcgcctcccctcgctgctgtccccgtccaagcccctgctccggcgccggctgccggcggcgaggctcgcggcatccgccgcatccaggggtcaagcctcggcgaccgcgggcgcggcggcgccggcggccgcggagacccgcggcggggacagggaggggcaggtcacgccgcggtccgcggacttcaacgcctggtacacggacgtcatcgccgctgccgagctcgcggactacgggcccgtgcgagggaccatggtcattcgcccctacggatacgccatctgggaggccatccaggattatttgaatgtcaaattcaaggagacagggcacagcaacatgtacttccctcagttcattccatactcatttatagagaaggaagctagtcatgttgaagggtttagcccggagcttgcattggtcaccattggaggaggaaaagaactagaggaaaagcttgtggtaagaccaacaagtgagaccattgtaaaccacatgttcaccaaatggattcagagctatcgtgatcttcctctcatgataaaccagtgggctaacgtgacaagatgggaaatgcggactaaaccattcatccgaactcttgaatttttatggcaagaaggccatacagcccatgccacccttgaggaggcagagaaggaggcgatgcagatgattgatgtatataccaaatttgcctttgagcatgctgcaataccagttattccaggtagaaaatcaagagtagaaacatttgcgggtgccaatcggacctacactatagaagctatgatgggtgacaagaaggccttacaagctggaactagtcacaaccttggccaaaacttttcacgagcttttggaacacagtttatggatgaaaatggtcaaatcgaacacgtctggcagacctcttgggctattagtactcggtttgttggtgggattatcatgacccatggcgatgatgccggtctaatgcttcctccaaggattgcacccattcaggtcataatagtaccaatatggaaaaagggtgatgagaaggctgttgttgtggaagctgtagattcagttcaaaaaatactcaaagaagcaggaattagagttaaagtggacgactcagagctgcgaactcctggatggaaattcaatcactatgagatgaaaggggttcctgtaagaatagagataggtccacgtgatgtcacaaataagagtgttgtggtttctaggcgtgatgtccctggaaagcaaggaaaggagtttggagtgtctatggagccttcgatattggtgaaccatataaagggtcgtctagatgacatacaagcatcccttttacagaaggccataacattccgtgatagtaacattgtcgacgtaagctcatatggcgagctgaaggaagctatttctgaaggaaagtgggctagaggtccttggtcagctagcgatgctgatgagctgaaagtgaaagaagagaccagcgccaccatcagatgctacccattcgagcagcctgagggcaccaagaaatgcttcatgactggcaaccccgcagaggaagtcgcaattttcgcaaagtcatactaggcccactgtgtgtccactgtcagagataagaacagcatttccttttcaattttataggattgtaccctgtctacctaaggtccagattgatgacggttcatggaacagcattgtgtgctgctgatatttaaaatgtaaatttgataatcaataggtcaattttgttccactaacactggaggtaagttgtttgcctactcagtatcaaatgtttcaaacaagttccccaatatgctaaatcatgcaagttatcacatcgaattggataagtagaccgtgcatattgctgtgcaaaatattatttcacactgcaatggttacagagtgaagtttaaaataggtatgataagtaagattgctagagatagcctaagttactaaaggagttaagacctccaataattattatacactgaaaggaacattgctttattgcaattcttgaatgctggagtagaaattagaagaaaaacgttaacatatcggatatcgctgctattgcatgttaaaccaccactccatcgcaaccgtcttccatcgtgtgtgccaaaatgatgctccatcgccaccgattgcctgctcctacatgattcgttcagacatggaaggcagccgccggaagaagttgatcaccggtgctggcatccgattccggaacatcgggtggcgcaggtagtagaacccggcgaccacggccaccatcttcatgggcaccatgtacagcaccatggccacgaggacgcacagcgcgacgaacagcccggtggcacgcgggtcgcgccaggacacgagcgcctgccccacgcgtccgcccacgcgtccgcccacgcgtccgtgctgcagccgcacgcccaccatcctggcgcggtcgtagcgcgcccgcaccacatcgggcggcctcgcgctcgggatcgtgtcgaactcctcgtccagctcctccctgtcgggcgcctctgccatggacgcgcgcacgcacgggtgcgccgccggcgcgcgcggcctccgccggtacttccacacgcccaccgcggcggcgtggagcgtcagcgtcggcacgacgaggtccgggtgccacgcgaggaggaccagcacggcgtgcgccatcgcggtcgccgtcgggttgcgccacgaccgggtgtcctccacccagcgcgccgcgtcggtgacccaggagagcgcggccacggcgcggttccagttggcgcggaacttgcgcatgctgaacccgcgaggctccgcggcgtccagcatccacgtcgacacctcgcgccgcagcggcggctccgcggaccgcgccaggtgcgccgcggagatgcgcactgccgccagccgcagagcctcgcggttcaccagtgggatgggccgctggtggtgcatcgccgggagcaatggtcggccgtacgcgtgcagcacgtccagcatcgacccggacgtggagaagcggatggccagctcgacgtcgcccattcgctttgcgccggtgggcagcatcatgatgagcgggtacaggccacggtacgcgcggcctcgctccagcgtggacaaccgtatcctcaccttacccatcggccgcgagcacgcgacggcggcggcatccttgccgccgccttctgacggctgcaacggcagtgggtcgtcgaacacgccgacggtaagcacggtgcaggggtcgtacaccggccacgtgtactgctcgttccaggccgggtcgtagctgtcggcgatggtgcgcgtgcgcgcccacttgggtccgtacttggccaccgcgtacgcgtccgtgcagcccttgccgtcggcggcgcgcatcggaaggaggcccttgcatccaatgatgcctagctccacgacgccaaggggcggggaccacagctgccgcgccgacggccggaagtcgctgcacgcgtaggacggctcgtcggcgacgttgtagccgccgtcgaggcacacgcgcacgtgcagccggcctccgtgcatgtgcatagccgctctcttgccgactctcatcgcggcttcgtcggacgggaggaggtcgagccacttggacgccaccttccggtcgtcgacgcgcctctcaacggtagccagcgatatgctcgccgagccgacagggaaggcctctttgccgtggcgcacttcgagggagatgacgaggcagtcgtcgtcggtgaacggctcggcggcgacgaagagaaggtcctcgttccacgcaggccctccgttgcgcgccaccggcgtggtgcgcgtcttgagcgcctgggagcccagcgtagcgcgcacagcgatgccggcgtcgcggggaggcggcgccgtgagcgtgtcctgcgcctcgatgacggtgaggcgaaggagccagagcttaggcgacacgtaaaccttggcgcgcgacgtggcggcggccgcggccgtggccgtggtcgccgctggggagtctgccttccacgcgtcggcgaaggcctcgtcggcctgcgtgccggcccacgtggcgaccatgaggtcggcgccaccgaggcggcgcccgccctcgagcctgtaccactgcgtcgcgagaggcccgtccggcgggtcccgcgcgtgcacgtcggcggtgtcgaagcagaggccgccaaggaagtgtcgatcgtcggcgatggacacgtcggcgtcgggcggcaggtcccagacggagacctccagcgtcgggcccggcgagtaggtggccggatcgcgcacgaacgcg

SEQ ID NO: 1967 - DNA, 1168 bp, Zea mays
aatctattggcgggctggcggctcctgtctgtggtcgcagactcgcagtagccagtagatgccggagccgtcgcagccacccaaaccccatcaacaaaacggcgccaactcaacagacttccagctagcagtgaccacggcgaccatcgccggctcgccgccatgaagcacctccacctctcatcttctcttcctctcctcctccaccgcccctccaagccccatctcctccaccctagccgccgccgcgcctccatccgcaacgccgcatccggcggcggctccggcgaacccacccccgccgcggaaacggcctcaggtacctctccgccagccgctgccaagcccgccggcgtcaaggaccgcctcaaggcgaggaaccaggcccgccgggtccggctggactccccgccgccggaggtggtggtggtgccgaagaagaagcccgcccccgccgcgtcgtcgtctcctgcgccgaagaagaaggtcgggcggaaggggtgggaggagatgagcctgggcgagaaggccgtggacctctacgtcggcgagaagggcctgctcttctggctcaacaagttcgcctacgcctccatcttcatcatggtcggcgcctgggtcctgttccgcttcgtcggcccctcgctcggcctctaccagctcgacgccccgccgctgccgcccaccgccgtgttcagcggcggctcgccgtgatggcgtcgagtcgttcccgagtgggcgtacactaggtcgaggcgtagagctagcgtagccgcggattaataatggtgacatgatatggaaagattgaggaagatgatgctgattctggagccaaagtttggaccttttgctgccaatatgtgaattgtagacgcgcggttcttggagcttgaattcctggtttgtctgtgcaaaacctgtttggttttgtacaggcaagcaattcatttcggtatggtctggttttgagaagaagctgatatcaagaagacatccattctgctgtcgttcttctaatggagaagaaattctcagaacagaccttatattcagaagcccattatgaggagcagatggaactagatgtaattccaagtcatttccattatgttctaatgccaatctcttaatttttcgatgcaaaaaaaaaaaaaaaaaagcggcc

SEQ ID NO: 1968 - DNA, 1538 bp, Zea mays
tgaggtgatgcatcataagttcattctatcaatttttggtagaatcaacccacttcacatgtatatactaattattagcttatgaggaatagggtggtgatgaatcaacccattctattccacaaagcaaataaaaaagtgaggagtgagaagaagatgaatcatttcattcctcaaaccaaacacactattaggatacgtagttttgaaacacaaaagcacgattgcactaagatattttattgccattaaaatcaccgtctatgctctgattgctctccaatctattggcgggctggccgctccgcggggtggtcgccccctcccggggtcgcagactcgcagtagccagtagatgccggagccgtcgcagccacccaaaccccatcaacaaaacggcgccaactcaacagacttccagctagcagtgaccacggcgaccatcgccggctcgccgccatgaagcacctccacctctcatcttctcttcctctcctcctccaccgcccctccaagccccatctcctccaccctagccgccgccgcgcctccatccgcaacgccgcatccggcggcggctccggcgaacccacccccgccgcggaaacggcctcaggtacctctccgccagccgctgccaagcccgccggcgtcaaggaccgcctcaaggcgaggaaccaggcccgccgggtccggctggactccccgccgccggaggtggtggtggtgccgaagaagaagcccgcccccgccgcgtcgtcgtctcctgcgccgaagaagaaggtcgggcggaaggggtgggaggagatgagcctgggcgagaaggccgtggacctctacgtcggcgagaagggcctgctcttctggctcaacaagttcgcctacgcctccatcttcatcatggtcggcgcctgggtcctgttccgcttcgtcggcccctcgctcggcctctaccagctcgacgccccgccgctgccgcccaccgccgtgttcagcggcggctcgccgtgatggcgtcgagtcgttcccgagtgggcgtacactaggtcgaggcgtagagctagcgtagccgcggattaataatggtgacatgatatggaaagattgaggaagatgatgctgattctggagccaaagtttggaccttttgctgccaatatgtgaattgtagacgcgcggttcttggagcttgaattcctggtttgtctgtgcaaaacctgtttggttttgtacaggcaagcaattcatttcggtatggtctggttttgagaagaagctgatatcaagaagacatccattctgctgtcgttcttctaatggagaagaaattctcagaacagaccttatatgcacttgccctcaaatgctatgagttaagaacaaggcaacataaagtgttaaatgctgatgcccttcgtccaacaaagggcattattcctttagggattaatggaccttggacgaaggtttgtgacaatatgattacgaaggttaaatcttcgtaattgcagtttaatagattgtataaaatatcataa

SEQ ID NO: 1969 - DNA, 3177 bp, Zea mays
aattcggcacgaggatttttttttggggaaggtgaagcgagaggagcaggaggagagaaaggggaacgaggccggccgcgaatcggaggggaattcggggggcggggctcggtccggccggaaattcgcgcgattcgggcgcgggttagcggaaggggagggtgagcgcgcgcgcggaggcgccgcggatgtgaagatctggtgcccgtcggcgggatgacttcttcggcggcggccgcggctgctgccgcccaggtggcgggaggaggtggaggcgccgcgcggggtgccgccgctgcggcgcgaggcggaggcggaacggaggacggcatgtacacggagctgtggaacctctgcgccggcccgctggtcacggtgcccagggtcggggacaaggtgtactacttcccgcagggccatatcgagcaggtggaggcgtcgaccaaccaggtggctgagcagcacatgcaattttacgatctcccgtggaagatcctgtgtgaggtcatgaacgttgaattgaaggctgagccagacaatgatgaggtttatgcccagctcactctgctacctgaatcaaagcagccagaggagaatggctctagtgaggagatgcctgcttcacctcctgctgcacttgcaaggccacgcgtgcactccttctgcaagacattgacagcctctgataccagcactcatggtggattctcggtgctgcggcgccatgcagatgagtgtcttccgccactggatatgacccgtcaacctccaacacaagagcttgtagccaaggacctgcatggtgtggaatggcgctttcgccacatattcagaggtcaaccacgaaggcatcttttgcagagtggctggagtgtttttgttagtgccaaacgtcttgttgctggcgatgccttcatctttctaagaggtgatagtggggagcttcgtgtaggagtcaggcgtgccatgaggcagcaagcaaatgttccgtcttcagtaatatcaagccacagcatgcatcttggtgttcttgctacagcatggcatgctgttaacactgggaccatgtttactgtctactacaagcctaggacaagtccagctgagtttgttgttccctgtgatcgctatatggaatcactgaaacgaaattaccctatagggatgagatttaaaatgaggtttgaaggtgaagaggctccagaacaaaggttcactgggaccattgttggaaatgtggatcctgatcaagctggatgggctgaatctaaatggcgttacctcaaggtgaggtgggatgaagcttcctccattccacgtcctgaaagggtttctccctggcaaatagaacctgcagtcagccctccccctatcaacccacttccagtgcacagacccaagagacctcgctctaatgctgtagcttctctgcccgagtcttcagctccaacaaaagaagctgctccaaaggtcacattagagactcaacaacatgccctgcaaaggcccttgcagacccaggataatgtggccccgaaaagtgtttttggtgataacagtgaattggactctgctcataagtcctccctgcgaccgtcaggttttgatctggacaagagcaccattggcatgcagaggaagctgggttcagatatttggatgcgaatgaacagacctgatggttacagtgaaatgttatcgggatatcaaccacctaatgaaggtgcacggaattcgcagggtttctgttctttacctgatcagattgccgctggacgtcctaatttctggcacactgtaaacgctcattaccaagaccagcaaggcaatcacaatctgttccctggttcatggtccatgatgccttcaagtactggctttgggatgaacagacagagctatccaatgatccaggaagtcggtgggatgtctcagagttgtacaaacaccaagtttgggaatggagtttatgctgcactacctggccgaggcattgatcgatacccatctggatggtttgggcacacgacacccggtggtcgcgtggacgatgcccagccacgcgtgattaagcctcaacctttggtccttgctcacggcgaagctctgaaaatgaagggcaactcgtgcaagctttttggaatccatctcgacagcccagccaaatctgaacctttgaagtctccgccaagcgttgccacaccggcagctgagaagtggatggcagacggaatcgacgcagacaaaagccctgagccgcacaagacgccaaagcaactcggtgctacacaggtggatcctgtcccagagagatgcccacaagcttcaaggggcacacagtgcaaatcacaaggcgggtcgactaggagctgcaagaaggtccacaagcaaggaatggcgctgggcaggtccgtggaccttaccaagttcaacggctacacggagctggtggcggagctggacgagatgttcgacttcaacggcgagctgaaaggctgtagcaaggagtggatggtcgtgtacaccgactacgaaggcgacatgatgctggtcggggacgacccctggaatgagttctgcagcatggtgcacaagatcttcgtgtacacgagggaggaggtccagcgcatgaacccgggcgccctgaactcgaggccggaggacagcggcctcgccaattcgacggagaggggctccgcatctactgctgctgctagagaggcacccggctaccagtccgcctcgtcgcttaactccgacaactgctgatgccttggcagctagctggtcgtcccaagtagtagagaacaaggcaaatgtatccatagatctccttgtagcggagcttaatgcctttttttcccctttctaatatgcattggatgagcccgtagcgcaccgtagtagtatctaaagctggtgttctgagttggttggaccttcctgcagttttggtttctccttctgatgtggcaagttttagctggtcgcacctacctaatgtatgcttagcaaacgaagtcccactaagcgctgtacataactgcccctccctgcatcaactctaatatatcatctgcttaatcgtcaaaaaaaaaaaaaaaaaaaaacacggggggacttgccagacattatatacaggaagccatccatgctatttcagaggcacacaaagat

SEQ ID NO: 1970 - DNA, 1503 bp, Zea mays
ctcgaggccggccaggaacgacgacgtgcaagatgggttcgaccgttcatccatggctgtacctgttgttgagaagtgatgaaaggcgcgcaccgttgtcaaatgcgtcgggtggctgagggagctgaggtcaccgccagtctcttgtcacaccaaacacccagtggttcaggctggccaaagttatgagttatctgccctgtcctcccaaactaatctagtcccaggaaactaatttcaacacacaactggacgacggtgcgttgcgttggtggccgccggcgacgatgtcgtcgtccgcgggcgacaagaggaagaagacggcgtgcgtgaccggagggaacgggtacatcggctccgcgctcatcaagatgctgctggaggacggatacgccgtcaagacgacggtcaggaacccagacgacatggacaagaactcccacctcaagggcctgcagcagctcgggccgctgacggtcctccgcgccgacatggacgaggagggcagcttcgacgacgccgtcgccggctgcgactacgccttcctcgtcgccgccccggtgaacctctcggcacaggatccagagaaagagcagatcgagccgtccgtccgaggcacgctgaacgcgatgaggtcgtgcgcgaaggccgggacggtgcggcgcgtgatcctgacctcgtcggtggccggagtctacatcaggccggacctgctgcaactgcgaggcgacgggcacgtgctggacgaggagtcctggtccgacgtcgagtacctcagagccaacaggccaccgacctgggggtactgcgtgtcgaaggtgctcctcgagaaggaggcgtgcaggttcgcgggcgagcacggcatcagcctggtcaccgtctgccccgtcatcaccgtgggcgcggcgccggcgcccaaggtccgcacgagcatcatcgacagcctctccatgctgtccggcgacgagcgagggctcgccgtgctcaagggcatcgagaagacctccggcgcggtgcagctggtccacgtcgacgacctctgccgcgccgagctgttcctggcagaggcggcggcggccgacgggaggtacatctgctgcggcctcaacacgaccgtcctcgagctcgcgcgtttcctggcacacaagtacccgcagtacggcgtgaaaacaaacctcgacggcgatgaacagcagctactcgagaagccgagggtgagggtgtcgtcggagaagctcgtccgggaagggtttgagtacaggcacaacacgctggacgagatctacgacaatgtggtcgagtacgtcaaggcgttagggattctgccctactgatacttagatgcccgagcttaattaagtaggagggcagcatatatgttgtcggacatatacgagtcttggaaagtacttaaataatttatggacatatttttcattggaaaaagcaaaaaaaaaaaaaaaagtgtgagagttctagactaaaggctagtttggaaacttc

SEQ ID NO: 1971 - DNA, 1792 bp, Zea mays
ggaacacagctgatctcatccgctcaccatccctatccccagccgcccgaccgcccagccgccctctgttttctttttaacgcacgcaggcttctcttcttctccagccgctcaccagccttggccgtcgagcgccccagctccttcctctccctctcgattctctgttgaccggtgccctgctcgaatttccgcccgccaagctcccagccgagctcttgcgctgggtttctctccctggtgtgctcgcccgtaccgcactcctgctcgaacagcgcccaacctgcttgccaaggctcttcccctcggcgtcgatctccctgcgcgtccccggcctcagcccctctgttcttcgttcctgctcagccgctccctcccctccttccctgctcaaccagctcggttccatggcagcgcgcagctcccctttgctcgcccagccgtcgagtttccccatgcgcaatctcctgcagccatggcgcccggccggaatttcccgtctagttcgcgtcctgctcggtgttcctttgctcgtcgcgccggagctcccatcgccgtgcgcagcttcttctctggtggccacgcgcccttccagctcgccacggcgctcagtcctgtccatctcgccgtgttcggatttagagcagcacactccctgcgtgtcgcgccgttcctagttccctgaacacgcgagttcttttactggcgctgttcccggtgtcgcgcgccgtgcagtagcgcgccctttgccgaactcgtggtcacggtctcgccttgctgccacagccacgcctactgccgcgctcggtcttcgtctctgtcgcacgcgcgaattttcttcgcttggtcttaattcccgtcgcatcgtcgacctcgccaaatgcgttcgtcgtttggtcctgtgtcgttaggatcgttgaccgtgtttgctaccgcgtgcgcttgtttcttaggcgcatcgcgcagtagatgggtctcgcgcgcgtggttttgaagctatgcgcgttcgtcgtgccgcgtcgtgtgctgatattctctcccagcagactttgccgtcgaccatgttcaagtaattgttcggctcctcgcatcccacctattcaataaaccacccaaatccatagactgtcgacgcactgctgccttacgcggctgtctctgtcgcttgcgtcagcccgccagacctacagctccatatacgtcgctctcccgtatcgtcgtcgagcccgtcgaacctcgttcttccatgctcgatcttgtcgaaccctgaatcccagactttagacaaaaataagcgaggcccctgtgcatcgctcatcaagtgctcggcccaaggcgccgatccaggatcatcgttgaccccgcaacttcagctcgagttaattatggtaagttgatttattattcctgtcgactaaataaatggtaggattaaatagaagaattcattgcgatgattctcttgtttattactcgatgtagagattaagttgaattttagggttatgcgataagtatattggtagacatatataatacacgagttaaccggtaaattagtttagaaagttaataaaagtttttctatcaaattttttaagtattagatgtctaaaaattgtgaagttacaagttataagtcgtttagggtactctctaaactagatatcatattctatgtgtgttagtggcttttataattggaatggatggtgattgtgacctcgactatttagctaagttgtaagagcatgatcgtcgtaagtaacaatatatcgatactagtgtccgt

SEQ ID NO: 1972 - DNA, 1747 bp, Zea mays
cttgcatgcctgcagccgatcaaaaaacatgttccctccgttgtaaatttacaatttgttttacctttttaagataagtttaacggactcgttttatttaaatttgagccggcgaatactttaggaataacatccacgatgtgtttgtctgataatatccgccatgggtaggtcagtttttttgaattatctgaaatgcacccaatagtgataaaattatattcgtgatattcatatagaatattcatgtgaacacatatacaaaaatatctagatatcagaaaaagtattcacgctcgggtcaaatggacggtcgaacaaacattcagtaccatttgcataattgcatccggatctgaaaagttgtgccggcaccgtgggaccgtgccaggtccacgtcagccgagataccgctggcacgagggaatgtgccgagttgccgacgtccgacgaggccgggggagcacgtgacatgagatatcatcacgcacggcgctcgttgctcctccccatctccgccgtccgcttcgcatcccacggctaccgcctccctccgcgccctcctgtccgcctcatctgccgagaccaccagccaatcagccagctacacacacacatcacttgccaggccagttgcgcttgcgccgcgcgcgctctctctatctgcttgtcgtgcagagaaagtgaggcgctgcgctgcgctccgccgcgcagatgtgggcgccgggctcgcctgggaggctgccggcgatggtggagtgcgacgaggacgggcacggggacgcgtaccacgggacgatggcctcctgctggggccgcttcggcgccgccgcgctgtggcgcaggctacggcggcgtgtcagcctggtgcggcgcaggcggcggcgcggccgctccctcctcggcgggctaaactacgacccgctcagctacgcgcagaacttcgacgacgggtgcctggaggagcgcgagccggacttcagcgccaggttcgcgcccgcgcgccacgccgccgccggctccccgcggcccacggcctgacggcgtactagatttttttttattacgacgtactacccccgctcggtgctctgctcgcagtcgcagcgcgccattggaagagtcaagagtggcaggtaattgctcctccgcacgtcctttagttgataaatgtatatacatggtacaccgtacacgccgtcgactcgcatggatggattggatggatgtaattaaatacagtagcaggtatcgttagtcgatctcgatcggaacgaaaaaaataaaaaaaacgattggctggcttccttcatccggcagcgttcgttcttgcggctgcaggattcttgaggttttgacgtgttcatgtacgcctgtgcctgtgtttcgggcttcggcacagcgatcgcctaaatcgttctaggtcttgtggagatggcagcattcaccttcagttcgtgcactgtttctcccctcaacacatcccatatatatttgctatatagcttcagcgtggcgaagttagagcaaaattgaggatggtgaaattgatcggcatactattttttttttctaggagtacatatacagtgaaattttaactgcatctatagaatttgcgttttcaagggggcgtattgcatccgataggtacaaactagcttcgccactgagcttcatatttacattaaaatgtgacgctttgatgcaggcagctgacactgcacctgcagccacgcgtgcctcc

SEQ ID NO: 1973 - DNA, 1953 bp, Zea mays
cccactttattcttcagcacgttgttttagcgacgaaaacgagggtacattaacgaatcgggtttcggctaatttcggtcgaatcacgcagaacaaattatcagtaccgaaatcagtttatttcagtctgttgtttctcgcccggatccaaatcttcggatataaacaattattaaataatttggttctcactcgtccaccgtgaaatcgcgtacgagaatctataattgagcctcgattcactggtaagttatccgtggttgtggaaccagatgttctgacctcaggtaaatttatcagattttgaatcgaagggaacacagtccgaaatatgagttgttaatatcattctaatttgttctgattatgtatcgtcccgatctaaaaatcttgactcaaaaatatctgcgatttgtcgttaaaaaaaaggaaaaggaaatatccatcttctccacgccgtttgctggggaatattttttttcctcaaccttgtcaatacggcagtcggcagctataggtgttcatctctgcagccgtgattttcctgccgcgagctcatcttccccagatttttccctccggccgttcaagcgatggatatttcaagccgcccgtgggtcttgatcttttcttggcgatgttcatctccaggctgccgcgcttatctccgtgagatattccagcgccgccccctgctctttttaatgcgcgcgcagcttcttcccagccgcgcctgctcctggcgctcctcttcctctccctgagttccttccctgcgcgtcgtgtgcccatctcctccagcgccctgcccaggttcgaccatggcatcctcctctgtcgcggtatcccggctcctcgcctaggatggcgctcggtcgcccggccatctattccccttcccagccgcgtcctgtcgagcttagctccgtgcgcgcgcgcgctcttcccccttcctgccatggccgctcctatctgcagctcgcccagccttcttctccctgctcgccgaggctcctgctcccagcgtagcgctcctctctcctccaccgcgccggacttccctgctctctgctccctcgcggcaggccggcaacttcctctctctctgctcgaccttcccaaaccccaacaccgtcgatctcctgcttgtccctgcgcacgcgccgcggattttccccgagctccctcgccgtggtcctctgctcgattcgctatagcttatccaagctccccatggcgcccggatttccctactgcccctgcgcgcgttctgcttcctgcgcgcagctgcgagctccgctctatcgctcggtctcccgaagctcgcgtcgttcgttgtgctgtcgcgccatcgcctcggtctggccgtcggccaggacctctcaatactcagctccctgttcatccacgacgcgtccggttttctttgtcttgtcgtcgtcgttcagtcgcctcgccctcgcgccgtccatcgttaggcacaatctgctctagcccgtggacgtcgtatcctggctctggtcgctagatgccgcaccttgcctgtgctgaccgtcatcacgtataggcccggacaccacctctacctacacgagctcgaccggatccccatcttcgcgaattcgccgtcgatatccagctcgctcttatgtcgccctcccttctctcatcccctgctcaaccccaccccgccagctcgctccagacataatcccgtcgtcgttctgtgcgtcgggtgaagacgaagctagccgagtaatattcaccgagtgcgcgacaaaaagctcgaaccagtcgtcaatcgtctcgacaacaaccacatccaagactccaccgttccaataattttgccgcatcgtccttcaaatccgaatcctcgtccataagatcgtcgttgatctcacaacttcagctcgagttaattgtggtaagttaatttattattccgtcaac

SEQ ID NO: 1974 - DNA, 1016 bp, Zea mays
  misc_feature (23)..(23): n is a, c, g, or t
  misc_feature (34)..(34): n is a, c, g, or t
gcccgacacaaagcgtttcaaanttggcgtcgancacgttggtgtactgtgtccccgtgtccacgacgggcctgcccgtgccgtcgaagaaggcgtagtccagcgggaagtcgtcgttgtcgtagaggctcaggaacgggtagatgttgacggtgaagggcgcgccgctctggttcaggaactgcacgatctccgtcatgaggccggcgatgtcgggccggaaccgccccgccgacggcaccaggttgtccttgggcgagttgtacacgtcggcgttcagcggcaccgtcgccttgatggtgtcgccgaagccggcgtcgttcagcgcgcgctggatgttctgcagggcgggcaacgtgacgttcaggaacgtgccgttgaaagacgacaggaagggctcattcccgacagctacgtacttgatgttcacgccgccgtcgaagttatagcggctgacgttctggcgcacccagtccctggccgtgccgtagtccgtcatcatgtcgagcatgttgttggggatggccaccatgacctccacgctggtgccggcgagcgcgtccatggggccggcgtcggcgtcgaaaagcttcaccttcctgatgccgttgtcctccagcatccgcaccacggtggccggcggcagctggtgcgtcgccatcgtgccccagttcaccccgagcgctccagccgccggcagcccagcgaccgccagcgccaccgccgccaccaccacagcggacgccgcgacggccaaccgatcatagctcgccgccgccatggaagatggaagacgggacgccgcttgctacgtgtcggtgtctgcaggctaccagccgcgcctgcgcacgtgcacgcgcgcgcgcgcgcgcgtatgaattcgcagggtcgagtcgctgggttaattttagaggaagaggaagatgtgtaacgcgtaagaggaagaggtgtggccgacgcaacggggattggagggagtggacaatgggattcccgccggctcgacgcccgatact

SEQ ID NO: 1975 - DNA, 1745 bp, Zea mays
tatagttagtgtattttaattgtttataatattgagttgtttgattaactaactatattttaatatagttggagtaaggaaatgttgatctttgactatatgaacttaaacttattatattattaatttgtaatctttgtgagcttattatattgtgaattatgtacttgtgatatttgcgatctttattgtattgtgaagttattatattgatatgattaccgatcgaattttagatttcgaccgttaccggcgtatttttcgtaccgaactttcgtttccgatgtttccgaagtaccgatatcgtttccgtttccggagtttccgtttccgatttcatttccgataaaaaatatgaaaacggtaacgattttagtgtttaccgatcgtttccgaccgttttcatccctagccacgcacggcgcccgcagcgcctccccatctccaccgtccgtctcgcatcccacggctcccgcctacgtccgcggctctcccatccgcttcatgcattgatccaaatgccaactaaccacctgcgcggtgcgcgcgcgctctctatctgctattctgcttttcgtgcagacgggaggggagagctgcactgcactgcacacagaatcacagatcacagatgtgggcgccgggctcgccagggaggctgccggcaatggaggagtgcggcgaggacgaggagacggacgtggacgcgtaccacggggcgatggcctcctcctgctggggccgtctcggcgccgcctcgctgtggcgcaggctacggcagcatctcagcctcgtgcgccgccgccgccgccgccagcgcggccgctccctcctcggcgccggtgggctcaactacgacccgctcagctacgcgcagaacttcgacgacggctgcctctgcctggaggagcgcgagccggacttcagcgccaggttcgcgcccgcgcggcacgccgccggctccccgcggcccacggccgcggcgcgtgacgtcgcgaccgcttgacggcgtagcacatgcagtagcctttaccacgtaccgctcgccgcagccgcgcgcctttggaagagtggcaaactggtaactgctccacacggcttttttagttggtaaatgtacatacgtggtacacggctacacgccgtagtagacgacgcgcgtggatggatgtaagtaggtttgttatagcgtcatctagatcttcgcatcgcatcaagcgaaaaaaggtctctttgccgatttgctgcctccagctgcagcgttcttgcagttgcagggattattcttgggagtttttgctcgtattattgtacatgtacacttgccatttggctgggcttctgcacatcactttgtcctgaataagcctacctcgttctcgttcttgtggagatgacagcattcaccttttagctcataattgttttcccctcagcacataccatactggatttgccagagcttcagatttgcgttggtgaagctgagagagagagactgcacgcacctcggcacctgtaggctgtagctatcatgctactactggtttctccactacgcttaatactcccttaaagctgtgccactaatgctatcatggaattagctctcctgtcacagtctaattattagaggacgaattcaagatttgggtgcccctgcttctgttcacaaaagcaaaggtggcgagatagagaggggatatgcgcatattgggggtagagtgttggctacaaatcccggg

SEQ ID NO: 1976 - DNA, 3379 bp, Zea mays
  misc_feature (3280)..(3280): n is a, c, g, or t
gtcagcgtcacggcagccctggccgccgacgccacgtcagagctcggcgcctaggccatatgacgccaagctaagagtacaaaattagaaataagtcaccgagtagtctaaatgttattttttgtcgaaaaaagaattaaaaaacaaaaaatcggatttaatcactgcaatccatctcgaacggaacacaagggacattttagctctatccactccgtcatgcgctattgggaaggcgaaaccgaagccgccattttcttgcgcaaccccgtgtagacgtaaacccgggctcgtgcgtgcttacacaccagatttgtatttgtattaatacggagtattacccaaaactagcagagctgaagaaggcacctagcgcgcgctcttcgtttcgtttgatcgcacgcgccaatcctgacgcggtcaaccgcgagtccgcgaggggaggggaggggaggcgaggagaatgacgcgcaccgtgacgaccacattggtgacactgtgttccgtcatcacgatactacaggcgccgcgcgcgtggctcctcgtatcccgaccgacggtcacgtcgcgcgggcgcgtcggtctcgcatcgcactccactttttccactcagttgcgtcacgattttcacgacgccccggcccccgcccgtcgatcccttccctcctcctgcttgggccgcgcccgcggttcgggttccccccttcggccgtccccctatatattaaaccatgcccgtcctgtggaaagcatccgttcggatccgagagtcctgcagagcccatcctgttcctgtccccctcgagcaatcgagctctacagctgcacgctcgcttacgcggagacacagacgctgagacacacgcaggtcatgatgctgctcatggactcggggagccgcggtgactgctccccggtctgcttggacctcagcgtcggcctttcgccgccgtcgccggggagcggcccggaaacgacagctgacgctgagagactcgaccgtcccgccactggctgctgggggccacggacatcgtccctcgctgacgggaaggacgaggtaactgaccgacgaccatttcctcgccgctcggtttccacaatctatcggcgtcgtcgtcgtccctgaaatcctgaaaatctatcggcatcggtggccacaatgctgtgtgatgagggcaggccaagaccctggaggccaggctcacccaggtcagcgaggagaaccggcggctcaccgagatcatcgcctacatgtacgccagccaggtcgccgcgcggcggagtcccgacggcaggaagaggagcagggacagcctggagccgtcgaattcgggcgacgccaacgctgccgtcgagagcgccgccctcagcgacgagggcacgtgcaggcggatcaagctcaccagggtctgcaccaagatcgacccctccgacaccacgctcaccgtcaaagacggctaccagtggcgcaagtacggccagaaggtgacgcgcgacaacccgtccccgagagcctacttccgctgcgcatacgcaccatcctgccccgtcaagaagaaggtagactcctggcccaccatccgtccatccccggcctgacattgattcgattcacggcggcttctttcactctgtcgctaatggtcgatacaataactctgttcctcggaacaggtgcagaggagcgcggaggacagcgccatgctggtggccacgtacgagggcgagcacaaccacccgagcccgacgcgcgccggcgagctccccagctccacctccatcaactcctccggcccggccatcacgctggacctcaccaggaacggagccggcgccgtgcgggggctcgatgccgccgccgaggtgcccggcctcaagaggctgtgccaggagatcgcgtcaccggatttccgcacggcgctcgtggagcagatggcgcgctcgctcaccaaggatcccaagttcaccgacgcgctggctgccgcgatcctgcagctcctcccggagtactagtgtctagcgccccacctgctttcagtgcttattacagatatcagagcgcccgtcttcaaagagcagcagttctttcatcgtcaggaaacaaaaaaccgctttacgtttaggggtagctcgaaaactctatttttaagggatttttattatctcaaagaaaaataaataaatttttttaagaaaatagaaattcctttgaaaaatagagtttctaaactaagacttagggttagtttaggaatcacatttttccatgtgatttctatttttctaaagaaatttagtttatgttctttttagaaaacagaaatcccttagaaaaataaagcttctaaactagctcttacttagattagattagagccaatctccctcaaatttattataggtgtacctgtaagtttctttcttctgttcttctggctaggatctgaactgcactagtactactgtacatttcacatgtgcatagagccatagaaggccgttgtcaagtaccgcgactgcgtcctacctgaatgtgatctgcctagttatcaatagggaattttatactataaaatttaagtatagaatcagattagagagtgagtgaagaagcatttaaatcgtgatctattactatcccttttcaaagcatacatttgatctctctagaattagagatggagtgttgggtacaactaacacaactcgaccaatataacgggcgagctcgagccataatttttgacccgcaacaattcatagttgggtacagaccatgatttttgacccaaaacctgatccaactcgaaaaccttcgacccatagcttgaaaactcgtctcgacatgtcccacaggggggcacgtgccaacccggcggctatgcacgggtcaggtgtgggttgtgtcaaacgatccacgagccaaccattttttctcctcgaacatggttcgacaactatgcacaggtcaggcacgagctgtgtcaaacgacccgaccgatcatgacccggcccaaacccgatccgagcagaggtttgaacaggtctagatacagcccaagtaaagttttatacttgtctcgtcaaatgtttgaataataattccggatattaaatatagtctaattataagactagttatagatggagactaaaagacaagtcaattttattaaatttaattaaaccaatacttaatagtcttaattgatatttgttttaattaatattcaaacatttaatgtagcacagactaaactttagtaaccaaatatcncttaaatttagaaactaaactctctcgatggaggatttcatttcactgtttctaaaacaagctgcaccaccagttaatgtatacatacatgttttgatc

SEQ ID NO: 1977 - DNA, 1771 bp, Zea mays
aagtagcatttgatatgtgcgagaagagctgcggttaacgtcgtaacgcaaatagttaactagacggaaaccggtagcggaaacaaaaacagccttgtggccgcaactacaccaaatagcaccatcaagtcactatcgaaatcgccctgttgcctgcctacttgcaagctggaagctgcaacttgcgtccccgtccagccgtccttgctctctgacccagatgcagcccccttccttccccagtgcctggtggctcccctcccgcgttattcactctgctagtcctgctcaggtctgctgactgctgctctctgatccaaacctcctcctccaccaccacctataaatacgcatcctcaaatccaccattcccaaatcgaaaaccactcgaacacaaactcaggcaaggcaaaaggaacccgcaccatccgaggctcaagcagggaagtgatcatcatcatcatcagaagaagatgtgcccaaccaagaaggggatgaccggagagccgagctcgccatgcagctcggcatcagcctcgaccttaccggagcaccaccagacggtgtggacgtcgccgccgaagcggccagcggggcggaccaagttccgggagacgcggcacccggtgttccgcggcgtccggcgccggggcagcgccgggcggtgggtgtgcgaggtgcgcgtgccggggaggcgcggctgcaggctctggctcggcaccttcgacacggccgaggcggcggcccgcgcgcacgacgccgccatgctcgccctcgccggcgcgggcgcctgctgcctcaacttcgccgactcggcctggctcctcgcggtcccggcctcgtgcgccagcctcgccgaggtccgccacgcggtcgcggacgccgtggaggacttcctccgccatcaggtggtcccggaggacgacgccctcgcggccacgccgtcgtcgccttccagcgaagacggcaacacctctgatggcggggagtcctcctctgattcctctccgcccaccggggcctcgccgttcgaatttgatgtgttcaacgacatgagctgggacctgcactacgcgagcttggcgcagggattgctcgtggagccaccgtccgcggtcacggcgttcatggacgaaggcttcgccgatgtgccgctctggagctactagagactgaaattttccgtttctttgcttggcctctggcgcctaattttggcagtgtaaaacggttacttcttttggtaatgagatggaacaagtttgcgaaacatgaaaacagagcatgctaatcgacattttagcgcggccccgtcaatttacttttaactaaaatatggtatataaaaaaatgaaggaagcctttgcacttactaaggatgcaataggaactgtatagtatgcatgagacatgacccaataatacgaatgatgctacgagattttggtccactatatccacatgtattaagatagattaagatataacttatcttaatatatgtgaattatgattaatactagagtaatctagccgcgccgagttgaaagagttggtacttggagagtcaacttcacacaccggcaaagaatcaaacgatgggggtatattatctctgttctaaaataattgactttctcactttctaataagtcagctattttcaacttaactatatatgtagcatataattgatgttattcgatatacatttaaatctatttttataacaaaagtatttaaagatattttgctaatgtttctaatgaat

SEQ ID NO: 1978 - DNA, 1759 bp, Zea mays
aaaagtgcgcctctttgaccaccaaagttctagcagaaattactcaactgcccagcgcatctcacgacccggcctcgcagctccggcgacgatccctccaatggcctacgccgccgccgttactctccggcgcgtggtgcttgtgtccgctgcgctgcggctcgcactagtggtgttcggggagtggcaggatgcccaccttgaggtgcgctataccgatgtcgactacctcgtcttctccgacgccgctgcctctctggccacaggcggttccccgttcgcccgcgcaacctaccgctactctccaatcctggccttcctgcttgtcccgaactcactcctccatgctgcctggggcaagctcctcttctctgccgcagatttgctcgtagggttgttcatagacaccattctggaactaagaggaattcctgagaaaatgcggatgtggtctgtggtagcttggctgttcaatcccttcacattcaccattggtacaagaggaaactgtgaaccaatagtctgcgcagtcatactctggattctcatatgtttgatgaagggtacccaatgccagaggctgcaaaacaagtcgggtctggggaagggataagctgatgcaagcctttccccgcaaatgcggagaagccgcttcgaacccgcaacctggtagagtgttgcaggcagctttctggtatgggtttattgtgcacttcagaatatacccaatcatatatgcaattccttttgtaatagttcttggcaagggctatgctggtcctgttggtaggcctactcttacgatgtggaggtccaaacaacagttgcaagatgataaagtcagtcaaatagaagaaccaacatcatttctggccactgtatggggttttctttcaaacttcataagcagaaatgggatcctgtttggattactctctggatccatgttctttgcctggaccggtgttttcttctatctgtatgggtgggacttcctaaatgaagcattactttatcaccttactcgtaccgacccaaggcacaatttctcgatatatttctaccacatatatctacaccatcagcaagggttctcaagtattcagaggctcgcttcgtttcttcctcaactgatcgtgcaactggcactcattctacgcttctctagggatcttccattctgcatgtttctccagacggttgcatttgttgcttttaacaaggtgatgacagcacagtacttcgtgtggttcttctgcttgttgcccctcattctcccttggagcagcatgaaacttaagtggaagggtctggcctgcgcggtagtgtggatggggtcccaactgcattggctcatgtgggcttacctgctggaattcgagggccgaaacgtttttgtgcagctctgggttgcaggcctcatgtttctggctgcgaacacctttgttatgctcatggtgatgaagcaccacaagtacactctgctcttctcaacgccgctgaagtctggcaacaaggttgctaccaagaaggaagaatagcagcgtttgggctctttccattttgccgactgatgtatgattaggacatggatcatgtttgtttctctttttttttgtgtttctgtcagatcacatgtgacttgaatcattgtagtttttcccgtacataatgtggtgacattgcatgagaatattttttggttaccagaatttgcaattggttcagattttacaaaaaaaaaaaaaaaaaagcggcc

SEQ ID NO: 1979 - DNA, 2953 bp, Zea mays
  misc_feature (1955)..(1955): n is a, c, g, or t
actgcgagacggcgttgtgtttcttccaagcattcacagagcccttagcaattccccgcgtcggtgatcgggcccattgccatctgcccatctctaccgacgaccaactgaactgaccgagtgagcgacgccgacctcgggctggtcggggcgatccggttccaggcttccggccatggcgaagccgccgcgggcgccgaggcccaaactgcagacgccgcgggcgccggcccggcggctcctcggcctcggcgggctgggcgtcgcggcggcggcgtacgtgggcgtggactacttgcggcacctctcgccggcgtggcacggccggctgcagccggcgctgtgggcggtgctggcgctcgcggccgccgcgcgcgcgccgttctaccgccactggtccgcggagctgcgcgccgcactgcccttcctgggatccatcgccttcatgctcgccgccttcctctgcgaggccatctctgttcgcttcgtctccgccgtcatgggactgcactggcacagaactgccgcgccgcttcctgacactggtcaatggctgcttctatcattgaacgagaagctccctcagagcgtggtcgatctactgagagctcatgttatcactctccaccattatctgatgttgtttatcatgctgggtttctcagttctgttcgactgcatcaaagctcctggtcttggtattgccacaagatacatgttcactatggcaattggtcgtgtacttcggacgataactttcatcgctaccattcttccatccgcaaggccttggtgcgctgtagcccgttatcaaatacctcaacatcctcatccttgggcacagaaatattatgttccgtatgcttctgactcgaatgctattcgcagagtcataacacaggatatggcatatgctgctgttcaagcttacccagatgaatataagcccgattggggacgtatgagcttccttgtagacattttgagaccaactcctggagaagggccttcgtggtaccatcttctgaagaaagctagtggcggctgcaatgaccttatgtacagtggacatatgcttgttgctgtcctgactgcaatggcgtggacggtaatatataagtgtcgttttaaatccgtatatcacaatagcatttttatacgctcccatgttgcccaaagggttcgtcataactcgtacggccgccgtatacctttgtttctatgtgtttcacaggaagcatacgggggctggatctctgtcgcgatatggctcctcgtcctgcacagcgcgcagagggaggtacgcgagcggcaccactacagcgtggactgcgtcgccgcgatctacgttggcgtcctcctgtggaggatgacggggttcatctggtccgccagagacctggcccgagctagacggctagccaagctcgaggaggtccagagcaggctggtccacgccgccaaggacagcgacatcgatgagatcagaggcctgctgaaggaggtggagctagccggccaggagaggcagggcttctcgcagagggcgatcctggccttcgccgcaggaacgatcatcttcaccttgtcttgtgtcctcatcgccttcacagctactagcgacggctgatttgggttctgttgcatgcccctgggtctgaatgttagccactttctcctgggctgcactgttttcttgtagtatgttgactgttgagtgtcgttggttgtggggaaaccatgtttaggactagtttgagaatctcatttttacgagggattttcatttttctttagaaaattagttcattttttcttgagaaaatagaaatcttttttaaaaaaagttctcaaactagcccttaaacggaaacgtaactagatcctagcggtgccagaattcatggacgttttgcagctgcacggggagctggtggctgtcggtaacattttgnttgttgtagccaagttttacttaaacagaggttgaggctttcattccttgcaacgcactgtaggccaagttttatttctgttatgtattttgtagtgaggcggttcaaaagtttcagtgtagcggatccttgcaggtccaaaagttttaggcagtgtttagtcgtagagcacgggatatagccgctctactttcaatttgttatttttagatttgtaggtttaaaagttttaggcagtgtttggtttagagtatggtgatagggagtcgtactgcttccaatttgttacttctaatttattgttatttaaattagtttcatacaagacaaagtgacttaaaaaagaaaatctatgtttaaatatagaaccatccaactctaaaatcttttgaacggggccagctgttctatcctaacggcctccgaaactaaacacaactttagtgtggcggatccttgcaggtgcagaatggctcaaaatcttcacgagcagagctgagtgaattgcagtacgttacttcttaaaaaccatttctacagatatacttagcttgacagcctaattttttcaagagatttttatttacctaaaaactagtttattttttaaaaatagtcagagataggctatataatgtttggaagggatgcagttgtgtatgttgtatttgtaataatgagtagagatgacaatgggtaaatactcaccgggtattactacctcatactcatacccacgacacaaaaataatcccatcaaatcacccatatacactggtgagtatggatttaccccatacccatacccatgtgggtatgggtcacccatcggatcacccgtacccacaaaaattaaacctctatcaaaatattatattatacaaatgtcaagtatatccatctgtcattacaaaatttctagcatcatttaaccatccattcaacacacaaaagataattggataaaatagtaatactaggatagtactacatagcac

SEQ ID NO: 1980 - DNA, 2146 bp, Zea mays
ctcgaggccggccgggccgggcctccgcgtcgtcccttccctcccggcttccagggtccaggcctcccgcctccctgcacagcacagcacagcacagcaccccgcatctctccccttcctcaccaaccccgccgcctccgacgttcacctcggctgccgccaccggcgaggccgcacctcgccggtcacccacccccgctactcgatattatatcctactccgaggatccgcgtagccgcctccggctgcccacccgcggaactctagatctccgataccccgcgctccctcccgccgacggccacccgaccggaatgggccgctgtcttcagtaaggtctaaggacccaagggaaccctcctccgccttcgctcgtgcgcgaagcgcggccgcgatggcgatccgcattacggtgtcctactcgggctacgtggcgcagaacctggccgcgtccttcggcctccgctgcaccgtggctgcgggcgcaagtgcggcgctcggcccggggtgccgcttcctccaggacgcgctatcccaccccttctgcctcttcgcttcctcccgccgcgccgacccccaccatgacgccgaggatcacaaccacccgaagcccaggtccaaggctctagcccccgccgccgcagcaagaggaggcgaccactcattgctgctgccgcggtcgtgttccgggaaggcggcgccgccggtggatgaccccccagcctcgttggccgtggggctgctgtcggtgttcgcgtctgggatgggatcgactggtggcattgctggtgcgtcctcccttgctgcgtcgccgtcaatatcagccgggttcaaccctgcggcgctcctcccgttcttgcaggcgagcaagtggctcccctgcagcgacatagtcactgttgcaacgacgtcgcgcagctcaggacgcccagcaggttcaactgcttcgcctgtaccgcggacaactgcaccatcgccccgtcctacacaacgcgcagccgctccttctccctgccctgtgccatcacctgctgttgctgctccttccaaggtcggcatacaagcattggttggtagtgctagcatcgcctcaggttcagctgagattggaaggggagccattgcctctggtgtggctggaatggtgaagaagagtggtgctagtcttcctgctggtgcaggggtgagaaggaagactggttggctctcaaagtgggtgagctcatgctcagatgatgcaaagacagtcttcgccgccgtgaccgtgccactgctctataaatcatccctagctgagccgagatccatcccatccaggtcaatgttcccaacatttgatgttggtgaccggatccttgctgagaaggtttcgtacattttccgggagccagaaattttggacattgtgatatttcgtgcacctccagtccttcaggcattgggctacaactcaggtgatgtgttcatcaagagagttgtggctaagagcggggacatcgttgaagtacgtgatggtaacttgttggttaatggagtagttcaggaggaggaatttgtgctggaaccagccaactatgaaatggatccgctgactgtgcctgaaggctatgtctttgttctgggggataacagaaacaacagctttgattcacataactggggtccacttccatttaagaacatccttgggagatctgtgctccgatactggccaccatcgaggataacagatacaatatatgagcatgacatggtgcagtacacagctgctgcatcctgatagtacattgtggcaataccacatgctgcaggtccatttttcctttccctgctgacaaagggttatgctgagcctttaggttctttatttactggctgtagccttgcctcaaatgtcgattgcgcagcttggcagacagattgattttttttcactccctacgggcagatgcttgttcgaaagcaacaaattttctctgtagctaagaatgaatgtcatataaatgttgcagaagtagatgaacgagcatcaatgagtgataaggatgtcagttctcttattttatgtgacgacatgttgttcaaaacttatgtaaaaaggaaatacaaagcataaaagactgcccaaaaaaaaaaaaaaaaatc

SEQ ID NO: 1981 - DNA, 2997 bp, Zea mays
  misc_feature (486)..(486): n is a, c, g, or t
  misc_feature (2750)..(2750): n is a, c, g, or t
agcgaccatgccatcaaaggctctttcaatttatgcagctgtgaattgacctaacaatatcgcatccatctgttgtgttacccttggctaattgtatttgaataaaaaaaaggaaccaatgagatttccatcttgtgagatgaacataacatgcttagaatgttcttttccatccatccagcctcattgatctttctgagatgtgagaatggtttgtccattgtcctatctctttagagatagtttgagaacctcatttttttctaagagatttttctaaaggaaatttagtttattttttcatgaaaaaaaagaaatctcttaggaaaataaggttaacaaactagcaaaaagagatgatcatccataataaaaaaaccaaatgacccaaagttcaaacgtgtcactgtttttcctctcttgctgtatgctctcatttttttcttcttcccagaactttgcattgcaatgccaaccaatacgacngtgtccacctaccgcccaccgctctcgttccaacctagttggaccaccccgtaaaaaatctgaggggagccggcctccacgaactcctccgctgcaacgacataaaagagccgcgccggcccgcccggcccggcttcctggcctgcacctagcatctctccgcttcctccccatccccgccgcctctgacgttgacctcggcggccgccaccggcgaggtcgcacctcgccggtcaccaccacccccgctgctcgatcttatatccctactccgaggatccctgtagcctcctccggccgcgcacccgcggaaccctagatctccgataccccgcgctccttcccgccgacggccacccgatcggaatgggccgccatcttcagtaaggtccaaggacccaggggtacccccctcagccttcgcgcgtgcgcggagcgccgccgcgatggccatccgcatcaccgtatcctattcgggctacctggcgcagaacctggccgcgtccttcggcctgcgctgcaccgccgccgcggctgcgggcgctggcgccgcgcccggtccagggtgccgcttcctccaggacgcgctatcccgccctttctgcctcttcgcctcctcccgccacgtcgacccccaccatgacgccgaggatcagaaccacccgaagcccgggcccaaggctctgtcccctgccgttgcagcaagaggagatggctactcactgttgctgccgcgatcgtgttccgcgaaggcgccgccgccggtggatgaccccccagcgtcgctggccgtggggctgctgtcggtgttcgcgtctgggatgggatcgactggcggcattgctggtgcatcctcccttgttgcgtcgccgtcaatatcaaccgggctcaaccctgcgtcgctcctcccgttcctgcaggcgagcaagtggctcccctgtagcgacatagtcgctgctgcaacgacgtcgcgcagctcaggacgcccagcaggtgcaacggctgcacctacaccgcgtacagctgcaccatcgcctcgtcctgcaccacgcgcagccgctccatcgccccgtcctgcaccatgcgcagccgttccatcgccccgtcatgtaccagtgccgtcacctgctgttgctgctccttccaaggtcggcatacaagcattggttgatagtgctagcatcgcctcaggttcagctgggattggaagaggggtcattgcctctggtgcagctggaatggtgaagaagagtggtgctagtcttcctgttggtgcaggggtgggaaggaagaccggttggctctcaaggtgggtgagctcatgctcagatgatgcgaagaccgtctttgccgctgtgaccgtgccactgctctataaatcatccctagctgagccgaggtccatcccatccaggtcaatgttcccaacatttgatgttggtgatcggatccttgctgagaagatttcgtacattttccgggaaccggaaattctggacattgtgatctttcgggcacctccagtccttcaggcattgggctacagcgcaggtgatgtgtttatcaagagagtcgtggctaagggtggggatatcgttgaagtaagcttttatcccaatggtacgtgatggtaacttgattgctaatggagtagttcaggaggaagaatttgtgttggaaccagccgactacgaaatggatccgctggtataataactaatcttcttaccacatgctactaaagagccactattttgtagtcctactgtgcctgcagcctagttatgtggcatcaattcttgacttttgaattgttacaaattggttgtgacctcaaaagtattcctgtgttctatgttcatatattaagtttactactttcatccactgaatctatatacacgtgctgattaatcgttgttgcttggccagactgtgcctgaaggctatgtctttgttctgggggataacagaaacaacagctttgattcacataactggggtccacttccatttaagaacatccttgggagatctgtgctccgatactggccaccatcgaggataacagatacaatatatgagcatgacatggtgcagtacacagctgctgcatcctgatagtacattgtggcaataccacatgctgcaggtccatttttcctttccctgctgacaaagggttatgctgagcctttagggcttgttcggttattttcaatccatatggattgaaggggattgatacggattgagggggattntgacttactagggattgaaaccccctcaatccccctcaatccatatggattgggatataaccgaaccaagccccttaggtctttatttactggctgtagccttgcctcaaatgtcgattgcgcagcttggcagacagattgatttttttttcactccctacgggcagatgcttgttcgaaagcaacaaattttctctgtagctaagaatgaatgtcatataaatgttgcagaagtagatgaacgagc

SEQ ID NO: 1982 - DNA, 1306 bp, Zea mays
  misc_feature (2)..(2): n is a, c, g, or t
  misc_feature (5)..(5): n is a, c, g, or t
  misc_feature (8)..(8): n is a, c, g, or t
gnaanagnatggtgctagtcttcctgttggtgcaggggtgggaaggaagaccggttggctctcaggtgggtgagctcatgctcagatgatgcgaagaccgtctttgccgctgtgaccgtgccactgctctataaatcatccctagctgagccgaggtccatcccatccaggtcaatgttcccaacatttgatgttggtgatcggatccttgctgagaagatttcgtacattttccgggaaccggaaattcgggacattgtgatctttcgggcacctccagtccttcaggcattgggctacagcgcaggtgatgtgtttatcaagagagttgtggctaagggtggggacatcgttgaagtaagcttttatcccaatggtacgtgatggtaacttgattgttaatggagtagttcaggaggaagaatttgtgttggaaccagccgactacgaaatggatccgctgactgtgcctgaaggctatgtctttgtactgggggataacagaaacaacagctttgattcacataactggggtccacttccagttaagaacatcctcgggagatctgtgctccgatactggccaccatctaggataacagatacaatatatcagcatgacatggtgcagcacacagctgttgcatcctgataatacattgtggcaataccacgtggtgcacgccaatttctcctttccctgcatagctttattgacaattgatatgcttagccgtggggttctttatttatttgttgtagccttgcctcaaatgtcgattgggcagcttggctgacagattagtttttttttccctccctacgggcagatgcttgtttaaagacagcaattcttgtactccgtagctaagaatgaatgccatataaatgttgcagtagataagcatcaaggagtgtaggatgaggatggcagttcttttgttttatgagatgagatggtgctctaaacttacgtaaaggaaatacgaagcatagaagagtgcccaagttgtgttatttatttttttcattccttgatcttggatcaaagattcaaggcaaagtcagcctggtgcaaaggttttggttgaatccttgtatcctgccagataaggttttttgatggtgcaattttggattagcatttgccctagtatttagtgttttttagttctgtattcatttatgattaatacaactttgcgagcatagttctgtttggcctgctttgttcaatcgcagtgcgggttcaatactacgttgcctgatgttattgtctgttattttctttgtaaaaaaaaaaaaa

SEQ ID NO: 1983 - DNA, 1199 bp, Zea mays
ccgtcatgggactgcactggcacagaactgccgcgccgcttcctgacactggtcaatggctgcttctatcattgaacgagaagctccctcagagcgtggtcgatctactgagagctcatgttatcactctccaccattatctgatgttgtttatcatgctgggtttctcagttctgttcgactgcatcaaagctcctggtcttggtattgccacaagatacatgttcactatggcaattggtcgtgtacttcggacgataactttcatcgctaccattcttccatccgcaaggccttggtgcgctgtagcccgttatcaaatacctcgacatcctcatccttgggcacagaaatattatgttccatatgcttctgactcgaatgctattcgcagagtcataacacaggatatggcatatgctgctgttcaagcttacccagatgaatataagcccgattgggggcgtatgagcttccttgtagacattttgagaccaactcctggagaagggccttcgtggtaccatcttctgaagaaagctagtggcggctgcaatgaccttatgtacagtggacatatgcttgttgctgtcctgactgcaatggcgtggacggaagcatacgggggctggatctctgtcgcgatatggctcctcgtcctgcacagcgcgcagagggaggtacgcgagcggcaccactacagcgtggactgcgtcgccgcgatctacgtcggcgtcctcctgtggaggatgacggggttcatctggtccgccagagacctggcccgagctagacggctagccaagctcgaggaggtccagagcaggctggtccacgccgccaaggacagcgacatcgatgagatcagaggcctgctgaaggaggtggagctagccggccaggagaggcagggcttctcgcagagggcgatcctggccttcgccgcaggaacgatcatcttcaccttgtcttgtgtcctcatcgccttcacagctactagcgacggctgatttgggttctgttgcatgcccctgggtctgaatgttagccactgtctcctgggctgcactgttttcttgtagtatgttgactgttgagtgtcgttggttgtggggaaaccatgtttaggactagtttgagaatctcatttttacgaagggattttcatttttctttagaaaactagttcattttttctt

SEQ ID NO: 1984 - DNA, 2806 bp, Zea mays
  misc_feature (418)..(418): n is a, c, g, or t
ttttggttagctggagtggctagccaagtttagttagcgagagagctaactttgagccggatcgtttagcgagttgatgattattttgatattaaacagctaaaatttagcttaatggatcatttgactagtgtgttggagatgcttttaattcttaaaaatagctgttttttaatcagaaaaattggacaacagttgagacggataattcagggcacgtacagtgcacagacggctaccatctacaagtttttttgaaaagtacatgcagacggatgaatagacagctcgtacaatcacctgtctatttacatcatgtatatattatttataattcatttaaggcccttaatggtttctatatgagatgagaagttctggtgaaagatgctcctgttcgtacaacggtagatgaggncgtcgcttggcatgtgagcacgagacgacggcaagctcctcttccttctttttattatagtccacgtaagcaaatttctgtgacatggcatcatacagacgactcatttaagagcgctgtacatgcccttagtcttttttttccctcgtagagtatttacgcagaagcatctcctggagacctggactgatggaaaaaaaggccccatggcccatccaggcctgcctcaggcccaggcaatttttttttattgcccagtctagtgcctacctgccttctctagttctctcccctacacgccgcgtgcgcgcgccgtgctctctctcgctcgtggggacagctgcgcgaccgccgccgccctacgccaggcgcccaggtcttcggcagtaccttcgccggcgacgaactagcacccacaggtttgttctccccttctcccccttacttctgtgagaaaccgagcttcgtaaccctaacttgacccatttgtctactatctgtatgtgtactcggatctgtttctgatctactaatttacaagtgttatgcctaccaacttcgggaatttgcgtctgggtcactatttgctgaataaaaccctgtgatgaatgtatgtcctgtattagcttttgacatctcccacttacatccagaaataatagtggccgctttgaggtgatgctagtgcttgtgtccgggaggaatcactgtttttattatttcttggattatcgatcatgtgccagtaaagttgcgtcattagtaacggagaatggtgccagtagatgttaggctgatgaattgctctgctatgcaagttttctctctttcttggccagtttgtgttatgcgggagtatttttatttttattattggtttctgggctacgtgaataggatttgctatgctcattaaatgtttatgccagttaactatccttttcgatatgttattcctcttcctccattcccgttacagcagggagcatgaagcctgtgtttgaatgcttattataccgttatggtcataaaacggttagcagctaggatctgcatcgctttcttataacaaattcctccttacatctcgagcaagctgtaaatctacttagttttttttttctttttgcgaggacaaatttactgacttaataggcaagactgttatttagttgtgcacagcccaatactgcctgcaaaaactgaggcaaattctggtagtatgatttacgagaggcaggcaaccaagtttactcaaatagttgatgaggtgattacaaagtgctgaacattacttttcgcagcatagcatataaaatattttccccatttgctcatatttcttaaattgtaacgctattttttttaaaaaaaaaaacttccttatccttggttactgcttgtttgattatattgcttgcttggtgatgtttatgatagttctctatttagtgctacggaaatgtcgatgtgtttggctttaattgttttatcttgaactcttagcttgcagtcttgcacctgtgcttaaaagctgcaattttcttcatgggcttttgccgttagtgattttgttctccggttatctgcatcactaggaaaatggcaagcagagcaggtggcgacggcaaggaagccataaacgagcaggtaatcgccaacacctacgccaacatgcgcaccgaaatgaaccagctctacacaaagatcacggagctggagatggaggtcagcgagcactccctcgtgatgggcgcgatcgagccgctggacccctcgaggcgatgctacaggatgatcggcggcgtcctagtggagaggaccatcagggaggtcatgcctgccgtgaagcgcaacaaggagggcctggaagaggtgattgcccgcatgcacgaggcgctggagaggaagaagaaggagataaccgagtttgagctcaagtacaagatcaggatccggaaggctgatagcgacgctgaggatgaaggcggcaagaaggaaggcactgcgcagggagtccttgttggtcctgccggacagtaatctaagttgattagagagacctgcgtgctacaagctatttatgcttggaccacagtaaggtggttgttgctcctctctgccaatgtgtgtgtttagggggtgacgacatgcttctgtagaaccagcgattttgtgtttaaactggaatggttttgacaaggtgcgatgtgtttctgcatttgttcttcaggttcaggtgtttcggttaaccaaatgtatttcttgcttgctgataatgatggcacatctctagtttcgcagggctgcagtctgtgtctggaggccccctttttttatcttttcagataattccctcggaagtcgtctttatgattatttggactt

SEQ ID NO: 1985 - DNA, 958 bp, Zea mays
cattgggtccctcgaggccgcccggcgctctagttcgctcccctacacgccgcgtgcgcgcgccgtgctctctctcgctcgtggggacagctgcgcgaccgccgccgccctacgccaggcgcccaggtcttcgccagtaccttcgccggcgacgaactagcacccacaggaaaatggcaagcagagcaggtggcgacggcaaggaagccataaacgagcaggtaatcgccaacacctacgccaacatgcgcaccgaaatgaaccagctctacacgaagatcacggagctggagatggaggtcagcgagcactccctcgtgatgggcgcgatcgagccgctggacccctcgaggcgatgctacaggatgatcggcggcgtcctggtggagaggaccatcagggaggtcatgcctgccgtgaagcgcaacaaggagggcctggaagaggtgattgctcgcatgcacgaggcgctggagaggaagaagaaggagataaccgagtttgagctcaagtacaagatcaggatccggaaggctgatagcgacgctgaggatgaaggcggcaagaaggaaggcactgcgcagggagtccttgttggtcctgccggacagtaatctaagttgattagagagacctgcgtgctacaagctatttatgcttggaccacagtaaggtggttgttgctcctctctgccaatgtgtgtgttttgggggtgtgacatgcttctgtagaaccagcgattttgtgtttaaactggaatggttttgacaaggtgcgatgtgtttctgcatttgttcctcaggttcaggcggttcggttaaccaaatgtatttcttgcgtgctgataatgatggaacatctctagtttcgcagggctgcagtctgtgtctggaggccctttttattaatatgcagtgcttggaggttggtgaaaaaaaaaaaaaaaaaaggccccta

SEQ ID NO: 1986 - DNA, 1432 bp, Zea mays
cattgggtaccccggccgggccagcgcagcgcaacgcaaacccagacggcccgccagacccagcggtcgcttactcgcatcgcagcgcactcgcgccacagtcggcatcacagaccagatccctgcgggtgcggcggccatggccgagaacttccaactccagggccggcacggcaagtcccgcgtccgcgtctcccgcgtctggcgccgcccggccgcggcggggggcgacgtcatcgttgagtggaacgtcgccgtcagtatcgtctccgactgcctcccctcctacacctccagcgacaactccgccatcgtcgccacagattccatcaagaacaccgtgtatgtcaaggcgaaagagtgcacggaagtggtgtccatggaggaattcgccgtgattcttggaaggcatttcacctcgctgtaccctcaggtttcagaggccacggtgactatcgtggagcgcccatgggagcgtgtgactgtcgacggaaagcctcattcgcatgggttcaaagttggtgttgagaagcacagcacagaggtcattgtaaaaaaatctggaagcctgcttataaattctggaattcaaggatactcgctgctaaagacaactcagtctgggtttgaagggtttgtgacggatcgctataggcttcttcctgatacaagggaaaggatagtagcaacagaagtaactgcttggtggaggtatccctttgaacatgtttcgcagctcccatcgaagccattctgcttcacgcagagataccaggacgtaaagaaagtccttgcagagacgttctttggtcctccggatgttggtgtgtatagtccatccgtacaaaatacgctatacctcatggccaaggaagtccttacaaggttcccagatatatcgtcagtccagcttagaatgccgaaccttcactttctgcctgtcaacttggggagcaaagaagctccgctggtgaagtttgctgatgatgtgtacctgccgacggatgaaccacacgggacgattgaagcaaccttaataagccgtcccatgtcaaagctgtaaaaaaaatgtagtcgtcaggctggtattagactcctgcttcgtctccccagcatccccaggcttaaaatggacagtaagctgtaagggaaagataaactgtcataaatcgtagcccctatgctttatgtgtggtggtggtaataagtgcacagacttgtattggatgttgtcagctgtagcctgtaggcgtccagcttgtgacgtttcgccactgtaatcgtgtacattgctcgtcttgtgtggaaaccagttaatatctttggaagctttggtcagttttacataaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1987 - DNA, 1383 bp, Zea mays
gcacgagaccattacctagaacatcctaatcgaaaaactcgcatcgcagcgcactcgcgccacagtcggcatcacagaccagatccctgcgggtgcggcggccatggccgagaacttccagctgcagggccggcacggcaagtcccgcgtccgcgtctcccgcgtctggcgccgcccggccgcggcggggggcgacgtcatcgttgagtggaacgtcgccgtcagtatcgtctccgactgcctcccctcctacacctccagcgacaactccgccatcgtcgccacagattccatcaagaacaccgtgtatgtcaaggcgaaagagtgcacggaagtggttgtccatggaggaattcgccgtgattcttggaaggcatttcacctcgctgtaccctcaggttacagaggccacggtgactatcgtggagcgcccatgggagcgtgtgactgtcgacggaaagcctcattcgcatgggttcaaagttggtgttgagaagcacagcacagaggtcattgtaaaaaaatctggaagcctgcttataaattctggaattcaaggatactcgctgctaaagacaactcagtctgggtttgaagggttcgtgacggatcgctataggcttcttcctgatacaagggaaaggatagtagcaacagaagtaactgcttggtggaggtatccctttgaacatgtttcgcagctcccatcgaagccattctgcttcacgcagagataccaggacgtaaagaaagtccttgcagagacgttctttggtcctccggatgttggtgtgtatagtccatccgtacaaaatacgctatacctcatggccaaggaagtccttacaaggttcccagatatatcgtcagtccagcttagaatgccgaaccttcactttctgcctgtcaacttggggaccaaagaagctccgctggtgaagtttgctgatgatgtgtacctgccgacggacgaaccacacgggaccattgaagcaaccttgagccgtcccatgtcaaagctgtaaaaaaatttgtagtcgtcaggctgatattagactcctgcttcgtctccccagcattcccaggctaaaatggacagtaagctgtaagggaaagataaactatcataaatcgtagcccctatgctttacgtggtggtggtaataagtgcacaaacttgtattggatgttgtcagctgtagcctgtaggcgtccagcttgtgacgtttcgccactgtaatcgtgtacattgctcgtcttgtgtggaaaccagttaatatctttggaagctttgctcaaaaaaaaaaaacccgcggggggcttttagctcgttattaggccaccagcttcagtagatctgattgtttctccatatatttgaac

SEQ ID NO: 1988 - DNA, 918 bp, Zea mays
gcttgcgacctgatttgggaaagaaagcaaaagaaacgaaactagagggtagaacacgacggtgtccggcgtccgtaaaaaaggaggagaggaggccagggaggcgggggcagcaagaatggcgtgctccaccggtctctgcttcttggcgtcgattcctcctctctcagcctcttgttcttctggctcctcctgcttcctcatgatcaagcgtgtgtcctctgctccgtccttgtccagatggacgatccaatacaagcaattgggacatacaatatatcggagaagccacgttctggcctttgctagtgcagatgcaccacaaggcaaaagaagctcaggtgagaatgttgtgatggttgatccactggaagctaagcgcctagctgctaaacaaatgcaagaaattagggccaaagaaaagctgaagaggcgccgtcaagcagaagcgatcaacggggcattggcagtgataggactcacggctggattgctagtggaggctcagacaggaaaggacatcttagggcagctagctggatatctgacggctatttctagtttatttgggcaataacactggaccatggttggagatttatttttcacgttccacggccaggagaggtcttatctgaatcttatttgatggatccacccaatttttttgggagctgatcccagatggatgtggaatagcgcacccagacttgtatgttgatcaagcacgatagcatgggctgaacattagtatttctatgtagcacatcaatttctgacgatagcgcctgctaaagagcagttctattcatactcaaatgtgaaatgttgaagtcttcgagaaaaaatatcaaaaaaaacccctaaccattaagatgatggcacattggcacctgcagtggattgatgagtctcgct

SEQ ID NO: 1989 - DNA, 1498 bp, Zea mays
tattttttttttttttttgatcaacaagacaaaaacagcattgcaaacctgcaactgcaaggttgtccaaactccaaacattcttttacacttccctctctgacgaatccccgtatactgattcccaaaaataatttactagcactagacgtcgatgatgctacagtggctatcaagacgaaatgcacgacagagaagaagtagcgtccgggtagaatagaccatccatcatacaggcggcgggggcaggtccagcaggagccagaagccgacgcagccgtcggagttgaggttctcctggatggccaggaagtggagcccgccgcaggccttcttcgccgcctcccaggcctccgcctcctgcgtcgacgcggcggttttctggtacccagagtagacgtaccgcgtcgacacccccgccgacaggatcaggctcgccctgccggtgtccgcctccatcgcgcagatctccagaccgttcatccacgcggccagaggcttggcgcgagatgattccacggcgacaccagggactagcgtggtgtcatcaagctcgaaccccagcagttccaaatccagccccgcaccgaatgcgtaccgcctctccagtgactccacctcctctctaacagcggagaacgggagctgcacgaacgcccacttgtcgccgaagaggttctcggggagcgtggtggggaacgggttgtcgagcgcgagcagcggccgggtgccggcctggaaccccgggtggcggctgtacaccacctcgtaccgctcctccagccacagcagcagcgacacgcaccgccggctcggcacagccttcacgcccagatcgccgcaggcgcgggtgatgatggtctgcatctgggaccggaagaagcggacgcggtcgggcatgggcacgcccagcgcctcggacacggaggccagagcgtcgcggagcgtcacgctgttgatggcgttgttggggaagtagcgcgtgaactggagcgacagcgtggcgtcgcacaccacgagctcccacaccttcttgccccgcgcgtccaggatgggccgcgagcagaagtccagctcccactcccggatcgactcagggtccacgtcagggtccaggtagcacacctccgcctgcgggtccaccttgttctcggcctccacttcttcgtcggcgatgtcagccgcagcggatgcctcggtggagctctcggaggagatggaccggcaccggcgcggcgaccgcggcgacgggctagccgggacaatcatgcggcgggctggagtgacggggcgcgcggagagggagaccgacgtggtggctcgccctggcgggttggggagggggaggctccgacgcagcgcgaggccatgcccggcgacgatggcggtggcggtcgtcatgccgcgcgcgggcacccacggccacacgcagaagctaaccccggccggccccgtggcacccaccagttcacagctctacccacctccactcgaccac

SEQ ID NO: 1990 - DNA, 3128 bp, Zea mays
  misc_feature (1537)..(1537): n is a, c, g, or t
  misc_feature (3086)..(3088): n is a, c, g, or t
  misc_feature (3091)..(3091): n is a, c, g, or t
  misc_feature (3116)..(3116): n is a, c, g, or t
ggctgtcccctctcgaaaaatctagtgccgacatccactgggccgccatgtcgctgggccgaatgggttggcctgcgacagaggaaggcggccgcctaggtatcgttggcccatcagcggaatcgatcaacaagacaaaaacaaagcattgcaaacctgcaactgcaaggttgtccaaactccaaacattcttttacacttccctctctgacgaatccctgtatactgattcccaaaaataatttactagcactagacgtcgatgatgctacagtggctatcaagacgaaatgcacgacagagaagaagtagcgtcccggtagaatagaccatccatcatacaggcggcgggggcaggtccagcaggagccagaagccgacgcagccgtcggagttgaggttctcctggatggccaggaagtggagcccgccgcaggccttcttcgccgcctcccaggcctccgcctcctgcgtcgacgcggcggttttctggtacccagagtagacgtaccgcgtcgacacccccgccgacaggatcaggctcgccctgcccgtgtccgcctccatcgcgcagatctccagaccgttcatccacgctgaaatggaggtgacaggaaacacaaagatggtaccgtttctgatggcgagtcatgactcaatgatcatggaagaagggacacagcaaactagctaacgcaggtgtgattgttcgatattgtctcctttacagtatgcagttcaaacgcggtaacttgttcaacatcaaatgcatattcagttgtcatttcttctataccaaccagaatcaactagatggttcttatgtggctgccatttctcctacattctcaattctctttgttcttgtgtttgaattctggaacgataaacatgtgagatcatctcatataacatgccaaaacttgcctaggtgcacaacgatcaaaaaactttttcagttgttggagaaagacgatagccagttgcaataagatcattgatcatagagatcaaactgaccaacttacatgcaagtactctatctaataggaaattaatgtttttaccagcaacaaaaaaatgcgtccccccctccagtaatccgaacatatggatagatgcatttgcaaagaagcattagccatgaagaaaatcgttgccagttcgttataaacattttgaatgccttggtggcttcctcctgcttgttaatttcagtacaccgagacacaaacttaccggccagaggcttggcgcgagatgattccacggcgacaccagggactagcgtggtgtcatcaagctcgaaccccagcagttccaaatccagccccgcaccgaatgcgtacctcctctccagtgactccacctcctctctcacagctgcacagcacgaacaatcaggagaagctcgctccgctcaaggcctcgtcaatggcttaacaaccaaggctaatcgccgtggcagatcgagctactgaccggagaacgggagctgcacgaacgcccacttgtcgccgaagaggttctcggggangcgtggtggggaacgggttgtcgagcgcgagcagcggcctggtgccggcctggaaccccgggtggcggctgtacaccacctcgtaccgctcctccagccacagcagcagcgacacgcaccgccggctcggcacggccttcacgcccagatcgccgcaggcgcgggtgatgatggtctgcatctgggaccggaagaagcggactcggtcgggcatgggcacgcccagcgcctcggacacggaggccagagcgtcgcggagcgtcacgctgttgatggcgttgttggggaagtagcgcgtgaactggagcgacagcgtggcgtcgcacaccacgagctcccacaccttcttgccccgcgcgtccaggatgggccgcgagcagaagtccagctcccactcccggatcgactcagggtccacgtcagggtccaggtagcacacctccgcctgcgggtccaccttgttctcggcctccacttcttcgtcggcgatgtcagccgcagcggatgcctcggtggagctctcggaggagatggaccggcaccggcgcggcgaccgcggcgacgggctagccgggacaatcatgcggcgggctggagtgacggggcgcgcggagagggagaccgacgtggtggctcgccctggcgggttggggagggggaggctccgacgcagcgcgaggccatgcccggcgacgatggcggtggcggtcgtcatgccgcgcgcgggcacccacggccacacgcagaagctaacgctagagagatggcggtagcataaaccagttcacagctctacccacctccactcgaccacacgccccaggctggccggtgataccgggatctcattcccccccggggcccgtgggccgacccaataccatgaagaagcccatctaacggtgaggaaacaagataaagtcgacatggttgattttataaagaaagaaaaaagaaaaacgaaaaactagagggtggaggacaacggtgtccagcaaaagagagagaagaggaggggaggaggtgcgaagtagcaagaatggcgtgctccaccaatctctgcttctcggcgtcgattcctcctcttccagcctcttcttcttcttcttctgtctcctcccccttcctcacgatggagcgtgtgtcctatgttccgtccttgtccaggtggacaatccgatacaagcaattggggcatgcatatcagagaagccacgttctggcctttgctagtgcagatgcatcacagggtaaaagaagctcaggtgagaatgttgtgatggttgatccactggaagctaagcgtctagctgctaaacaaatgcaagaaattagggccaaagaaaagctgaagaggcgcagtcaagcagaagctatcaatggggcattggcaatgatagggctgactgctggattgatagtggaagctcagacaggaaaaggcatcttaggggcagctagctgggtatctgacggctatttctagtttatttgggcaataatagtgggcccccttttggagatttatttttccccgttccttggcagnnnagntcttatcctgtgcatcccccaattntggggggggagt

SEQ ID NO: 1991 - DNA, 1880 bp, Zea mays
ggaagtcgaggggaaatgcaaccatctacagcaaaacttggacaaattgcaggagaaacttacaaacttggaaaatgaaaatcatgtcttaagacagaaggcatttaatatgccgacaatgaacaatctgtctgtagctccaaagacattatctgagaaattttctgcatcaattgggcttcccaacagtgagccaaagcatatatatgaaagcccaacacctacaaaatatctggcttctcttccacagactttgagtacatcaaggagatcgaggttgcctgttgaaaggcatgagcaaaatcatgaaattttattgagatgcatcaaagaaaatttaggatataaggatggcaaaccagttgcagcatgtatcatttacaaatgtcttttgcactggcgtgcttttgaatcagagcgaactgctatttttgatcacgtgattgaggccataaatgatgtcctaaaggggaacgaagctgatggtagattaccttattggttgtccaatacctctgcattgctatgccttctccaaagaaatctgcggtcaaatggattattcactaccccgtctcgtcgttctggtggagctctagggaagatagcacaaacattgaggtctccttcaaagtttataggccgcagtgatactctaccacatgttgatgcacggtatccagccatactattcaaacagcagcttactgcatgtgtcgaaaagatatttgggcagctcagagataatctaaaaaaggaaatatcacctcttcttaatgtttgcattcaggctccaaagtcaacacgtgggcaatctggaaaagcatccaagtcatctggagttggtgcccacccagcatcgaactccaactgggacaatatcgtcaatttccttgacttacttatggatacattgcgcgaaaattatgtgccatccttctttatacgtaaacttatcacacaattattctccttcatcaatatacagttgtttaacagtcttcttctccgacgtgaatgttgtacattctccaatggggaatacgtgaaagctgggctatcgttgttggagaaatggattactgatgtcacagatgagtttgcgggtacatcttggcacgagctcaattatatcagacaagctgttggatttttggttatacaccaaaaaagaaaaaagacgcttgaggagatcaagcaagatctttgcccgtccttgagtgttcgccaaatctatagaatatgctcgatgtattgggatgacaaatacggtacccaaggcatttcaaccgaggtggttgctgcaatgcgggagatggtcaacaaagatacccagaatcttgtgtcaaattccttcttgttggatgatgacttaagtataccattctctaccgaggatctatcaatggcaatcccgtcaatagattatgctgacgtcgatcttccagaatctcttcagcactatacatcagtacagtttctactaaggcagcaggatccacagcctgcccaatagaatgaatgtggtcagcctgccctgaagatctgtctgtcccctggttgtttctaccaaggcagcaggatccacagcctgcggcctgcccaatagaatggatgtggtcagcctgccctgaagatctgtctgtcccctggttttattggggtaacatccatctgcgatgttgtattgatgtttagagagtacctagtttggtggagtggacacaatttaaaagcaaccattgttgctagatgccaattcattggtgttcactccccaagtatttttcattgtacaggaaatgttgtaagtctgttgactagcgcaaaattagttatatcagtggtaaattgggcaaaaaaaaaaaaaaaaagcggcc

SEQ ID NO: 1992 - DNA, 2046 bp, Zea mays
  misc_feature (1959)..(1959): n is a, c, g, or t
  misc_feature (2028)..(2028): n is a, c, g, or t
ggttgtacgcccacagtaaatacttgtgtttgagctcgacaagaggacggaacggaagacgccatccattggattggatcacgtacgacgtacgtaacgtacgcaacgcaacgcaacgcaagcgtcccacccaccccttccaagtctggcaatgtcctgttgcacgccacgtgctcaacagctcaaagagtgtccgtcgccaacgtttataattcatcggagggatgacacgcatatattgcagcatttgccatttcagctagctagatctaacagacttcaagtttttgtatgcgtgtaatgttggtttcatggtctggtactttggccaagatgatccgccgcgcgctggggtaggccgcccgctggttggtgggcaatgccgccgcaataacttaccaatgaaacctagcaacgcccactcggtcgccacgtcccacgaatggcccgcacggcagcgtgagccagccgccggaacccgccacgggagacgaggcagcgcggcatggcgaacgcgaggagcaagcaagccgaagcagccaagcgaccccgcatgcagccactcgccctcctcgtcccattggaatccacccaacccgcccttcctctccaaagcacgcgcccggcgccgcgcgactcggctagtcctcctacgtgtcggcagcgtccccgcaggtcgcccacgtaccccgccgcgctctcccacgtgcccttccttctgcgcgcgtccgattggccgacccgcccttcttaagccgcgcctcctgccccgcgtccgggcccccaacgccgtcgtcgtcgtgtctccgctccagagtgatcgagcacactgacctggctctggcctgccccccgagcctcagctcgtgagccagagcgcctcgccatggccatggtgcagccggcggacgcgaccgtcaaggccaacgagatcctggcgcggttccggcccatcgcgcccaagcccacactggcggccgagggcgtggtggccgcgaaccgcgtgctgtgccatctgcagggcaggccgtgccgcgcgcggaaacgcggccgccccggccccgccgtcgtggcgccgtcgcccgagtcgggcgcgcagccgcccgccaagcggaagagagccgcgacgccgtacccgcctctccggtgcgcggggccgcgtgcgtccgcggccgtcccgggcagtgcaggcctccctctggcgtcggcgtcgctcccgccggcgggtgcgggtgctgccgaggacctcgcgaaggtggcggcggaggggagggacgtccccgtggagcgcgacctgctgcggaagctgctggagcccaaggtcatctcgccgcgggcggtgcgccccgtgtgctccgccatccacgtcgggtgcatccaccgcgccgacgcgacctgcaccgccgccgtctcgaagacagcggttcgtgtggaggcggagctggaggtcgacgcgctcccggcggttgtctccgacgccagcaaccgcgtccggctcgtgaacgacgcgtacaaggagatggtggggcagcccgagtgcccgtggctcgacgccgtggctgccacgtcgaggaggatcagcggggaggtcgcgctggtggtagccaaccagtcctccctgccagagtcgtacggggtgttcacatgcacggcaaagatcgagtgggaggacgacgggaaggtcgcctccatcgatgtaccctgcgacgtcagccggctgcagtgcgagtccagagagtacctcttcgtctggaggttccgtaccgccgacgccgacgccgacgcatccgttggctgcagctccgaggagattagtgagagttaggggaagcttgcttgagctgcatcctgtgcgcgctgcagtgaaaccaggtgcataggctaagcaagctgcatctcaaaaactggccagcttcctctttcgcctagtccatagagtgtagacccagttctgaaatntggagtaaatataagatctcgactggagaatgcaaatggaaaattggaaatataacatgtactttttcncgaaaaaaaaaaaaaaaa

SEQ ID NO: 1993 - DNA, 967 bp, Zea mays
gccacattatgtgttgctcctctgttcattcaaagaacaactccagcagcatgtgcgtgttcatgcaatggaagcagtcatggcttgttgggagctcgaacaaactttacaaagccttacaggtgcatctcctggtgagggcactggggcaactatgtctgacgatgaagacaatcaggtggacagtgagagcaacatgtttgatggaaatgaggggtcagatggaatgggatttggcccattaatgttgactgagggtgagagatccttagttgagcgtgtccggcaggagctaaagcatgagcttaagcaggggtacagagacaaacttgtggatattcgggaagagatattgcggaagcgaagagctgggaaactccctggcgacactgcttctaccttaaaagcctggtggcaagctcattctaagtggccgtacccaaccgaggaagacaaggctcgactggtgcaggaaacagggctacaactgaagcagatcaataactggtttatcaaccagcgtaagcggaactggcacaacaattcggcgtcatcctcgtcggacaaaagcaagagaaaaaggtgatgggaacgcagaaccagcctggtagggcatggtcggggaacgaagtttatgtaaataatgcttctactgtgaagagttccatcatatttgttgctccagaaaagaccctcagaccggtgtttcctgaacccatattcatacaaagacatcagacgatgaataatgttgcgagtagtcaaataaaataaataacttgtatagtgaataactagaaactagcattcatcgttttggtattgtatagcgctagagtgtaattgtttggtcggactgtcttgtataatggtgtaaggttcaaatgcattttgacctagcattcgatattgtattttgtgatgttaaaaaccatgtatccaaagggcggccctcgcgatctagaac

SEQ ID NO: 1994 - DNA, 2910 bp, Zea mays
tatatatatatatatatatatatatatatatatatatatatatatatatgcataagatgtatgtctgtgcgcacggaggaggttaatcatctatgcttgcacatgtattatagaaatacaatcgaataggtttcaatatatttacatgactaaagatcaaagaaacatcataccaatttaaaatataataatttttttttaaaggaagttaaatacacacatgttttgatgaaagctccagctgagtaaaagaagtttcgtaataagtccaagcaaactgggtaaaaggagtttcgtattaagtccaagtgtatgagaaagctatagtatttaggtgtaaacaaattacaaaatgttatgttcatagcaacatttatgaaaatagaaacagtatgaaaaagtataaatttaagtatattatcatgacttcttaagtcttacctggtccggtatgagacctggttcggtatgagatgcagatatgtaagaggaattttgcgataatttgaagcttgtgcgtaacctgtagtgttgactagagataaagtaataagtcgagaaagactaatactagggctaaactactgctactcctaagtcaagaaagtaaaggatttcataaatagattgattggatcaattttaggtgcatttaaacggcagtaccctttatatttataggggaggtttggacccgttcataaacgctttccaacatgttcctacgaggttagtggataagtacacgcgggagagggactctcgtccgagatctaatctaaccgcggaccgtgcgaactaaaaccgcagaccgtccacatggttaaactgttcggccgtccctaggtaccataaatgatgctcaacagaatgttagtgaaatactccattcattcataaatatatgacatcgttgatatttttcaaaactttgatcactcatcttattcaaatatttatttaaaaatataaaattttaaataacgcttaaataaccttaagtgaacttacgatttttaatgagatgatggttaaagttttgaaaaataagttaacgatgacatatatttataaactaatatataaacggaaaaggtagtacgatatatataaaatcatgatctctattcttgaatatttgtcgttcgctagtttatttttaaactataccgtgataactatcatttactcatgtgttagtgacgaatttctgatacagtagtttccgacaacatttgtgttctcatctcatccaaatccaagcatgtttgctgtgcaattcactcttcggaattgagtcacgtgcacgagaaattaaagggagggcgctatccgtcctctacccccaaagcgcggtcccctcccttccccggtccccgctagcctctacactgcctctcgccgtcgcgtctaaaaagcctccgccacttgactcccatcccctctcgcgtggtccttctcctgctcccgctcccgctgctcctcatcttctcgcgccgcggcccccagcctttgcccgccgctacctctctctaattgggcggcggcctgccggtccgatggcgttcaactaccacgaccacgcgctggcgatggaccccgcggcggccgccgcggttggggcggccgcgaaccctagctttgtctccggaggtggcatggccggggggcccggctgggagagggagaaggcggccatcgcggcgcacccgctgtacgagcgtctactcgaggcgcacgtcgcctgcctccgcgtcgccacccccgtcgaccagctcccgcgcatcgacgcgcagatagcggcgaggcccccgccccatggaggccgcggctgcggctgctgcggcgggcggagcacactcgggaggcgaggagctcgacctcttcatggtaagtacccatactttctcgtctctcttcctattatggtcttgctatgatgaagctaataaggttgcccagtggttctctcttctccatgcggattttctgattgagttttgggtgttcaattggatatttgtatggctggatggttcatccggcatgctaagtattctgtagtacgcatgtggaagattttgggggtgatgttggctagttaattcaaaatggatttccgaataaaccgagttaattatgcatgcatagcaaaggagccgcaaatttaagtgcagaatcgactcatgaacttttgatgctatcccttattacatgcttttcgttcttaattgcgttgcttctctgtttgccaaggttatcgatagtgaagccgtttttgcaactttctttttacgtttagctgtacctctcttttctttttgaaatgataattaatcattttgtggcaagagcaggttgttatcattctctgttttttccctctttcgaatggttctaaattctaacctgtctcgtttttcgtccagacacattatgtgttgctcctctgttcattcaaggaacaactccagcagcatgtgcgtgttcatgcaatggaagcagtcatggcttgttgggagctcgaacaaactttacaaagccttacaggtagctgaagctttctactttaatatttttagaggaaaatgctttagctgcccctttttggagtctgcttgatgtacaagtacaactccctacttaatatttgctatgtttcatgttttgttcgtatggtggtcacagcaggtttcagtgcaacctaggcagaccatcttattgaaatttctcgccacaaataacgtattgaccattccccaaatgtttccttcctttggaaattgaccaaatagccattctcttgttggtcttatcaggtatatggaaactacaaactaactaacattaactaacattgttagtactttttttcttgcattagaatcaaaaccttacacttcacgctat

SEQ ID NO: 1995 - DNA, 1531 bp, Zea mays
ctgcgtccgccacttgactcccatcccctctcgcgtggtccttctcctgctcccgctcccgctgctcctcatcttctcgcgccgcggcccccagcctttccccgccgctacctctctctaattgggcggcggcctgccggtccgatggcgttcaactaccacgaccacgcgctggcgatggaccccgcggcggccgccgcggttggggcggccgcgaaccctagctttgtctccggaggtggcatggccggggggcccggctgggagagggagaaggcggccatcgcggcgcacccgctgtacgagcgtcttctcgaggcgcacgtcgcctgcctccgcgtcgccacccccgtcgaccagctcccgcgcatcgacgcgcagatagcggcgaggcccccgcccatggaggccgcggctgcggctgctgcggcgggcggagcacactcgggaggcgaggagctcgacctcttcatgacacattatgtgttgctcctctgttcattcaaggaacaactccagcagcatgtgcgtgttcatgcaatggaagcagtcatggcttgttgggagctcgaacaaactttacaaagccttacaggtgcatctcctggtgagggcactggggcaactatgtctgacgatgaagacaatcaggtggacagtgagagcaacatgtttgatggaaatgaggggtcagatggaatgggatttggcccattaatgttgactgagggtgagagatccttagttgagcgcgtccggcaggagctaaagcatgagcttaagcaggggtacagagacaaacttgtggatattcgggaagagatattgcggaagcgaagagctgggaaactccctggcgacactgcttctaccttaaaagcctggtggcaagctcattctaagtggccgtacccaaccgaggaagacaaggctcgactggtgcaggaaacagggctacaactgaagcagatcaataactggtttatcaaccagcgtaagcggaactggcacaacaattcggcgtcatcctcgtcggacaaaagcaagagaaaaaggaacactgcaggtgatgggaacgcagaaccagcctggtagggcatggtcggggaacgaagtttatgtaaataatgccttctactgtgaagagtgccatcatatttgttgctccagaaaagaccctcaggccggtgtttcctgaacccatccatattcatacaaagacatcacgcgatgaataatgttgcgagtagtcaaataaaataaataacttgtatagtgaataactagaaactagcattcgtcgttttggtattgtatagcgctagagtgtaattgtttggtcggactgtcttgtataatggtgtaaggttcaaatgcattttgacctagcattcgatattgtattttgtgatgttaaaaaccattggattcgttttgtgttttatccgtggaatagggacactgttagtgttgccctcaaaaaaaaaaaaaaaaaaaaaaagggcggcagcgcgcccctcgcgcctggaac

SEQ ID NO: 1996 - DNA, 1419 bp, Zea mays
aacttcttgccttctcgcgctcgcctccgtttcgtgtcggctcgctctaaacgtgagatcggggaggtggtggacttggggtcgttgtggtatcggcggcgagccgcgggggcctagggtttcctgccttcctggtttggatccgcgccctggcccatgggatccggaggcttcgcggccgcggtggccgcgtgcccctccgccgccgaggccttccttaagtactatggtattgtatcaggaggtacaagtgcggagtcaagacaagcattggttgagctttcactagctatagacggaattgaaggaatgagggatgtgatatttgctgatattccaaagctcattccatttattgatctggaggatatgagcctattcagttgcttctacgattttgttttcttcatctgccgtgaaaagggtcaaaagagtgtcactattcagagagctgtagcagcatggaggattgttctaagtggaaggttccgtttgcttgatcgatggtgtaacttcgttgagaagtaccaacgccataacatatccgaggatacttggcagcagctgctagctttcagcaggtgtgtaaatgaagatctggaaggttatgacccacgaggtgcttggcctgttctgattgatgattttgttgagcaaatgcacagaatttatcactccactgactgcagcagtgcgatggaatcacagtgtaacatttccagtacccttaaaggactggaccctcaacctggatcaaagaggaaatgcccacacctcaaatccaatgaagaggatgtagagctttcggatagctttacgcgctctgtccatcttacaccaataaagcgactcaaggaaagccatgacgccagatatggagcgggggaatccgccaaaactacccatttctctaatagttcctctggtggttaccacgaggatatgaatttacacaactcaagaggttgccttcagaactccccctgtaatgttgaggatgccctgtccaaagggtttgagggttgtatttcgatgaaatgcccattttgatgtaacaaatttcgtgtcagcccagaaactatacattcccttttagcggcaaaatcatcctgtgtgtgtatctagtcattttgtgcaaaaaaaatgcagtaattgaatgcattttttttaaaatgctttaaagtgtattgatcagcatcggacctgtttttagaggcatcggtatgaagggagggctgttggttgtgtttgcttgacagcaaatccctcccattcaataccccgcactttctgaaaattgcgacttccatattcccttcccttgagctttgttaagacagtattgtattacaagatctgaatcgctgcaagcgtgcagaataatgaatgccatctttctatgcaaaaaaaaaaaaaaaa

SEQ ID NO: 1997 - DNA, 2186 bp, Zea mays
ctgtagcagtctaaataaccgtcttttagatgttccaaacaggttctaaatagagctacaatactaacgagtcaaataggttctaggaatttggatcctaatccagtagtactacaaactactcaccctaagagacggcgtatttttataattctttcacagtccagtgtcctctgtcgacacgctggagggcaccttccgtgatgcgttagcacaggggcagaaacgtctttctcctgagccagaaatgctggagcactgccccccaatggtgagctgccagaggcccgtgtcctctcccccggccggcgcggccgcctcacctccacccgccccgtcccgttttgacggccctttctcccctctcctccgcgagcgccgccgcagtagaacccggtggtaacccactgccgcaagcatcccaccgcgccgagctacgcgacggacgcggcgcgcggcccacaacccaaccgcagcggcaacaaccgctctataaagcaatccccccacctaccggctccgcggcctcgctcgcttcgctttcccccaaatccaccgcgggctcgagctcggaggagaggagacgagacgacccaagactttctcacccccctttgcttcctgcgcaattcctgcggcagcgcctttctctctttcaatggacagcgactacgttgccagcctgctcatgggcatgggctcatccgcccctgcgctcgacttcgccgcgctggacgccgggttcctcgaaacgctctgcggcggcggcggcggcctcttcggggtgtccggggtcgccgcgggggccgggtgtggcggcgtgtccccggaggggtcgtcggtgtccgacccggcgtgggcgcgcgccaggggcgatgacaatgtcaggaagcgcaaggcgccgcccacggggtccgccggcggcaaggaagcctgcccgggcaaggctgcggaggccaagggtccggacgggaagaggtgcagagtgggcggcagcgacagcccggtgaagccgaaggtagaggaggtggcggcgagcgacgcctcggttgaactcaaagcgcagaagaagggcaaggggaagaccgccaagccggcagtcgaaccgcccaaggactacgtccatgtccgggcgcggcgagggcaggcgactgacagccacagcctcgcagagagggttagaagagagaagatcagccagaggatgaagtttctgcaggacctagtgccaggatgcaacaaggtggttggcaaggcactcatgctcgatgagatcataaactacgtccagtcgctgcagcagcaagtcgagttcctgtccatgaagctcgccactgtgaacccacagcttgacttcagcaacctgtcgacactcctacacaaagacatgtaccaaccatgtggcccttcggcaaattcggtctttccactggaaagtgacggtgcagctttcccattctgtgaccaagcggatcttttccacagctttggttcgggttcggctgctatggaggatcagtgctctctaagcctgctagacacggctctgccccacgcggccaacccacagtttgcttttcaaaagcagcagagggacttctgggaggatggcctacagaacgccttgcctaccggtagtgagcaaagacaggaggaggatgggcttttagtacccaactttgatggccagttacatgctgaccagacaaaggttgagttctagtccctggtgatcctcccaaggttgatatttttgtatataggtgggtaccaagacctgtggcaagcaaagcgctctctctctctgtgtgtccgaagctgaccatcattagagtctaggcctgcgaactgatttcgttccgtgataatgctgcatgtatggcatctcggttcttcccacagagatcatgtgatgtgatcgacctcgagaaattaaaagtagattgtgtactagatatggcgcaaatattacatgcgccatcttctaaagttgtactgattggtatgtaagggcgctgggtggtgttggaacggataccgtgtactgtttgttgcttttttttctctagtattaatgattatgatgacgaaagtccaagtaaaaaaaaaaaaaaaaaaaaaaaaaaaaagctccgggtaccttttttttctgcaggtgttgtaataaaatgtaaaaagctgatctg

SEQ ID NO: 1998 - DNA, 1604 bp, Zea mays
atcggtcgcttcgctttcccccaaatccattgcagtactcgagctcgcagtagacgagagacgacccaagacttcctcaccctccctttgcttcctgcgcaattcctgcggcagcgcctttgtttgtttcaatggacagcgactacattgccagcctgctcatgggctcatccgcccctgcactcagcttcgccgcgctggacgccgggttcctcgacacgctacgcggcggcggcggcgggggcctcttcggggtgcccgcggaggcagggtgtggcggcgggtctccggaggggtcgtcggtgtccgacccagcgtgggcgcgcgctagggactacggcaatgccaggaaacgcaaggcgccgcccacggggtccgccggtggcaaggaggcctgcttgagcaaggttgcggaggccaagggtccggacgggaagaggtgcagagtagtgggtgccagcgacagtccggtgaagccgaaggaagaggaggaggaggcggcggcgagcgacgccttggttgaagtcaaagcgcagaagaagggcaaggggaagagctcgaagccggcagtcgaaccgcccaaagactacgtccatgtccgggcgcggcgggggcaggcgactgacagccacagccttgcagagagggttagaagagagaagattagccagaggatgaaatttctacaggacctagtgccaggatgcaacaaggtggtcggcaaggcactcatgctcgatgagatcataaactacgtccagtcgctgcagcagcaagttgagttcctgtccatgaagctcgccactgtgaacccagagcttgatttcagcaacctatcgacactcctgcacaaagacatgtaccaacagccatgtggtggcccttcggcaagttcggtctttccactggaaagcgccggcgcagcttttccattctgcgagcaggcggatcttttccacagctttggctcgggtggtagcggtagcggtagggtagtggtatggaggatcagtgctctctaagcctgctgctagacacggctctgccccacgcggccagcccacagtttgcttttcaaaagcagcaaagggacttgtgggaggatggcctacagcatgctttgcctacccctactaccggtagcgagcaaaggcaggaggaggatgggcttttagtacccgacccttgatggccagttgcaagctgatcaggcgaaggctgagttctagcccgtccctggtgatctgcaagggctggtatttttgtacataggtggtggtggtaccaagacctgtgtgtgggctgtgtgtttcaagcagagctctcctctgctaagctgaccatcattagcgtttaggcctgcgactgcgactgcgagctgaaattcattccgtgatactgctgcacgtatgtcacatggcgactcgattcttgccccccatagagatcgtgcgacccatctcgtgaaaaattggagtaggtcgtgtgctaggtagatatggcgcaaatattacatgcgccatcatctgaagctgtactgattattactcctatgtaagaccgctggtggctggtactggaaaaaaaaaaaaaaaaaaggtgac

SEQ ID NO: 1999 - DNA, 1410 bp, Zea mays
  misc_feature (1336)..(1339): n is a, c, g, or t
  misc_feature (1341)..(1344): n is a, c, g, or t
  misc_feature (1346)..(1346): n is a, c, g, or t
  misc_feature (1348)..(1349): n is a, c, g, or t
  misc_feature (1353)..(1353): n is a, c, g, or t
  misc_feature (1359)..(1359): n is a, c, g, or t
  misc_feature (1361)..(1361): n is a, c, g, or t
  misc_feature (1363)..(1363): n is a, c, g, or t
  misc_feature (1370)..(1370): n is a, c, g, or t
  misc_feature (1375)..(1375): n is a, c, g, or t
ccggccgggaatcatgttctggatgaaaattgcgtccctcgggtaaacgcaacaacgcgcactcgcgcagagacactgcccatcaggatttcgcaaaagcaacaaaacccacgtcgagggtagaagaggcctgcaaatttccgaagagctcgcggaaatggcgacggtgctgccgcttgccgccgcctcggcctcgcccacgccgaggacttgcatctccggcggcccagttcccgcgcgattccttgggactcgcatgcgtctccgcatccacatcccaccgcggggcgttgcctgcgccctccgaaggagacccaccaagtacaagactaaaatccagagtgaggaggatgtggtggctgcagaagatgtcatggatgatgatgacgacgaggatggtgcactggaagcacttttcaagcagctggaagaagatcttgacaatgatgatttatctgtcgatgataatgatatatcagaagaagatatggcaaggtttgaaaaggagttggcagaagcaattgaagatgtcagtggtgttgatgactcagcgggggattcgttgctgagctctggcgactatggtattgatgagcaactagatggaagcgaacgggtagagctgaaaacctggcaactccggagattggctcgtgcactgaaaataggccggcgtaaaactagtattaagaatcttgcaggggagctaggcctagataggggtttggttattgaaatgctccgcaatccaccaccgaagcttctactcatgtctgattctttgcctgatgaagtcccttctaaatctgaagtgaaggaaatagaaacccctagtacgaccactgttgacgaggttgataccagtgaaatcaaaccacagttggagcttccagtgcacgtcatgagtgcagaatggtctgcaagaaaaagactgaaaaaggtgcaacttgagaccttagaaagagtctacctgcgaagcaaacggcccacgaatacaatggtcagcagcatagttcaagtgacaaaccttccgcgaaagaccattgttaagtggtttgaggatagaagggagcaagatggagtccctgaccatcgtgctgcattcaagagatccctatctgagattggtgctagttcataacttcttcagataagcatttgttacggtgtttacttggaaccattacaaacatgtaaatatgagctttgaaattatgacaagttttgcaagctcaacatgcagtatcttttagatggtagtctcaaaaaaaaaaaaaaaaaaaaaaaaaaaaaaaaaaaaaaaaaaaaaaaaaaaaaaaaaaaaaagggcccccannnncnnnnancnnttanaaaaanananggggaanccccncgggaaaaaaaaaaaaaaaaaaaggcccctagggc

SEQ ID NO: 2000 - DNA, 2521 bp, Zea mays
aatgtgttttaaacctgagatgttttattctagctgatacacttcatttcggaggaaataaagtgggggaaaacttttcttccaaaaaaaaatgatatttgttgatgtggaaacttttagtcaaaagtagcctattgtgtctgcctttgtttatcaatttattgcactttgttgtactttgcctttgctaaatgtcatttggttgttgcacatagttttctctgatgaacaatttcattataggcagattgttcctctttgttttctattgagaaattgtttgctagtacatggatttaattttttttgtttctttctaggttggtgaggatgaccaaaagctggctgaaggaattagtctgctctctgtctcttcggaaaaccgtgaaaaaccagctgttcttgggaaattgattaaggtcggggtttattatatttgtcccattaaaatttaatttctttgttctaatttgctggagcacgttagcaatttgtttgtttcgtgtaggaacatgcaaaaggtggcaagtgcattgtttttacacaaacaaaaagggatgcagatagattgtcacacaatatgagtcgaagtttccaatgtgaggcgcttcatggggatatctctcaatctgaaagagagaggacactggcaggatttcgggatgggcggtttaatatattgattgctactgatgtcgcttctcgtggattggatatcccaaatgtagatctggtttgtgcttccccttctctaagctatctccattattttttgttgcaatcaccatgtgcgttatctgttgtgtacccctcatgcggttctccttgttcaggtgatacatttcgaattgccaaattcgtcagagatattcgttcacagatctggccgaactggccgtgctgggaagaagggcactgcaattgtgatgtacaactatgatcaaagtagagctgtgcgggtcattgaacgtgacgtaggatgcaagtttatggaggtgggggcttgtggtttgtgttgtacaatgcttttttttgggctgttcccactgcattatgttcacttggttttcgtttgccttgcagcttccaaaaattaatgtcgagggatccgacttgctgggtggtggatttgactccttcgggggcggaggtggtgggtatggtggctcaaactatgggcgctcacgagggggctttggtggacgtggcggtggtggtggttttggccgatcaggcggtggtggatttggcaattctgggtttggccgctcaagtggtggatttggtgactcgggatttggccgctccgggggtggagggtttggtgactcaggatttggcaggtcaggtggtggcggaggattcagtgactcaggatttggccggtctggtggcagcggtggaggattcagtgattctggttcaggtcgtttcggtggcggttttggtagttctcgctcaggtagttttggtggctttggcgacaaggactcacgatagacctataactaataacagctatagaattatggacatcctgagccagattcagcttggtcatgcggtatatcacaaaggagatcgagattgttgcggaccctatccatgaacacctcggagagggcataaggctgggtgaggcgggtccttcgataggcaaaaataatcacgtgccttgtttattagtgttcttttctgttcgttttttcatttgcttctgcaagttctagctctagatcatacctgtaaaatatgcagaggtcttttgcggatgatattcttatatcgtttttggtagtcgcgctgtactgtaccgtgtgatgattatggagctgctttgtaggccgtttttaacctgatatgatgatcttgattattggccattttagctcccttgcatgtttccattgccctaggcgagtaccgctgctaccaccctttggttcaagcctcttaagacctgttttgctgatataaatgaaaaaaataaacctcatttatgttggggccaaaaatttctgtgactaaagttaaaacaatatcaacaaattgttcttcactattttcaaacttgggtgtttaaacatttgaatatcaattatggctagtttaatttaaaactaatcatagagatgaaaactaaatggcaaaaggaatttattaagactaaatttgaaataggagatgactaggcatcctctattctatttttgagcttccatccaacatgattggtactgcggactagaaaatggcatggagaaactgcatttaaacatgattaagtttgtgttacaataataatgcttccaacatgggaacctaatattataaagcttctgctatttgttattatattcctgttcttagagctgattttcttctcaccaactatgagggcctttttgatttagctttctgagctatattcactcttaaaactagaatgccaaccaaattggtataaggggtgaatagattctttcagatttctatcatccaatttttttcaaactactag

SEQ ID NO: 2001 - DNA, 1906 bp, Zea mays
ggcggcggcgcagcggcggaggggctcgagattgccagtttgggatctcgtccaagatcgtcgaaagggtggccagcaagggcatcaccaagctgttccccatccagagagctgtccttgagccagcaatgcaaggaagggacatggttggccgtgccaaaactgggactggtaaaactttggcatttggaatccccataatggatgcaattatccggggcggcgagaagtacaagcctggtaagtttcccttggctattgttttggcgccaacaagagaacttgcaaaacaggttgagagggactcccggccggccgcccctttggttacactatgtgtatatgggtgggactccaattatgcagcaaataaggaaacttaattatggcgttgatgtggtcattgggacacctggacgtgtgattgatctgctaaaaagaggttctcttagtttggcagagatccgttttgttgttctcgatgaagcagatcagatgttgtccgtcgggttcgataaagacgttgaaacaattttggagagagtgcccccgcaacatcaaacattgatgttctctgcgacaatgccaacatggatacggaagctcacacagaagttcctcaacagtcctgttacagtggaccttgttggtgaggatgaccagaagctggctgaaggaattagtctgctctctgtctcttcggaaaaccgtgaaaaaccagctgttcttgggaaattgattaaggaacatgcaaaaggtggcaagtgcattgtttttacacaaacaaaaagggatgcagatagattgtcacacaatatgagtcgaagtttccaatgtgaggcgcttcatggggatatctctcaatctgaaagagagaggaccctggcaggatttcgggatgggcggtttaatatattgattgctactgatgtcgcttctcgtggattggatatcccaaatgtagatctggtgatacatttcgaattgccaaattcgtcagagatattcgttcacagatctggccgaactggccgtgctgggaagaagggcactgcaattgtgatgtacctgcccgggcgacgtagagctgtgcgagtcattgaacgtgacgtaggatgcaagtttacggagcttccaaaaattaatgttgagggatccgacttgctgggtggtggatttgactccttcgggggcggaggtggtgggtatggtggctcaaactatgggcgctcacgagggggctttggtggacgtggcggtggtggtggttttggccgatcaggcggtggaggatttggcaattctgggtttggccgctcaagtggtggatttggtgactcgggatttggccgctccgggggtggagggtttggtgactcaggatttggcaggtcaggtggtggcggaggattcagtgactcagaatttggccggtctggtggcagcggtggaggattcagtgattctggttcaggtcgtttcggtggcggttttggtagttctcgctcaggtagttttggtggctttggcgacaaggactcacgatagacctataactaataacagctatagaattatggacatcctgagccagattcagcttggtcatgcggtatatcacaaaggagatcgagattgttgcagaccctatccatgaacacctcggagagggcataaggctgggtgaggcgggtccttcgataggcaaaaataatcacgtgccttgtttattattgttcttttctgttcgttttttcatttgcttctgcaagttctagctctagatcatacctgtaaaatatgcagaggtcttttgcggatgatattcttatatcgtttttggtagtcgcgctgtactgtaccgtgtgatgattatggagctgctttgtaggccgtttttaacctg

SEQ ID NO: 2002 - DNA, 1190 bp, Zea mays
gtggttccactcctctcccgcgtggctggggttccgggagacgggggctgcaggggcggcggcgcgcgcggagttcgcggcggacaacgggtcgttctacgaggaggacaagagggcgcccgccggcggcggcgcagcggcggaggggctcgagattgccaagcttgggatctcgtccaagatcgtcgaaaggctcgccagcaagggcatcaccaagctgttccccatccagagagctgtccttgagccagcaatgcaaggaagggacatggttggccgtgccaaaactgggactggtaaaactttggcatttggaatccccataatggatgcaattatccgccacaacgagaagtacaagcctggtaagtttcccttggctattgttttggcgccaacaagagaacttgcaaaacaggttgagagggagttccttgattcctcccctttggaaacactatgtgtatatggtgggactccaattatgcagcaaataaggaaacttaattatggcgttgatgtggtcattgggacacctggacgtgtgattgatctgctaaaaagaggttctcttagtttggcagagatccgttttgttgttcttgatgaagcagaccagatgttgtctgttgggtttgatctagatgttgagacaattttggagagggtgcctccgcaacgtcagacattgatgttctctgcaacaatgccaacatggatacggaagctcacacagaagtacctcaacaatcctgtcacagttgaccttgttggtgaggatgaccagaagcttgctgaaggaattagtcttctcgctgtctcttcggagaaccgtgaaaaaccagctgtccttggggaattgattaaggaccatgccaaagatggtaagtgctttgtttttccccaaacaaaaagggatgcagatagattgtcacacaatatgagtcgaagttcccagtgtgaggctcttcatggggatatctctcaatcccaaagagagagaccactggcagcatttcgagatgggaggtttaatatattgatttctcctgatgtcgctgctcgtggattggatatcccaaatgtagatctggtaatacattttgaagtccctacctcatgacagtcgtatgtaggccaatctggccgaactggccgtgctgggaagaaggccacagcaattgtgatgt

SEQ ID NO: 2003 - DNA, 572 bp, Zea mays
atagattgtcacacaatatgagtcgaagtttccaatgtgaggcgcttcatggggatatctctcaatctgaaagagagaggacactggcaggatttcgggatgggcggtttaatatattgatcgctactgatgtcgcttctcgtggattggatatcccaaatgtagatctggtgatacatttcgaattgccaaattcgtcagagatattcgttcacagatctggccgaactggccgtgctgggaagaagggcactgcaattgtgatgtacaactatgaacaaagtagagctgtgcgggtcattgaacgtgacgtaggatgcaagtttacggagcttccaaaaattaatgttgagggatccgacttgctgggtggtggatttgactccttcgggggtggaggtggtgggtatggtggctcaaactatgggcgctcacgagggggctttggtggacgtggcggtggtggtggttttggccgatcaggcggtggtggatttggcacttctgggtttggccgctcaagtgctggatttggtgactcgggatttggccgctccgggggtggacggttt

SEQ ID NO: 2004 - DNA, 1626 bp, Zea mays
cgggggccccctcgaggcccggcgcaaaataaaagtgaaattccattaccttgctgtctcggtctgtcggccatcgccggttgcgcagcgggcagcggctcacgtcgacggggaagactccggaggccacgggcgttacattctcctgccgtatttttgcgatccctggctaaccaaacaaatggtggagacatggattagtgcttatgggaaaatcatccccaacagggattgaagtgacagccagggatccactcatcccctgggtggaaaaattcaggttgtggattggattgctagctaccgaacaagccctcagcgtgctaatttcagtggaatcttggtagacaccactgaacttcttggtttccaattaagttcgagcatagagatcgtcttctctcacactgagttgccagtttattccgaaggtccttcaagctaagttctgatgatggctaaggccaatggagcagtccatgcatccacgaaggaacccttgttttcttttggtgtcatagctgatgttcagtatgctgatatcccagatggtcgctcattcctcggtgtcccaagatactaccgccatagcatcactgtcctccaaagggccgtcaacaggtggaacgaacaaggcaacatcaagttctcaatcaattttggtgacattattgatggctactgcccaaaggacaaatcattgtgggcggtgcagaaggtccttgatgaatttgacaagtttgatggcccgacatatcacatgattggcaaccactgcctgtataaccttccgcgcagccagctggtgtctctgcttaagattgcaacagattctgatcgtgcctattatgacttctcgccatgccctgggttcagaatcgttgttctggatgcttatgacttcagttgccttggctggccccatgatcaccctgtgactatagcagcaatgaagctcctggatgagaagaatccaaacactgataagaacagccctgatggtctggttggtgttgataggcggttcgtgaagttcaatggtgcagttggcaaggagcaggtgtcctggctcaatgatgtcctccaggacgcatcgacgcaacatcaaaatgtcatcatatgcagccatctcccaatggatcccggggcgtcttccccagcagctctgatgtggaactacgatgaggtgatggctattgttcaccagtacaactgtgtcaaggcctgctttgccggtcatgaccacaagggtggccactctgtggactcacacggtgtgcaccaccgcacccttgaggctgccttggagtgtcctcctggtaccagcgcttttggtcacgtcgaagtgtatcctaacaggctgctgcttgtaggttttgacagaatggctgatacagaggtccgtttttgagccattaagcggctttaattcgtaccgacttctactacttctataatgtttttgtctatatagattacagctgcagcagtccaaacgctggctttaatccgatgcttacacaaattcatgtgacttcattgcctgccgcataattccattgaaactggattattgcaataatgaaatgaattccttacggtaaaaaaaaaaaaaaaaaagcggcc

SEQ ID NO: 2005 - DNA, 897 bp, Zea mays
gagattgccggttatgttcttattcttctccaaacccgatgatcgctgtcgtctaatctaccgcgcgcaagcctcccctcggggctagatctccggtctccgcttgcccaatttccaccactgaggcgatgcaggaagccaagcacctcaccacctcaaagcttccgccgcaatcccaatcctcatccccatccccttcggctcccgccgcgaaccctcccccataccatcacgactatggtacctttcaccggccgtttcagccgacgctgcccgtcgtaggccccgcctaccatgactaccatgcctctcctatcgggttcggcagccaggggttcgttgcctccccgggcgccgtccagcagcaggtcttcgtggagggcatccccgtccgagagccgcccctaccgttctgcggcgtcggcgtcggctggtttttgttcttattggggttcttcttggcggcaatcccctggtatgctggtgcgttccttctattctttgttgctttggaccacagagagaagcctggattaatcgcatgcaccgttgctggcatatttgcactagttccattcatcctgaacggtatcagattgaaccctttctggtgatcagtgcttgccaatccagatccacatgactaatgttttcagcaccacattcgatatgttcatagctgtattattttgctcaaacttgcgaagaacaaaatatatgagcttatgtgtaaaaaggaattgccatgctgttttatgtccgcagcaggttcatgccctgtgatatgtgtaatcatgaattgtacagtttatctgtaccgcagcagtttacgagaggtctagtaaaagcacattttacccaaaaaaaaaaaaaaaaaagccgccccgctcagctttg

SEQ ID NO: 2006 - DNA, 2387 bp, Zea mays
  misc_feature (2377)..(2377): n is a, c, g, or t
cccacgcgtccgcccacgcgtcccgcccggccgcacggagctgacagcaaagcaaagcttgagaggcttttctcaaaaacgcgccgtcgccgtttcttccccctttttctttgagaaaattcgcccgcgagatctttagtttcagaccccgtgtggattagtcgctgtcacgatcgaggcggggcgccaattgcggtggccaccacctccaatccactccccgcggtggcctcgccgagctgttcttgctccgtcctccctccaactccaagatttgtttcgcacccgattcctgagcttccgcggcgcttcttgctgaaaagaaagctccgagttcttcagttctggatcgatagagaggcggttcctttgcgggctctgaggttcagctctcgctcttgatttgtctcatcgacgcatcagttgggctgcaggcttagagctggaaggaataatttgactagagaaatggggcagtgttgtagcagagctcccgccccggactctggacggggaggcaccaatggttatggctattctaaccaggcaaagccagcgcaaacaccttcgagttacaaccctcctcagcagccggccgaggtgaggtacacgccgccggcgacgaaccctccggtagtcccacctgtgcctgtgcctgtgccaccgaagcccacggcggacacgattcttggcaaacagtacgaggacgtacgctctgtctactccctcggaaaggagcttggccggggccagttcggggtgacatacctctgcacagaggttgcctctggtaagcagtacgcctgcaagtccatctccaagcgcaagcttaccagcaaggcagacagggaggacattcgaagagagatccagatcatgcagcatctgtctggacagccaaacattgttgagttccggggagcatacgaggacaagagcaatgtccatgtggtgatggagctctgcgcaggtggggagctcttcgatcgcatcattgccaaggggcactacacagagcgtgcagctgctacaatctgcagagcagttgtgaatgttgtcaacatttgccacttcatgggtgtgatgcaccgtgacctgaaaccggagaacttcttgcttgcgagcaaggaggagaatgcaatgctcaaggccactgattttgggctttccgtcttcatcgaagaaggaaagatgtacagggacatcgttggaagtgcttattatgttgcgcctgaagtccttaagcggagctatggaaaagagatagatgtttggagcgcaggtgttattttgtacattcttctcagtggtgtgcctccattttgggctgaaactgaaaaggggatatttgatgctattctgcatgaggagattgactttgaaagtcaaccttggccatcaatttctgagagtgctaaagacttggttagaaagatgttgacacgagatccaaagaaaagactgacttcagctcaagttcttcaacattcatggctcagagaaggtggaggtgcatctgataagcctatcgacagtgctgttctttctagaatgaagcagttcagagcaatgaataagctgaaaaagatggccctaaaggttattgcctcaaaccttaacgaggaagagatcaaggggctaaagcaaatgttcatgaacatggacacagacaatagtggcacaatcacgtatgaagaactcaaagcaggactagccaaacttggatcaaagctgtcggaagctgaagtaaagcagttgatggaggctgctgatgttgatgggaatggatccatcgactatgttgagttcatcactgccacaatgcatagacacaagctcgaaagagacgagtatttgtttaaggcattccagtacttcgataaagataacagcggtttcatcacaagagatgagctggagtctgctttgatcgagcatgagatgggtgacacgagtacaataaaggagatcatatcagaagtggacacagacaatgatgggaggattaactatgaggagttctgcgcaatgatgagaggagggatgcagcagccaatgaggctcaagtagcctgttcccttagtagaaatggtgtaccgttagttactgttcttcactctttttcccccttcgtatttggtactcttggtagccggattaagcttacaatgggcgtcgctcttttgcattgtcaagagatgattgtgtatatctttttcttttgctcgtgtttgttgcattgtagtatcctgaacgtcccttccttttgtaagtttgtttatacacaagcacatccaatagaaagtgcaatttgtgtctcaaaaaaaaaaaaaaaaaaaaataaaaaaagaaaaaaggtctaaaaaaaaaaatagtnctagatcgca

SEQ ID NO: 2007 - DNA, 2345 bp, Zea mays
attgggtacctcgaggccggccggggtgaaggagtgcccctctcgacaggctaagcttttactcaaaaacgcgctgtccccgccggcccccctgtcaaccttttttctttgagaaaactcggccccccgcaggatcttttgttccggaccccgtgagtcgctgccacgatcgaggcagggcgccaattgcggtggccaccacttccaatccactccccgcgttcgcctcgccgagctgttcttgctctgtcctctctccaactccacgatttgttccacacccggttcccgagcctccgcagcgcttcttgctgaaaaagggaactccgagttctccagctctggatcggcagagagcggtggttccttttgcggactctgaggtccagttcttgtttttgatttgtctcatcaacccaccagtcgggctgcaggcttagagctggaaggaataatttgactagagaaatggggcagtgttgcagcagagctacggccccggactctggacggggaggtgccaatggttatggctattctaaccaggcaaagccggcgcaagcacctccgagttacaaccctcctcagcaggcggccgaggtgaggtacacaccatcggcgacgaactcttcggcagtcccacccgtggctgtgccgccgaagccaacggcggacacgattcttggcaagcagtacgaggacgtgcgctctgtctactccctcgggaaggagcttggccggggccagttcggggtgacatacctctgcacagagattgcctctggtaggcagtacgcctgcaagtccatctccaagcgcaagctcgtcagcaaggcagacagggaggacattcgaagggagatccagatcatgcagcacctgtctgggcagccaaacattgtcgagttccggggagcatacgaggacaagagcaatgtccatgtggtgatggagctctgcgcaggtggggagctcttcgatcgcatcattgcaaaggggcactacacagaacgtgcggctgctacaatctgcagagcagttgtgaatgttgtcaacatttgccacttcatgggtgtgatgcatcgtgatctgaaacccgagaacttcttgcttgcgaccaaggaggagaatgcaatgctcaaggccactgattttgggctttctgtcttcattgaagaaggaaagatgtacagggacattgttggaagtgcttactatgttgctcctgaagtccttagacggagctatggaaaagagatagatgtttggagtgcgggtgttattttgtacattcttctcagtggcgtgcctccattttgggctgaaactgaaaaggggatatttgatgctattctgcatgaggagattgactttgaaagtcaaccttggccatcaatttctgagagtgctaaagacttggtgagaaagatgttgacacgagatccaaagaaaagactgacttcagcccaagttcttcaacatcagtggctcagagaaggtggggaggcatctgataagcctatcgacagtgctgttctttctagaatgaagcaattcagagcaatgaataagctgaaaaagatggccctaaaggttattgcttcaaaccttaacgaggaagagatcaaggggctaaagcaaatgttcatgaacatggacacagacaatagtggcacaatcacatacgaagaactcaaagcaggattagccaaacttggatcaaagctgtcagaagctgaagtaaagcagttgatggaggctgctgatgttgatgggaatggatctattgactatgtggagttcatcactgccacaatgcatagacacaagctcgaaagggacgagcatttgttcaaggcattccagtactttgacaaagataacagcggcttcatcacaagggatgaactggaatctgctttgattgagcatgagatgggcgacacgagtacaataaaggagatcatatcagaagttgacacagataatgatgggaggattaactatgaggagttttgtgcaatgatgagaggagggatgcagcagccaatgaggctcaagtagcctgttcccttaatagaaacggtgtaccactagttactgttcactttttttcttcatgtttggtacttggtagtcggataaagcttacaatgggtgttgcttttgtattgttgagagatgattgtctatacctttttttccctttttgctcgtgcttgttgcattgtagtatcttgaacgtcccttcctttttttaagtttgtttatgcaagtacatctaatacaaagtgcattttgtctttaaaaaaaaaaaaaaaaaagcggccaaaaaaaaaaactcg

SEQ ID NO: 2008 - DNA, 2705 bp, Zea mays
  misc_feature (2687)..(2689): n is a, c, g, or t
atcgaccgtataaccccacgccaccctgtccctttccccgcgccaccgccctctccgtcgccgccgttcgaccgagcgccgctcacccaccccacgagctcccgcgcgggttcatgtccatctctccacacgaacgcaccggaggagcctattacccgcgcccgcacaaccctagccctagtccccaacatggcagcgacagacgccgccacggccgccgctcccctccggcatccgtctcgccacccggcgccgctgcggaagctagcgacggcggggtcggctcgagctccaacccagtggttccagctattggagaatctattaatgctcccgaaaaggtagttggatttataatatctggggaagagaatgatacatgtacacaagaggttggcaatgtttcagaatgccactcttcagaacagggggattccggtttgcctgtagataattttggctcagttgggtcatatcctgagagacctaaaatggtgggatcccttcaggctgaccatttggcttcaggttctactggactgggtaatgggactcagatagctgccaggaagaatcagaccgtgaatgctaatcacctactgaatttccagtatgatcctatttctcggccacagcccagaggccctagaacatatcttccgagaagacaaaggaagataaaaccttacaacaaggatctgttcatccaagcaaactataagtttgttgtattggatactgggaattaccagattgattcaatggatcctgataagatgcttcagtgggaagatattatctgtgtaagatactatagcccttctgaggtacaatgccctatttgcttggaaagaccattgtgcccacagatcacatcatgcggacacatatattgctttccatgcattttacgttatctaatgatgggcaaagatgattatagaggtgagtgttggaagaagtgtcctctgtgtttcatgatgatatcatcaaaggatttgtatacaatacaaattactcaagtccagaatgtccgtgctggtgacgttgtcacatttacacttctgagcaggtcaagaaattcgctcactccttccatcaaaagctcctccagtgaaagttctacaacagatgaagagcattataatgttttctcaaagtttattttgacatctgatgtggagttgtctgttcgagatgcaaaattggatcttagtaattggttgcatatggctgacttaggccttgttgatgacttggagaaacttccatttgtttctgctgctttggagcaactggaagagaagacgaaatattggattgattacagaaattatggtggtagtcctccatcaaaagatagcttctctcctggatctagtttcaagtctaggaactcttttgatgtgaatacttctcagcagatgagtgagcacaagatctctctttcagatagagatatggtcaatggtatttcagaactctccatgtctcccgagttgagtaaaacctctggtaaaggaacaatatctaaagtaaatgagaaatgtaccacaaccattgattcaaatgaacatgacccatacacattttaccaggtgtcagatggccaacacctaattctccatccactaaacatgagatgtcttctaaaccattttggaggttctgatatgcttccacctagaataactgccaaaatattggagctggaaactgtaacacagtctgaggctataaggaagcgctatcggtttttgagtcacttctcattaacaactacatttcagttctgtgaaattgacttgagtgatgtagtgtctcctaactcactggctccattcttggatgaaatcaagaagcgtgagaaacaaagaaaacgagccgccaagaaggaagaaagtgagagagtgaaggcggaagttgctgctgctgttcaggcatcagctatgcgatttgagtatacaaattcctctcaaagtcacaacgatgtcatgttctctctggatgactttgaagccctgggaaacaacgctgggccgtccaccagtccaccagcgagtgaaaggaagcttttctctgatgtaacacgcttgggttttgcatctgctcaagactcacctcccttaagactcggaactggggatgcaaatggccaaagtgaaacctcgagagaccaagggccgttagcgacacccgcattatcatttgccagcatcatatcttccagtagagccgtgactgcagctgacaactcggagatgcagaaagcaaatggcgctgggaagaagggtaagaaagcaactagagtgcttttgtcgactggtggtggccgtcgatactgaaggactatagatgcattggaacgaacagtttggttgtttccatataatgccgtagctcaatgcaatgtgcatagtacataacctggctgggatacgcttgtaagttgtaacactgagcggcagtcgtgtgtgttttgcctttcttgtgggtgtgcttgcgttgtgcccacatcctgtcccttgcatgatctggaaacgagcgcagagaagcgtgtaccataactaataaaggtggcgcaacactttagttgtggaacgccgctagtctgcccggagtgtcaaaatctccaaaaatgtgtacttttgatcattgaacatagttcatcagggttcaaagaaaannnaaaaaaaaaaaaaaaa

SEQ ID NO: 2009 - DNA, 2683 bp, Zea mays
  misc_feature (11)..(11): n is a, c, g, or t
tcccggggggnaggaaaaaggaaacaaaagagataacgcacggccgcccgcagtgcttggaaaccagcccgctcctccattccaacgtctgcacccactgcccccaatggcgacgccgttcccgccggaggccgacgagggggaggcgcgggagctcctctacgaggcgtacaacgagctgcacgcgctggcgtccgagctgggcggcgcggcggcggcgccggcggtcgtggtcgtcggccaccagacggacggcaagagcgcgctggtcgaggcgctcatggggttccagttcaaccacgtcggcggtggcaccaagacgcggcgccccgtcgcgctccacctccgcttcaacccgcgctgcgacgagccccagtgccgcctcctctctgcaaccggcgatgccgaagaacatgacgaagccggggttgccgcccgccccatgccgctcgccgacatccaggcatatattgaagctgaaaacttgaggttggagaatgacccgtgccaattttcagagaaggaaatcataattaaggtagaatacaagcattcccccaatctcaccattattgacactccaggcctcatccttccagctcctggccgtaaaaacagagttttgcagagccaggcttctgctgttgagagccttgttcgtgctaaaatccagcataaagagaccattatactgtgccttgaagattgtagtgattggagtaatgcaactacacggagagtagtgatgcaggtcgatcctgatcttgcaaggactgttctagtctccacaaaactggacactaaaataccacaatttgcccgtccctctgatgttgaagtgtttcttcacccaccaaattgtgtgctagatgtttccttattgggagattctccctttttcacatcagtaccttctggtagagttggctcttgccatgaagctgtgttcaggtcaaatggagagtttaagaaggccatcttatcaagagagttggaagatattgcatctattgaagacaagttaggaaggtcacttacaaccatggagaaagatagaattggagtgggtaacttaagattatatttggaagagttgctgcagaagaggtacgttaagagtgttccattaatcattccacttcttgagaagcaacatcgaaatacaacaagtaaattgcgtgaaatcagtcatgaactcagtgatctggacgaagccaaactgaaggagaaagctcagctattccatgacacatttttgaccaagttatctttgctattgaaaggcatggtggtggcacctcctgataaatttggagaaactttagtcaacgagaggattaatggaggaacatttactggaagtgagaatttccagctcccgaacaagatgatgccaaatggtggcatgcgtctttatggtggtgcacaataccatcgggcaatggctgaatttcgtctggtagttggtagtaccaggtgccctccaataactagggatgtaattgtcaatgcttgtggtgttgaggatattcatgatggtacaaactactccaggactgcctgtggaattgccgtgccaaaagcacgtgacacgtttgagccattccttgatcagttgggttttaggcttttgtacatactgaagaggctgatcccaatctctgtttatctgttggagaaagatggtgagcactttagtagccatgaagtgctcataaggcgtgtccagggtgcgggccccagctctgtggaatccactgagcaatcttattcgccctttcgagcggccgcccgggcaggtaccactcgttatgtcacttggtcccttcacaacaagaaccgtgctggattgagacatttcctcgattcatttgttgcaccggagcaactatcagtaaatacattgaacgagcggttttctgggttgaatgataacaaacaggataaggcaaagggtgactcgaagtcaaaccattctccagacacaaattcgtccactgctatgccagagacaaggctggttgacctattggatagcacactctggaacagacgcctggttccctcatctgaaaggcttgtttatgcgctggttcaccagatttttcatggaatcaaagagcattttcttgtcaccactgaactgaagttcaattgctttctcctcatgccgattgttgacaaactaccagcacttctaagacaagaccttgagtcagctttcgaagaggaacttgatagcatctttgatgtcactcagctgcgccagtcacttgggcagaagaagcgcgagctggagatcgaactgaagcggatcaagcgcttaaaggaaaagtttggggagataaataagaagctcaattctcttcaggttaggcagtaggccaggctcaaaatttagcagtagcttggtagtctaggactccaggtagagtgtttctatgctgtaataaaataattggtcatctagagtgacttcttgttgtatcctatcagttgtaaatatgaagtcttcctatgtcttaacgtatgttgttgctacacgggttttcggagtcaaaaaacccaaacatgatgcggcccactgcgattccttcaggttgaagtcagccaaataggtccaaagtaacagcaagctctaatatctaacctcctctgtttcaatctaaaaaaaaaaaaaaaa

SEQ ID NO: 2010 - DNA, 3654 bp, Zea mays
  misc_feature (19)..(19): n is a, c, g, or t
  misc_feature (41)..(41): n is a, c, g, or t
  misc_feature (95)..(95): n is a, c, g, or t
ccgtaaaaacagagtttgncagagccaggcttctgctgtgnagagccttgttcgtgctaaaatccagcataaagagaccattatactgtgcctgnaagattgtagtgattggagtaatgcaactacacggagagtagtgatgcaggtcgatcctgatcttgcaaggactgttctagtctccacaaaactggacactaaaataccacaatttgctcgtccctctgatgttgaagtgtttcttcacccaccaaattgtgtgctagatgtttccttattgggagattctccctttttcacatcagtaccttctggtagagttggctcttgccatgaagctgtgttcaggtcaaatggagagtttaagaaggtatagctagtaccgactgaattctttagagctttgtgcttcctcctgtgaagtgtcgaattgtacactgcataaacatgcttgcactctagcatcaagcagactcttgaatttttttcttctgttctgtgccaataaagcaaccggccatctgatttcattatgtacttgtcagagcagtttggttaaactcaagagcgaatgtgtaactcagtatgatgtacaatcccttacaaaaatgattacaactaactgaaaacctgcagtttttaagagcttttagggacacaggtttacacattaaagtcacatgccccctcatttcattttgtaaggtttactcacaagtcacaacataagattcaaacttgataatattttattagcacttaatattataatttgtaggttatgccatacaaatatttgagaacacttccatattgtcaaatgaatattcatgaacattacaatgtatgtgtgttaatggtgaaaatgtactatttcttttgttcttgataaaatgatacacaactttactgcatttgagaagaaaaaaaatataatggtcaaaacatgacatttaccatgccttacaaaaataaaaggagggattactttctgtgtttttttaattcatattgatttttaactcaaatataaaaatacatgcttgctttgacttgtgaagcttctcagactccacttcgaggtgccactccaagagtatgtgtggatgtgcctatatttctatttgtttctgtagggtaaagtctactccagggataacctgtgactaacagataggtctgtacttcctgttgaggttaagaatgtaatcgacaacacttctatcatgtctgtgaaatgtttgctgctattggatttacaattcatatttgtaggatcaagtgacatgtaccctgttcatgtatgctgccttttttaacaacactatctacaataaagaatgttgaagatcagctttcatagtaatattttagtgaaaagtttaaaagatattatattgtgaaagtactgtctcataaagaagaaccgacattattgtttccaggggctacattacaattacatcatgttactagtttgcaatttaaccttgttttatgtacataaccacatttgttttataacaatactatgatgaacttccccaaagtttttcataaaaaaaatcaacagagtttgacgactgaaatcataaacacattatattctgaagggatggaataacatcaaaattaaaaaggtgcttttagggaatgctccaactgaactgctttacagaacacaatgcctttgttttagtgcagcttttttgctagcattgctaattagatatccaaatttgggccttttctcttatgtgtgtgtgatgtaagcaggacagtttttcacaaggcctctaatgttttttattgtgtcgtcatgaaggccatcttatcaagagagttggaagatattgcatctattgaagacaagttaggaaggtcacttacaaccatggagaaagatagaattggagtgggtaacttaagattatatttggaagagttgctgcagaagaggtacgttaagagtgttccattaatcattccacttcttgagaagcaacatcgaaatacaacaagtaaattgcgtgaaatcagtcatgaactcaggtgatcttgatggaaccttactgaaggtgattagctctgctatcaataaagtgggtccttccttgtagtgggttatgtggtgtttctgtagctcaaagctttgatggaaagctgggttacgttcttccccatatctccaactttacaggctcatgataatatatttgttattcaagatgtattatttatgttgtcaccctatatctgaacagtgatcttagatgaaaccaaactgaaggagaaagctcagctattccatgacacatttttgaccaagttatctttgctattgaaaggcatggtggtggcacctcctgataaatttggagaaactttagtcaacgagaggattaatggaggaacatttactggaagtgagaatttccagctcccgaacaagatgatgccaaatggtggaatgcgtctttatggtggtgcacaatatcatcgggcaatggctgaatttcgtctggtagttggtagtaccaggtgccctccaataactagggatgaaattgtcaatgcttgtggtggtggggatattcatgatggtacaaactactccaggactgcttgtgtaattgccgtggcaaaagcacgtgacacgtttgagccattccttgatcagttgggttttaggcttttgtacatactgaagaggctgatcccaatctctgtttatctgttggagaaagatggtgagcactttagtagccatgaagtgcttataaggcgtgtccaggaagcattcaagaggtttgttgaatccactgagcaatcatgtcgtcaaaggtgtatggaagatttggagagtaccactcgttatgtcacttggtcccttcacaacaagaaccgtgctggattgagacatttcctcgattcatttgttgcaccggagcaactatcagtaaatacattgaacgagcggttttctgggttgaatgataacaaacaggataaggcaaagggtgactcgaagtcaaaccattctccagacacaaattcgtccactgctatgccagagacaaggctggttgacctattggatagcacactctggaacagacgcctggttccctcatctgaaaggcttgtttatgctctggttcaccagatttttcatggaatcaaagagcattttcttgtcaccactgaactgaagttcaattgctttctcctcatgccgattgttgacaaactaccagcacttctaagacaagaccttgagtcagcttttgaagaggaacttgatagcatctttgatgtcactcaactgcgccagtcacttgggcagaagaagcgcgagctggagatcgaactgaagcggatcaagcgcttaaaggaaaagtttggggagataaataagaagctcaattctcttcaggttaggcagtaggccaggctcaaaaacacttagcagtagcttggtaggctaggaactccaggtagagtgtttctatgctgtaataaaatcattggtcacctagagtgacttcttgttgtatcctttcagttgtaaatatcagtgtcataaacgttaaacggtaaacagtcggtcctcctctgtcttagcatttaaccggattatacggatgttgttgctac

SEQ ID NO: 2011 - DNA, 3598 bp, Zea mays
  misc_feature (538)..(538): n is a, c, g, or t
  misc_feature (574)..(574): n is a, c, g, or t
  misc_feature (1044)..(1044): n is a, c, g, or t
  misc_feature (1108)..(1108): n is a, c, g, or t
  misc_feature (3501)..(3501): n is a, c, g, or t
  misc_feature (3503)..(3504): n is a, c, g, or t
  misc_feature (3507)..(3507): n is a, c, g, or t
ggtgagcgagagactctagaagcttgggaatgcctcaaagtatagaaagatcctgaggccttaggggccctggtcatgccaattatgatggacgggagtggctaggacaacctcacgggttcaggggctcaagatgaggtccattagggtgggtctctaggggcacatgtctggagttagtcaggctctcgattacttttatcgagatccttagaaggcatcttcatctagagtgtgaccttccccatgcgctaatagaggtccccaagtcaaccatagacctatgaggcttgctggtgggcccaaatttctcgtaatacacttgagaaaagaagacttattatctgttagagaactactacatagttcaatgatggcaagcacccaatacctggtgcactaagtgtcgtcatggtacaacattacagtaccataagcaaccaaaagacacgaagaaagtttatggacagagcaaggagcataatctataggcgcattgatcctaggtgtagcacatagtcattttataaagggctangccacaagatgataccatatgtcctctttaagtacnatggtttgacgaacacataggtgaagaagaatacaagctcagatatcaactaagcgtcatgatcttctagctctcccttactattcggttctcatgagttctaggctagtggtccctagttcacctctatgtatgacctccaacaacgtgctctaatttttgccatctaaaagaatattctctatcctttagaacacactctagaaaatttcatcctctatatctttatcatctccaacaacatcctctaaatttcattctctgcaacattgtctttcttctccgacaccccacctccaccgttgtactccatccatccacccagtatctcccatgcccctagatgcgggttgagaagcactccacacggagcgccgtgtccaggatcacctatctcatctccggcaacacagaggatggacttgtgctgcgccgaggtgggggagaagcatagcaacaaacaagggagnagtgcgaagagagaaagatcgagttacaggtcctatgcgcctacgtcatccaaggtcgtgtttnttgcacatccggtcgccgtgcgcctcgtcgtcctcttctaccgtggatgcaagttgggaggtgctggctgatgtgctactttgtcgcggcgtgcacagccgacctgtagtctctctacacaagacggtgcacatagccgacacaacggaacactctacatctgttgtgcgcgttagtggtccgctactttagcgggtcctttagcggaccttgagaacgaaaagcagattgcgcacgttaaatttagcgtacaggagcatttacagagtcttgctctcgagagtcttgtacgtttaattgacaagctaattttacgcaaataaataacaatttggatagatccaaacgagatattattatagctgaccagtgtaagctagttcatgcacacgcaaaaaaatctcgcgatatactagtccgtcaatcggtcacacttggacgagagtgacacacgagagatcacggcaagtgtgggagtctggaaccgggacgctatagtagtagactaggtggcagaaagctggagccgccatctgccgtgtgcgttgcacacttgcgctcgtagtcgtaggtgactcgtaaggtttttatccggtgaggccgcagagatcgagcgctctcggccaaccaaacgtcgtgggaccgaacatgacaacgccctctaccgcaccagcgccactggcatctctcctcctccgcgtctccgcggccgctgttccagtggctcgacgacgtcctaagagccccgcggctgcggcggcggcacgctgggagggaggtgggggcaggaggaggtgccgggcggcggtggtggaggaagccggggtgctgctgcccaaggagggggagggggagggggccccggacgcggcggcggggcgctacgactggagggaggagtggtacccgctgtacctggccaaggaggtgcctcgacgacgcggcgctcccgctcaccgtcttcgaccgccagctcgtgctctggcgcgacgcccacggcgtgctccgctgccacgaggaccggtgccctcacaggttagcgaagctatcggaagggcagatcgtggacggcaagctggagtgcctctaccatggctggcagttcgacggcgacggcaagtgcgtcaagataccacagctgcccgagggcgccaagatcccgcgcagcgcgtgcgcgcgcaactacgaggtgcgcgactcgcagggggtggtgtgggtgtggatgtcggacgccaaccctcccgacgaggggaagctgccgtggttcgagccgtacgcgcgggcggggttcacggacctgtcgacggtgcacgagctcccctacgaccactccatcctgctggagaacctcatggaccccgcgcacgtgcccatctcccacgaccgcaccgactggacggccaagcgcgaggacgcgcagccgctcttcttcgacgtcaccgagcgcacgccccgcggcttcgcgggctactggggccgcaccggcacgccgcacctccgcaaccttctgcgcttcgaggccccctgcgtgctcaccaacacgctagagttcgccgacaaggacggcagggagcagtgcttctccgcgcacttcctctgccgccccgccgggcagggcaagtccatgctcctcgtgcgcttcggctccaccctcaggtcgccgctcgccaaggtgctcccgtcctggtacttccaccagaacgcgtgcaaggtgttcgagcaggacatggggttcctgtcgtcgcagaacgaggtgctgctccgggagaagctgcccaccagggagctctacctcaacctccgctcctccgacacctgggtcgccgagtacaggaagtggatggacagggcgggccacggcatgccctactacttcggccacagcaccctgtcgccgccgcccgtgccggccgtcgtggagcaggcgcccgcgggggccgtcgcggggatctcggcctcgttcccggccaagggcggcgtcggcatggtgcacgcgcccaacccgaccaacaggtacttccgccacgtcgtgcactgcaagagttgcagggcaaccgtcaaaaagtacacctcgttgaagaccgtgttcgcggccctcgcggcggcggccctatcggccgccatcctggcggcgaccagacagtggaaggccgtcttggtggcggcgtcggccgtgctagccgccgcatcctatgcgtgtgacgcggtgctttctttgatcaccaccaacttcatcaggacacacaggagactgtaattaatgtggtactggccattgtatatttaggtaatggccggcggggagcgttctctgtacatttgtatcaccgtagctgctgcctgcggctgttgtattttgtgtatttgcagtaacgttttgcatgtcagcagcntnnaanagttttgactgataaacctgggggcaacatatgcttgcagcgaagttgaattctggggtatctgcattgtcaaatttacaacgtgtgcaat

SEQ ID NO: 2012 - DNA, 1918 bp, Zea mays
agacaattcgaccgtgaactggcccgagtgaagtccacgcatccgtctcttcccgctccggcccattgcccattccgttcacaaattcacttctctctctctccgtcgagatgcttcgtggctccgccgccctcctccgccgcctcgcccctcgtatctcgggcggtggctgcggaaacacgactcaccggcgccttcttcctcccatcgcccccttcctccgcgcccgcttcttgtctgccccgactacctcttcaccgccttcttcgtcttcagctgcctgccacgaggaggatgcggaggacagagacctccccgagatctccaatggtgatgcaggtgcccggctcagcatctccgtcgaccgctccgggctctacaaccccacagagcactcgcacgagccgtcgtcggaatccgagctcgtcaagcacatcaagagcatcataaagtttcggagtgggccaatcagcatagctgaatacatggaggaggtgctgacgaacccacagtcaggattctacatcaaccgtgacgtgtttggggaatcaggggatttcatcacctcgccagaggtcagccagatgtttggagagatgattggtgtatgggcaatgtgcctctgggagcaaatgggaaagccagcgaaggtgaatctgattgagcttggcccaggacgaggaacactcttggctgatttacttaggggatcggccaagtttgctaacttcaccaaggcactgagcattaacttagttgagtgcagccctacattgcaaaaaatccagtataatactctgaaatgtgaagatgaacatgttggtgatggcaagagaacagttagcaagatttgtggagcccctgtttgttggcatgcctccctcgaacaggttccctcaggatcaccaccataatcattgccatgaattctatgatgccttaccaatccatcagtttcagaaagcatcacgtggatggggcgaaaacgatggtggatattgcagaagattctttgtttcggtttgttttgtctccccatcccacagcctctttaatctacctcgccaagcgttgtggttgggctagctccgaggagcttgagaagattgagcacattgaagtctgccccaaagcaatggagcttaccgaacaaattgcagatagaattagttcggacggcggaggcgctcttattattgactatggaaaaaacggaatagtatccaatagtctccaggccatccgcaaacacaagtttgtggacatattagacgatcctggctccgctgatttgagtgcctacgttgattttgcttcgatcaagcgctccgccgaggaagcttcagacgatatctcggtccatgggccaatgacgcagtcccagttcctgggttctctcggcatcaacttcagggtagaagctctcctgcagaactgcaccgaggagcaggcggaatcattgcggacgggctactggcgactggttggagacggggaagccccgttctgggaaggccccgaggaccaggcggcacctgttggaatgggcaccaggtacttggccatggccattgtcaacaagaagcagggcacgcccattccgttcgagtgagggtccggctcgggcatagctttccccgttctgttggaatgtagcagcgttgtcgaggggttttgatgatcagatcagccaattcttctctgcttttcctcatctacacgcaaaacatggtctcgttattttgtgacggacggaaggagggtacctactcgactgaaacagctcataattgtgtcctatgccattacaatcgcaatgttcctctactgtcgaaatgtgcctctgcacgctattattcgagacgtgcagcccttgagaaaaaaaaaaaaaaaaaaaactcgagggggggcccggtac

SEQ ID NO: 2013 - DNA, 843 bp, Zea mays
ggaacctacgaatcaaagttgccctgtgagcagccaagggccttgcgttcttgcacagcgacaaggccagagttatctaccgagatttcaagacatccaacgtgctcctggattcgaactacaacgccaagctgtctgacttcggtttggcaaaggacgggccaaccggcgaccagagccacgtgtccaccagagtcatgggcacctacggatatgctgctccggaatatctcgcaacaggtcatctcacgccgaagagcgacgtctacagcttcggcgtcgtgctgctggagatgctgtcgggccgccgcgccatggacaagaaccgcccggccaccgagcacaacctcgtcgactgggcgcgcccctacctcagcagcaagcgccgcgtctcccgcatcctggacgaccgcctggccggccactacccgctgccggccgtccaaagggcggcagcgctggcgctgcagtgcctctccgaggactccaggaagaggccaaccatggaccaggtcgtcgcgtcgctgcagcaactcacagccgcccaggaccacgacgatgcccaccggtcgtcgcgcaggtacccaaaagatcaccgtcaggctgcggcgctcaacaaccggaatctgaacgctcatcgccgcctgtccgccttgcctctacccgagtgaactaccatattcatattcgatcatcttttgtatcttcacaaaagtagtatgtaaatccgtggtgaagacctgggtaattagtgataaaacacaacttgattgttgattagatgtaaatggtggcttcaacttaaccggtttatggaacaaaaaaaaaaaaaaaagggcggcc

SEQ ID NO: 2014 - DNA, 770 bp, Zea mays
cctgccgggattaccaaccctaccctgtccttcgttgcgcctcccatggcgtcgtcactcgctgccttccaccccactctttccccggaccaacccataacccatccgcatcgctgccctgcgcgccccaaccccaccaccggtctcctccgcctcctcccgccctgccgtcgcgctcgtgctcccgcgctcgtccgcctcgccgtttctgcctcctccacctccgccccgctccaatcggccgatcggtcggaggccgcgtcgtcgcttgagagatgcctcttgttgacgggggcggggatggaaaggggggcgatgccaccagcctcggccccgccgcgcgccgcgccagtgatgaaggggggacggaagcagcccagcacatttggagccgtcacgctcgagaaggccaagctcgatctctcccagcgtcgcaagaagatcatgcccgagctagcaaccggtggtggcggtggagatgttggaaaaaggatcggtcatggtgggggtgatggtggtgatgatgatggtgatgatgatgattactttgatgattttgatgatggagaggaagaagaaggtgggcttttcaggaggcatattgttgtacaagagctattcaatagagagtttgtagaaactgtgttgcaagaatggtgcaagacgatgagtaatttgcctgctggtctccaccaagcttgtgagatgggtttggtgagttctgcacagatggtacgttacttgacaatatttgcaagacctacaaacac

SEQ ID NO: 2015 - DNA, 1523 bp, Zea mays
cattgggtaccgccccgccggacacaactaggagagtggtggaggaggagacccaccgtcggctcgcccgtgtcccgattcccactcacgacatcaacctgtccccatccatctcgcccgcgacgtttgatggagtctctcctcgcctcgcgatccattaggtcttccttctccgccgtcgccagcaccaggggcgccgcttcccccaggccctcgcgcgtcgccaccctcgccagcgccggcgccggcgcccgctcccgcgcgctccgtgctggccacacggactcaatccttgaggtgctggcacaggacgatatgctgaacgcaaaggagctggtccaatgggagaatggcttgtcattcaatgacatagcggctaggcaggggattcgcatccgcagacactgccgccccactgcctccttgaaggagatagaggaggagctgggagccccccttaacatcctagagaagatcatttgggacaaggagattgaagtagctgaggggcatgctaagaagcctcttgaggaggtgattcaggctgcaacgaaagcccctccttcaagagacttctatggcgctttagaagctgcctacaagcgtaatggggtgcctgcattgattgctgaggtcaagaaagcatccccgagtaggggtgtgctcagggagaactttaatcctgttgaaattgctcaagcttatgaaaagaatggagctgcatgtttgagcattttgacagatgagaagtactttcagggaagctttgataatcttgaaaaggtgcgcagctcaggagtgaagtgccctcttctctgcaaggagtttgtcattgacaagtggcaaatctataatgctcgctctaagggtgctgatgcaattctactaattgctgctgtgctaccagatcttgacataaggaaatttcttcagatttgcgaagagttgggaatgacagctcttattgaggttcatgatgaaagagagatggaacgtgtgctgaagataaatggagttaagcttattggtatcaataaccgaagccttgagacatttgttgttgatacttcgaacaccaagatgttgctcgagaaacatggggatatcatcagggagaagggaattttggttgttggtgaatcaggtctgtttactccggatgatgttgcttatgttcagaatgctggcgtttctgctgttttggttggggaatccctggtgaagcaagagtgccctggacgagccattgttgggttatttggcaaagaactgctgcactgaatgagaggacaaagattgtagtagtacatggtttggtggtgaggtgttagtgctaggctgctagctgttagccatagcatcatttgcagtaatagcattggttttattaataataccaccgaatgtgacatgcagaataaaaataatgttcaataagttccattcagtgattttctttagttcagtgacaaaaaaaaaaaaaaaaaaaaaaaaaaaggacaccccaagcaccccattttgcc

SEQ ID NO: 2016 - DNA, 1388 bp, Zea mays
aggccggaactaggagagtggtggaggaggagacccaccgtcggctcgcccgtgtcccgattcccactcacgacatcaacctgtccccatccatctcgcccgcgacgtttgatggagtctctcctcgcctcgcgatccattaggtcttccttctccgccgtcgccagcaccaggggcgccgcttcccccaggccctcgcgcgtcgccaccctcgccagcgccggcgccggcgcccgctcccgcgcgctccgtgctggccacacggacgatatgctgaacgcaaaggagctggtccaatgggagaatggcttgtcattcaatgacatagcggctaggcaggggattcgcatccgcagacactgccgccccactgcctccttgaaggagatagaggaggagctgggagccccccttaacatcctagagaagatcatttgggacaaggagattgaagtagctgaggggcatgctaagaagcctcttgaggaggtgattcaggctgcaacgaaagcccctccttcaagagacttctatggcgctttagaagctgcctacaagcgtaatggggtgcctgcattgattgctgaggtcaagaaagcatccccgagtaggggtgtgctcagggagaactttaatcctgttgaaattgctcaagcttatgaaaagaatggagctgcatgtttgagcattttgacagatgagaagtactttcagggaagctttgataatcttgaaaaggtgcgcagctcaggagtgaagtgccctcttctctgcaaggagtttgtcattgacaagtggcaaatctataatgctcgctctaagggtgctgatgcaattctactaattgctgctgtgctaccagatcttgacataaggaaatttcttcagatttgcgaagagttgggaatgacagctcttattgaggttcatgatgaaagagagatggaacgtgtgctgaagataaatggagttaagcttattggtatcaataaccgaagccttgagacatttgttgttgatacttcgaacaccaagatgttgctcgagaaacatggggatatcatcagggagaagggaattttggttgttggtgaatcaggtctgtttactccggatgatgttgcttatgttcagaatgctggcgtttctgctgttttggttggggaatccctggtgaagcaagagtgccctggacgagccattgttgggttatttggcaaagaactgctgcactgaatgagaggacaaagattgtagtagtacatggtttggtggtgaggtgttagtgctaggctgctagctgttagccatagcatcatttgcagtaatagcattggttttattaataataccaccgaatgtgacatgcagaataaaaataatgttcg

SEQ ID NO: 2017 - DNA, 1125 bp, Zea mays
cctcgaggccggccgggatgcaattttatctctgtgcgagtttacggaccagacccggaccatgagaggagggatatcgtttttcctctttagtcccagataactcttgtggtacacatcgacgcgacactctgacacgctacggcctctcggcggggcccggcaacagaccgggcagcagcacggcagccatggcgtcgagttcgaccctggatttggcgatgggccccggcgccctcctcccccgcagcgcggtcccgtacgcctccttcgctccaggaaggggaaggagcgcgagcggaacgaggagcaggaatctggcgctctccgcttcctcctccaacggtgcagcagtgccatccctgacaacagattcggagaagaagggcccagtgataatggaaattccactggaccaaatccggaggccactgatgcgaacgcgggccaatgatccagtcaaggtgcaagaactcatgggcagtatccgtgtcatcggcctccaagtacctattgatgtgttggaggtcgatggggtctattatggcttctctggatgccaccgctacgaggctcaccagcgccttggtctcccaaccatccgctgcaaagttcgccgtgggacaaaggaaacactgaggcaccatatgcgatgagttatattttattcagttacaaagtgatctgtgtatctagagctaaaacagaagcttccatggtcttttcgtcgtctcgtctgcaattctccatacctgtaaatgttgtccaaacagagtggtgaatagtacttctgtacccagcagcatcagaaaatgttaattttgcctacaacactcttttcgatcagtggatggatgagtaccacccgctcagtagatcattccatttctacgagatttttgtaaaaaaagaaaaatgcagcagcagtcggcacgctgtgtcatttagatcatctagaaaaccagaaaaaacgagtcatgtaacttgtttggctcgtgcaaaaaaatattcaaaaccaagtttgcttatactggatgctgatgtgtcatgctatgttggggcacactaatgaaagtttggagatttaagttatatgtcaagtttgagagctcaaatgttaagttt

SEQ ID NO: 2018 - DNA, 2533 bp, Zea mays
ctgcagattgatgtcctggaggtcgacggggtctattatggtgggtactctaagattccagaacgaattagtcactcgtgctgtcactatttggaggtctagatccatttttcaggtcctgaatatttttcaggcttctctggatgccaccgctacgaggctcaccagcgccttggtctcccaaccatccactacaaagttcgtcgcggtacaaaggaaacactgaggcgagtgcatcttaccttcagcttggattccattttgaattacttgatgcactgaacttcagtttgaaccatatgcgatgaccgatgagttggattttattagtggctacatcagctacaaagtggtctgtgtatctagagctaaaacagaaccttccatggtttttttgccgtctgaaattctctacacctgtaaatgttgtccaaacagagtggtgaatagtacttctgtacccagtagcaacaggaaatgttaattctgcctacaacattcttttcgatcactggatcttccatctacacgaggtcgacttggccgtggagcaggacgcggtagagaaaacgctgtagggggagaggacacgcgtcagccggcagagggcagaggtcccgtgttgcgcggggagagcttgaaagggagtcaggtttataatatctccgatatggaaggcggtaaaacgaaatcagaagctggtgtgtagagaaattaaaaaatagctagagaaagagaacactacatataattgacaggaataattgtccatataagagtaccagctgttaagctgctgccaatgctaacccagcggaacacacatacgccatagaacagaagattcacagagacagaatgtagctaaccaacttgtcaatggcaacctgagaagacccagtgctctccaagcagcctgctagtttcgcgcaaagctcttgcgctgctcttctcatctcagctccctcccgctcacccatcaacttcctaaccgcgtccttgatcttccccctctccagctccccttggagctcgaagccgacgccccagacgtcctgcaagtacctcgtgttcatcatctggtccacggcgtccggcctgcagatcatcgggaccccctcgctgaccgcctccagagtcgagttccacccgcagtggctccagaacccacccactgcgcggtgggccagcacctcctgctgcggggcccagcggaccaccacgcctctgcccttgacggcgtcctcgaaaccatccggcagctgccgcgcgctgtcgacgtcgcagcctcgtaccatgttgggccggacgacccataggaaggggtggccgcactccgccagaccccatgccacctcccggagctcgctcgagtccatggccgccaggctcccgaagctcacgtacagcaccgacccgggccgctgcgcgtccagccactcgatgcagctgtggtccggggcgagcaagctgctcccggcgcccctggaggaggagagcttgtggagtgggccggcggcgagcaccaccgggaggtggaccagctcgtcgcggagcctccctagctcggctgcctccagtgcctcggctgtgttgatgacgacgccggagcaatctctcactgtttcgctgccccgggcgaggactttgcgcatcagctcgtggtcgctgtgcttcgagtagatcaggtccttcactcggagtggtggcagctccggcaccggcgtgcacagctgcgactcttgcggaggcagatagcccttttcgtggagcatggggtaggccaggaagcagccgaggcaggcggcgctcccggtgcgcagcaccagcgtgggcagtccgagcgccctggccgccctgtgcacggcgaggaggttggcgtcgacgaagaggcacgaggcgcggggccgcccctcctgccccgcgaccgcggacgcccgcagcgcctccccgacggccggcgacgcctccatggcggcgttcatggccaggatgatgtcgatgatcctccccgtggcggcgacgtcggcgggcgtgccgtcggggacggccacgaactggaactccgggtgccgcgcggggtccaacgcgttgaagcgcgtgtggagcacggtcaccgcgaggccccgcgcgtggagcacgcccgccaggtgcagcatcgggtcgatgtggccctggaagggcagcgggaacaccagcacgcgccgcgcgcacggctgatgaccaggggcgtcgccagcttcttgggcgccggccattattgctaactgtgcgctactgctgatggatggacaaacaagagtgctagctagcgaacacaaggtatgtagcagtcacgcgcacgcaatgaagccatacggttactataaaaaaggctgaatgcctgtcaagaactagctagatcgttttttttgttgttgttgagagcaagaacactaaaaacctgatttttatcggctactcctatattttccacacgtcattaaaaaatacaaagagaaactgttttatcaaacaaatttaaaacaactct

SEQ ID NO: 2019 - DNA, 2030 bp, Zea mays
  misc_feature (2026)..(2027): n is a, c, g, or t
cccacgcgtccgaacatggccaaagaaagaggggcccaaattagtatctccttggcaattgaatgatgaaattgagtagcaatacttctttttaaagaaatcttttgatgatggtggctcatgccttggcccttttgaacctccacccgtaataggggtggtaatggatcgcgatccaaatgttccttcacaaattcttaggtccttaaataaattttagttcaaaaatgaatagaaatagagcccgaacctaatccgagccttaaattttatagtgtaaaatttagagtccattgtcacccctccgtacacagctattactaatttgttgctgtattgatcatagcatgttttgacctcaggctatgcatgaataattgttctgaatcttgtgcatgttttgacctccagcagaggtttgtaccactttaatttagcagtttattctacatttgcttatgaacggacttggatagctattgtgtaggaggagattagcatggtgtaagaggcctgattttaatttatcatcaaatcaagtttatgtatcaattttgtttgcgtatctaaatcctaccatgtcatatatctgcagatgcttagtgtgctggaaagtgcaataaagcgagactacttatcatcaaactttgaaacgacaactgagttgcttgattcaagcacaccagattttgctactcagtattcggctggaggttctggatctgccactgcacttccatgggttcctgacactactgctgctgtagccttgagattgttagacttggatgcttccatctcatacacccttcatccaaagttgggttcaaataaggagcaagaatctggagatttcatgaaacttccaccgagatatccttctatgaataagggcaaacaagaaatagaacagttcaggcctattggttttgatcaacaggatggaacgttgctacctaacagcaatggtcgtagaggtcggggaaggggaggtagaggaggcagcaggggaggtagatctcgtggtcgtggtggtagggttcccagaggtattggcagctcttccaggattcagttcagggatgacaatagtatgctctatgggagagccccacgaaagaatgcacgtggtggccgcggccgtggacgtggacgtggacgtggacttcgaactgttagacctcggcaaccatccgagctcagtgccagatcaattccaaaggcaaacctattgggcagttttagcatgttaagtaagacaaatcacactggcactacgcattctcccgagagctcaggtgcagaagagtgggcctttgagaggagggaatatgtgaaggatgatgagaacaatttggtctctcaatccgatgagtctgaggaaaatgtcgaacctatgaatgaggaatatggtgagcatatttcaggctatccaagagacaattccgactccagacccgtacagatgatgggtgatgggagcgacgataatgatgaggatgctgaaggagatgagggtgaggaagatggagaggactatgaagctgaagatcctggtgatgaggatgatgacgttgagatggatggggatgatgatgtcgaggtggatgaggatgatgacattgagatggatgaggatgatgacattgaagatggtgatgacgacgacggtggagatggagcagccaacggagatgaggatggaggtggtacatcatcatattcttcagagtatagtgaatgatgagtgattgaagttgtgcaggcttgtggtaaatgatgtaacagaggctttggtgggctcaccaacgctaatgctgacttgaaaaactatttaggaggttgccagttctaaactgtcttgtgtggcttgttattagatagaagccactcaacattagaagatcggccttgtgtgtatacatacataccaattatcaaaagttgaaaatgagggtcgatcagctgtctgttttatgttcagctacttttttcattgttatatattgggagcgttctctttaannaaa

SEQ ID NO: 2020 - DNA, 2170 bp, Zea mays
cattgggtaccccgcggccggccgatttttccaaaacaaaacaaccccaagtccccaacccagtttcaaacaaactagatccgcggcgaccatgcggcgcggcggcggtcgccggttccccaagccctccttggcgccctccaccgcggccgaggccaccccggcgctggacgccagcgtcatccgcaacctcgactccgccttctcccgccgcgactccgacgccaacagcctctgcagcagccgtcccgcttctaccgtcggcgccatcctcaacttctccgaccgcgccacgcaggtcgccgcgctccgcgtcgtcaacacattcctcgcccccgccgtcacgctccgggggcctctgcccgccgcgcgcgacatccaggcggcgctccgcctcctcgtcgaccgtctccacttgccccgcaacgacgccacattcgatgatgacctcatccaggaccttcgccttctcgggtgcccctacaaggtcacccgctccgcactcaaggcccccggcaccccgcactcgtggccggtactgctctccgtactccactggctcaccctcctctgccactcccaaggagacgacccggatgccccgagcggcccatccgacgatctcttgctctacatcacccagtcgtactcccacttcttgtcgggggacgacgccgccgtcgaaaccgtcgacgaggagtacgcctccaaagcccggatgaccggtgaggcgtacgttgcaacggctcgtgccctggagaaggaggctgaggaactggagacccaggtgaataagctcatctcgggtccctcgcggcgggaagcactggagtcagagaaggaggccttcaatgctgatattcacaagttcgacgcagtggtgaatgcttggaaaactaagttcaatgaaagggaacaatcgttgggggatttggagaaagagttggaggcaaaagtgtcggacacccagcgcgctgctgctgaaattcaggatctattgaaacaagtggatgctcagccggtgaatgtgaaggatgtggatagaatgcgtagggagatgcaggctattgaagatgacattgccaacgccgagaaggggaaaacagcactggaggataaggtctgggaacttgaagctaagctggttaccaagcttgaggagcttgagaggcatgctgagcagtgcaaccaggccctcaaaaagttgaaacctactgttgcttttcagtacatgatagattcaaaaggatcttctcctgctgagatgctaggtactggttacaaaacagtactaaaacctgcacttctggctcatgctgaggagaacaaaaggatctgtctctcaaatcttgaaaacttaaatgatctacagaagcagctgcaaggaaatgctaaggttctagaggaggaaaggaataatatttccagtctccaggaaaaaaatgacgaaatcgttgctcgtttgaatttactggatcgtgaaattataaatgatgactcaagattcacatctgaagctgcacaaatgaaagatgagttggagaaaaagaagaatagtttgatttctgctgaaaagcaggcagatgattttcttaagaaatcggagaagaggctccaagatgtaacacttaaagttgaagaagaaactcaggcagctgctaaggagctgctggagcttcttgattccatggctgaacataaagagttcatggaaacaacaattgctcagaggaggaaggacctctatgaaactgcagattatatagcatctgtggcatccaagacagtcatcacccaagtaccgaaccctgctgaatcctgatacctgaattatgcagtaatcttttcgcatagaaagttcatcatagcaggcctgcctaccgtggcagccttctctggcatgtaatataagttgaagttgtcccacttgaagctgtggtcttttttggccttggactttggtttgcgttctggtgaggtagtagttggtatgttcgggcttcaatcctagatgtcatgaaactgttgtaatttcattgcttcagtaatgaactttggattggtcctctgtgaaaaagtacccaaccctcttggtgtttgtttcagctttatgaacccgcttctgctttaccaaaacccaaccaagctcagtttaaaaaaaaagaaaaaa

SEQ ID NO: 2021 - DNA, 1004 bp, Zea mays
cagattcttgccaagatcgtggtcggctgcgacggagtgaactcgccgatcgcgaggtggatgggtttctcggagccccggtacgtcgggcacatggcgttccggggcctcgcggagtacgccgacggccagccgttcgagcccaaggtgaactacatctacggccgaggcgtccgtgccggctttgtccccgtctccgcaaccaaagtctactggttcatctgcttcaacagacaagatccagggcctaagatcacccgccccgcggcgctcaagaccgtggcgctggagctcgtccgcggctggccatcggacctcctggcggtgatgcgcagcacgcccgagggcgccgtggtgaggacgccgctggtggaccggtggctctggcccgggctggccccggccgcgtcgaggggcggccgggtggtgctggccggcgacgcgtggcatcccatgacgcccaacctcgggcagggcgcctgctgcgcgctcgaggacgccgtcgtactggcgcgccgcctcgccgacgccggcgcggacggggcccaggccgccgccgccatgcgcgcgtacgaggcggagcggtgggcgcgcgtgttcccgctcacggcgcgcgcggggctggtgggtgcgctcgtgcagtgggagaacgcggcggtgtgcgcggcccgcgacggcgtggtcatccccaggctcgtcaggctgggaccgttcctggagcacaccaacttcgagtgcgacctgctcgaaccggcgccggagtcgccatgacaccggcacactagctttctccggcacaatgtaactagtagtatattgattaacctcttcttcgaaagatcgattaacctctgattgacatgtactccctctatctcatctcaaaatagtatttattttagggtgaatttatacaatatttgatatatatgaatttaaaaaaaaaaaaggagggcggccgccgaatagacagctcgtcgcacccggtaattaccgtccgcggc

SEQ ID NO: 2022 - DNA, 1455 bp, Zea mays
cattgggacctcgaggccggccgggcggcccacgcgtttggattttgctccttgctcccttgatccatccacttctgaaagggtcaccatgtctgcctttgtggggaagtacacagatgagctgatcaagaccgccaagtgcctcgcaacgccgggcaagggcatcctggcctccgacgagtcgacgggcaccatcggcaagcgcctgtccagcatcaacctcgagaacgtggagtcgaaccggcaggcgctccgcgagctgctcttcacggcgcccggcgtgttcgactacctctccggggtcatcctcttcgaggagacgctgtaccagaagacctccgacgggaagccgttcgtggacgtgctcatcgcgggcggagtggtccctgggatcaaggtcgacaagggcaccgtggagatcgcgggcaccgacggcgagaccaccacgcagggcctcgactccctgggcgcacgctgcgccaagtactacgaggccggcgcgcgctttgccaagtggcgcgccgtgctcaaggtcggccccgcggggcaggggcagccctccgagctcgccgtcaggcagaacgtcgagggcctcgcgcggtacgcgctcatctgccaggagaacgggctggtgcccatcgtggagcccgagatactcaccgacggcggccacgacatcgggacctgcgccgccgccacggagcgcgtcctcgccgccctctacaagtcgctcagcgaccacaaagtcctgctcgaggccacgctcctcaagaccaacatggtcacccccggttccgatagccccaaggtctccgcggaggtgatagcggagtacacggtggcggcgctgcggcgcaccgtgccgccggcggtgcccggggtggtgttcctgtcgggcgggcagagcgaggaggaggcgacgcagaacctggacgcgatgaacaagctggaggtgctcaagccctggacgctgtccttctccttcggccgcgcgctgcagcagagcaccctcaagaagtgggtcggcaagaaggagaacgtcgccgccgcgcaggccaccttcgtcatccgctgcaaggccaactccgaggccgcgctgggcaagtacgccggctccggcgccggggacgccgccgcctccgagagcctgtacgtcaaggggtacaagtactaaagccgccactgctgactgtgccgacccaatccttgtgtcccacgtcgcagcgctcggactgtgccgagatatatgtgctacactagtgtttgtgtactaaattctcttctcttcgtccggctcctatttgagcaaaacatacacacacacacacacaacacgttgatctatttgcagctcgcaatgtacagtattactggaacataagtgcaatatatatagatgtgaccatcttacttaaaaaaaaaaaaaaaaaattggccgcccgccaccgcggtgga

SEQ ID NO: 2023 - DNA, 2432 bp, Zea mays
gttcggtcagcccacctgcttattcggcgggcgggcgggcgcagattgcactggagtatgtagtgctctctggttttcgcaaaaaagaaaagcttgctaatagtctggtcatggccgggttttgtgttgctacttttagctactgattgctcgctagcaaagttggtggcctttgtgtaagatggcactacctctgcatccttccttcctttcctacgctgtatctctttctttctttctgtgttttctttctttctttctgtgtgattgtgtgtggaattcggccgctcctcggctctctatatagcgacgcccggcccgcacacagacagctccagagtccagacgcctgatcggaaagcaacgtcgttgccccccccccccacctcgtcacgagtcagagagctacacaacaaccatcctgttcccgcccgcatacaggactctagctagctagctagcgttgttccgttgtggttgctctcgctcgctctcgttcggtcgatcatggagtggagggacagcttcttggacctggcgctcatcccgctcagcctgctcctccccatggcgtaccacgcctggctgtggcgcgaggtccgcctccgcccgctgcgcacggccgtcggcatcaacgccgccacgcgccgcctctgggccatcggcatgatgaaggacaacgccaagaacgcggtgacggtggtgcagtcggtgcggaacgtcatcatggggtcgacgctgatggccacgacggcgatcctcttctgcacgggcgtggcggcggtgctgagcagcacctacaccatcaagaagccgctcagcgacaccgtgttcggcgcgcacggcgagtacatgatggcgctcaagtacgtggcgctcatgctgctcttcctcctcgccttcctctgccactccctcgccatctgcttcctcaaccaggccagcttcctcatcaacacctcggcctgcctcttctcctcctccgccgactccgacgccgccgtcctcggcctcccgctgccgcccaccagggactacatcggcgacgtcctggagcgcggcttcaccctcaacctcgtcggcaacaggctcttctacgccggggtgcccctcctgctctggatcttcggcccgctcctcgccttcctgtcctccatggtcatggtccccatactctacagcctcgacgtcgtcaacctcatgggccacagcggatgcgtcgtcgtcagcggcaaatctgcggagatgaacggcgggagcgagtgcgcgcgtgccgtctgaagctgccggacttgtgtcctcaacaaaccatatgcatgcgatccgtacatgtgattcggttgagactgttgccgcgcgcaacggcctgtgatgtgtcgagcaccaaggagacggcatgttgttcgtcgtcgtcgttctctcattcatgtggggttataggctagccgcgcgccgtcgtagctgatgctgatgtactaggaaaaccttcgttgcatggatgacacggaacccataccccacgcggttcagttgctttgctgctcttggtgctcgacaagttgacagtgtgtgccactacaacacatattccaagtcggctttatctcttcctgtccaaaaaaaaaaaaaaaatagaaatgcaagtaaaaaaaaatatacatatatatatatatatatatatatatatatatatatatatatatatatatatatattttctttgccatggcggttcaagcagcagagagacagcaaaggttggtggccgctagcatgcgcgatgcagaattccacaatgtcagcgagtgcatgtcagctggcgtgtatcagggatgtcgtccattatattaccatgcccaaattcgatgacggatcagcacgcaggcacaaaccggcgcagcagggcccgtgcgcgcggcttcgaactttttttaaatatattttcgtaaggaaaatgtcaaagtataggtctggtcctggaaatcccaagaacagcgtgcgtgctccttatgttccagaataaatgactctctgatagtctgatatttaaaatttatctagaaaagaacattctacaaattatgggcatcacttttattttatggtactcgatgaacttgcacaggccaatgaggacctgggcctgaccgcctgagagtgaaaaaggcagcgagcctagagccgttctagatttcacacttgattgcaaccacgtcggcagccgcgagctgggtgtatgattcaccccgccaggatggctcactgaatccccagcgtgcatcaaatttggcttataacacgtaggtaacacaaattcaacagtttttttttcctctcttctctccaactttctcgtgttatcgatgatcccaatgagaacctcacgcgtcgtcacgtccaaagtcatcatcattcaccaacagaagcaactg

SEQ ID NO: 2024 - DNA, 1308 bp, Zea mays
ccggcctggcgcgcggcgccgtcgtggcggccagagtgctcacggggcagatgaacccagccgagggcgtggggctcgctaacaccagccccgcctcttcatgggcatgaccgccctccccattgggtaccccgtcaccggcgaggtcttcgcgttccgctacggccccgtgccgccgttcgtcacctacttccggttcgacccggccgggaacaagggccccgacgtgcccatcttctcggtgcagcagccgtcgttcctgcacgacttcgccgtcacggagcggtacgccatcttcccggagatacagatcgtcatgcagcccatgggcatggtgacgggcggcgcgcccgtggggtctgactccggcaaggtgccccggctcggcgtgctcccgaagtacgccacggacgagtcggagatgcggtggttcgaggtgccgggcttcaacatgatgcactcgctgaacgcgtgggaggaggccgacggcgaggagctggtgctggtggcccctaacgtcctgtccgtggagcacgcgctggagcgcatggagctcgtgcactcctgcgtcgagaaggtgcgcatgaacctgcgcacgggcgccgtgtcacgaaccccgctctcggcgggtaacctcgacttcggcgtgatccacccgggctaccttggccggcgcaaccggtacggatacctcggcatcggcgaccccatgccgaagatctccggagtggccaagctggacttggaccgcgccggcacgggcgactgcactgtggcgcggcgcgacttcgggcccgggtgcttcgcgggggagccgttcttcgtccccgacgacgtggagggggacggcaacgaggacgacggctacttagtgtgctacgtccacaacgagcgcaccggcgagaaccagttcgtggtgatggacgcgaggtcgccgcagctggacatcgtcgccgaggtgcagctgccagcgcgcgtcccctatggcttccacggcatgtttgtcacgcaggccgagctccaggcgcagcagcaatgatcaaagcaccgaacactcgtccagtgtttacgtgctggggatctgtagcacatgattccaggagaaacacacacaaacacccatcaggtgcatactgaatagattgtagtaagaacaactctaggccacatagcattcacgaattatattgtagtgtaaatgtagcagaacccataaaagagttcatgagtagaattgatacgaaatcacaaaaaaaaattattggaatagaacaatgttcatcagaacgctcgcgatctaggccgcct

SEQ ID NO: 2025 - DNA, 1204 bp, Zea mays
ttgggtacctcgaggccggccgggagacactctcggcccgtttcagattcgtgacgtactccctccctccaaccacgcccggccagccaaacttgccatggcgctgccgtcgtcctcgacccccaccgcgtcggctccggcctccctcggcgagcggtggccgccgctggagtctacccccgcagttttcaaccagttcgtgtggtcgctaggtgtcccggaggacgacgtggagttccacgacgtgtacgggctcgacgccgacgcgttggatatggttccccagcctgtgctcgccgttgttctctgcttccccgacccaccacagcatgcaagttacccttcagaacaactcttaatttctggagaaaaggaaacacaggaccaggtttactttataaaacagatcgaatcattgggaaatgcttgtggaactattgctctactccacgctgttggaaatgcatcttccaaagtcaatttagtggagaattcatgcttggacttgttcttcaaatcaactgctaccatggacccatatgagcgtgctgtgtgtctggagaaggatgatacaatggcaagggctcatttacttgctgccaatgatggtgccactgagctcagtgatcttatagaagagcactacgtttgttttgtgtatgtcaatggaacactttatgagcttgatggaatgaaggatggacctataaagcacggaccctgttcttctataagtttgctgcaggatgttgttcctgttattaaggccatcatgtgcaatatccccaactcaatcaacttcaatcttatggtgctgtcaaggaaagaaaaataatgctggtgctattccttgagctggtaagcggtggaatgcaaaatgcaagggttcaagggaaggggattaaacggatgcctgtttggactgcagctgcgtcactaataagttcagtggatgcaaacattttttcctggtgtgtttgctatcatatctagtcgagtgcttgactacattcatctttagtgttcgcaaagcatctgaaaacttgtcttaggctctatttgtttccttccaggattatataatccagcttatacattatatagaccccgtttgttttcttctaggattatataatctaccttatagattatataaacacataatgatctacttataaattattacaaaaaaaaaaaaaaaaaa

SEQ ID NO: 2026 - DNA, 1189 bp, Zea mays
cgtgctgcggccttttacttgcaattgcttgagcaatgtgggcaagtgcgacactatagatctcaaaccattcaggtggtatgctattcggtgttttagagaagaaatccatctgctcagctgatgtcatctgcaagaaagcctcattcatgaaggcctcacgagaaaatcctcctccaacagtagcaataccacccctgccaacactccacaatatgttttttgcaccttgcagaccttcttggcgtttatttttatgtttttcatcagtaggaagagcaagaagctccaatacacaacgaggtgtaatctcctccaaagtttcatcaatctgtgcaagcagttcaggtgcaagattgcttgcaccatcctcctgcaggagcttcagtgccctctcaagcacctcacaacagcagattacatctggagggcttgctgccatagcatcccttgatatgtccacataagccaatgccattgctagcaccacatcctgcttgaaccgcttaggtggacggtcctgaagcaagtgctctccagttgctaacaccagttgtgcctccccagcctcctgaagcacacacagcacacctggaaccttatcccaggcaacatccatggtgagtgccgcatcacggtcctcggaaagcgcacggtcgtactcggtgcgcgagctctggtttgtgagagtatcatgggcaatctgcagcatttgccgtcgcccaacaagagcttctgtgctgtacccatactgaggtggcttagctatccgcgactcgaacgccctccgaatgccatcgcctaggaaatgtggctccgcaccaagaatcttgtagaagtcgaccgggaggggcaaggcgcggtcggcggcttcggggaagatcgggacgaacggggacgaggaggaagaggaggccgcggctggcgggtcggcggcggcggggaggaggtggaagtcggcgaagaggcggtcggcccagcggctggcggcgcggcaggtggaggggccaggcggtggcggcctgtggctcctgcggaggggcagcggtgagaaggcgaacggcgcggagttgggccgggccaggaggctgtgaacgccctccattgccggcgggggcggcgagccgcgagcctgtgagcgagatggtggattatgcacaggacctgccagactcccggaccggccggc

SEQ ID NO: 2027 - DNA, 2987 bp, Zea mays
agttttcaaagacggcacagccaaagtgcttctcaactctcaagcaacatgtgtgtgttggggattgtttgggacaaaccaacaaaagcgctagccagctataaagatggaaattttgggacctcacttcttgcaatgccgtgacagtgtgttctggccccaaagcccttggacttgatgctttgccacctgcgaacaatgtcttcagccaacttcgcgtccatcctagggatttccagtggctcttcatctgccgctggaccttcaacaaacaaagatggaaggattaatttccctggccagacgcacgtttaacaaataatacggcttctatgagcattttatgtgtgcacttctatgatgtgcattacatatagaaataggaagtgttatggccctggacacaatttatgtggaatatttgctacgcggctttgtcaggagcatcaagcaaaacccagtgactttggagaaagtaatgctatctgatacaggtttactcaccatcaatggagtcaacaaccgccacagacccatactcgcccctaagagcaggaagtgacttgttacgaggcaagcacttgagacctaacactgcaaatagtgcaagcagtgtaccagcagagataatcttcaaggcgtcatttctggaatcatggatagcgtctccagcaacacttccttgggcgagtttttcaagagatttatcaagatcatcacttgggatatccttgcctgacatgtctagctgttctgtcaatgggaaaaccttactgaaagcttgaagagcacttgattttacagtaccaagcgcagcagtagcttgagcaccaagttttgctatagcggcagctgcagctaaatgggaagcaccaccgccttccatcctttctaagtagcttagaacttttgggtcgtcgtaatagtctcccagtctgaactgcgtccctcgggtatctctgctccttgggaatacctcggagacaagccatgtctccaagagcttgcacagccctggaagaagatcattctcttcgttcatgctagagttattcaccacaaactcgataattttggggtccctatatgacgaggactcattatcaattccaagccacattctgcaattgcaaatatcccccacaagtaacgagcagagtgccctttctaatgcgaggtccatctcgttttcataaggatattgagaacctatattgaacttctgaagttgttcgaagagttcatctgccatcatgatgaattgtggccttttacttgcaattgcttgagcaatgtgggcaagtgcgacactatagatctcaaaccattcaggtggtatgctattcggtgttttagagaagaaatccatctgagatataaacagaaaatgagtgaagacttctaaaaactgtgttcaagtaaaatggacagactacacactacagtatgttgctcattaaacttggtagacacaaacctgctcagctgatgtcatctgcaagaaagcctcattcatgaaggcctcacgagaaaatcctcctccaacagtagcaataccacccctgccaacactccacaatatgttttttgcaccttgcagaccttcttggcgtttatttttatgtttttcatcagtaggaagagcaagaagctccaatacacaacgaggtgtaatctcctccaaagtttcatcaatctgtgcaagcagttcaggtgcaagattgcttgcaccatcctcctaaagtaaaatgtttccattagtagtgcttaccaagatatctctaatcaagacagaacctacaaaaccttcacacgctgatctaataacaagtgaaaataaactgacagctaaaaatgcagcagacattttttgtgctagcagcttgcaataatgggatgataattttaagaataagaggagaaagagaaaaaactagagcatttcattatctctatacagcagttcctaatagtttcataccagattggttttacagtgaaacagtattaatggctgtgccatgatgtagccaatggtttcaggctttttataactgatactgatgcaaggcctactgagatctaaagtgcagtgagaagtactattgaactaatgcttacccaaagtgattttgtttaccaaagaaaacaagtggtaatcggtatcaacagcaaacaattatataaaacctggagcatgttcatctacaaaatatggtatgtactgcacacatatttcgccctaacagtgaacatgtcacattaagattaaaacaactgtatgtacacagccaccttaagacatattggatctgcaaccttaaagcaagttagttcacctgcaggagcttcagtgccctctcaagcacctcacaacagcagattacatctggagggcttgctgccatagcatcccttgatatgtccacataagccaatgccattgctagcaccacatcctgcttgaaccgcttaggtggacggtcctgaagcaagtgctctccagttgctaacaccagttgtgcctccccagcctcctgaagcacacacagcacacctggaacctgcttggcaagtttccggagagaggcagcaacaagttacacgccagcgctatttacagattctacaagaaacagatagcattgttcgcacgtttgctgtcccataacctcaccttatcccaggcaacatccatggtgagtgccgcatcacggtcctcggaaagcgcacggtcgtactcggtgcgcgagctctggtttgtgagagtatcatgggcaatctgcagcatttgccgtcgcccaacaagagcttctgtgctgtacccatactgaggtggcttagctatccgcgactcgaacgccctccgaatgccatcgcctaggaaatgtggctccgcaccaagaatctgagcatatagacacccatcagatcacttcgcaaaatcaagcatgcaagattgcaggttattatgcttatcccagcca

SEQ ID NO: 2028 - DNA, 3191 bp, Zea mays
cggcttcggcagggtgtaccagggcgcgctggcgtccaagacggaggcgcggtgaagaaggtggcgcacgggtccaggcaggggatgagggagtttgtggccgaggtcgtcagcatcggccgcctctggcactgcaacctcgtgcagctgctcggctactgccggcgcaagggcgagctgctgctggtctatgactacatgcccaacggcagcctcgacaggtgcctctacgactggagcaggaccgcgctgagctgggggcagaggtttcgcatcatcaagggcgtcgcgtccggcctgctgtacctccacgaggactgggagcaggtggtggtgcaccgggacatcaaggccagcaacgtgctgctcgacaaggagatgaacgcgcggctgggtgacttcgggctggcgcggctgtacgacttggggatgcaagttacccttcagaacaactcttaatttctggataaaaggaaacacaggaccaggtttactttataaaacagatcgaatcattgggaaatgctcgtggaactattgctctactccatgctgttggaaatgcatcttccaaagtcaatttaggtgacctgaaacgattatatgcagcacacagaattctataagatggttgcaatctttcttgttctctccttgtttctgaattgaattaacctatctggtctgcaaggtgatacacttacactgatgatacttattgttgttgttttctacatgcactgtcagttgagttagtgtctctgccatatttgataattgtttgcttagtgtctgatatcccactgcaaactactgtttgcttgtattaagtgatttgttttctatacttccacaaatattattgtcgatgtgtagctttctgtagccctatggctgaaatattcatctatacaatttagtacacatgatgattcacctttgtagattgcatgatgttacttatggtgatgattctgcctctttcacttgcagtgttctagaattagttgatgttgttgtgtatccttcatttctagaaccagtcaaggaaactattttgagggttcacagtgtgaaggtagaatttcagttattccctaaaatttagtttcttctcagtcagttctatatattttaaatgcacagttctgtgaatcttcctaggtcaatcttcttagagatgctttgaaaggacaattttgttttttatgtatccataactaagagatcaaacctcagacttaatataagttataaatggagtacacatattactttatcactgtcagggtgcttcttggtgttttttctttcattcatttgacaagttataaattggttaactgatatgatagttgtgctactgctacactagcaataatgtagctactataaagagatagcatataacttggttataatcattttcttttttgtacaaagggaaagcaaaatatagtttaaagaccagaaattaagtttgttccaccatagctacagaacttcgttggtgcaaatattttactgcacagttaaactgtagaagtagaatcttttctattttatctgtaaacataatgaataacatggccaattatgtgaataattaatgatgcacttgatagatacatgtttctttgatttttttagtgctgcatagattgcccgaatcgcacaaatgttgcacaatatgcatatggtctttctgcttttgggaggcaacttcatgcaatgggactgacagatgcttcagaaatccaccctgatagagtatatattttttctgtttcttttttttgcaattttgattatcttctcaccttctatctcaattgcagcatttgggcagtcatccacaagcatatttggccacaactcgtttggagcttcgtagggttagtattattgtaaatttttcgagcatgtttggacaactatcccattcaaatggtttacctatgtgatatatagaatttgtagcagcgcacgagttgttcgaaggctaaataattgtgtcactgcaccaggcatgactgactttgcagagtcattgtcttctttggctctctccttggcaagatgtgttactgccattcacatatctgttgttcatagtaaattgtcttgaggagatagctacggtgaaatattctctattttgttccagctccgtaaagaaggacgaagttgttatcactgttcagtttcaacaatgcatcaagatcctagcgaacaaagtttatttactaacacaacagagtgttgagctgctagaacgttattcagctatgcaggcagtacatggaggtatcacaaaagagttggatttgaagaaagtgcttattagtaatctctacaataaactttaacaagaaaaataggtttgtcttggagttttgttactccaatttctgcatttggcaatgaattcccatggtttatggatataaccatttacctttttgctatttatgctaacgagcaaatttgctatggtgtcccatggaaatcattttaacagaccagcaaggagaagatatcatttggtcggttcgaagtctatgagctcgctgtctttttctaaaactctgctgggcactatgtggcgatcaaccgaaactgctcaaactactacttgtctgaggaatccatcgccatgttcaccgagcaccaccggcagcaccctaccagggggttgtgagtactttgggtgactgttgccatgctgcctaatgcttcctgttgaaacaaacaccttcatgatcctgatgacaattgtcggctgaaaagaagggagaaaactatcaactatatatatatacacactgaaatttgttactatacgctcaattctcagttgctttttcaagttatgtttgtatatatgatcaccttcacggtgtaaatagactcgactactgacgctaggcatctcttcattcaagcagactgaatattcttttagctagcatcgcattattgttccttcaattggacctatcttttttgaaaaaatcttcattagtagttctggcttatagtagttcagttaggcctcctttgccaatgctcctagagtaggcgatcctctattggagacctctgccgaatagaagtgatactctgctaattctgtgaactgaaaattctgtgaagtgaatatctgaaataaattatgaggttgggagttg

SEQ ID NO: 2029 - DNA, 1466 bp, Zea mays
aaaaactctatatagagatgatgcaacaatgttctctatatttagagaactgtttagaagatgttgctggagacaaaaaaaaaagagaaatcttctctaaaatttagagtagatggcgctttaaagacctgccggatagagtctaagcagtgaccttgtctgtcgttgtgttgtggtaagcagtgatgcactgccgccttcattaagatcaatcgtttcagaggatctgacccagcaatagtaacaccaaattatctatcaataaaaactacatgacaaatttcgacctcaggagctcatcactcagcaacctaaccaagctttctagtactggaacgagccagtgctcacactgtttatttacacacgctgccaaaagaaaagaaaagaatgggaatcgagcttaccgctactcgcctactcctgctgcagctgcacaagcacagccgttctacctacgacctgaggactgcgccttcggtgatcctccaccctgctggcctggagtaggtcatctcgtaccgggcggtgtacttggtgtcgtacgcgtcgtcgttcttagggtcggtcacgtcggtaagccggcccacctcctcgatcgtcgcctccaccgctgcccgccggccgtccacggagacggtgatgctgtcgatcgtcacgccggagagcgcgtactcccagaaccagccgtggcgctcgatctctgcagctcggtccgcccacaccttcagcatgttgccgccgaggacctcttgcaatgccgtgacagtgtgttctggccccaaagccttggacttgatgctttgccacctgcgaacaatgtcttcagccaacttcgcgtccatcctagggatttccagtggctcttcatctgccgctggaccatcaatggagtcaacaaccgccacagacccatactcgcccctaagagcaggaagtgacttgttacgaggcaagcacttgagacctatcactgcaaatagggcaagcagtgcaccagcagagataatcttcaaggcgtcatttctggaatcatggatagcgtctccagcaacacttccttgggcgagtttttcaagagatttatcaagatcatcacttgggatatccttgcctgacatgtctagctgttctgtcaatgggcggacccgtcggaaagcttgaagagcacttgattttacagtaccaagcgcagcagtagcttgagcaccaagttttgctatagcggcagctgcagctaaatgggaagcaccaccgccttccatcctttctaagtagcttagaacttttgggtcgtcgtaatagtctcccagtctgaactgcgtccctcgggtatctctgctccttgggaatacctcggagacaagccatgtctccaagagcttgcacagccctggaagaagatcattctcttcgttcatgctagagttattcaccacaaactcgataattttggggtcactaat

SEQ ID NO: 2030 - DNA, 5941 bp, Zea mays
ttatgttgctatctgtttattttcagttgttccataataatacatgtttcatgtttatatgcttattatatttatatgattcatatgtttcatgttctcttgatccatattgttatggatatatttgagataatgatttctatgattaaacatattttatatgtcatcatcataatgttaatttatggaattaaaataatacggaaaatgcctatatttctaacaaaatatggtattagaaagtacatattgtattaatatttactataagtttcagcagattgagattgtatactctagataacgatgtttactgtcttcaacatatcatgtacatgatcatataaaatactatactattctacataataaataattataaacagtagagtttgaaatagaaaatcggtgaagacagccttacgctgacactgtcacttacactgaacacctcagtgcacgtgccgtctctgcaacgattagctgcatcggtcgctagccgcccctgtcggcgtacgtatcggcagcgagccaatgacacacgatccatcggctttatatacgccacccgctgctgctctccggtcctcggctcatcagtattattattattattattattcggctcctgctcctcgcctgcagcagtcgtgctccggaccggagaagtcgaaatggaggagaggctgttcgccacggagaagcacggtggccgggcgctctacaggctccacgccgtcacggtgttcctggggatatgcctgctgctctgctacagggcgacgcacgtcccggctgccggctccggcggcagggcggcgtggctggggatgctcgcggcggagctctggttcggcttctactgggtcatcacgcagtccgtgcgctggtgccccatccgccgccgcaccttccacgacaggctcgccgccaggtctgtgacttgaccttcttcgtgtgcatgcacatatacaaactattttgcttgttgcacgtccagtcatttttcaaaggaaggctaatatgagttaataatgaggctaactggtggtcatagtccactaactctctctatatattagcttaatacatgtaagtatcacacggtcacacacccctataagtacatagaaactagcagttccaacaacatcttatgttacaaatgtttatataaaaaaatataggacacactataaagtgacctaaatacaccacacctcatattaatgtcatattcatattttctatatcattatcaacatttttcttttctaataatgcaatttactttcttaaatacatgatatagagcttaacgattggagctcaatttattttcagtgccctgaacactttaaatgatgtagtattttaatttttgggaaattatttttgagacacctatttggagatgatctgcacatacactctcgtttcttgagggtttaaacccatgactcttatactccctccattccatattaaaattcgttttagttaattaatcggtttatacaatatttagtatatatatgtttaaatctatcttcaaatatttgaatatggacataaaaattaagagctaaactaactacgaatggatgagtatatattactaaaaaatgaattccaaacgatggtcgttcacaaggtgagccgtttctatacatgagctgggttcggaatgtggactgtggaagctagaagttgcgacagccgataggctgtgggggcaaacaaatctaagtatgaaaccgtgcgtgctacagactgcaggccgcaggcacgcaggaggagcagataagatagactcgtgcagtggcgatgcatcagctgattggggggtccattcaggtccttctgcagcatatataagcgccgcgtgcagccaaattaaaacgatggatatggcacgggttcttctgactgcaccatgcctgtctgttttgttctactgactactgcctaagacgtcgaggccaaggccactgtgtagctcgcgagattgtttactgcagaaggcagttgggccacgtgggctctatcgcacgccttggtgtgggggttgtcgttcagcgctacggctgtcgacgacggtgcgtttcaatgatgccgtcggcgacggtggtgctggtggcctgtgtggctgtggtgtcacgggtttctaactctagcgccagttgcaccaatgcttttagggctcgtttgggacataggagtttcccccccactatttcatgtgttttgctacgaaaataaactgatttcagtgaaattcgtgtatgattcacctaaaatttctgcattccaaatgatacattattagatttggctccatgcggcccacaccataggatgtgacttgaagatggtgtccttgggcgcatgttctcttgaaccatttattttcgaggaattaaaatttattcaataaagtgatctatttgggttattggaatttaacattttatcactttttcagatataagactattttaaattcatgcggtggaggacgtgaaatgatattatgtattactagaatatgtttctactctgcaacttacacgacgcacttcgacttattttctctgccgtaaaatgtattttaaataatagtatacaaatatattttaaataaaactatattagcctaaattagtatcgttagaatggaattcaattccagtaaggtgcgtcccccttcgatctccgttggtccatatgaaactgaagctaattaataaagtcaagacaccatccaacaggtggtgtgtgtgcgtcgtaatgcctgcgaggaggttggctgctaaacccagccagagcctcctatgatactgtccaggcacaaaatatcctttggtgatgcacaagtcgggccggggtcacgaacatggcacagagcctggactcagggtttcggcataaactataccatctttgctgctccattgtcggcctcaagctcggacattggctgatactgctttgattgccgtcgtacgttaacattattggtatcatgtcggagcaggttcggagagcggctcccctgcgtggacatcttcgtgtgcacagcggacccgcggtcggagccgccgagccttgtcgtggccacggtcctgtcggtgatggcgtacaactacccgcccgcgaagctcaacgtctacctctccgacgacggcggctccatcctcaccttctacgctctgtgggaggcctccgccttcgccaagcactggctcccgttctgcaggcgggccggcgtcgagccacggtcgccggccgcttacttcgcccagtctgatgagaagcctcgtcatgatccgccgcacgccttgcaggagtggacgtccgtcaaagtacgtgcacgcgtgtgtttttactgtgtatagacggacggatgcatgtcttgctagctagcttgtaggcagcgtgtggcaacgaactgatatttcttctggtccgcgcagaacctatacgatgaaatgacggagcggattgactccgctgctcggacgggcaatgttcctgaagaaactagagcgaaacacaaagggttttctgagtgggatacgggtattacctcaaaagaccaccacccgatcgttcaggtatatatatcattattcccgtccctctatatttctccagacttttttgtattataaaaatatagatgatgttttcttttgctagattctgatagatgggaaagacaaggctgtagctgacaacgaaggcaatgtgctgccgacgctggtgtacgtggcacgagagaagaggcctcagtaccaccacaacttcaaagccggggcgatgaacgctctggtatgattcattcattcgcaccagctggtagcttagcatgcagggacattgtttgcttaacatatttataatatctgtgcgagatcgccgccaatttgaactgcagatccgagtatcgtccgtgataagcaacagccctatcatcctgaacgtggactgcgacatgtattccaacaacagcgacacgatcagagacgcgctgtgcttcttcctcgacgaagaaacgggccacaggatcgcgttcgtgcagtaccctcagaactacaacaacctcaccaagaacaacatatacggcaactccctcaatgtcatcaaccaggttagtactgtcaagtactgaaattatatatgcatgcctcttgacagcgacactgacaatgttgggcggcgctgaatcatcacaaggtggagctgagcggcctggacgcttggggcggcccgctgtacatcggcacgggatgcttccataggagggagaccctgtgcggcaggaggttcaccgaggactacaaggaagactgggacagaggaaccaaggagcagcagcagcaccgccaccgcgtcgacggcgagaccgaagcgaaggccaagtcgctagcgacctgcgcctacgagcacgacgacgacacgcggtggggagacgaggtggggctcaagtacggctgctcggtggaggacgtcatcacggggctggcgatacactgcagagggtgggagtcggtgtacagcaaccccgcgagagcggcgttcgtcggcgtcgcgccgaccacgctcgcccagaccatactgcagcacaagcggtggagcgagggcaacttcggcatcttcgtttccaggtactgccccttcgtctttggacgacggggcaaaaccaggttgccgcaccagatgggctactccatctacgggctatgggcgcccaactcgctgcctacgctgtactacgctgtcgtcccttcgctgtgcctgctcaagggcacccctctgttccctgaggtatgcatgtcgtacgtgtgattcaatggcattgaagcatatatatgtgctctctcttgagtcttgactgtgtgtgtgtgtttgtttcatcagctcacgagtccgtggatcgcgcctttcgtctacgtcgcggtcgccaagaacgtctacagcgcgtggcaggcgctgtggtgcggagacacgctgagagggtggtggaacgggcagaggatgtggctggtccggagaacgacctcgtacctctacggcttcgtcgacaccgtcagggactcgctggggctgtccaagatgggcttcgtggtgtcgtccaaggtgagcgacgaggacgaggccaagaggtacgagcaggagatgatggagttcgggacggcgtcgccggagtacgtgatcgtcgcggccgtcgcgctgctcaacctcgtgtgcctggcagggatggcggcggcactggatgtgttcttcgtccaggtcgctctctgcggggtgctggtgctcctcaacgtcccggtctatgaagccatgttcgtcaggaaggacagggggaggatgccgttcccgatcacgctagcctccgttggctttgtgacgctggccctcattgtgccattcttttgactttgaggtgctaataatacgtgtacgggcacacgcacgttcgcatgtatgacgattatgggcaacaggcgtgtaataccactaatacctattaaacactccagtctccaagtgatccattgctacacgtgtgttcctcctgttctctatatgcatgagctgctgatggtgatacgatactgtcagatactgcaataagacgccaaacaagataagcatcggcaatcgagtggatcctcacaaccacagtggacgctatgcaggtctttggaggcagttgctatgcacactttgattggcgcttcacaaatagactttcgttatgatggcgtcttttagtccctttagtcgttggttggtgaattgcaataggcgttctaatttcctgttgggtgtgtctgtttgtagatggtagtgtcatagttttatactcggtcctaacttcctttgaagggaaggccgtaattgtttcttttatctaaaaaaaaggcatcggaga

SEQ ID NO: 2031 - DNA, 2440 bp, Zea mays
  misc_feature (2400)..(2400): n is a, c, g, or t
gggacctcgagccggcggcccgcccggggcttattagtattattattattcggctcctgctcatcagctgcagcagtcgtgctccggaccggagaagtcgaaatggaggagaggctgttcgccacggagaagcacggtggccgggcgctctacaggctccacgccgtcacggtgttcctggggatatgcctgctgctctgctacagggcgacgcacgtcccggctgccggctccggcggcagggcggcgtggctggggatgctcgcggcggagctctggttcggcttctactgggtcatcacgcagtccgtgcgctggtgccccatccgccgccgcaccttccacgacaggctcgccgccaggttcggagagcggctcccctgcgtggacatcttcgtgtgcacagcggacccgcggtcggagccgccgagccttgtcgtggccacggtcctgtcggtgatggcgtacaactacccgcccgcgaagctcaacgtctacctctccgacgacggcggctccatcctcaccttctacgctctgtgggaggcctccgccttcgccaagcactggctcccgttctgcaggaggtacggcgtcgagccacggtcgccggccgcttacttcgcccagtctgagaagcctcgtcatgatccgccgcacgccttgcaggagtggacgttcgtcaaaaacctatacgatgaaatgacggagcggattgactccgctgctcggacgggcaatgttcctgaagaaactagagcgaaacacaaagggttttctgagtgggatacgggtattacctcaaaagaccaccacccgatcgttcagattctgatagatgggaaagacaaggctgtagctgacaacgaaggcaatgtgctgccgacgctggtgtacgtggcacgagagaagaggcctcagtaccaccacaacttcaaagccggggcgatgaacgctctgatccgagtatcgtccgtgataagcaacagccctatcatcctgaacgtggactgcgacatgtattccaacaacagcgacacgatcagagacgcgctgtgcttcttcctcgacgaagaaacgggccacaggatcgcgttcgtgcagtaccctcagaactacaacaacctcaccaagaacaacatatacggcaactccctcaatgtcatcaaccaggtggagctgagcggcctggacgcttggggcggcccgctgtacatcggcacgggatgcttccataggagggagaccctgtgcggcaggaggttcaccgaggactacaaggaagactgggacagaggaaccaaggagcagcagcagcaccgccaccgcgtcgacggcgagaccgaagcgaaggccaagtcgctagcgacctgcgcctacgagcacgacgacgacacgcggtggggagacgaggtggggctcaagtacggctgctcggtggaggacgtcatcacggggctggcgatacactgcagagggtgggagtcggtgtacagcaaccccgcgagagcggcgttcgtcggcgtcgcgccgaccacgctcgcccagaccatactgcagcacaagcggtggagcgagggcaacttcggcatcttcgtttccaggtactgccccttcgtctttggacgacggggcaaaaccaggttgccgcaccagatgggctactccatctacgggctatgggcgcccaactcgctgcctacgctgtactacgccgtcgtcccttcgctgtgcctgctcaagggcacccctctgttccctgagctcacgagtccgtggatcgcgcctttcgtctacgtcgcggtcgccaagaacgtctacagcgcgtgggaggcgctgtggtgcggagacacgctgagagggtggtggaacgggcagaggatgtggctggtccggagaacgacctcgtacctctacggcttcgtcgacaccgtcagggactcgctggggctgtccaagatgggcttcgtggtgtcgtccaaggtgagcgacgaggacgaggccaagaggtacgagcaggagatgatggagttcgggacggcgtcgccggagtacgtgatcgtcgcggccgtcgcgctgctcaacctcgtgtgcctggcagggatggcggcggcactggatgtgttcttcgtccaggtcgctctctgcggggtgctggtgctcctcaacgtcccggtctatgaagccatgttcgtcaggaaggacagggggaggatgccgttcccgatcacgctagcctccgttggctttgtgacgctggccctcattgtgccattcttttgactttgaggtgctaataatacgtgtacgggcacacgcacgttcgcatgtatgacgattatgggcaacaggcgtgtaataccactaatacctattaaacactccagtctcccagtgtcncaaaaaaaaaaaaaaaagggcggccgtcgcgatctagaac

SEQ ID NO: 2032 - DNA, 2628 bp, Zea mays
ccatggtcggcacgccagagctcgcccaacccgcgcgcgcgctcaccccggcgtccggtcaagtccgccgcgcgcccacgccctcggccgtgcccgcccacgcctataaagcctccccgggcgcacctctcttcgccccgcacccaccctctccggccagccacctttccttagctccggcgagcttatttccgcccgccattgccgccagagcttcggccgccgtggccagcccactccagccaccctcaagcccagccagtgcttcggctagctccgccagtagcccgtgaagctcgccaagccctcggacccggccggatctcaccggaggcccgagatcgacctcaccggacttcggtcttccgccgccgcgcgtggaccgagctatccagtgagtctccgcccaattcctttcgctcatagcttctctggcatcccgtggacctccctgacctatttgattgaactatctcgccgtgacaaggccggtctcctcgccgccgacgagcatccccgcctgcgcgcgtggaccgaccgactccggccatctccgacggcgtcccgcacaccgttgtgatccccgagacctccccttcgtcctcgaccacttcaccggagcaacctcgccgccggtaagcccctccgcccttttctccgccgcggctactgtttaaggtagaagaaggacctcgggttaggattggtagaacccgaggggttttctgtaatgtcagtgactcatgtgaatagtaacctaaggactgattcgcgaagaaaacttagaaaaccgccagggaccccagtgcaaagtggatttccatttaatcaattctgttattctttttaaaatgaccagagaacttagaaaacccataacttgatgaaatcttaataaaaagttgtcaaaccaattttgctagctcctgaatattatgatctatcatttaaaaatagtaaactccatgctttctgttcaaaattttaaagtttaaaattaaaaacagaaacccactaaaccttgtttaattaaggaaaattagtttttcttctgtgctgaacttaagaaaatttgtagatgtttaaaccttatttagacactgtttaaaaatagtaggaaccccagcattgaaaattatgatgtagtttttcatttaaagctaatttgtccaaaacttagagaaaatcagaaaggccttagaaattaatgaacagtgattaataatatttttcctagtttacttatgcaacagagaacctaggaaaaatacagagaccattaatttggaccagttttaaattaagatgatttgtttagcctcatatagactgaaaatcaattattagagttacaaaactataaccaaaatgattaataaaaatctagtggacttataaccaccagagccccactacaaaaatacagagcacctcagcccaactttttaagtaaagaaaataaatacaaggtgataataaggcattttccaaataaatcatgaacaaccccttttaatgtgataataggcaaccaaaaatttgctaagctcatgatgaggtaaactaccagagaaaaatgcaaacccatgaaaaagaagcaaacccataccttttgctaatgatttaagagaaagaccactttaattcaaattatgcaaaccaccccttcccttaagcaaaaagaagccaaacttcagaatgattgctcttgcacaaaatactaactatgaaaaataagaactttgttgtttgatatttttctatagtggtagtagaaagcacccatttggctagaaacttgagaaaaccatagaaaaataattaaaaggtagtaatggctagaaatttgtatcaagtcatgttgtaacacctaaaagccagcaaaaataagttttagagaattacccactgttaaatagtagttgtagttcaaagcaccccttctgccctagagtttgataattttgtccagagaaaactattcactttctgatccccaaattttgagacagggaaacatacaccagtacccagccactgtaatttttgcagaatttttagaattttataaaagcaactcgtagttcagacctactccaaaacattaaaagaataaaagaaaaaggaaagaagaaataaaccccaccccaataagtctaacttgagaacttatcatttatccctaagacttaaaaggaattcagtggaaccccaaaaaaataaacctaccccttaccttagctaagtataacccaacttaccaagcataccactaagggttttacataagtaaagttaacttgtttaaactcagaagatcatacacctttaaagttgtaatttctaaaagcacatatcatatcatgcatatatcttacgcattgcattcattagattgtaaccttgtcgacggagagtacgtgctcatccccgagcaaggacctgtccaagaagaggaccaggagcaggcttcagaggctgctatcgaggatctccccgcagccccagcaattgaaggcaagccccggttttatgcataaccatgttattatatgctactttactacacttaatgcttgtagaattgcaatgtgcacttaagtgtaggagttgattgaaaccctagtt

SEQ ID NO: 2033 - DNA, 2715 bp, Zea mays
gcctaaaccgcacggttgtccatacacaaaagacaaagcttggtctggtgaacaaatcccttgcagtgatcttgcccaaattcgcgaagatttgctcccaatcggcgcttgaacaggggcagaggcaacgggaacacgtgttcgaccgcggctgacacccctggttcacgcccgttcgcgcaccgcgccttcccagtgcacgcccgcgcgcactcgccggtccacgaccgcccgtgcaccgcgccgtgcctataaagccttcccaggcgcgccccacttcgccccgcactcaccctcaccggccaacccctttcccttagctccggcgagcttatttccgcccgccattgccgccagagcttcggccatcgtggccagccccctccagccatcctctgggcaagccagtgcttcggctagctccgccagtagcccgtgaagctcgccaagccctcggacccgaccggacttcaccggaggcccgagatcaccctcaccggactttggtcctcccccgtcgcgcgtggaccgagctatccagtgagtctccgcccaattccttccgctcataacttctctggcatcccgtggacctccctgacctatttgattgaactatctcgccgtgaccaggccggtctcctcgccgccgacgagcatccccgcctgcgcgcgtggaccgaccgactccgaccatctccgacggcgttccgcacaccgttgtgatccccgcgacctccccttcatcctcgaccactttaccggaacagtctcgccgccggtaagcccctccgcccttttcttcgccgcggctactgtttaaggtagaagaaggacctcgggttaggatttgtagaacccgaggggttttctgtaaggccagtgactcatgtgaatagtagcctaaggactgattcgcgaagagaacttagaaaatcgccagggaccccagtgcaaagtggatttccatttaatcaattctgttattctttttaaaatgaccagagaacttagaaaatccataacttgatgaaatattaatcaaaagttgtcaaaccaattttgctagctctggaatattatgacctatcatttaaaaatagtgaaccccatgctttctgttctaaattttagagtttaaaattaaaaacagaaacctactaaaccttgtttaaataagaaaaattagtttttcttttgtgctgagcttaagaaaatttgtagatgtttaaacctcatttagacactgtttaaaaatagtaggaaccccagcattgaaaaatatgatgtagttatccatttaaagctattttgtccaaaacttagaaaaaatcagaaaggcattaggaattaatgaacagtgattaataatatttttcctagtttacttatgcaccagagaacctaggaaaaatacagagaccattaatttgaaccagttttaaattaagatgatttgtttagccttatatggactgaaaatcaattattagaattacaaaactataacctaaatgattaataaaaatccagtgaacttacaaccaccagagccccactacaaaaatacagaacaccccagcccaactttttaagtagggaaaataaatacagagtgataataaggcatttttccaataaatcataaacaaccccttttaatgtgataatgggcaaccaaaaatttgctaagtccatgatgagacaaaccaccagagaaaaatgcaaacccatgaaaaagaagtaaacccataccttttgctagtaatttatgagaaaggccatttaattcaaataatgcaaaccaccccttcccttaagcaaaaagaggccaaacttcagaatgattgctcttgcacaaaatactaactatgaaaaataagaactctgttgcttgatatttttcaaatatagtggtagtagaaagcacccatttggttagaaacttgagaaaaccatagaaaaataattaaaaggtagtaatggttagaaatttgtatcaagtcatgttgtaacacctaaaagccagcaaaaataagttttagagaattacctactgttaaataatagttgtagttcaaagcaccccttctgccctagagtttaataattttgtccagagaaaactattcaccttctgatccccaaattttaagacagagcaccacccaccagtaacaagccactgtaatttttgaggaatttttggaattttataaaagcaacttgtagttcaaacccactccaaaacccttaagagaataaacgaaaaggaaagaaggaataaacctcatcccaataaacctaacttgagaacttatcaattctccctaagacttaaaaggaattcagtggaaccccaaaaatttaacctaccacttaccttagctaagtctaacccaacttaccaagtataccactaaaagggttttacataagtgaagttaacttgttggaactcaaaaagatcatacacctttaaaagttgtaatttctaaaagcacatatcatatcatgcatatatcttacgcattgcattcattagattgtaatcttgccgacggagagtacgtgctcatccccgagcaaggacctatccaagaggaggaccaggagcaggcttcagaggctgctattgaggatctccccgcagccccagcaattgaaggcaagccccggttttatgcataaccatgttattatatgctactttac

SEQ ID NO: 2034 - DNA, 2717 bp, Zea mays
cacgacaaaacttgggatttgcctcgggtttgggcagggagacagaccagatttcctggctccatatctctgcaacctgtaggcaaaatcctatgacctccacacaagaatggtagcttgtagggaggagaagaggttttgtgcactgaccaaggcgagagcaggctcggatgagcgaccacacgcgccagagcttgggcagaacgcacgggcacacgtgttcgaccctggtcggcacgccagagctcgcccaacccgcgcgcgcgctcgccccggcgtccggtcaagtccgccgcgcgcccacgccctcggccgtgcccgcccgcgcctataaagcctccccgggcgcacctctcttcgccccgcactcaccctcaccggccagccaccgttccttagctccggcgagctcatttccgcccgccattgccgccagagctacggccgccgtggccagcccactccagccaccctccagcccaaccagtgcttcggctagctccgccagtagcccgtgaagcttgccaagccctcggacccgaccggacttcaccggaggcccgagatcaacctcaccggacttcggtcttccgccgccgcgcgtggaccgagctatccagtgagtctccgcccgattcctttcgctcatgtcttctctggcatcccgtggacctccctgacctatttgattgaactatctcgccgtgaccaggccggtctcctcgccgccgacgagcatccccgcctgcgcgcgtggaccgaccgactccggccatctccgacggtgttccgcacaccgttgtgatccccgcgacctccccttcaccctcggccacttcaccggaacagtctcgccgccggtaagcccctccgcccttttcttcgccgcggctactgtttaaggtagaagaaggacctcgggttaggttctgtagaacccgaggggtttttcgtaatgtcagcgactcatgtgaatagtaacctaaggactgaattgcgaggaaaacttagaaaaaccgccagggaccccagtgcaaagtggatttccatttaatcaattctgttattctttttaaaataaccagagaacttagaaaatccataacttgatgaaatcttaatgaaaagctgtcaaaccaattttgctagctctggaatattatgatctatcatttaaaaatagtgaaccatatgctttctgttctaaattttagagtttaaaattaaaaacagaaaccccctaaaccttgtttaattaaggaaaattagtttttcttttgtgctgagcttaagaaaatttgtagatgcttataccttaattagacactgtttaaaaatagtaggagccccagcattagagattatgatgtagttattcatttaaagccattttgtccaaaacttagagaaaatcagaaaggccttagagattaatgaacagtgattagtaatatttttcctagattacttatgcaacagagaacctaggaaaaatgcagagaccattaatttggaccagtttctaattaagatgctttaattagcattatgtagactgaaaatcaattattagaattgcaaaactataaccaaagtggttaacaaaaatccagtgaacttataaccaccagagccccactacaaaaatacagagcaccccagcctaactttttaagtagggaaaataaatacagaatgataataaggcattttcccactaaatcatgagcaaccccaaataatgtgataatgggcaaccaaaattttgctaagtccatgatgagataaaccaccagagaaaaatacaaacccatgaaaaagaagtgaacccatgccttttgctagtaatttgtgagaaaggccatttagctcaaataatgcaaaccaccccttcccttaggcaaaaggaagccaaactccagaatgattgctcttgcacaaaatactagctaagaaaaataagaactctgttgtttgatgtttttcaagtatagtggtagtagaaagcacccctttggctagaaaccttaagaaaatcttggggaaagaattaaagggtattaatgactagaaatttgtatcaagtcatgttataacacctaaaagccagcaaaaataagtttttgagaattacccactattaaataatagttgtagttcaaagtaccccttctgccctaaaatttggtaattttgtccagagaaaaccattcactttctgaaccccaaattttgagacagagaatcatacaccagtaacaagccactgtaatttttgcagaatttttggaattttataaaagcaacttgtagttcaaacctactccaaaacattaaagagaataaaagaaaagagaagaaggaataaacctcatcccattaagactaacccaatttaccaagtataccactaaagggttttacataagcaaagttaactggttttaactcaaaagatcatacatctttaaagttataaattctaaagcacatatcatatcatgcatatatcttacgcattgcattcattagattgtaatcttgccgacggagagtacgtgctcatccccgagcaaggacctatccaagaggaggaccaggagcaggcttcagaggctgctattgaggatctccccgcagccccagcaattgaaggcaagccccggttttatgcataaccatgttattatatgctactttactacacttaatgcttg

SEQ ID NO: 2035 - DNA, 2619 bp, Zea mays
gatttcctggctccatatctctgcaaccagtaggcaaaatcctatgacctccacacaagaatggtagcttgtagggaggagaagaggtttcgtgcactgaccaaggcgagagcaggctcggatgagcgaccacacgcgccagagcttgggcagaacgcacgggcacacgtgttcgaccctggtcggcacgccagagctcgcccaacccccgcgcgcgctcgccccggcgtccggtcaagtccgccgcgcgcccacgccctcggccgtgcccgcccgcgcctataaagcctccccgggcgcacctctcttcgccccgcactcaccctcaccggccagccaccgttccttagctccggcgagcgtatttccgcccgccattgccgccagagctacggccgccgtggccagcccactccagccgccctccagcccaacctgtgcttcggctagccccgccagtagcccgtgaagctcgccaagccctcggacccgaccggacttcaccggaggcccgagatcgacctcaccggacttcggtcttccgccgccgcgcgtggaccgagctatccagtgagtctccgcccaatttccctttcgctcatgtcttctctggcatcccgtggacctccctgacctatttgattgaactacctcgccgtgaccaggccggtctcctcgccgccgacgagcatccccgcctgcgcgcgtggaccgaccaactccggccatctccgtcgacgttccgcacaccgttgtgatccccgcgacctccccttcaccctcgaccacttcaccggaacagtctcgccgccggtaagcccctccgcccttttcttcgccgcggctactgtttgaggtagaagaaggacctcgggttaggttttgtagaacccgaggggttttctgtaatgtcagcgactcatgtgaatagtaacctaaggactgattcgcgaggaaaacttagaaaaaccgccagggaccccagtgcaaagtggttttccatttaatcaattctgttattcttttaaaataaccagagaacttagaaaatccataacttgatgaaatcttaatgaaaagctgtcaaaccaattttgctagctctggaatattatgatccttcatttaaaattagtgaaccatatgctttctgttctaaattttagagtttaaaattaaaaacagaaaccccctaaaccttgtttaattaaggaaaattagtttttcttttgtgctgagcttaagaaaatttgtagatgcttataccttaattagacactgtttaaaaatagtaggagccccagcattagagattatgatgtagttattcatttaaagccattttgtccaaaacttagagaaaatcagaaaagcattagaaaatgttgaacagtgattagtaatatttttcctagtttacttatgcaaccaagaacctaggaaaaatgcagagaccattaattaggaccagtttctaattaagatgctttaattagccttatgtagactgaaaatcaattattagaattgcaaaactataaccaaagtggttaacaaaaatccagtgaacttataaccaccagagccccactacaaaaatacagagcaccccagcctaactttttaagtaaggaaaataaatacaaagtggtaataaggcattttcccaataaatcataaacaacctcaaataatgtgacattgggcaaccaaaaatttgctaagtccatgatgagataaaccaccagagaaaaatacaaacccatgaaaaagaagtgaacccatgccttttgctagtaatttgtgagaaaggccatttgacttaaataatgcaaaccaccccttcccttaagcaaaaagaagccaaactccagaatgattgctcttgcacaaaatactagctaagaaaaataagaactctgttgtttgatgtttttcaagtatagtggtagtagaaagcacccctttggctagaaaccttaagaaaaccataggaaaagaattaaaaggtattaatgactagaaatttgtatcaagtcatgttatgacacctaaaagccagcaaaaataagttttaaagaattacccactgttaaataatagttgtagttcaaagtaccccttctgccctaaaatttggtaattttgtccagagaaaaccatttactttctgaaccccaaattttgagacagagaatcatacaccagtagcaagccactgtaatttttgcagaatttttggaattttataaaagcaacttgtagttcaaacctactccaaaacattaaagagaataaaagaaaagagaagaaggaataaacctcatcccattaaagcttacccaatttaccaagtataccactaaaagggttttacataagtaaggttaacttgtttaaattcaaaagaccctacatctttaaaagttgtaaattctaaagcacctattgtatcatgcatatatcttacgcgttgcattcattagattgtaatcttgccgacggagagtacgtgctcatccccgagcaaggacctgtccaagaggaggaccaggagcaggcttcagaggctgcttttgaggatctccccgcagccccagcagtgaaggcaagccccgg

SEQ ID NO: 2036 - DNA, 2954 bp, Zea mays
tgcttttcgaaactcaaagccaggagatccaaatatcaaagtcgtgccaaattcccttgaacacgtcctggaaaagtttgaactcaaaccaaattcatttggcatggatttggcgcagcttgacctcgggaccaggcattctgacactggcaccttggtgacgctacaactccctgtccctagcctaaaaccgcgcgacgtccatacacaaaagacaaagcttggtcaggtgaacaaatccttcacagcgatcttgcccaaattcgcgaagatttgctcccaatcggcgcttgaacaggggcagaggcaacgggaacacgtgttcgaccgtggctgacacccccggttcacgcccgttcgcgcaccgcgcctcccagtgcacgcccgcgcgcactcgccggtccacgaccgcccgtgcaccgcgccgtgcctataaagccttcccaggcgcgccccacttcgccccgcactcaccctcaccggccagccactttcccttagctccggcgagctcaattccgcccgccattgccgccagagcttcggccaccgtggccagcccactccagccatcctctgggcaagccagtgcttcggctagctccgccagtagcccgtgaagcttgccaagccctcggacccggccggacttcaccggaggcccgagatcgacctcaccggacttcggtcttccgccgccgcgcgtggaccgagctatccagtgagtctccgcccaattccttgcgctcatgtcttctctggcaccccgtggacctccctgacccatctgattgaactatctcgccgtgaccaggccggtctcctcgccgccgacgagcatccccgcctgcgcgcgtggaccgaccgactccggccatctccgacggcgtcccgcacaccgttgtgatccccgagacctccccttcgtcctcgaccacttcaccggagcaatctcgccgccggtaagcccctccgccctttcttccgccgcggttactgtttaaggtagaagaaggacctcgggttaggatttgtagaacccgaggggttttctgtaacgtcagtgactcatgtgaatagtagcttaaggactgattcgcgaagaaaacttagaaaacccgccagggaccccagtgcaaagtggatttccatttaaacaattctgttattctttttaaaatgaccagagaacttagtaaaatccataacttgatgaattcttaatcaaaagttgtcaaaccaattttgctagctcctgtatattataatctatcatttaaaaatagtagaccctatactttctgttcaaagttttagagtttagaaattaaaacagaaacccactaaaccttgtttaattaaggaaaattagtttttcttctgtgctgaacttaggaaaatttgtagatgatcaaacctcttttagacactgtttgtccaaaacctcttaggaaaaataatgggaaccccagcattgaaagatatgatatagtttctcatttaaagctattttgtccaaaacttagagaaaatcagaaaggcattagaaattaatgaacaatgattaatatcatttttcctagtttacttatgtaacagagaacctaggaaaaatacagagaccattaatttggaccagttttaaattaaaaatgatttgtttagccttatatagactgaaaatcaattattaaagaggcacaactataaccaaaatgcttaataaaaatccagtggacttataaccaccagagccccactacaaaaatacagagcaccccagcccaactttttaagtaaggaaaataaatacaaagtgatgataaggcattttccaactaaatcatgaacaacccctattaatgtgataatgggcaaccaaaaattagctaagtccatgatgagataaactaccagagaaaaatgcaaacccatgaaaaagaagcaaactcataccaattgccaataatttaagagaaaggccacttaattcaaataatgcataccaccccttcccttaagcaaaaagaggccaaacttcagaatgattgctcttgcacaaaatactaactatgaaaaataagaactctgttgtttaatgtgtttcaaatatagtgatagtagaaagcacccatttggctagaaacttgagaaaaccataggaaaataattaaaaggtactaatgactagaaacttgtatcaagtcatgttataacacctaaaagccagcaaaaataagttttagagaattacccactgttaaataatagttgtagttcaaagcaccccttctgccctaaaatttgataattttatccagagaaaactattcactttctgatccccaaattttgagacagagaaacacacaccagtaacaagccactgtaatttttgcagaatttttagaattttataatagcaacttgtagttcaaacctactccaaaaccttaagagaataaaagaaaagggaagaagaaataaacctcacctcaataaatctaacttgagtacttatcatttatccctaagacttaaaaggaattcagtggaaccccaaaaataaacctaccacttaccttagctaagtttaacccaatttaccaagtataccactaagggttttccataagtaaagttaacttgtttaacctcaaaagatcatacacctttaaagttgtaatttctgaaagcacatatcatatcatgcatatatcttacgcattgcattcattagattgtaatcttgccgacggagagtccgtgctcatccccgagcaagggcctgtccaagaggaggaccaggagcaggcttcagaggctgctattgaggatctccccgcagccccagcaattgaaggcaagccccggttttatgcataaccgtattattatatgctactttactacacttaatgcttgtaggattgcaatgtgcacttaagtgtagg

SEQ ID NO: 2037 - DNA, 1717 bp, Zea mays
cgggccgtgagtctccgtccaatcccttgcgctctatcttctctagcatcccgtggacctccctgacccatctaattgaactatcttgccgtgaccaggccggtctcctcgccaccgacgagcatccccgcctgcgcacgtggaccgaccgactccggccatctccgacggcgacccgcacaccgttgtgatccccgagacctcccctacgtcctcgaccacttcaccggagcaatctcgccgccggtaagcccctccgccctttcttccgccgcggttactgtttgaggtagaagaaggacctcgggttaggatttgtagaacccgaggggttttctgtaacgtcagtgactcatgtgaatagtagcttaaggactgattcgcgaagaaaacttaaaaacccgccagggaccccagtgcaaagtggatttccattaaaccaattctgttattctttttaaaatgaccagagaacttagaaaatccataacttgatgaattcttcataaaaagttgtcaaaccaattttgctagctcctgaatattatgaactatcatttaaaaatgataaaccctatgctttctgttctaaattttagagtttaaaattaaaaacagaaacccaccaaaccttgtttaattaaggaaaattagtttttcttctgtgctgaacttaagaaaatttgtagatgtttaaacctcatttagacactgtttaaaaatagtaggaaccccagcattagaaattatgatgtagttattcatttaaagctattttgtccaaaacttagagaaaatcagaaaggcattagaaattaatgaacagtgattaagattatttttctctagtttacttatgtaacactgaacctaggaaaaatacagaggccattaatttggaccagttttaaattaaaatgatttatttagccttatatagactgaaaattaattattagagtggcaaaactataaccaaaatgattgataaaaatccagtggacttacaaccctcagagccccactacaaaaataaagaacacctcagcccaactttttaagtaaggagaataaatacaaaatgataatgaggaattttacaaataaatcataaacaacccctaataatgtgataatgggcaaccaaaaattagctaagtccataatgagataaactaccagagaaaaatacaaacccctgaaaaagaaacaaattcttacctattgctaaagatttatgagaaaggccacttaactcaaataatgcataccaccccttcacttaagcaaaaagatgccaaacttcagaatgattgctcttgcacaaaataataaccaagaaaaataagaactttgttgtttgatatttttcaaacatagtggtagtaggaagcacccatttgactagaaacttgagaaaaccatagaaaactaattaaaagatattaatgactagaaatttgtatcaagtcatgttataacacctaaaggccagcaaaaatgagtttcagagaattacccacagttaaataatagttgtagttcaaagcaccccttctgccccagaatttaataattttgtccagagaaaactattcactttctgattcccaaattttgagacagagaaacatacactagtacccagccactgtaatttttgcagaatttttagaattttataaaagcaacttgtagttcaaacctaccccaaaac

SEQ ID NO: 2038 - DNA, 2235 bp, Zea mays
caccgagcggccaccgttccttagctccggcgagcttatttccgcccgccattgccgccagagcttcggccgccgaggccagctcactccagccaccctccagcccaaccagtgcttcggctagctccgccagtagcccgtgaagcttgccaagccctcggacccgaccggacttcaccggaggcccgggatcaccctcaccggacttcggtcttccgccgccgcgcgtggaccgagctatccagtgagtctccgcccaattcctttcgctcatagcttctctggcatcccgtggacctccctgacctttttaattgaactacctcgccgtgaccaggccggtctcctcgccgccgacgagcatccccgcctgcgcgcgtggaccgaccaactccggccatctccgtcgacgttccgcacaccgttgtgatccccgcgacctccccttcatcctcgaccacttcaccggaacagtctcgccgccggtaagcccctccgcccttttctccgccgcggctactgtttgaggtagaagaaggacctcgggttaggttctgtagaacccgaggggttttctgtaatgtcagcgactcatgtgaatagtgacctaaggactgattcgcgaaggaaaacttagaaaaaccgccagggaccccagtgcaaagtggttttccttttaatcaattctgttattcttttaaaataaccagagaacttagaaaatccataacttgatgaaatcttaatgaaaagctgtcaaaccaattttgctaactctggaatattatgatccttcatttaaaaatagtgaaccatatgctttctgttctaaattttagagtttaaaattaaaaacagaaaccccctaaaccttgtttaattaaggaaaattagtttttcttttgtgctgagcttaagaaaatttgtagatgcttataccttaattagacactgtttaaaaatagtaggagccccagcattagagattatgatgtagttattcatttaaagccattttgtccacaacttagagaaaatcagaaaagcatttgaaaatgttgaacagtgattagcaatatttttcctagtttacttatgcaaccaagaacctaggaaaaatgcagagaccattaattaggaccagtttctaattaagatgctttaattagccttatgaagactgaaaatcaattattagaattgcaaaaccataaccaaagtggttaacaaaaatccagtgaacttataaccaccagagccccactacaaaaatacagaacaccccagcctaactttttaagtagggaaaataaatacagaatgataataaggcatttttccaataaatcataagcaaccccttttaatgtgataatgggcaaccaaaaattagctaagtccatgatgagataaaccaccagagaaaaatgcaaacccatgaaaaagaagtgaacccataccttttgctagtaatttgtgagaaaggccatttagctcaataatgcataccacccctttccttagcaaaaggaagccaaactccagaatgattgctcttgcacaaaacactagctaagaaaaataagaactctgttgtttgatgttttttcaaatatagtggtagtagaaagcacccctttggctagaaacttgagaaaaccataaaaaatcattaaaaggtattaatgactagaaatttgtatcaagtcatgttatgacacctaaaagccagcaaaaataagttttaaagaattacccactgttaaataatagttgtagttcaaagtaccccttctgccctaaaatttggtaattttgtccagagaaaaccattcactttctgaaccccaaattttgagacagagaatcatacaccagtagcaagccactgtaatttttgcagaatttttggaattttataaaagcaacttgtagttcaaacctactccaaaacattaaagagaataaaagaaaagagaagaaataaacctcatcccactaaaactaacccaatttaccaagtataccactgaaaggttttacataagtaaggttagcttgattaaattcaaaaagaccatacatctttaaagttgtaaattctaaagcacatatcatatcatgcatatatcttacgcattgcattcattagattgtaatcttgccgacggagagtacgtgctcatccccgagcaaggacctgtccaagaggaggaccaggagcaggctccagag

SEQ ID NO: 2039 - DNA, 2875 bp, Zea mays
catctgtgttctctgcttttccaaactcaaagccagaagatccaaatatcaaagtcgtgccaaattaccttgaacacattctgggaaaatttgaactcaaaccaaatccatttgacacggttttggcgcagctcaacctcgggaccaggcattctgacactggcaccttggtgacgctacaactccctgtccctagcctaaaaccgcacgtcgtccatacacaaaagacaaagcttggtctggtgaacaaatcccttgcagtgatcttgcccaaattcgcgaagatttgctcccaatcggcgcttgaacaggggcagaggcaacgggaacacgtgttcgaccgcggctgacacccctggttcacgcccgttcgcgcaccgcgccttcccagtgcacgcccgcgcgcactcgccggtccacgaccgcccgtgcaccgcgccgtgcctataaagcctccccaggcgcgccccacttcgccccgcactcaccctcaccggccagccaccgttccttagctccggcgagcgtatttccgcccgccattgccgccagagctacggccgccgtggccagcccactccagccgccctccagcccaacctgtgcttcggctagctccgccagtagcccgtgaagctcgccaagccctcggacccgaccggacttcaccggaggcccgagatcaacctcaccggacttcggtcttccgccgccgcgcgtggaccgagctatccagtgagtctccgcccaattcctttcgctcatgtcttctctggcatcccgtggacctctctgacccatttgattgaactatctcgccgtgaccaggccggtctcctcgccgccgacgagcatccccgcctgcgcgcgtggaccgaccaactccggccatctccgtcgacgttccgcacaccgttgtgatccccgcgacctccccttcgccctcgaccacttcaccggaacagtctcgccgccggtaagcccctccgcccttttcttcgccgcggctactgtttgaggtagaagaaggacctcgggttaggttctgtagaacccgaggggttttctgtaatgtcagcgactcatgtgaatagtaacctaaggactgattcgcgaggaaaacttagaaaaaccgccagggaccccagtgcaaagtggtttttcccttttatcaattctgttattcttttaaataaccaaagaacttagaaaattcataacttgatgaaatcttaatgaaaagctgtcaaaccaattttgctagctctggaatattatgatctatcatttaaaattattgaaccatatgctttctgttctaaattttagagcttaaaattaaaaacagaaaccccctaaaccttgtttaattaaggaaaatttgtttttcttctgtactgagcttaagaaaatttgtagatgcttataccctaattaggcattgtttaaaaatagtagaatccccagcattagagattatgatgtagttattcatttaaagccattttgtccacaacttagagaaaatcagaaaagcattagaaaatgttgaacaatgattagtaatatttttcctagtttacttatgcaaccaagaacctaggaaaaatgcagagaccattaattaagaccagtttctaattaagatgctttaatcagccttatgtgaactgaaaatcaattattaaaattgcaaaaccataaccaaagtggttaacaaaaatccagtgaacttataaccaccagagccccactacaaaaatacagagcaccccagcctaactttttaagtaaggaaaataaatacaaagtggtaataaggcattttcccaataaatcataaacaacctcaaataatgagataatgggcaaccaaaaattagctaagtccatgatgagataaaccaccagagaaaaatacaaacccatgaaaaggaagcaaactcataccaattgctagtgatttaagagaaaggccacttaattcaaataatgcataccaccacttcccttaagcaaaaagaaaccaaacttcagaatgattgctcttgcacaaaatactagctaagaaaaataagaactctgttgtttgatgtttttcaaacatagtggtagtagaaagcacccctttggctagaaaccttaagaaaaccataggaaaagaattaaaaggtattaatgactagaaatttgtatcaagtcatgttatgacacctaaaggccagcaaaaataagtttcaaagaattacccactgttaaataatagttgtagttcaaagtaccccttctgccttaagatttggcaattttgtccagagaaaaccattcactttctgaaccccaaattttgagacagagaatcatacaccagtaacaagccactgtaatttttgcagaatttttggaattctataaaagcaacttgtagttcaaacctactccaaaacattaaaaaggaataaaagaaaagaaaaggaggaataaacctcatcccattaaactaacccaatttaccaagtataccactaaaaggttttacataagtaaggttaacttgcttaaattctaaagaccctacatttttaaaagttgtaaattctaaagcacatattgtatcatgcatatatcttacgcattgcattcattagattgtaatcttgccgacggagagtacgtgctcatccccgagcaaggacctgtccaagaggaggaccaggagcaggcttcaggggctgctattgaggatctccccgcagccccagcaattgaaaggcaagccccggttttatgcataaccatggtaatatatgctactttactacacttaatgcttgtaggactgtaatgtgcacgactttgccctcgtgattggcat

SEQ ID NO: 2040 - DNA, 2991 bp, Zea mays
taactcaactaaatccccaaatcagcccttgatctatgaacccttagagaaattcagatttctgaatttctgaattttagacctcttctcaaagatcatctgtgttctctgcttttccaaactcaaagccagaagatccaaatatcaaagtcgtgccaaattaccttgaacacattctgggaaagtttgaactcaaaccaaattcatttgacacggttttggcgcagctcaacctcgggaccaggcattctgacactggcaccttggtgacgctacaactccctgtccctagcctaaaaccgcacgtcgtccatacacaaaagacaaagcttggtctggtgaacaaatcccttgcagtgatcttgcccaaattcgcgaagatttgctcccaatcggcgcttgaacaggggcagaggcaacgggaacacgtgttcgaccgcggctgacacccctggttcacgcccgttcgcgcaccgcgccttcccagtgcacgcccgcgcgcactcgccggtccacgaccgcccgtgcaccgcgccgcgcctataaagccttcccaggcgcgccccacttcgccccgcactcaccctcaccggccagcccctttcccttagctccggcgagcttaattccgcccgccattgccgccagagcttcggccaccgtggccagcccaccccagccatcctctgggcaagccagtgcttcggctagctccgccagtagcccgtgaagcttgccaagccctcggacccgaccggacttcaccggaggcccgagatcaacctcaccggacttcggtcttccgccgccgcgcgtggaccaagctatccagtgagtctccgcccaattcctttcgctcatagcttctctggcatcccgtggacctccctgacctatttgattgaactatctcgccgtgaccaggccggtctcctcgccgccgacgagcatccccgcctgcgcgcgtggaccgaccgactccggccatctccgacggcgttccgcacaccgttgtgatccccgcgacctccccttcaccctcgaccacttcaccggaacagtctcgccgccggtaagcccctccgcccttttcttcgccgcggctactgtttaaggtagaagaaggacctcgggttaggatctgtagaacccgaggggttttctgtaatgtcagcgactcatgtgaatagtaacctaaggactgattcgcgaggaaaacttagaaaaccgccagggaccccagtgcaaagtggatttccatttaatcaattctgttattctttttaaaatgaccagagaacttagaaaatccataacttgatgaaatcttaataaaaagttgtcaaaccaattttgctagctctggaatattgtaatctgtcatttaaaaatagtgaaccctatgctttctgttctaaattttagagtttaaaattaaaaacagaaaccccctaaaccttgtttaattaaggaaaattagtttttcttttgtgctgagcttaagaaaatttgtagatgtttataccttatttagacactgtttaaaaatagtaggaaccccagcattggaaaatatgatgtagttattcatttaaagctattttgtccaaaacttagagaaaatcagaaaggccttagaaattaatgaacagtgattaataatatttttcctagtttacttatgcaacagagaacctaggaaaaatacagagaccattaatttggaccagtttttaattaagatgatttgtttagccttatatagactgaaaatcaattattagaattgcaaaactataaccaaaggggttaataaaaatccagtgaacttataaccaccagagccccactacaaaaatacagagcaccccagcccaactctttaagtaaggaaattaaatgcaaagtgataataagacattttccaactaaatcatgaacaaccccaaataatgtgataatgggcaaccaaaaattagctaagtccatgatgagacaatccaccagagaaaaatgcaaacccatgaagaagaagtaaactcataccttttgctagtgattaaagagaaagaccacttaattcaaataatgcaaaccaccccttcccttaagcaaaaagaagccaaacttcagaatgattgctcttgcacaaaataccaactaagaaaaataagaactctgttgtttgatgtttttcaaatatagtggtagtagaaagcacccatttggctagaaacttgagaaaaccataggaaaataattaaaaggtattaatgattagaaatttgtatcaagtcatgttataacacctaaaagccagcaaaaatgagttttaaagaattacccacagttaaataatagttgtagttcaaagtaccccttctgccctaaaatttggtaattttgaccagagaaaaccattcacctcctgacccccaaattttgaggcagagaatcatacaccagtaacaagccactgtaatttttgcagaatttttggaattttataaaagcaacttgtagttcaaacctactccaaaacattaaaggaataaacctcatcccaataagtctaacttgagaaccttatcaattctcactaagacttaaaaagaattcagtggaaccccaaaaataaacctaccccttaccttagccaagtttaacccaatttaccaagtataccactaaagggtttacataagtaaaattaacttgtttaaactcaaaagaccatacacctttaaaatggtaatttctaaaagcacatatcatatcatgcatatatcttacgcattgcattcattagattgtaatcttgccgacggagagtacgtgctcatccccgagcaaggacctgtccaagaggaggaccaggagcaggcttcagaggctgctattgaggatctccccgcagccccagcaattgaaggcaagccccggttttatgcatatccgtattattatatgctactttactacacttaatgc

SEQ ID NO: 2041 - DNA, 2387 bp, Zea mays
tcacccccgtgttcaccatcgccggctagacacccctccttagctccgacgagttcctttccgccggccatggccgccagagcctcggccaccgtggccagcccactccagtcaccccaagtcgcgccagcgcttcggttagcttcaccattggcccgtgaagctttccaagtcctcagacctggcagaacttcaccagaaggcgaagatcgacctcaccatacttcgggcgctcgcctgcacgcgtagactgggcactccggtgagccattcttcaattcctcgcgcacacacctttcttgatccctgatgaagccctctgaccagtttgattggtcaattgtgccctggataggccggactccttgccgccgacgagctcccccgtctgcgcacgtggtccggccaactccagccatctcagactgcgatccgcgcatagttgtgaccctcaggacctcccgaacaccctcgaccacttcaccggagcagtatcgccgctggtaagcccctccgcccctttcttcctccgcgggcactgttccgttagggaaggaccgcgggttcgatttccagaaaccctagggggttttccagactcatgtgaatagtgcactagggacctgtctgtaatacccttaacaactttcgccagggcccctagcgcaaaaccctttttcctttattttttctgtttattctttttaaattcagcagagaacttaggaaatttatatcttgagaaatatttaactaaatttaatcaaaccaattttactagattcaaaatattatgaactatcacataaaaatactgacccatgtgcttcagttttaaattttagagtttggaattaattaagaaaactgaccaaaccttattaaaatgaagaaaattagttatgcttttgtgctgaacttaagaaaatttgtggatgttcaaacctcatttagacactgtttaaaaatagtagaaacccgagcattagaaattatgatgtagttattcatttaatgctatcctgtccaaaacttagagaagatcagagaggcattagaaactattgagcagtgattacgattatttttcctagtttacttatgtagcagagaacctaggaaaaatacagagaccattaatttggaccagttttaaattaaaatgttttatttagccttatttggactgaaaatcaattattagagcagcaaaactataaccaaaatgcttaataaaaatccagtggacttacaaccaccagagccccactacaaaaatacagagcacctcagcccaactttttaagtaaggaaaataaatacaaagtgataataaggcattttccaaataaatcatgaacaacccctattaatgtgataatgggcaaccaaaaatttgctaagtccatgatgagataaactaccagagaaaaatgcaaacccatgaaaaagaagcaaactcataccaattgctaatgatttaagagaaaggccacttaattcaaataatgcataccaccccttcccttaagcaaaaagaggccaaacttcagaatgattgctcttgcacaaaacaataactaagaaaaataagaactctgttgtttgatgtttttcaaatatagtggtagtagaaagcacccatttggctagaaacttgagaaaaccatagaaaaataattaaaaggtattaatgattagaaatttgtatcaagtcatgttataacacctaaaagccagcaaaaataagttttggagaattgcccactgttaaatagtagttgtagttcaaagcaccccttctgccctagaatttaataattttgtccagagaaaactattcactttctgatccccaaattttgagacagagaaacacacaccagtaacaagccactgtaatttttgcagaatttttggaattttataaaagcaacttgtagttcaaacctactcccaaacattaaagagaataaaagaaaaggaaagaagaaataaaccccaccccaataagtctaacttgagtacttatcaattctcactaagacttaaaaggaattcagtggaaccccaaaaaaatttaatctacttaccttagctaagtttaaaccaatttaccaagtataccacccaagggtcttacataagtaaagttaaccttgtttaactcaagaaagatcatgcacctttaaagttgtgatttctaaaagcacatgtcatatcatgcatacatcttacgcattgcattcattagattgtaatcttgccgacggagagtacgtgctcatccccgagcaaggacctgtccaagaggaggaccaggagcaggcttcagaggctgctattgaggatctccccgcagccccagcaatgaaggcaagccccgg

SEQ ID NO: 2042 - DNA, 1429 bp, Zea mays
aaaatacagagaccattaatttggaccagttttaaattaaaatgttttatttagccttatatggactgaaaatcaattattagagtagcaacactataacccaaaatgagtagtaaaaatcgagtggactttaaccaccagagccccactacaaaaataaagagcccctcagcccaaccttttaagtaaggaaaataaatacaaagtgataataaggcattttaccaataattcttaaacaacccctataatgtgataatgggcaaccaaaaattagctaagtccataatgagataaactatcagagaaaaatacaaacccatgaaaaagaagcaaactcatacctattgctaataatttaaaagagaggccacttgattcaaataatgcataccatctcttcccttaagcaaatagaggccaaactttagaatgattgctcttgcgcaaaacaataaccaagaaaaataagaactctgttgtttgatatttttcaaatatagtggtagtagaaagcacctatttggctagaaacttgagaaaaccatagaaaaataattaaaaggtattaatgactagaaatttgtatcaagtcatgttataacacctaaaagccagcaaaaataagttttagagaattacccactgttaaataatagttgtagttcaaagcaccccttctgccctagaatttaataattttgtccagagaaaactattcactttctgatccccaaattttgagacagagaaacatacaccagtaccaagccactgtaatttttgcagaatttttagaattttataaaagcaacttgtagttcaaacccactccaaaacatttaagagagtaaaagaaaagggaagaagaaataaaccccaccccaataagtctaacttgagtacttatcaactctcactaagacttaaaaggaattcagtggaaccccaaaaataaacctaccacttaccttagctaagtttaacccaatttaccaagtataccacccaagggtcttacataagtaaagttaaccttgtttaactcaagtagatcatacacctccaaagttgtaatttctaaaagcacatatcatatcatgcatatatcttacgcattgcattcattagattgtaatcttgccgacggagagtacgtgctcatccccgagcaaggacctgtccaagaggaggaccaggagcaggcttcagaggctgctattgaggatctccccgcagccccagcaattgaaggcaagccccggttttatgcataaccgtattattatatgctactttactacacttaatgcttgtaggattgtaatgtgcacttaaagtataggagtttgcttgaaacctctaggtgcatgaacttaggattcctttttgagatgatactaatatgctaggtcgagagctgcttgct

SEQ ID NO: 2043 - DNA, 2055 bp, Zea mays
atgggcagaggcaacggaaacacgtgttcgaccgtggctgacacccccggttcacgcccgttcgcgcaccgcgcctcccagtgcacgcccgcgcgcgctcgctggtccacgaccgcccgtgcaccgcgccgttcctataaagccttcccaggcacgccccacttcgccccgcactcaccctcaccggccagccactttcccttagctccggcgagctcaattccgcccgccatcgccgccagagcttcggccaccgtggccagcccactccagccatcctcaagtcgagccagtgcttcggctagctccgctagtagcccgtgaagcttgccaagccctcggacccggccggacttcaccggaggcccgagatcgacctcaccggacttcggtcttccgccgccgcgcgtggaccgagctatccagtgagtctccgaccgattccttgcacccatatcttctctggcatcccgtgaacctctctgacccatccaattgctctatctcgccgtgaccaggccggactcctcgccgccgacgagcatccccgcctgcgcgcgtggaccgaccgactccggccatctccgacggcgacccgcacaccgttgtgatccccgagacctcccctacgtcctcgaccacttcaccggagcaatctcgccgccggtaagcccctccgccctttcttccgccgcggttactgtttgagttagaagaaggacctcgggttaggatttgtagaacccgaggggttttctgtaacgtcagtgactcatgtgaatagtagcctaaggactgattcgcgaggaaaacttagaaaacccgccagggaccccagtgcaaagtggttttccgtttaatcaattctgttaatctttttaaaatgaccagagaacttagaaaatccataacttgatgaaatcttaatagaaagttgtcaaaccaattttactagcttctgtatattataatctatcatttaaaaataatagactctatactttctgttcaaaattttagagtttaaaattaaaaacagaaacccactaaaccttgtttaattaaggaaaattagtttttcttctgtgctgaacttaggaaaatttgtagatgatcaaacctcttttagacactgtttaaaaatagtgggaaccccagcattgaaaaatatgatatagtttctcatttaaagctattttgtccaaaacttagagaaaatcaaaaaggcagtagaaattaatgaacagtgattaatattatttttcctagtttacttatgtaacagagaacctaggaaaaatgcagagaccattaatttggaccagttttaaattaaaaatgatttgtttagccttatatagactgaaaatcaattattagagaggcaaaactataaccaaaatgcttaataaaaatccagtggacttataaccactagagccccactacaaaaatacagagcacctcagcccaactttttaagtaaggaaaataaatacaaagtgataataaggcattttccaaataattcttgaataacccctaatgatgcaataatgggcaaccaaaattttgctaagatcataatgtgatgaactaccagagaaaaatgcaaacccatgaaaaagaagcaaactcatacctattgctaataatttaaaagaaaggccacttaattcaaataatgcataccaccccttcccttaagcaaatagaggccaaacttcagaatgattgctcttgcacaaaatactaactatgaaaaataagaactctgttgtttaatgtgtttcaaatatagtgatagtagaaagcacccatttggctagaaaacttgagaaaaacatagaaaaataattaaaagttagtaatgactagaaatttgtatcaagtcatgttataacacctaaaagccagcaaaaataagttttagagaattacccactgttaaataatagttgtagttcaaagcaccccttctgccctaaaatttgataattttatccagagaaaactattcactttctgatccccaaattttgagacagagaaaca

SEQ ID NO: 2044 - DNA, 1722 bp, Zea mays
  misc_feature (1608)..(1608): n is a, c, g, or t
ctccctgtgtgtggcagtgagacaaacaggatttctcccctctctatctcttaatccagtcagcgaaacttactagcctccacacacaaacgacaaagggacctgagaggaagagatctctcaacgggatcatggccataatctcaaagatttgggcccaatccgcgcttgaacttgacctctctctgcgttgcctcgtgctcgacgctgtgccaggcgccagagcgcgcactggcgttcgccgcgcactccccgagcgcttgtcagagccctgccctcggccgtgctcgcccgcgcctataaagcctccccgggcgcgcctcacttcaccccgcgctcaccagcaccggccagccacccctcagctccggcgagctcatttccgcccgccattgccgccagagcttcggccaccgtggccagcccactccagccacccccaagtcgagccagtgcttcggctagctccgccagtggcccgtgaagctttccaagccctcggatccggcaggacttcaccagaagcccaagatcgacttcgccagacttcggtcttccgccgccgcgcgtggacagagctaaccagtgagtcttcgtccaattccttgcacccacatcttctctggcaacccgtgaagctctctgacccattcaattgaactacctcgccgtgagcaggccggactcctcgccgccgacgaacatccccgcctgcgcacgtggaccggctaactccgaccatccccgatggcgacccgcacatcgttgtgatccccgagacctcccctacatcctcgaccacctcaccggagcaatctcaccgccggtaagcccctccgccctttcttccgccgcggttactgtttaagttaggagaaggacctcgggttaggattagaagaacccggggggttttctgcaacgtcagtgactcatgtgaataggagcccagggactgatccgtgaggaaaacttaaaacacccgccagggaccccagtgcaaagtagtttcccatttaatcaattctgttaatctttttaaatgaccagagaacttagaaaatccataacttgatgaattcttaatcaaaagttgtcaaactaattttgctagatcctaaatgttatgaactatcatttaaaaataataaaccctatgcgttctgttctaatttttagagtttaaaattaaaaacagaaactgaccaaaccttgtttaattaaggaaaattagttttgcttctgtgctgaacctaagaaaatttgtaggtattcaaacctcttttagacactgtttaaaaatagtaggaaccccagtattgaaaaatatagtgtagatatccatttaaagctattttgcccaaaacttaggaaaaatcagaaaggcattagaaattaatgaacagtaagtgaaattatttttcctagtttgcttaagtaacagagaacctagtaaaaataaagagacctttagtccagatcagttttaaaataaaatgttttatttagcattatttcaactagaaatcaattgttagaattacaaaaccagacccaaaattgataataaaaatccagtggacttataaccaccagaacccactgcanaaataatgaacaccccagcccatcattttaagtagggaaaataaatctaacatgataataaggcattttcccaataaatcatgaataaccccatataatgcaataatgggcacc

SEQ ID NO: 2045 - DNA, 1524 bp, Zea mays
  misc_feature (10)..(10): n is a, c, g, or t
ggccgggccngggatcctccctccagggccgcacaccgccgcctcgcctcctttgtccccctccttcccaccgccgacgactgccccgacacctccggcaagaatggggagcaccgacgagactggaactccctatggcgagtacacctatgctgagctggagagggagctgtactggccatctgagaagctgagaatctcggtcactggagctggtggtttcattggatcccatattgctcgccgtctgaagagtgaggggcactacatcattgcctcagactggaagaagaacgagcatatgaccgaggacatgttctgccatgagttccaccttgctgacctcagggtcatggacaactgccttaaggtcaccaccaatgtcgaccatgtcttcaatctcgctgctgatatgggaggcatggggttcattcagtctaaccactctgttatcatgtacaacaacaccatgatcagtttcaacatgcttgaggccgggcgtatcaacggcgtgaagaggttcttctatgcctcgagcgcatgcatctatcctgaattcaaacaacttgagacaaatgtgagcttgaaggaagctgatgcctggcctgctgagccgcaagatgcctatggcttggagaagctcgcgaccgaggagctgtgcaagcactacaccaaggactttgacattgagtgccgcattggccgttttcacaacatttacggtcccttcggaacatggaaaggcggccgcgagaaggcaccggctgccttctgcagaaaggctcagacatccacggagaggtttgagatgtggggcgatggtctccagaccaggtccttcaccttcatcgacgagtgcgtggagggtgttctgagattgaccaagtcagacttccgcgagccagtgaacatcggaagcgatgagatggtgagcatgaacgagatggctgagatcgtgctgggctttgaggataggaagctgcccatccaccacatccctggcccggaaggggtccgcgggcgcaactctgacaacacccttatcaaggagaagcttggctgggccccgacgatgaagctcaaggatgggctgcggttcacctacttctggatcaaagagcagatcgagaaggagaagacgcagggggtcgacatcgcggcgtacgggtcgtccaaggtggtgtccacccaggcgcccgtgcagctgggctccctccgcgccgccgacggcaaggagggcctctaaagcgacgacccagggctgtctggcgtaccatggcgggatatactgtttgcggtagaatatcacagtagcagcaaaactagtacttttggaggttcagacatgacggtcgccttcttttctattttcccattcatcgctccatttatttatgatgccatgcaactcgttgaatttttgctgtactccctttatttggtcttggccggccggcaataaaattctccctgtttctactaaaaaaaaaaaaaaaaaaaactcgaggcgcggcccggggcccg

SEQ ID NO: 2046 - DNA, 4314 bp, Zea mays
  misc_feature (849)..(849): n is a, c, g, or t
tattacttattctttattgttattcggaacattgtgctctaatgagttatttatgtaatcgatgtgtacgttaatttcagaatctgacacgtatacattcagttgaactttaaaaccggatgtgacacttaaattggtcttccttatcccaagaaacatgcatgattgcctgataactgataccacagtaaagaaaaaaaaggaaatgctggtattcggcaggatgatttctttctgcaaaagagacaaaaaaaaaaaagaaacaggaaaatcctgccaaaccttcgccatcacaatctcatcgcgtttttttcttgccagcaaaagtacagtgaacccccacctatcctgtgtccctccctctataaataaataaataaacttttttaggagacgaagcacaccgcaggacaggagaagcttgggtctcctatcctccccacccctctctcggtctcttccccaccgcgtcttcgtcgtctcgtcttcctgcctccttcgcccgagaaaggagaggtaagcccgccgagatctccttttcttgcgtgcttcatcacgccaggctcgtcccggtgactggctggttttggctctgggttgtcggctccggcctccgggtccgggcacagagcgcgccgcgcaatggcgccgtgcggatgtctttcggttgactgagtccatgcatgcaggttttgtgcctggaattgctaggattttttaggattttccatagtagcttcgttaatccgcccgtttccaacttcccgtgggaggaataaacctgggaagccatgtctaggctgtcgcccctgttttgccttgcgaatcctaggatggcgcttgcctgtntttaccgtgtgaaatctgttgtgcagcagcgtcgttgttcgatttagggacggcggttgacttttcggccgccaagatcctgcctgactagcaagtacggctctcatgtaggcaacattagaggcacaaggcttacaagctctcttctctgtttccttcactctctgtttatcatgagatggtaacttggaaattgctactctgctactggaaagtaaaagtttcagaatttacatcattcagaaggtttgattatttgcacgtctctgatagccttgtttatttaatgcctaggtttgttaatgagctttgcgctctgtttactacgtactgcacatgtttttcgttcatctggccgcgcttaggcttttaagtcaaccagatctgcaacggtactttgagttaagaagcttcagaagtatcatgcgtgttcagattccttgatgccataacggacaatatttaattgccaccggcacacacgacttgctgtaaagattccctggacccatgattggctgataatttggtatcttcttgttttgtttttattgagtatatgtgccacacattggctatacgttgatgatccatgagctggactttagcaactgctgatgtgtgtgtgattcatgagctggactctagcaattgattgtcttgcttcaaatgacagtgctgtcggcagcgagaagaccgttaccgcctacggcgagtacacctacgctgagctggagagggagccctactggccgagtgagaagctgaggatttcgattactggggctggtggtttcattggatcccacattgctcgccgtctgaagaacgagggccattacatcattgcctctgactggaagaagaacgagcacatgaccgaggacatgttctgccatgagttccacctcgttgatctcagggtcatggacaactgtctcaaggtcacccagggtgtcgaccatgtcttcaatcttgctgctgatatgggtggcatggggttcatccagtcaaatcactctgtgatcatgtacaacaacaccatgatcagttttaaacatgctggaggctgcacgtatcaatggtgtgaagaggtatatatacaaatatattgccacttcattttctttctggctggtgaataacttcccaagtaatctacctgatgctatttgactgaagttttcaaagaacctattcatgcataatagtatcattttggtctggcaggttcttctatgcctcgagtgcatgcatttaccctgagttcaagcagcttgacacaaatgtgagcttgaaggaatctgatgcctggcctgctgaggtgtgttcatcgaaatacaatgacgttcctgtttgttagacatatatacagtcaaatctaaatcccctcggtgttacgtttcagcctcaagatgcctatggcttggagaagcttgcaaccgaggagctgtgcaagcactacaccaaggactttggcatcgagtgccgcgtcggccgcttccacaacatctacggccctttcggaacatggaaaggtgaacctactaccagttttctgggctgtggctgtgaggtcataacaatccaacggcctgataaaaaaatgctctctttgtctatcaggtggccgcgagaaggcaccggctgccttctgcagaaaggctcagacatccacggagaggtttgagatgtggggcgatggtctccagaccaggtccttcaccttcatcgacgagtgcgtggagggtgttctgaggtatgtctgtgtgctttggatatactaccaaatttaagcaagagctagctgttgcctgtgttgtgtatagcaatggagaatcgacattgtatgacgatgatgcccacactgtgtgcactgcagattgaccaagtcagacttccgcgagccagtgaacatcggaagcgatgagatggtgagcatgaacgagatggctgagatcgtgctgggctttgaggataggaagctgcccgtccaccacatccctggcccggaaggggtccgcgggcgcaactctgacaacacccttatcaaggagaagcttggctgggccccgacgatgaagctcaaggtactgtcactatcttgctagatatagcctccatcgccatgctggagatgttgggaggacaaacagatgtaaacaaaataccctttgtgcaggatgggctgcggttcacctacttctggatcaaagagcagatcgagaaggagaagacgcagggggtcgacatcgcggcgtacgggtcgtccaaggtggtgtccacccaggcgcccgtgcagctgggctccctccgcgccgccgacggcaaggagggcctctaaagcgacgacccagggctgtctggcgtaccatggcgggatatactgtttgcggtagaatatcacagtagcagcaaaactagtacttttggaggttcagacatgacggtcgccttcttttctattttcccattcatcgctccatttatttatgatgccatgcaactcgttgaatttttgctgtactccctttatttggtcttggccggccggcaataaaattctccctgtttctactacatgtggacaacatgtatgtatgatcctatactagattggtatgggctctcagcttccattccatccattcaaatgtgacgacgagactgccatctgccaaggaagacgtagctgtagcgctagctgtggttggttgtgctgtcgtcttctcagacgggcggcgggaccatgttcttctttgacaaacggctgccggctgggctgtgcgtggtgatgccgagtaatattccctgggaaccagaaagggaacgctacgtgttcgggcatggtccaaacgatacgagcgctcccgcgggcacggggtcgtcggcgtcagcagcccaccggccaccgcagcaaaaatcagcctggtccaccgtggaagcgggcagctcatcacccacgaatagtacgttacagaagcagaatgcacaagcccgtgtatgcgactaagaccaagctccactacaagcacttcatgcgccccacaacttactatagatttgatgagatgtatataaattttaaaaactataatagtccttcatggcaggcagacaacaaccaagtttgaatccagtccacacaaaattcactgtatagatatatatacatataaattaaagccaacattacttgttgcacactgcaacccaccagctagcatgtacataatattattgtgcaataaggttcacaaatctattcctcaaggaggctagcattggtagttaaacgtttgttcacaaatttattcgtatttagggctacacgttttgtatttgtaattatgttaacgatgttaattaatactctccctcccataaaataaggcgtacatgtttttagaaaagtcaacgttttaaaattttaactaataaatttataaatcagcaaaaaacata

SEQ ID NO: 2047 - DNA, 1575 bp, Zea mays
cgtccggggggccgggccgggccgggaagcacaccgcaggacaggagaagcttgggtctcctatcctccccacccctctctcggtctcttccccaccgcgtcttcgtcgtctcgtcttcctgcctccttcgcccgagaaaggagagaatggggagcagcgagaagaccgttaccgcttacggcgagtacacctacgctgagctggagagggagccctactggccgagtgagaagctgaggatttcgattactggggctggtggtttcattggatcccacattgctcgccgtctgaagaacgagggccattacatcattgcctctgactggaagaagaacgagcacatgaccgaggacatgttctgccatgagttccacctcgttgatctcagggtcatggacaactgtctcaaggtcacccagggtgtcgaccatgtcttcaatctcgctgctgatatgggtggcatggggttcatccagtcaaatcactctgtgatcatgtacaacaacaccatgatcagttttaacatgctggaggctgcacgtatcaatggtgtgaagaggttcttctatgcctcgagtgcatgcatttaccctgagttcaagcagctcgacacaaatgtgagcttgaaggaatctgatgcctggcctgctgagcctcaagacgcctatggcttggagaagcttgcaaccgaggagctgtgcaagcactacaccaaggactttggcatcgagtgccgcgtcggccgcttccacaacatctacggccctttcggaacatggaaaggtggccgcgagaaggcaccggctgccttctgcagaaaggctcagacatccacggagaggtttgagatgtggggcgatggtctccagaccaggtccttcaccttcatcgacgagtgcgtggagggtgttctgagattgaccaagtcagacttccgcgagccagtgaacatcggaagcgatgagatggtgagcatgaacgagatggctgagatcgtgctgggctttgaggataggaagctgcccatccaccacatccctggcccggaaggggtccgcgggcgcaactctgacaacacccttatcaaggagaagcttggctgggccccgacgatgaagctcaaggatgggctgcggttcacctacttctggatcaaagagcagatcgagaaggagaagacgcagggggtcgacatcgcggcgtacgggtcgtccaaggtggtgtccacccaggcgcccgtgcagctgggctccctccgcgccgccgacggcaaggagggcctctaagcgacgacccagggctggggctgtcttcgtccatcacagctggcgtaccatggcaggatatactgtttgcggtagaatatcacagtagcagcaaaactagtacttctggaggttcagacatgacggtcgtcttctattctattttcccattcatcgctccatttatttatgatgccatgcaactcgttgattttttgctgtactccctttatttggtcttggccggccggcaataaaattctccctgtttctactaaaaaaaaaaaaaaaaaaaaaaaaaaaaaa

SEQ ID NO: 2048 - DNA, 1083 bp, Zea mays
acaagaaccagaaccagaacccccccgctgcgcaaccggaggcgtctcccagccccgcgccgccgctgacggagatggccggccccgtctcctcagcgccccggaccgtcgaggacatctacaaggactacgccgcccgccgcgccggcctcgtccgcgccctcacatctgatgtcgacgggttctacagcatgtgcgacccagagaaggagaacctgtgcctgtacggtctcccgaacggcggctgggaggtatcgctgccggtggaggaggtgccgccggagatgcccgaaccagcgctagggatcaacttcgccagggacggcatgaggcgtcgcgactggctctcgctcgtcgccgtacactctgacgcttggctcgtctccgtcgcattcttcttcgccgccaaactcaacggcaacgacaggaagcgattattcaacatgattaatgatcatccatctgtgtatgaaataatggctgaccggaagggaagggagaataatcctggtgttgataacagcagcaaatccaggcactcaacgaagcgatcaaatgatggaaagataaagaactcaagagtggcagttggtgaatgtaggtatgagaatgatgaagaccacagcgaaaccctttgtggttcttgcagtggtctctacaactcaagtgagttctggattggatgcgacatttgtgagcggtggttccacggcaaatgtgtgaggataaccccagcaaaagcagaacagataaagcactacaagtgccctgattgcagctacaaaaagagcaggcaataaaatcttggagctgctggcctcctattactgactcagctgatcaaccaaacaatacttttcaatttggccgtagatgttaactaccctaggcatttctttgttgtggtacatgctggaaaaagacatacaggatagttgatcttacagtctggtcaattgcttttgtgcttgttttaatgacatctgtttacgggttatgtcttcaaggtggatggtaatcttttgcgttgtgggctctagcaacgtgatgagttatggccattatccaaatttgagaaaaaaa

SEQ ID NO: 2049 - DNA, 719 bp, Zea mays
cccgcggccggccgggcgggcagggagtacaaactcccgtcgtggcgtctcaccgtttccaggatacgaccatgaggtcggccatcctgcttacgatctgcaccttgtccgcgctgctgctggtggcgcgcggctcggagaagccatcggccgcgccgccgccggtggtggccgtgggcgtggcggcggccagcgacctcatccgctccggcggtcaccgctacctggacgtcagaacagaggaggaattcaggagtgggcatgtggaggattcactcaacgtgccctatcttttcttcacttcacaaggaagggagaagaaccccaagttcatcgcacaggtcgcagcgggtttcgacaaagaggacaacatagttgtgggctgcaaaagcggagtgaggtctgaattagcatgtgctgatctcatggcagctggatttagaaatgtgaagaacatcgaaggtggttataccgcatgggtggaaagtggccttgccgtgaagaaatctcaagcacaagatgaactatgatgtgccctatcatgttggttcttccttgctttgacgacaaccttcgtatagaaaataataggtttaaatgagcaaaaatatacttccttggttatttaaatatatgacacagttgattttcgaaccgctcgacttgaaaaaaaaatcgtcagttttcatttaaaaaaaaaaaaaaaaaggcgggcctgg

SEQ ID NO: 2050 - DNA, 1435 bp, Zea mays
gggcgattgggatcctcgaggccggccgggagcagaaagcaatcgagaggagaaccagcagcctccaataagagccagccagagaaactaataaaactctcaccgccgccatccgagagaacaagccaaccgaccccgtccccaaggcaatccgtcgccgacgtaccaccgccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgccgccgcggggccctccgccagcagcggcgcgcccgccctcgccgccgcgcccgccgcgctcctcttctccctcctcgcctactacctccactaagcgtgtgcgtgcttacgtacgcgcgcatggacgacgatggatccgtccaccgttgccattgcagttgcctcgctcgttcttggtgactgttgctgcggtggtcgacttggaagacgtcacctgcaccgctgtttccatatattattattgatgtgatctgatatgaatatatatgcatggtgacgggttgtgttaattacatagacgtgatttaatttatctatttgtgtcaagtcgttctgtaatcatgcgatgaaatatatgatttggttttccatttgtttgaaaaaaaaaaaaaaaaagccgacagcaatcgagaggagaaccagcagcctccaataagagccagccagagaaactaataaaactctcaccgccgccatccgagagaacaagccaaccgaccccgtccccaaggcaatccgtcgccgacgtaccaccgccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctgccgctcccgccggtgctgccgcgcccgccgcgctcctcttctccctcctcgcctactacctccactaagcgtgtgcgtgcttacgtacgcgcgcatggacgacgatggatccgtccaccgttgccattgcagttgcctcgctcgttcttggtgactgttgctgcggtggtcgacttggaagacgtcacctgcaccgctgtttccatatattattattgatgtgatctgatatgaatatatatgcatggtgacgggttgtgttaattacatagacgtgatttaatttatctatttgtgtcaagtcgttctgtaatcatgcgatgaaatatatgatttggtttttccatttgttccaaaaaaaaaaaaaaaaaagcggccctcgagctc

SEQ ID NO: 2051 - DNA, 1282 bp, Zea mays
gccgccccggcccgggagtcagaaaagccgctcttcttccgttccgtccgcccgcccgcctgcccgcttctctctccccctctccctccacccaacccgcgagaccgccggcagctccaggacaggaggaggagcggcttcaattcgtccccgcgccgcgcgcccaggacccgcccccgctgcctctcccgagggttccaggttctcatcaggcagaggcagaggtcaccttctgctgctcaacgcaacactgcacatacatacatacagatgggttccgaggggccttctcccgtcaccaccaccgtccacgtcactgggttcaagaagttccacggagtcgccgacaaccccaccgagaagatcgtgcgcaacctcgcgtcgttcatggacaccagagggctgcccaagggcctggtgctcgggagctgcaccgtcctcgaggccgccgggcagggcgcgcttggcccactgtaccaactgctggagtccaccgtcgtctccggccggggacgtgggatgccggctcaggagcgagtgattctgctccattttggcgccaacagtggttcacataggtttgcgcttgagaatcgagctgtcaatgaagctactttccgttgccctgatgagctaggatggaaaccacagaggacgcctatcatatcatccgatggaaacatcttacacgcaagacagaccacactgccactgaaggaaataagcaagtctctccagcaaatgggatatgatgtgatgccttcagatgacgctggtcgatttgtgtgcaactatgtctattaccactcgcttaagtttgcagagaagcatggcatcacgtctctcttcgttcatttccccctcttcctggcaattgatgaggaagttcagatgcaatttgttgcctcccttcttgaagtcctcgcttccttgaacttctagtagtaacctgatggtagatctatctcttccagtggtgtattgttcccaatttatttggaagggttcccaatttacatgtggagtgaataagaatgaggaatcattcatggagttatgtgtgcttcaaaatgtgtaaaaaaacagctcttctcaaagaacatgtccaggcagtacagatgtacaaatatccaaagtggtttatatgacaggtgctattgttctcagagatgtgtttcactctgttctttgacatttacagaaacatttttctgatcatcagatcatatgtaataaagtaacttacaaacatggtgcaacgatctgtgtttttcaatatttt

SEQ ID NO: 2052 - DNA, 1090 bp, Zea mays
cgcgagaccgccggcgaatttgttgcagtgcactgaagccaaccgctgcggcgctcgggccggcggggccggcgtttccacaattatcccccgcgcgcccaggccagccccgcccccgcccgcccactctcccgaggattccaggttctcaacacaacagacaacaccgctcaccgcatatatatatatatagatgggttccgaggggccttctcccgtcaccgtccacgtcaccggattcaagaggttccatggagtcgccgagaacccgacggagaggatcgtgcgcggtctccagccattcatggagacgagagggttgcccaagggccttgttctcgggagctgcaccgtccttgaggccgccgggcagggcgcgcttggcccgctgtatgaactgctggagtcgaccgtctccggccgggaacgtcaggagcgagtaattctgctccattttggcgccaacagtggttcacataggtttgctcttgagaatcaagctgttaatgaagctactttccgttgccctgatgagctaggatggaaaccacagaggacacctatcatatcgtcagatggaagcatcttacacgcaagacagactacactgccagtggaggagataagcaagtctctccaacagatgggatacgacgtggtgccttcagacgacgctggtcgatttgtgtgcaactacgtctactaccactcactcaagtttgcagagaagcatgggatcgggtctctgtttgtccatttccccctcttcctggcaatcgacgaggaagtccagatgcagtttgtcgcttcccttctagaggtcctcgcttccttgaacttccagtgaacctagtggtagatctaccacttcccggtggtgtattgttcccagattatttgggaaaggtttaagttgttcccaacttacctgtggagaataagatcgaggaatcattcgtggaattatgtgtgtggttcaaaatgtgtaggggaacaaaaacaagtcttctcaaagaacatgtacatgcagtccagatgttaatatcccaagcggtttatatgacaggtgctgatgtagcgttgctctcac

SEQ ID NO: 2053 - DNA, 1182 bp, Zea mays
ttgggtccctcgaggccggccgggcctcctctggaaaaccacctcttctcctagacttcttccgttgcatcttctcttctgttctccacgacgcagttcggctgccagacaaaaaccctaaacgccgccgccgccgccgctcttcctcgagatgggaggcaagtgcccgcaccgcaaggtaaagaagcgccgcctatcccacaagacggctcgccgcggcaagttcctcctgaaggccgacgatgccgtctatgacgagctcgtcaagctggccgaccagggcaaggacgctgaagccaaggagctccccgtcgatgaggacctcccaggcctgggacagttctactgcctccactgcgatcgctactttgcaagtgaaagcgtgaaggatgatcactaccgctcaaagcgccacaagaaaagggttaaggtaatgtctggaccggccccgcacacgcagcttgatgcagaactcgctgcagggatgggaaagcctgacaacggcctgaagctcatgtccatgtgaaggaacctcttgctggtactggtacttgttccgtgcctttgttgctgccgtacacttgaagctgctttgcgcagtaagtaatagcaagagttatagcagacgggtttttattagtgtacgcaagactttcgaagtcggtgtgagttgttttagagaggtggcagaggggggggggggtgtcaatgcatgtatcatgaaaccatttaccgacccataccagtgatgatgatgatgtctcgtatcattaaaaaaaaaaaaaagcccgcccgatgtagggtagtactcccttcgtttcgttttagttgtcgttggatactccgtttctttttagttgtcgctggatagctcaatttcaactactaaaacgaaacggagggagtaccccaaagacagacggatggacgcgagaggcgtccaggccaggacagccgcgcctgccagcttccgttctgtgccaagattttccaagatctgtgtctgctgtacagtacctgtgctctctatggctctggtttcgtcggccgatgatgccgatggctgggtcgtctataataattgcctatttcgcgtagagacggagagattccttgggctgtgttttgttgtgctcatttcatttttgatctaacatgctgtaccgggcgaacgccatcctt

SEQ ID NO: 2054 - DNA, 802 bp, Zea mays
tgggtacctcgaggccggccgggccgggagtctgaacactggcatccccccaggcctcatccagaaccgaaaaaaaaaactctgcggagattgaccgaccaccaccaccgcctgcgttcccgcgccgccaccgccatggctgccgctgccccccatgcatactcctccctcgtgcctgtttcggctgcgcggcctctctccggaagcacagtttctttcggtgcttcgtgccacaagtggaggaaggttccggcatggcgactccactgtgttgctgaagacgaagcagaggaagtcaaagattttggagtcaatatggcactatccatgctaaaattttacaaacgagaaatatcacctttactaccttcaagctgccgatatgtaccaacttgcagtgagtactctatgcaggcgtacaaacgatatggtgttgtaaagggttccatcttgactgcttggcgcctttgccgttgtaatcctcttggtggatatgggtatgatcctccaaaatggtttggcgaggaagatgtacctctgcaatagtaatgcctagtaattgaaagtacaggcattgtaattcttcagatccagacttgcagcagtttttatgtaatttactgaaactaaacccagaaacacaaggataaaattctgcaatatctatgcacctctgaaggagcatgtattttttttgtgtatgcctggtatggttattttatctagttctcgtgcaattcctccaaggtgattgtatgagcgaaattcatttattacctacaattaacatccataattcccc

SEQ ID NO: 2055 - DNA, 902 bp, Zea mays
ccggccgcgcccgcccccccccccaaccgattgcacaaggccacgcggcttctggaagcttcccttcccttgccttgccttgcctctcaacccaaatcgccacggctcctccgcccgcagcgccctcggcacgaccgccggattcgcctctgggtggggttggttttgtctcccccaccaccctacccacccctctcctctcctccaaggcttggcttgcctcgtgtcgtgtgtccctccaccgcccgccatgccgacgaggcttgccccccaccgccgatcgcacacggtcatatgattgcaatgaatcctgacatggtactactgtcttggaaacaacttccaccaacggtcgatcctgtgaaacactaagacacccgttgccactggaaaggagagagcaaagtgatttgctgtctcctggcgatcgttgctcgtgaggcctagtgatggcagatgctagctcaaggactgacacctcaattgttttagacgacaacgacaagaatcatagggatctcactacgcattggcacctctgaaggtcttcgttggatatgaccaaactatttcaaccaattttgaacaagcttttcttcaattagtgctacccctagcctatcagatggagaatggaagtggtgcggttgtaccttctaattcttcagataggtccgacaggtctgataaacctttggaccaaaagacaatgcgacggcttgcccaaaatcgtgaggcagcaagaaaaagtcggctgaggaaaaaggcatatgtgcagcagctggagagcagtaagctgaaacttgcacaactggaacaggaactccagaaagctcgccagcaggggatcttcatttctagctctggagaccaaacccatgccatgagtggaaatggagctt

SEQ ID NO: 2056 - DNA, 2008 bp, Zea mays
gacccacttactaatccagccagccaatgagtcccccgtttcatcacgcaacgccaacccacaccaacgccacccggacccacccacccctcccgtccgtcgcataccatcccatcccatccccgtgcgccgagttcacggccgccgccaccaccaccaccacaaccgattacacaaggccacgcggcttctggaagcttcccttgccttgcctctcaacccaaatcgccacggctcctccgcccgcagcgccctcggcacgaccgccggattcgcctctgggtggggttggttttgtctcccccaccaccctacccacccctctcctctcctccaaggcttggcttgcctcgtgtcgtgtgtccctccaccgcccgccatgccgacgaggcttgccccccaccgccgatcgcacacggtcatatgattgcaatgaatcctgacatggtactactgtcttggaaacaacttccaccaacggtcgatcctgtgaaacactaagacacccgttgccactggaaaggagagagcaaagtgatttgctgtctcctggcgatcgttgctcgtgaggcctagtgatggcagatgctagctcaaggactgacacctcaattgttttagacgacaacgacaagaatcataggatggagaatggaagtggtgcggttgtaccttctaattcttcagataggtccgacaggtctgataaacctttggaccaaaagacaatgcgacggcttgcccaaaatcgtgaggcagcaagaaaaagtcggctgaggaaaaaggcatatgtgcagcagctggagagcagtaagctgaaacttgcacaactggaacaggaactccagaaagctcgccagcagggaatcttcatttctagctctggagaccaaacccatgccatgagtggaaatggagctttgacttttgacatagaatatgctagatggctagaggaccaaaataagcagataaatgagttgaggactgcagtgaatgctcatgcaagtgatagtgatctacgacttattgtagatggcataatggcacactatgatgaaatattcaaggtcaaaggtgttgctgcaaaggctgatgtgtttcatatactttcaggcatgtggaagacacctgctgaaaggtgcttcctatggcttgggggttttcgtccatctgagcttttaaagctcctagcgaatcacctcgagcctctaactgagcagcaaatgctgggtttgaccaacctccagcaatcttcccaacaagcagaggatgcgttgtcacagggcatggaagcactgcagcaatctttggcagagactttggctggatctctcggtccagcaggttcttcaggaaatgtggcaaactacatgggtcagatggccatggccatgggcaaactcgggacgctagagaattttcttcgccaagccgacaacctgcgacagcagacgttgcatcaaatgcaacgtatcctaacgatccgacaggcttctcgtgctcttcttgcaatccacgactatttttcacgattgcgcgctttaagttctctgtggcttgctaggccacgtgaataacgaagggccgtcagtattttgagttccctctgccttacggtgctgctgcgtcgttcgcagcgatgcatcacagatctttggtggtactgtttttgttgtacaattacttttggccgctgcttggtccaaattgtactcaggtgggtgtacaagtaggtcaatataatcctgtaagttatggtgatttatgggtgtgttagcaatgcaataataattagagagggcaggatcagggtttctgttgtttgtactggttagagatttagtcctaatgtaacttcctgggacatggggggcggaatgggaagagagtaacaagaatcttcctttggttactgtagtatatgttggtattgttgcatcccatttgctcattttgctgttaggagaatgattattctgtccaaaaaaaaaaaaaaaaagcggcc

SEQ ID NO: 2057 - DNA, 1345 bp, Zea mays
agataaattacagtagagatacacttccctgcctatttcacgtaaaaaataatagaacaaagctgaaccagggccttaagtggctctcagcgctcgtattatgtggcccaaggttctatatggcccgaaaacaaacttagcactttaagggccgggcccagaatagaataataaccaggtccttaccagcccagtaaaagctcatccaaccaggccgaaccacctcaagctaaaatcacaccgtgacaccgagcccacccgtcgcgatctgtcacgtacacacctcgtacacgcgttgccttcagagccccattattctccgcctttgtgggccccacgtgccacgtttcgatccttcatactataacgcattcccgggcgccgccgcccactttccctccccatcccgtgaggcgtgagcgccacacccacacgaaggatcccgaagccgaagagaaccctaccgaggaggcagaaaatccgtaggcgcgcctcatacgattccgagatccgtgcctcttatcggcagccatgatgctgcgcgcggcgggcaggcgactcctcggcgtaggaggcggcgatccagcgcccgcggtcgctgctgctgtggcggcgagcaggagcagaggataccacgagcgggtggtggaccactacaacaacccgcgcaacgtggggtccttggacaaggacgacacggacgtcggaacggggatcgtcggcgcgccggcgtgcggggacgtcatgaagctgcagatccgcgtcgacgaggggtccggcaggatcgtcgacgcgcgcttcaagaccttcggctgcggctccgccatcgcgtcctcctccgtcgcttccgaatgggtcaagggcaagcaagtggaggaagtggtggccatcaagaacaccgagattgcgaagcacctgtctcttccaccagtgaagctccactgcagcatgctcgctgaggacgcaatcaaggccgccgtgaaggattacgaggcaaagaaagggaagaagatggccaaggcagaggagcaggacaccccatgcccgtaagagcgacagctagtaaactgaagcgagcagagagtactgtatgtagtatgtaacggctaacgagcgaggtactcgtgtcgtgtgtgccaaaagaagcatgtatgtaatgtaaagctaggtaacaacgatgtttgggtttcatagaataagcgaacttgccgcagtgttttttttatctgctctgcacatgaataaggtctgcccattgctctttatctgtttagtcggagcatgtatgcttagtttgatcaagcaatgctgttgagataaaaaaaaaaaaaaaaaacggcacgag

SEQ ID NO: 2058 - DNA, 1236 bp, Zea mays
cctcgaggccggccgggacgtttctatccttcatactttggggccctccaggccggccgggccttctttccctccccatcgcgcgagcgccacacgaaggatcccgaagccgaagagaaccctaccgaggaggcagaaaatccgtaggcgcgcctcatacgattccgagatccgtgcctcttatcggcagccatgatgctgcgcgcggcgggcaggcgactcctcggcgtaggaggcggcgagccagcgcccgcggtcgctgctgctgtggcggcgagcaggagcagaggataccacgagcgggtggtggaccactacaacaatccgcgcaacgtggggtccttggacaaggacgacgcggacgtcggaacggggatcgtcggcgcgccggcgtgcggggacgtcatgaagctgcagatccgcgtcgacgaggggtccggcaggatcgtcgacgcgcgcttcaagaccttcggctgcggctccgccatcgcgtcctcctccgtcgcttccgaatgggtcaagggcaagcaagtagaggaagtggtagccatcaagaacaccgagattgcgaagcacctgtctcttccaccagtgaagctccactgcagcatgctcgctgaggacgcaatcaaggccgccgtgaaggattacgaggcaaagaaagggaagaagatggccaaggcagaggagcaggacaccccatccccgtaagagcgacagctagtaacctgaagcgagcagtactcgtataacggctaacgagcgaggtactcgtgtgtgcagtgtgcctaaagaagcatgtatgtaatgtaaagctaggtaataacgatgcttgggttttcatagaataagcgaacttgccgcagtgtttttttttaaaaatctgctctgcacatgaataaggtctgcccgttgctctttaaaaaaaaacaacgagcatgcatgcttagagcggccaagcaatgctgttgagattaatccccggatttgctgtgctttggcttattgcaaggagccgaaatacacacttaggaaggagcacgagtgcgcgactgacatcctggcgcgcgagtctagctcgcttttgtcagccagcctacaacccgcacccgcctaactaccacatgcgcgagcgcgagccatttgcgtgtcgggagccttgtcgacatccaaacactcgtactacgctgcatggtgagaccaggggcagggacctttacacggacccgggacccg

SEQ ID NO: 2059 - DNA, 2958 bp, Zea mays
  misc_feature (969)..(969): n is a, c, g, or t
  misc_feature (2401)..(2401): n is a, c, g, or t
agcggaggtctttgttggagaccgtctcgagattatcgcaaactacaccaaatcaaatcaacgcggacacccatgagcactggagtactgagtccagagtgaccacggaattccgacaagcgacaaccgttcctcggccccggcccgggcccctgcttatctgcttgcccgcgtcattgctgcagcgccgccgccaacgaggaaaaccgaagctgaaaggaaaccctcagagctggtcgcctccccccgtttcaaattctccgaatcgctgcaaacggtcgccgaaatttcaaaatcccacctcccaatgagcgggatcctcccccatttcaaatttcaaatccacccactcccacttctcacgattcacggctcacgagcccgccgatctatacagtacatcccatccccatcgcatcccgtggtctctcatccccatcccatcccatccccatcgcatcccatcccttttcgtcgagcgccgccgatggagtgggacggcgactgcagcgaggtcggcatgaactcggtccctgacggcgtcgtccagctcatcctgtcgatgctcagcaacgcccgcgacgtggccgcctgcgcctgcgtctgccgccgctggcgcgactgcgtcccctacctacccgcgctcttcttcccgcggaacgccttcgaaccggccaggggcgccgcggacgatgtcatcggccggatggtggcgtccgtcgcgcgcctcagggagctggtcatctactgccccttctccatggcgcgcctcccggtctggctcgccgagcggagcgccacgctccgggtgctcgagctgcggatggacgccgccgctgacaaggtcccggaaggtgggcacctcgactgcatcggcctgactgcgaatctggaggagctcaggctctggggagtgtctctcacggccccgccggcgtggggccggatggagcggctccgcgtgctggnaggttgtcggtgcgccgctgcgggatagcgccgtgagggacgccatcgccgcgtgccccaacctcaccgatctgtctctgcttggatgcgactgctccggcacggtggctatcgatcttcaacagctcgagcgttgccggctcgacatcctcggcgccggcaactgctcgctcttgctcaccgcatctcgtctggagtcactcgagatccagggcttcacctggatcactctgcgtggtggccacaacctccgccgcctctcaattgccaagagcaccggtgagacacaaatctcgaatcctttggtcagtttagtgttgctttgacgtgatgagaaattctgcgacgggatgatgcagggaggcttcacaaggtggacactggtaatctcccagatctggatcacctgtcgctgcgcggtgttcagtggaactggggagcagtgagctcggtgctgcagggcgcctccgaggggaagcatctagtgatgaagatagagttctgtggcgacctggacgcactccagccgttcccggaagtcgatttggttgacttcttcgacaaccaccccaaactccgcaaatttgagatccatggtgccatgttcgctgccctgtgccagaaaaatagcctgaaaaatgtgagtggtctgtcgtttctatagcattatggttcctaattggattggtacgctagacaatatgacatatagctaattcgcccggtgcctgcatgctggcctgttcaaggttcctcatcccttgtttggaagaggttctgatcactgtacgctccccactcaatgctgaacagaagctgaacactctcgagtcgcttctgaagtacagtgtgaagctgcggacgatgatcatcagaatctcccagatgaagaattgccccgaggctgctgatgagttctttgaggatatatgtaagttcaagtacatgaactacaaaaaagtgagaattgaataagtggagatgctgttttgatttttaaagttaatctgaccgaggactcgattttttttcatcccagaataattttattgtcattattgtcagaggattcattttgaacctcttgagtagttaagttttttttttatcatctagtctatatattgagtactagagggagttgttggaacaattccatcgagtattgtggctgcaaattgttgttgtaatcgtctctgttccatagcaaacatttttcatctacgagcaattcccaccatgaacatcaaatgttgtttactgttcaccgtcttttcttgaaggatgtttcttattattattatgaatatgaattatgacatgttgatttacttatttagatctatacattaggcaactgagatactttattatgtggctgtggctgtttattttgacagcattttgtgtgcttatatggtcaatgcggatngggtttcatatgtattttgaaagagacgcaggtattgtaactccatgagtaaatgtagaccccatatctaacctaaattgcccatctttgccttctcttatttatgtatttcttaataaaatactcacatagatactctataattttatccgtttgcaacatgctttgttgcttattagagaatctctaagaggcactctacatgatcacaaaatttagaaaaaaaccgcaaaaatcatgctccaatacacaccatatttttcactctccataaccaccttattccgtttttcgctttccacttttggggaggtcacatgggtctctaaatgcaaaatgtggtagttttctagggaactttttcatgcatgaaaatttatgataaattgttggagtatagtgcataaaaatctaattgatttaccgaccaaatatttattaaatggtgctctaaatagaaaaatgaaggcaaatttgtagaggcacttaaagtttcccttatactctatgcctttctatccccactcataaattttcttatttgcataattgcatca

SEQ ID NO: 2060 - DNA, 434 bp, Zea mays
cttctttctttttttattcttatgtaaaccaaagatttgcaggagaggagagattggcattaccgagaaggaacaatgcgatgatgatcacaactatgagtccaatccacatccattgccgcagttttctcttgcttcctcggtttcttaaaggcagaggaaccgattttgacttgttttgtttcagaaactgtgatgaaggtttgtgagatttcttcatttgttgactctcctctacggtttgtttctttggagtttcgatctcccttggggtttcgactacagtttctgctgtcggaattgggttttctgttgctgtctcttctgatgtaaaaatcccctttcttctctccttcttccttagcttcttctctcgttcctacaaaatagacagagttgttcaacaaaaaaaaaaaaaaaaaaaaaaaaaagaa

SEQ ID NO: 2061 - DNA, 4642 bp, Zea mays
  misc_feature (891)..(891): n is a, c, g, or t
aattcggcacgaggaaaaactctaagaaataacatccctatgtccttcgtctcccttctctgttcttcctaaaaccccatctaccttctcctcctactactgctaacaacctggtatcagattcagtcgatcttcctccgcccatggcgccgccatctacctcagattcggcccttacccttgctctggagaaccagacccgctccctgcttgccgagctggacaagcgtatccagtccatggatagcaagtgggagtcgcgggtgtccgtcctggagaacacggcgacggatgcagccagatccgtcaccgaattttccactgccctccgcgccgatgtggaggcccatctcacagcctcggatgccgctacagaagggcgtctgcaccacttcgaagtggagactggcaaccgcatcgctgctctcgagtccgcgatgcagatgttcgacttttggcgtcctcgagttgactcttccatcgactcgctccagtcgaacatggactggatgcgcgccgagatcgccaagatggatgctcagtggtcccacggagcgcgcgtcggcggcgccaccatgccaggtgtccttggttcccccggttcccttgctgcgtcgcccagcatcctcggaactccgggcgcgttcgcctccactggatcgggtccggggcacccacctgctgccgtcgactacactgatggccctagattcggacacggcttcgacagctacctccgggatagtggacttcggcatccaactgccgatggccgctacccggtcacgggtatgtggcgtccccccttctccaacattttcgtttgctcaaccaaatgggttcggcgggggcgacgtagatctcagaggggctctaaacaaacatggtggncgggttgcccaaacttacattccccacgtttgatggctccagtcccaagttatggcaacgacgttgcgaaaaatactttgaaatgtatgccacagaggagatggtctgggtcaaagttgccaccatgtattttgaaggggcagctggccgctggctccaatcagtggaaccccgcctgccttctctgtcgtgggttcagttctgtcgtttggttcaagaccgattcggtcgcgaacagcacgaactggtgattcgcaaactttttcatatccgacagacctccaccgtgcaagactacgtcgatcgttttagtgaattggttgatctgttagtaacctatgaacataccacagatcccctttactataccatgcgatttatcgatggcttacgcgacgacattaaatctgtaattttagtccaacgtcctagtactttggatactgcctgtgcgctggccttgttgcaggaggaggcggaggcgtctcgccctcgtgaggtccgtcgcggtgatgcccacttgtcttacaagactccaacgaagacatcatcatatcaggattgggacaaacattctccacaagcttctgacagacctacttcaatggtttcagatccttcgtcgtctgacagtaaggttgcgtccctccgcgcttaccgtcgggcacgaggtctctgtcaatactgtgctgacaaatgggttaaaggccacaagtgctctcccactatccagttgcatgtgatgcaggaactttgggatctactcactccagagtcccaggaaccagaggctgaatttcaagatacatcagaacagttcatgatactgctttctactgaagctgtgtcctccaagtcctctcggtccaccttccggttatcgggttcgctgttcggccaggaattgttgatgttactagattctggcagctctcattgttttcttaacacgtcactggcaagctctctcacaggggtgaatcaattggctcaaccattgtcagtaacagtggctaatggcaacaagttgcagtgtacggctgaattaacaaatgctgagtggacttgtcaggggctctcgtttacttcatcatttaagcttcttcctataccttgttatgatgccatcatcggcatggactggcttgaaagctgtagcccaatgtatgtggactggaaacacaagtggatatccctctcacatctgggcaaatctgcgcttcttcaaggagtccagccaacaacaccgtctgcatccctgttggagtttcgacacacagctccggaccagtctgaaatattccacctgcagatagcccatgattcatcagttccagaggcaattcaacacctcctacatgaatttgacttcctgttcgctgaacctaagtctctgccagcctagccgattttgtgatcaccatattccactcctcgcaggcgctcgcccagttaatttccggccttaccggttctcaccaacaatgaaggatgaaatagagactcaggtggctgatatgttacgccaaggtttgattcaccacagttccagttccttttcctcaccggtcctgctagtgcgcaagaaggacaatacatggcgcttctgtgtggattacaggcacctcaatgccctcacggtgaagtcaaaatacccagttcctattattgatgagttgctagatgaattgtttggagcctcctatttctccattttggacctccgggctggattccaccaagtgttgctcaaggccggtgaggagcacaaaacagccttccagacgcacatgggccactacaagtttcgcgtcatggcatttggactcacaggagctcctggcaccttccaacgggctatgaaccacaccttgtctccattattgcgcaagtgtgccttggtgttctttgacgacatactggtgtatagtgattccttggagagtcatgtgcagcacttgcatcaggtcttcagtttgctcgctcaggatcagtggaaagtcaagcgatccaaatgttccttcgctcagtccagtgtctcctacttaggccacgtggtcagtaaagatggagtggctacagacccgggtaaaattcaggcaattcctcctggcccgtaccatgttcacttaaggatctgcgcagttttttgggtctggccggttattatagaaaatttattcgccacttcggggttatctgtcagcctctcacacagttattgaagaaaggtgtgcacttcatttggacatctgagcatgacaccgccttttccaccctcaagcaagctcttacgtcggctcctgtgttatcattaccagattttgcttctcccttcacagtggaaacggacgccagtgcagtcggtattggagctgtattgatgcagcatgggcacccagttgcattcctcagcaaggctttgggccctaagacccgtggtctctccacttatgaaaaggaatacatggcgattattgtcgcagtccagcagtggcgttcctacctccaacatggcgaattcacaatcctcacggaccacaaaagccttactcagcttaacgagcagcgcctgcacacgccctggcaacacaaagtcttcaccaaacttttgggcttgaattaccgcatccagtacagaagtggctctgacaaccgtgctgctgacgccctgtcacggcatagttttgcagaatgtcaagccgtctccgttattgttcctcaatggctggttgccgtccaagatagttatcaccaagataaacaagcactttccctcatctctaaattggctgttgacccagcggctgtacccaattttaccctgcatgatggtctactccgatacaaggaacgcatttgggtgggtgaggacacacatctgcagcaccgcattgtcgaagctttacacagttccccattgggcggacattctggcataccagtgacatacagccgtgtgaaaaaactctttgcctggactaagttgaagccctttgtgcagaagttcgtgcaggaatgtcaggtctgtctgcaagcaaagccagatcgagctgcttatcccgggttgctgcaaccgcttcctgtgtgtaacacctcaaatccatcaattaaaataatacattattagttgctaaactaagtagagagtaaattaaaaatttatcaagtgtttgaatgcattcattatcggtgcatgatttctttgtttgttaatgaattgcaacacctttattttaatttattctctttgtgaagctctatttacttaaataataaaaaaattgcctagaagcttatttataatatatattatttaataaaatattgttattagatttattatactttttggaatatttaaaatatagttctttttgaataatctaatgttttttaaaataaggggaatgaatttcgaaatttaaaaaaaaaatggacgatcggacctcctcatcctgcgttggattttaccatgccttgcttgtgaacctcctctcattgacatgacaagtgggtcccactagtactttctatcctccttcacctttctcctttcacgctaaaacgaggcagcctgggagctagttctcctgcgccgccgcctggagccatccgtccggccccttgcctaaccgtcctctcgcctcccgattcagcccgtagcgtgggtaccgtgtccgaccagtcatcctccctccattgacgcactcacctgtctgtttttttaacagaggcaatgtctgcaggc

SEQ ID NO: 2062 - DNA, 6387 bp, Zea mays
  misc_feature (6352)..(6352): n is a, c, g, or t
cgatgataagtaaatacaatatacacatatacataaaggaaatattctctcttcatatgagttacaaatttaggtattacacagaaagaggctagaggcccaaccctatattcagtgtctcgtgtgtttcctctgtcgtgcttatgtgaagtgagacgagttctctacatcttcttacgcctctactgctgacgggagggaagggagcggatttggtgatccgtggtaacgtagttctcaacaactactacccacggtccacggaagagagtacatgaatgtacggccagatcggacggcggggatctcgtgtgatgactggttcgcgtataaagtgtctgatttcccgcgctcgatcgagactgaccgaactgggctcgacggtccttccacgttgtacgtgatgactgatcgaactggtgggccatgtacgtgggcgatatatgtatactgcaagatcccgttggaaggccggaaaccccccttcgaagccatgcatgcaggccgaatgctgctgaacgcacagatggaccgcgaaacgggcccagcagaggtcaccgtcgaaacgggcacagatgcaagtgaggcgagcagggatgacggaggaggaatcgcatccaagaccgcagagccggatgacggaggagaggaatcgcatcaaagcgcgtgccacgaccacgatccgcggatgcctgccccccgtgcctctgggggcttctgggcccgcccggcgaccggccggcgggaaaagcgaaagccagttgagtggagcggaggccaaacgaccaacgaaccagaaccagggtggtggtggggtgggcggatcggtcctggggatgaggaggccatcaacatcatccattgcgacctctgactgatggcacgccgcacgccatcggagcatgctgctgctgcatggggacgcgcgacgggctcgcgcaccaaggcccgcgccgatggtggacgctgacccgacggtgtcggtggacgccatgccagccactatgcctctgttctgctacacactgctttcccatcgcactcctccactttgggtggacactggacgctggacacctgtgctgtgtgcgctgcaccatctcctccgtcgcttcctctagatctgctgtctgtccaaagcaagcaggcaacgccgccggcctctctctcttcgccatacaagcctgacacgctgaccggaccgcccggcctcagcctgccatttcaaatcgtgatggggccccgggcatttttcccgccagacttctcttggcgccaagcgccaagcgcccgcgaaccttcgcttgttttggcgccaacccgcgtggtggccggcggccggggcgccgcgccatcgcgctcgcggggccggggcgagaacgagatccgccgcctgacgtgctggtccgtcctgttggctgttgctgttttggccgccggctggaccacggcccgcgtggcgtggcactccgtcgagacaccacgcaggaacagtacatctacacgaagcctaggttcgaccaaaacgggcgcgaccctccactccaggtgtcaaaaggacccggcatgcgtgccctgccctaatcctgatctctacgctgctgtgcagtgcccatacttactagtagtatacaagagtagctccacgcggcacgtcgccgatgcggggcgccggtgaccggtgtgcacgtcgtcgcggccctcctcctatctgaaggggcaggcatatcggtccatgcggtagcatattccagcagaattctgtcacccaaaaaatcggcggttcggcgcctcctgcttgctttgtctcaactactggaagtggaagctgagctcctaaaaaaacaaaaaagaaaaggttgccgagcctgccggccggtcccgcgctggctgtatgtactacgtgtcctgctgctgccggatggtagctcaaaaatcaaaacaatacaattctcgttttttttcaatttcgaactgtctaaattttaattaaacttagattaaattctgtacaatatttataataatatatactaagcaccactagattagttttagaatatgttttcattataatttcatttaaagactgctactataaaatttgtaagtaatggttacttattagttagttatttttttttacggatggagcgaatatttttcttacggttctgttctgcgctatagtacattccgttgcgggaaaaaaattcacccggggcccgcactaacatttggaatgtcatttgttgggatgtgttggttacgatgcctaaagttcaatatatgtacaaccatccaatgtttgaatatgcttgaatgccaattactgtaataaatctagtttaattattaaaaaaactaatcacataaataaaaactagataacaatccgaatttagtaaggctaactaagggtgtatgttaggattataataatatgcccaggttatataaaatctaacaaattttgaattaagtgttagtttacaatttattggattatataatatggataaattataatccaaaacaaatatctcctagtaattcatgactagtaaactatagcattccgtccggtcggtttccttattcgaaatttgtaacgtccgggaggagggtgcaagtgcaaagcaaggaacgaaggaacagccacagcacactgcggccctccacgtggcggccctccctggctcccacgcgcctggccagtcgcttcggcatgtgccgcaccagtgcaccacaccaccctccgccccccttccagcttccacctcttttttaaatccccgcgtccgttccgtcccggccactttcacccgcccacgcattccaattccgaatttcaactgacagctgtgctagctcagacaccggactacaggaggcgccggggagccaacaacaacaacaaggcggcgagcagagccacgccaaagcgcggggaagcctccaagccgcgggcgatcccgccgaggcgtcgtcgtccaccgcatcctccttgtactcttcgtccctgccgtcagggccgccgcgcgctttatatacagccgacccgcgtgcctgggctcgctgcctgccagcagcaagcaagcgccgaggcggagctcgcgaggcagaggctgacggcgccgatggagtggctggacgagtacgagaagctggtgatccggatgaacacgccccgcgtggtcatcgacaatgccgtctgccccacggccacgctggtgcaggtgagctgcggccgcccgtctcctccggttcttgggagtgggggttgcgctaggagctgcaacggcagtggctgactttggtggggctctgcctcttctactccgtggttgccctgcaggtggacagcgccaggaagagagggctgctgctggaggccgtgcaggtgctcgccgacctcgacctgtccatcaacaaggcctacatctcctccgacggccgctggttcatggacgtcttccacgtcacagaccgcctcggccgcaagctcaccgacgacagcgtcatcacctacatccagcaggtagagcgagcgggctatctctcgccatccccttcatttccccgtgcctcgcgctccgaacaaagagcggcctttcgctgacgcggcttcggtctgcagtctctcgggacctggaacgagccggcccggccggcggcgctcgagggtctgacggcgctcgagctcacggggcccgaccgcacggggctcctgtccgaggtgttcgccgtgctggccgacctgcagtgcggcgtggtggacgcccgcgcgtggacgcaccgcggccgcctggcgtgcgtcgccttcctccgcggggagggcgacgccgaccgggtggcgcgcatcctcgcgcgcctcggccacctcgtccgcggtgacggcgaggccccgggcgccgtggcagccgtgcccgccgccgcggtcgcgcacgtcgaccgccgcctccaccagctcatggccgcggaccacaacaacagcgcgacgccgtacccggccgcggccgcggccgtgtccgtgcagagctgggccgagcgcggctactccgtggtgaccgtgcagtgccgcgaccgccccaagctgctgttcgacgtggtgtgcgcgctccactgcctggactacgtcgtcttccacggcaccgtcgacaccgccgccggcgaccgcgcgcggcaggagttctacatccgcagcgccgacgggagccccatccggtccgaggccgagagggagaggctcgcccagtgcctccaagccgccatagaccggaggtcgctagaggtaactggattcgacgagttagtatactcgattgtgaatctgcatccattgcgtgagacttgactaatgtggctgctctctgaatctgcatccatccagggcgtgaggctggagctgtgcacgccggaccggccggggctgctgtccgaggtgacgcggacgttccgcgagaacgggctgctcgtcgcccacgcggaggtgtcgacgaaggggggcctggcctccaacgttttctacgtgaccgacgcggatggcaaggcggcgggccagagcgccatcgaagctgtcagggcgagggtcggcgcggactgcctcgtcgtgggcgaggagccccggccgccgcgcgtgttcccggaggccgggcctggcgaccgtgaccacggcggcggcggccttgggctggtctacctcggcaacctcgtgaagcggaacctgtacaacctcggcctcatcaagtcgtgctcgtgaactcggcaccaagaaaagacacgggcggtttctcaaggagacccacccgccattgacgtactgtgtacgtacaagatcgaggaaccggcgccgacggcatcaactaaacaccgcgacatggagcgccgctcaagcagggtgaaattcgggtcgggcatggtgttgtactcgagaggaaatgtcgtcgtccgtcatcaacaggcaccgacgccatggatggacggacggtcggacactgacgacggttgaggaggggtgattagcaataggaatttgtgtagccatctgccatgtacatagacaaattcgttgttgtcggtaccagtagaagaagtagcgcgtagccgtgtagtgggtgcattcatcgtatttaacttctgtcatatttacggaacaggcacatcattttttttcacccgaaacgcttactaaatttgctgcccatttgtcactcagaaactcgaaacgcaaaactaaatttgccgcaatgccacgcctagtaatatactaactttttaggcctgtttggattaccgctgttcccacgcctcagagcatcttcaaaagactagctaaatagcttgtcaagttaaattttagctatttaatagcataatagctatccaacagagtagccatttaacttgttaagctatttggctctctaaattaactcactcactagctaaatttagctagcaactctcgctagccaagctaaattgcattttgaagagtgttggaatgagatgttatatagagtttaatatttatgtagagacaaataaaaaatcaaatagagagtcaaaaataaaaagtctcttgaagatgctcttaggcacgatgtggcgttggaggtaacagtgcaaacaggcctaatctgtaccggcggcttctactggctttaatctgaacaagtcgataacctcgcacaaccagctctccggtgatcttcgccgctgcccgcgctccaaaacctttaaaattgaccgtccacgcgctactgtgacgacgtcctcctctttcatttgtttttcaattttctcaataagcttgcttccaagtgaaatacttacttctaaactataaagatatttcaaattttcgagagtcaaaacatttttagtttaattgaaataaaaacatcacccaagagaaattctataccgtacggcggcgccgttgtgtctccctaggaaagcagcattctctgggttcgttaacctctgctctttcggtctttcttgtctgtccttgtgttcttgactgctgagtatgctggatgcctgcaatcattcccaaatgtggctggctaatcctagcactacctaccatttttttgtttttttaggatctgggggagagaaaaaacgagtgagaggatgctttgtgctagtactcttagatggtgtttggtttgtggctcatttttaatatcttattctattatctcatttttaaccaagcatattctgattttgcattggattttgtgacaaaatctcacattccaataatgtgatatatattggattttgtgcagcactcaatttcccaaaataaaaaatctataggtaaccaaacatcacnttgttttcgttgtgcctgaaccacaatagaaaata

SEQ ID NO: 2063 - DNA, 1589 bp, Zea mays
aaaagcagtactgtagtagaaaaaactccctagaggtcgaccgagacccctgcggacctgcgcttcggccgttgcagaccgcaggagtgacgattccatggcggaggagatggcgcaggcgcaaccgagactcacggcgccacgtccggtccgctgtattgtcaagctaggtggagcggcgattaccaacaaaggcgagctggagagcatcaacgaggagaacctacggtcggcatgtgcgcagctgcggcatgccatgtccgaatctgacggcgatggcgccatggagaaggttctgggaatggactggagtaggaagcccggagattctgtcgacccggccgttgacgcggagtggatcgcggggatagctaggctggggctcgacactaacttcgtcgtcgtgcacggggccgggtcttttggccactttcaagcaagtagatctggagttcataaaggagggttacattcgacactggtcaaggctggctttgttgctacaagaatttcagtgaggccaattatggcattgtatttgacgaggatatcatgaattttgtcaaaatgttagtgcttctctgatgaatattctgatgcattttttttgtaatttaggtgacatctctcaaccaggaaattgttagagccttagcaagagaaggaataccatctgttgggatgtcaccatttgcttgtgggtggtctacccaacaaagaaaacttgcatcagcaaatgcttctcaaataattcagtcactccatgcaggttttgtcccagttttgcatggtgatgcagttcttgatgaattattggactgtaccatattgagtggggatgtcattatacgacatcttgcacagcttctaagtccgaaatatgtagtatttctgatgtccatggagtgtatgatcgccctccaactgattcaaatgcagtacttctgagagaaataggttagtattcacctggttgatttttatctgcccataatatctagcctgtaccttttgatgtgtattagtcattatgcgaggaaacaggacaacaaaggtaatgcaattgtcatcattcaattcttgggtaaaacatggaaatatgcttcttcaacaaattctagctgacttgtgttagttaacagaggtggatgacattggaggctggtcgattgtaaaacctgcattgctgcaaggcaacactaaaggagtggagatatcagttgcagcacatgacaccaccggtgggatggagaccaaaatactggaggctgcagtgatagctaggcttggaatagacgtgtatattaccaaggctggaacagaacactcgctgagggccttgaagggagatgtgagcaccgactcggaagattggcttggaactattatacgctcttccaaatagatttcttgttgcaaaaacattcggactggtttactggcgattttcccgatgttatatgagcagtgatgagccttgggctttcgatgatgaccaaaaaaaaaaaaaaaacctactgtggtcgtagtttggtttacaagcgtcagcctgatgttacaaatgccgttcagtaaatttgttttgtttt

SEQ ID NO: 2064 - DNA, 1447 bp, Zea mays
acgcccgcacggaccggtaaggaatggcccgaccgacgcgtgcggtagaaaaaaaaactccctagaggtcgaccgagaccagacccctgcggacctgcgcttcggccgttgcggaccgcaggagtgacgattccatggcggaggagatggcgcaggcgcaaccgagactcacggcgccacgtccggtccgctgtattgtcaagctaggtggagcggcgattaccaacaaaggcgagctggagagcatcaacgaggagaacctacggtcggcatgtgcgcagctgcggcatgccatgtccgaatctgacggcgatggcgccatggagaaggttctgggaatggactggagtaggaagcccggagatcctgtcgacccggccgttgacgcggagtggatcgcggggatagctaggctggggctcgacactaacttcgtcgtcgtgcacggggccgggtcttttggccactttcaagcaagtagatctggagttcataaaggagggttacattcgacactggtcaaggctggctttgttgctacaagaatttcagtgacatctctcaaccaggaaattgttagagccctagcaagagaaggaataccatctgttgggatgtcaccatttgcttgtgggtggtctacccaacaaagaaaacttgcatcagcaaatgcttctcaaatatttcagtcactccatgcaggttttgtcccagttttgcacggtgatgcagttcttgatgaattattggactgtaccatattgagtggggatgtcattatacgacatcttgcacagcttctgagtccgaaatatgtagtatttctgacagatgtccatggagtgtacgatcgccctccaactgactcaaatgcagtacttctgagagaaatagaggtggatgacattggaggctggtcgattgtaaaacctgcattgctgcaaggcaacactaaaggagtggagatatcagttgcagcacatgacaccaccggtgggatggagaccaaaatactggaggctgcagtgatagctaggcttggaatagacgtgtatattaccaaggctggaacagaacactcgctgagggccttgaagggagatgtgagcaccgactcggaagattggcttggaactattatacgctcttccaaatagatttcttgttgcaaaaacattcggactggtttactggcgattttcccgatgttatatgagcagtgatgagccttgggctttcgatgatgatccagcacgggtctattccctactgtggtcgtagtttggtttacaagcgtcagcctgatgttacaaatgccgttcagtaaatttgttttgttttctgaaaagataagatgcattggtcgcaagagaggaaaaaattgatttttgggacttgtcattcctaatattgacttcacagaaagaaacatgactcaaaatatgtc

SEQ ID NO: 2065 - DNA, 1225 bp, Zea mays
attgggtacctcgaggccggccggggaccgtaaatccgctacgccacagcaacgaccaaccggaaccgccgccgacgccgacggggacagggaaaccaccaccaccggccaccgccgcccccgtattaacagccgcgcgtgcacggtggagttctagttccgctcacgattcgattcgactcgactgctcgttccgtctcgaccttcaggcgggtagcaggttgaccgtccgcgaattcaccgtatcccgggatacgcatgggttccaaagcgtccttccgtgtcacgctcctcttgctgctcctcgtcgccgccgccgcggcctggggacctgctgcacaggccgacgacgctgctgagctcccggatcatagagctattaccttgaaggagcaggtttcttcgaccgagattcctgtccgtctcaagagtggcagcccgctgtgctcagcctgtgaagacttcacgggcaaagctgtcagttatatcagtgagaaacagacgcaagataaggtcatgggattccttcatgacgcttgctctcagtcattctcgtttgaacagaagtgtgatgaattgatggactcttacgcaaccctcctgtttgccaagatcacggagatcaaaccagaagcgttctgcaaacagtatggcctgtgcaggggcacggctcttttctctggtgtgacaagtgacagcacatgtgtgttctgccaccacctgcttgatgaagttatgtccaaactgaaagatccggacgcggagtttgagatagttcagattcttatcaaggagtgcaataagattgaaggccacgtccagcagtgcaagcgactggtcctgcaatacattcccctcatcctggtgaacggcgagaagttcctcgagaagaatgatgtttgcgcgctcgtacaggcttgtccagccacccataagaagactttcagctcagccttgaaggaagccttgttgctgagtgacgcttgaaggttggaggaagaacacgcaaagcgtttagcagtggttggaaatagtgtgtccaagtgccgtgtttgtacatataattgtcatatgaatgcatgaagacgtgtcttgtgccctgcattgtttccatcttgtatcataattcataaacacgttgtcttgagtagatttttatggacatccccaggggatgaaggttaaaatatttgtatcataattcataatcccattgtcttgagct

SEQ ID NO: 2066 - DNA, 2209 bp, Zea mays
gggggagtgcctgtacccctcctcggtttcttgccctttgggtacctcgcggccgcccgacacggaacggaaccgtcaatccgctacgccacagcaacgaccaaccggagccgccgccgccgccgccgacggggacggggacagggaaaccaccaccaccaccaccggccatattaacagctgcgcgtgcacggtggagttctacttccgcccgcgattcgactcgactcgactgctcgttccgtctcgaccttcaggcgggtaagcaggttgaccgtccgcgaattcaccgtatcccgggatacgtatgggttccaaagcgtccttccgcgtcacgctcctcttgctgctcctcgccgccgcctggggacctgctgcacaggccgacgacgctgctgagctcccggatcatattgctattaccttgaaggagcaggtttcttcgaccaagattcctgtccgtctcaagagtggcagcccgctgtgctcagcctgtgaaaacttcacgggcaaagctgtcagttatatcagtgagaaacagacgcaagataaggtcatgggattccttcatgacgcttgctctcagtcattctcgtttgaacagaagtgtgatgaattgatggactcttacgcaaccctcctgtttgccaagatcacggagatcaaaccagaagcgttctgcaaacagtatggcctgtgcaggggcacggctcttttctctggtgtgacaagtgacagcacatgtgtgttctgccaccacctgcttgatgaagttatgtccaaactgaaagatccggacgcggagtttgagataattcagatccttatcgcgcgccatttacgtgcttcatcactaccaggagttgccattctgtgtctgacatctttcccacttgtttgatgcctgtagtttgagatagttcagattcttatcaaggagtgcaataagattgaaggccacgtccagcaggtaagctatttggctcgttcatgtgcaaacttttcacgccccacaactcactcagtgtatgtcagaataaacaatctgaatgacctgcagaaacgctactatttggctcgttcatgtgcaaacttttcacgccccacaactcactcactcagtatatcccagaataaacaatctgaatgacctgcagaaacgctaggttctttattaaaaaaaatatatatccagagatgcacatgcacaacttacttaggctggccgcagcgcggcactggaaacggcactcggaaggtttagcgcatgcatacacgctgcagcggggtactgggaacggcatgctatcctctgctacgctacttccagcgctgtacggagtgctactctatttactgtgccgtgaggttggacacggggagcagaccggtggcacatgggtgggagtagggaggcagctgacgtggacaagagagaggtaaaataaataatagaatatgtagtagttggtatagggtagagatttagagtaaatatgactgcggaagattgtatggtagagtagagaatcttgctgatcaggatagaatattctttttagagtagaaatttagagttgcacgagtgtggacagccttatatcaggaaccgtcttctaacttgctcggttgatttgtgatggcatgcaacaaaatggcatgggctgatcttgttttcttgctggcagtgcaagcgactggtcctgcaatacattcccctcatcctggtgaacggcgagaagttcctcgagaagaatgatgtttgcgcgctcgtacaggcttgtccagccacccataagaagactttcagctcagtcttgaagggagccttgttgctgagtgacgcttgaaggttggagaagaacacgcaaagcgtttagcagtggttggaaatagtgtgtccaagtgccgtgtttgtacatataattgtcatatgaatgcatgaagacgtgtcttgtgccctgcattgttttcatcttgtatcataattcataaacacgttgtatttatggacatccacagggggtggaaggttaaaatatatttgtatcataattcatataagcacattgtcttgagctacggtgcagtcagtcaattcatatccagaaaatttcagcgctggtgactagaaaccgcagatgctgcggtattttattcgcagcaaaattctaaggttgcagagcacgaaaggggaatgttttttttt

SEQ ID NO: 2067 - DNA, 1255 bp, Zea mays
ccacgcgtccgcgccacagcaacgaccaaccggagccgccgccgccgccgacggggacggggacagggacagggaaactaccaccaccggccatattaacagctgcgcgtgcacggcggggcggtacttccgcccgcgattcgactcgactcgactgctcgttccgtctcgaccttcaggcgggtaagcaggttgaccgtccgcgaattcaccgtatcccgggatacgtatgggttccaaagcgtccttccgcgtcacgctcctcttgctgctcctcgccgccgcctggggacctgctgcacaggccgacgacgctggtattgctgagctcccggatcatagagctattaccttgaaggagcaggtttcttcgaccaagattcctgtccgtctcaagagtggcagcccgctgtgctcagcctgtgaaaacttcacgggcaaagctgtcagttatatcagtgagaaacagacgcaagataaggtcatgggattccttcatgacgcttgctctcagtcattctcgtttgaacagaagtgtgatgaattgatggactcttacgcaaccctcctgtttgccaagatcacggagatcaaaccagaagcgttctgcaaacagtatggcctgtgcaggggcacggctcttttctctggtgtgacaagtgacagcacatgtgtgttctgccaccacctgcttgatgaagttatgtccaaactgaaagatccggacgcggagtttgagataattcagattcttatcaaggagtgcaataagattgaaggccacgtccagcagtgcaagcgactggtcctgcaatacattcccctcatcctggtgaacggcgagaagttcctcgagaagaatgatgtttgcgcgctcgttcaggcttgtccagccacccataagaagactttcagctcagccttgaaggaggccttgttgctgagtgacgcttgaaggttggagaagaacacgcaaagcgtttagcagtggttggaaatagtgtgtccaagtgccgtgtttgtacatataattgtcatatgaatgcatgaagacgtgtcttgtgccctgcattggttccatcttgtatcataattcataaacacgttgtcttgagtagatttttatggacatccacagtgggtgaaggttaaaatatatttgtatcataattcatataagcacattgtcttgagctacggtgcggtcagtcaatttatatatccagaaaatttcagcgctggtgaaaaaaaaaag

SEQ ID NO: 2068 - DNA, 1189 bp, Zea mays
  misc_feature (1173)..(1174): n is a, c, g, or t
gtaaatccgctacgccacagcaacgaccaaccggagccgccgccgccgccgacggggacggggacggggacagggaaaccaccaccaccaccggccatattaacagctgcgcgtgcacggtggagttctacttccgcccgcgattcgaccgctcgttccgtctcgaccttcaggcgggtagcaggttgaccgtccgggaattcaccgtatcccgggatacgtatgggttccaaagcgtccttctgtgtcacgctcctcttgctgctcgccgccgcctggggacctgccgacgatgctgctgaactcccagaccatagagctattactttgaaggagcaggtttcttcgaccgagattcctgtccgtctcaagagtggcagcccgctgtgctcagcctgtgaaaacttcacgagcaaagctgtcagttatatcagtgagaaacagacgcaagataaggtcatgggattccttcatgacgcttgctctcagtcattctcgtttgaacagaagtgtgatgaattgatggactcttacgcaaccctcctgtttgccaagatcacggagatcaaaccagaagcgttctgcaaacagtatggcctgtgcaggggcacggctcttttctctggtgtgacaagtgacagcacatgtgtgttctgccaccacctgcttgatgaagttatgtccaaactgaaagatccggacgcggagtttgagataattcagattcttatcaaggagtgcaataagattgaaggccacgtccagcagtgcaagcgactggtcctgcaatacattcccctcatcctggtgaacggcgagaagttcctcgagaagaatgatgtttgcgcgctcgttcaggcttgtccagccacccataagaggactttcagctcagccttgaaggaggccttgttgctgagtgacgcttgaaggttggagaagaacacgcaaagcgtttaacagtggttggaaatagtgtgtccaagtgccgtgtttgtacatataattgtcatatgaatgcatgaagacgtgtcttgtgccctgcattggttccatcttgtatcataattcataaacacgttgtcttgagtagatttttatggacatccaccagggggtgaaggttaaaatatatttgtatcataattcatataagcacattgtcttgagctnnaaaaaaaaaaaaaaa

SEQ ID NO: 2069 - DNA, 1256 bp, Zea mays
tgggaccctccaggccggccggcctccccggcgcggtaaatccgctacgccacagcaacgaccaaccggagccgccgccgccgccgccgacggggacggggacagggaaaccaccaccaccaccaccggccatattaacagctgcgcgtgcacggtggagttctacttccgcccgcgattcgactcgactcgactgctcgttccgtctcgaccttcaggcgggtaagcaggttgaccgtccgcgaattcaccgtatcccgggatacgtatgggttccaaagcgtccttccgcgtcacgctcctcttgctgctcctcgccgccgcctggggacctgctgcacaggccgacgacgctggtattgctgagctcccggatcatagagctattaccttgaaggagcaggtttcttcgaccaagattcctgtccgtctcaagagtggcagcccgctgtgctcagcctgtgaaaacttcacgggcaaagctgtcagttatatcagtgagaaacagacgcaagataaggtcatgggattccttcatgacgcttgctctcagtcattctcgtttgaacagaagtgtgatgaattgatggactcttacgcaaccctcctgtttgccaagatcacggagatcaaaccagaagcgttctgcaaacagtatggcctgtgcaggggcacggctcttttctctggtgtgacaagtgacagcacatgtgtgttctgccaccacctgcttgatgaagttatgtccaaactgaaagatccggacgcggagtttgagataattcagattcttatcaaggagtgcaataagattgaaggccacgtccagcagtgcaagcgactggtcctgcaatacattcccctcatcctggtgaacggcgagaagttcctcgagaagaacgatgtttgcgcgctcgtacaggcttgtccagccacccataagaagactttcagctcagtcttgaagggagccttgttgctgagtgacgcttgaaggttggagaagaacacgcaaagcgtttagcagtggttggaaatagtgtgtccaagtgccgtgtttgtacatataattgtcatatgaatgcatgaagacgtgtcttgtgccctgcattgttttcatcttgtatcataattcataaacacgttgtatttatggacatccacagggggtgaaggttaaaatatatttgtatcataattcatataaaaaaaaaaaaaaaaaaaaaaaaaaaaaaaaagaaaaaaaaaaaaaaaaa

SEQ ID NO: 2070 - DNA, 1131 bp, Zea mays
agcccaacctcgaatgccaagctagcaagagaggcctcgatcgcagaacgaacccagcggcaaagcgagcaagcccgtctacaacgacgcacagatagctctgtccatggcgcccaagaggagcagcgaggagcgcgcggcggcggagcaggagcaggagcagccgaggctccgcggcgtgcggaagcggccgtggggcaggtacgcggcggagatccgggaccccgtgcggaaggcgcgcgtgtggctcggcaccttcgacacgcccgagcaggccgcgcgggcctacgacgccgccgcgcgcaggctccgcgggccgcgcgccaccaccaactaccccggcgacgtcgtccgagaagcgccgtgcacggcccctgctctggctgcgagcgcgagcggcagcaccgagtcgtcgtcgtcgtcgtcgtcaagggacgacggccacccgccaccgccgatgcctccggcgccgtcgtcgctcggcctgggcctcgggctcttcccggcgacggtggccacccagccgtgcctgttcctggacccggcgccggtggagagggaggaaggggagcgggagcggagctgctgctcccggtcgccgccgtcggtgctggcgggcctcgggttcgacctcaacctgcctccgcccgccgagatggtcatgtagcgtcggagatagtaattctagcaaaaagggattgtgtagtaaatagtaagggcaatcggtttgtgtagtagtagtactagccagtttgcctgtgcagtgtgcactagccactagtcaatttgcgacttcgcaatgcaaagcaagaaatcgacgggcaaatatttttctctcctgcccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaggggggcccgttttaagaacccaatgttaccatccttggcatgctacttcataacctttatatagggccacctaaatataatttacttgcccctttttaaaaaacgtgaaactggaaaaaccctggctttacccaatttaatcccctttaaagaaaatcccttt

SEQ ID NO: 2071 - DNA, 1822 bp, Zea mays
gccggccgcggcgcgcgactctgaccaccgcgccgattcgatcttcctgccggcgcggggcgcggcgcggggcgagggctcgagcggagcaatccatataacccgtttataccctacctcaattccactcatcagctcactccggcgccatcatcttccttctctcagttcctcacctcgatggactcacttgccgccgcctgcctctgctcccgccgtcgccgcgctcgccgactcctcctggccgctgcggcggccaccactgggtacggcctctaccgcctctaccgttaccaccgccgccgcatcgtcgctgccctctcccttgccgacgccgtgtctcaggtcggttccgacctcgccgaattcctccgctccgagtccgaccaggtcccacgaagcctcctccagctctccaagctcgccgcttccgaacccgtctcctccgccgcgtcttccctctccgagtccctcgcgtccggcgtcctccgcgccatctctcaccagcgccaattacatcaacaacagcagaaaaacccccaaaccccgctccaagatcggatcttggatcgtctcctctccccggagggcgccggattcgcttccgctgtcgtcggaagcttagcgaggagcctcgtcctgtcctcctgcgacgcccgcagggcggaggccggcgaccgcgaggagccgcggtggctggctgcgctctgcagcgccacgggcaaggaggcttctgcggacctcgtccgagtcttcgtcagcaccgccgttgccgcctacctcgaccgcaccgccgcagtgcgcagcaacaaccatctgctcgctggcctctctgatccaaggcacgaagcccaggtcaaggaccctggctgtctctgtctgcaacggtgctatcgaaaccttcctcaggacgtcgcggcagcttgccaaggaggcctccagtgctcgcattgaggtaacatcaatggagcgtgtggtggaagattcagacagcaactgcgtgatccacaaggtttcaagcacgctggccgctccgagcaacaggagatttgtactggacgtcacaggcagggtcaccgcggagacggtgcggtcattcctcgacttcctagcacagcggatgtctgatggggcacggaagagcatcgtcatcgcccgtgatgaagttgcggagagagggctcgttgctgtcaagtacctcggtgccaaatccatggctatcttcaccatctccttggcattatgcatgcacattttgatgggaacaaggttccttttgccggcatagctacctagcttgtggggagctggaattccatcgcaggtgattgattactacttgtcctgattctaggtgcagagtaagttatgtagattgcaaattgatcctataataccagttgtctttgtgtgtgtgtgtgttggtgaaaagtatgtaaactttagctagaacccgctgggatttgtagttggtttttgtttgtttggttgaaggaagtatatatgcatctgaaatgacactggccaatttggcaatgtgattttgaggttagacacctctattgttgcgttcgaatagctgtcactagattgttgttgctggttgtttttgttgtcataagctgttgatcaatgtaaaacaaccaaacagagcagcacgagctggaatcttgactgcttgctcttgaaactctctcttttgtacacttcttcagttgtaagaaagtggaaaatgaagtgaataatgaagtgaagcttccctttgtttcagaaaaaaaaaaaaaaaaaaaaaaaaaaaaaaaaaaaaaaaaaaaaaaaaaaa

SEQ ID NO: 2072 - DNA, 1573 bp, Zea mays
cgacttagccctcgatcacgggcgcacaacaacacagcgacgctatctgaccgagtgttcaaataaatacccacacgggcacgccacgagacgatggagacccctctgctccaatccgccgctccactccaagtcacacggaggcagccatcgtagcctcgcccgactccgcttcccctgttctttgggcatggagctgatcacaaatgtcaccgagtacgagaagctcgcgaaggagaggctgccgaagatggtgtacgactactacgcctccggcgcagaagatcagtggacgctcaaggagaaccgggaggccttctccagaattctgtttaggccacgggtactgatcgacgtctcccgtatcgacatggccacaaacattctgggcttcagcatttccatgcctatcatgatcgctccttcagccatgcagaaaatggctcatcctgatggagagcttgccacggcaagagctgcagcttccgcaggaacaataatgacattgtcctcatggtctacttccagcgttgaagaggtcaactcagttgggccgggcatacgtttcttccagctctatgtctacaaggacaggaatatcgtacggcaactcgtgaaaagggctgagatggctggcttcaaggccattgcactcacggtagacactccaatacttggccgcagggaagctgacattaagaacaggttcgccttacctccacatctggtgttgaaaaacttccaagcgctggatcttggcacgatggacaagacaaatgattccggccttgcttcctacgttgctggtcaagttgaccgcaccctttcctggaaggacgtcaagtggctgcagacaattacctcgttgccgatcctagtcaaagggatcgtgactgcagaagacactaggcttgcgatcgaatatggcgctgctgggatcatcgtgtccaaccacggcgcgcgccagctagattatgttcctgcgactatcagctgcctggaagaggtcgtcagggaagcgaaaggccggctaccggtgttcctcgacggcggcgtccgccgtggcacggacgtcttcaaggccctggcgttgggagcttcaggagtgttcatcggccggcccgtgctgttctcgctggcggtggacggcgaggccggcgtgcggaaggtgctgcagatgctgagggacgagctggagctcaccatggcgctcagcggctgcacgtcgctgagggagataacccgcgcacacgtcatcaccgacagcgaccggatcggccgctcgcggctgtagaatcattgtgcagttcacctcaggaatgatgttggtctcgactgaactgtcctgattcgggatctatttgtagctcttgtgctctcattttacgttaggcaaataaggaagctgcgtgcgtatgtgtgactgctgctgacgtttgtttgcgccgctgtcgtggttgcctggttggcacttggcagtgttgattggcgttagtggttggtttgggtgaaaggagtttatgagatctggtgccggtttctaagatactagcccaaaaacgttaaaaaaaaa

SEQ ID NO: 2073 - DNA, 1446 bp, Zea mays
ccgggtcgacccagcgttcgccccgcgtccgcccagcgtccgctccaatccgccgctccgctccaagtcacacgggggcagccatcgtagcctcgcccgactccgcttcccctgttctttgggcatggagctgatcacaaatgtcaccgagtacgagaagctcgcgaaggagaggctgccgaagatggtgtacgactactacgcctccggcgcagaagatcagtggacgctcaaggagaaccgggaggccttctccagaattctgtttaggccacgggtactgatcgacgtctcccgtatcgacatggccacaaacgttctgggcttcagcatttccatgcctatcatgatcgctccttcagccatgcagaaaatggctcatcctgatggagagcttgccacggcaagagctgcagcctccgcaggaacaataatgacattgtcctcatggtctacttccagcgttgaagaggtcaactcagttgggccgggcatacgtttcttccagctctatgtctacaaggacaggaacatcgtacggcaactcgtgaaaagggctgagatggctggcttcaaggccattgcactcaccgtagacactccaatacttggccgcagggaagctgacattaagaacaggttcgccttacctccacatctggtgttgaaaaacttccaagcgctggatcttggcacgatggacaagacaaatgattccggccttgcttcctacgttgccggtccacgttgaccgtaccctttcctggaaggacgtcaagtggctgcagacaattacctcgttgccgatcctagtgaaagggatcgtgactgcagaagacactaggcttgcgatcgaatatggcgctgctgggatcatcgtgtccaaccacggcgcgcgccagctagattatgttcctgcgactatcagctgcctggaagaggtcgccagggaagcgaaaggccggctaccggtgttcctcgacggcggcgtccgccgtggcacggacgtcttcaaggccctggcgttgggagcttcaggagtgttcatcggccggcccgtgctgttctcgctggcggtggacggcgaggccggcgtgcggaaggtgctgcagatgctgagggacgagctggagctcaccatggcgctcagcggctgcacgtcgctgagggagataacccgcgcacacgtcatcaccgacagcgaccggatcggccgctcgcggctgtagaatcattgtgcagttcacctcaggaatgttggtctcgactgaactgtcctgattcgggatatataccgctatttgtagctcttgtgctcccattttacgttaggcaaataaggaagctgcgtgcgtaaaaaaaaaaaaaaaaaaagtttgtttgcgccgcagtagtggttgcctggttggcacttggcagtgttgattggcgttagtggttggtttg

SEQ ID NO: 2074 - DNA, 1245 bp, Zea mays
gttaattttggaacgatacagagaagatgggcagggcccctgcgcatttatgacactcacaaatcgagaaatggtccacgaaaatgtcaaggggactcaatttgatcttgtggaatatctacaacgagaaaggcaagggtctgctcgtctagagaattttgcttctgcactcgaactgattggacaaaagctccaaatggatacactgcaaagtcgacttgatgcagagttccttctagctcatatgtgttcagtcaagtttaaggaatggatcgtggtgctagctactttattgcggcgtgcagaggttttggtggatctctttaggcatgatttgcgattgtggaaagcatatagcattactctacagtcacatgatgtattcacagaatatcttgaccttcttaatatcttggaggaggagctttcatctgtctctgatcttacattgcaaaatggaccattgtcatgaatgctggacaatgacactgattggaagaatgcggtgttttaaccctgagttaattaacacatacagtttgatgaaatctgcggcggggccaggaatctgatgtaaatagattattcaggggtttttttccctttgagcaacaccccagaggcgctatggcagctacctgtgcggtggtcagctaagcacctattgttgtattatttgtttgttgcagcagagttgaatgtgcattcttcgccttacggaggaggaatttatacagtggatggggttgccttccccctgccctttggcaggttagtaaagtgtgccctagaggaaagttgcatgtttgagagcaaggagactggagggggctaaaattccctttgttatttaaaattgaatagaagagaaatttagcctctcggatcccctcaattcccctgtatcccaaacaaacccttgaagtgttttctacagctttaggaaatgtggtttacttctatggtaggtacatgggcaaccaatgtatatacatttatttttacagcatcctggcccgttcatccacaacgtgttgcacatgtctagccctctccattgcaagggcgtacagatatgtatataaaaatctacacaatgcatgcgcatgcaccggagtgtatctgtatcgaccatgaaaggtttggtacaagtctgaaaaagtatacattgttgtcaaaaaaaaaaaaaaaaaaaaaaaaaaaaaaaaaaaaaaaaaaaaaaaaaaaaaaaaaaaactcgagaaa

SEQ ID NO: 2075 - DNA, 2245 bp, Zea mays
  misc_feature (2115)..(2115): n is a, c, g, or t
  misc_feature (2203)..(2203): n is a, c, g, or t
  misc_feature (2228)..(2228): n is a, c, g, or t
  misc_feature (2230)..(2230): n is a, c, g, or t
  misc_feature (2242)..(2242): n is a, c, g, or t
tacagctttcaacattgcgaggaactttcaatcatgagtccaaaaagcccacctgtttcaatgcgcttcattcctgaacaaaatgacaaaggagcgctgacagaagatactcatggattttctgatcttttgtcccagcaaccatcaagatgtttgatcttgcggaccaatggggagctttctgtgcttgacatggacgatggacatgaacacactctccctcgtgcccgggcgctcttttgggtcacctgttcccagtttgaagagaagggtagtcttatcaaagaggtttcatggcttgactatggtcatcagggtatgcaggtgtggtacccatcacatggagcaggtccttttaagcaagaggattttttgcagctggatccggagcttgagtttgatcgcgaggtgtatcctcttggtcttcttccaaacgttggtgtggttgttggtgtttcccagaggatgtccttctcaactgcggagtttccatgctttgagccttcacctcaagcccaaacaatattgcattgtttattacgacatctccttcagagggacaagattgatgaagctttgcgcttggcaaatttgtcagcagaaaaacctcacttctctcactgtttagagtggcttctgtttacagtatttgatgcagatatatcaaggccaagtgcttcaaaaaatcaggcttcacaaaaagttgattctcccaagaaatctcttcttgagaaaacttgtgacctgctacggaactttcctgaatatatggatgttgtagtcagtgttgctaggaaaactgatggtcgacactgggctgatcttttctctacagctggacgatccacagagatgtttgaggaatgcttccaacagaggtggtacaggactgctgcttgctacatactggtcattgctaagctggagggccctgcagtcagccagtattgtgcactccgtttgctacaagctacacttgatgagtctttgtatgagcttgctggggagttggttcgcttcttgctaagatctggaagagattttgagaacgccactccagactctgagaagctctctccaagatttctaggctattttctgttccgttcgccatataagaggcaatcttctgatttgagaagtaactcaatgaaagaacttagtccacatattgcttctgttatgaacattctagagcgtcatgctagctatttgatgtctggcaaggagctttctaaactcgttgcttttgtcaaggggactcaatttgatcttgtggaatatctacaacgagaaaggcaagggtctgctcgtctagagaattttgcttctgcactcgaactgattggacaaaagctccaaatggatacactgcaaagtcgacttgatgcagagttccttctagctcatatgtgttcagtcaagtttaaggaatggatcgtggtgctagctactttattgcggcgtgcagaggttttggtggatctctttaggcatgatttgcgattgtggaaagcatatagcattactctacagtcacatgatgtattcacagaatatcttgaccttcttaatatcttggaggaggagctttcatctgtctctgatcttacattgcaaaatggaccattgtcatgaatgctggacaatgacactgattggaaaaacagctgaatgcggcgttttaaccttgagttaattaacacatacagtttgatgagatctgcggtggggccaggaatctgatgtaaatagattattcaggggtttttccagttgagcaacaccccagaggcgctatggcagctatttgtgcagtgatcagctaagcacctattgttgtattatttgtttgttgcagcagagttgaatgtgcattcttcgccttacggaggaggaatttatacagtggatggggttgccttcccctgccctttggcaggttagtaaagcgtgccctagaggaaagtagcatatttgagagcaaggagattggagggagctgaaatcccctttgttatttaaaaattgaatagaataggaatttagcctctccgatcccctcaattcccctgtatcccaaacaaacccttgaagtgttttctacagctttangaatgtggtttactctatggtaagtacatgggcaaccatgtatatacattattttacagcatctgggcccgttccatccacaacgtgntgcacatatctagcctctccatgcnanggcgtacagatngta

SEQ ID NO: 2076 - DNA, 3785 bp, Zea mays
  misc_feature (3708)..(3708): n is a, c, g, or t
aaaaaaggcagaacacaagaccaccaaactccttgctgcgcacagaactgcagcctccttctgcgcatgttaacagcagtacgcaaaaggagacaaacagcaaaaagtgccagcaggccacacacacaactgttcttcactaatcacccaaaagatccctggacctaataattgcagcaccaagacccaatgcctcaagatgcctggcaacggcaagcctccagcactctaactcatccaaaaaaaactgtctttattccgttaatggaaggtctgacaccatcaaaaaccgtcttattacgatgaagccataaacacctagcttatgttttgaccaaactggaaaatatagaaagccttattccctattttaagtaggcatatatgaccctaggacaatgaagttagttaatcccagttaacgtactacttgacatttttcttggcattggataagtctggatggtattttgacctataagaatatcatttttttaatttagtttttgaaggtacaactgttttgggttccttttgatgtgaattatttggttgtcaaaaaagaactcatccttgctgctgtgatttattttgcttccttaggttttggtggatctctttaggcatgatttgcgattgtggaaagcatatagcattactctacaggttagtggccaagttttttttggatttatgaagtttttaggtgtctataacatggttacaatcatccttgctgcagtcacatgatgtattcacagaatatcttgaccttcttaatatcttggaggaggagctttcatctgtctctgatcttacattgcaaaatggaccattgtcatgaatgctggacaatgacactgattggaaaaacagctgaatgcggcgttttaaccttgagttaattaacacatacagtttgatgagatctgcggtggggccaggaatctgatgtaaatagattattcaggggttttttccctttgagcaacaccccggaggcgctatggcagctatttgtgcagtgatcagctaagcacctattgttgtattatttgtttgttgcagcagagttgaatgtgcattcttcgccttatggtaagtatgtgctgcactcttaacactgtaagtcatatgagttttgaccaacaagttgttttctccgttccatagaatcgtgttaagagctagaagtctagaacatgtagattgtcctcacctgatgtttgtagactacgagatattattaaaactggcactatgaggttctcttcattgcattttttacatgtcatactgatgtttttactctgggcaactaatggaaataccctaacctgcaggaggaggaatttatacattgtggggttgccttcccctgccctttggcaggttagtgaagtgtgccctagaggaaagtggcatgtttgagagcaattagattggagggggctaaaatcccctttgttatttaaaattaaatagaagaggaatttagcctctcggatcccctcaagtcccctgtatcccaaacaaacccttgaagtgttttctacagctttaggaaatgtggtttacttctatggtaggtacatgggcaaccaatgtatatacatttatttttacagcatcctggccccgttcatccacaacgtgttgcacatgtctagcctctccattgcaagggcgtacagatatgtatataaaattctacacactgcatgcgcatgcaccggagtgtatctgtatcgaccatgaaaggtttggtacaagtctgaaaaagtatacattgttgtcaatcgctatcatatttactgctgtcgcgatgtgtagtagccagtaggctgaccggtcactgatgtgcgtcatggccagatgcacccttcgctgtatgaatagtcgccaacatgggcagcacgtagtgatgtagccatgtaggtccgctgatgcccgaaggagttaattaggagcacagcaagtagtttggtggtttccttttctttgtcacgatgaccacggcgccagggctccgaatcatcgccgcgtcggttgcgcaatttgctcgggcgccgttcgccacttgccacttttttttcccccctgccgtggactctctgaactccgagtgagggcagggcatggtgcggtggtgccgttttctgttcttttcctgatactgccagaaacaagagaattcccttgggataggcaattcgatggcgagaggcagcagcagtgctgcaggagccaacatcatctactgctaggtacgtgtcatcacacggggaagggaagggacgatctgtaaagcctgaagcggcggtaccggcagggcaagcagcagcgaagacgcagctgcccgttctcgtgctgtagtaggagtcaaactgggaggattcgttacgtgcgagcccaaccagccgtcatttcgccgcagccaccgccccaccggaagcgagcgagcgagcgcgctccatctccattgagcggggcccgtcaaagttggacgagtggcgcccgagacctggttgaggagtgaggctgagcaccggccaggggggcggccaagagagacgtgtgacaggctgacagctgatggcaacaacaccgagaagtataccacccgccggggctgaagctgaaggcggaagggtctacgctggccgcccaatttgcgactgcgacgcccacggcccgcgggctattctgggacagcgaggccccgacgcaacaggccggcggcagcagcagcacaggaacagcaaaggaagccagaagcggaacgaggcgagcgcccggtggctgcaggccgcatgtggccgtgtggtggtgcggtgtgcggccaatcggtcccgtgctgcccctgcctctgctctctccgtcgcgcacgatctccgtgacctggtgcgcgtgcggtgccgttggcgcctgccttccctgcctagcaacagcttgcggctccgcgaaggcaaccgggggccacacgcagatgctgccgccgcgcggggagagccacaccacacgcacgcacgggcacggttggcttggctcggatcggatttcggatggcggcgggactggaccggaccggaccggacggccgttggggatggaggagtgatctgattgggagacgcaatgcaacccccggccgggtttggctttttcgttctttgtcgcgtgctgtgctgcctgtttgtgtgctcgggaggccggcggcaacggctgcgtggcattggtgcgtcgcatccgtttcttcttctcatcccttcgttcctccactccttgattgccgaagggcggctgatgctgatacaggcagccatacggtacagcaatcctgatggccaccttgatgtacgtgccataaatcctggtaccgtgtgacgacgaccggtgaacatacacggaacgatatttcccccccctccccctcttttgcggaaaaaaacatactacacggaatgattgggggtgtgtgtgtgtagggtgtagtgcgtgcgtgtcgagtgtcgacggtaggcgtacaaggcgggagtgtgtctatgtgtgtgcgcgcatgaagttcagtacactgttcacgtattctttgctaaaaaaaaattacgggcgacgattatccccactactccctaacgatggataacgtgagtagatagtatagtctgaggggagtgtgacggagcatcatgatcttctagtgcgccnatgcatgtgtcgtgcatgacagagcgtcatcttctgcgagccgtgatatatataaacatgtacgctgccgcaaagtg

SEQ ID NO: 2077 - DNA, 1290 bp, Zea mays
  misc_feature (4)..(4): n is a, c, g, or t
  misc_feature (21)..(21): n is a, c, g, or t
  misc_feature (23)..(23): n is a, c, g, or t
cggncgcgtggggatccacananagtttgaggcgagcggccgcccgggcaggtacaggactgctgcttgctacatactggtcattgctaagctggagggccctgcagtcagccagtattgtgcactccgtttgctacaagctacacttgatgagtctttgtatgagcttgcaggggagttggttcgcttcttactaagatctggaagagattttgagaatgccacttcagactctgagaagctatctccaagatttctaggctattttctgttccgttcaccttataagcggcaatcttctgatttgaaaagtaactcaatgaaagaacttagtccacatattgcctctgttatgaacattctagagcgccatgctagctatttgatgtctggcaaggagctttctaaactcgttgcttttgtcaaggggactcaatttgatcttgtggaatatctacaacgagaaaggcaagggtctgctcgtctggagaattttgcttctgcactcgaactgattggacaaaagctccaaatggatacactgcaaagccgacttgatgcagagttccttctagctcatatgtgttcagtcaagtttaaggaatggatcgtggtgctagctactttgttgcggcgtaccgcggccgcggccgcgctctttcagcatgatttgcgattgtggaaagcatatagcattactctacagtcacatgatgtattcagggaatatcttgaccttcttaatatcttggaggaacagctttcgtctgtctctgatcttacattgcagaatggaccattgtcatgaatgctggacggtgacactgattgaaaaaacaactgaatacggcgttttagccttgagttaattaacacatacggcgggaccaggaatctgatgtaaatagattattcagggtgtttttctctttgagcaacaccccgaggtgctatggcagttttttgtacagtgatcagctaagcacctattgttgtatcattagtttgttgcagcggagttgagtctgcattcttcgccttactgtaaatatgtgctgcgcccttaacattgtaagccatataccattctgagcagcaagttcttttctctgttccatagaatcgtgtttaaagctagaagcctagaacatgtagatagtcttcacctgatgtttgtagactccgagatattattaaaactgacactatgatttcttaattgcatttttttccatggcaaattatacaactctctctctttctcttattttcaattttaattgtctctct

SEQ ID NO: 2078 - DNA, 1279 bp, Zea mays
gcacgagaccattacctagaacatcctaatctaaaaacaggatctcccactcgtctcgaagacggccgcaccgcagacgccgcgggaatttaacgagagagactggcgccgcgcctcgcggagaccgcagcctggagccagcccgtgacgctgacgcggcgggccacgggcggggcgatgccaggagccatggagccggcagaggcggacgcggcggcagccgctgttgcgggaaggcggccgacggcgtccgagcgccggcgcatgtaccgcgacctggcgctgtcgctgcggtgcggactccgcgacgcggccgcggggttctcgttcctgcgcctgcgcggcctccgcgcgctcctccgcgcccctccgctccacctccgacgccgacgccgacgcccgacgcgggcctcttccgcgactcccagtccatccgagatctccaagtgatcccggtgctgttcgagcacagcctgcgcaaggcgaccggggacgcggtgctgacggtggcgcaggtgctgggcatggagcccgccgccgccaggctcaggaaccccgccacggactccgaggtcgtgcttgcgctcagggtgctcgaaggttgctgcctcctctgcccggcctgcgcagccgcggcgcaccgctacaatgccgtcaaggtggttttgaatatactgatgacacgtggtatcctcgagcaaagagcatgtctcgacactctcttagcgttgctggtgaattgttcaggaaacctgacggatttcaaagaacaagatggactaaataaaattgctgtcattgtaaaagatgcaaatagggatgaccatgtaaggttaaaatgttccgagtttctgcttctttactctggaaacgcaaaagaaaaatgtggcgcagattccgagtctaatatgcgagaagatttggcaaaggttttcggagaaaaatgtgcatcatttatctcctcaatgaacctattcagctcaactctagagtcacaaatgaggcaatctgagctaagctttcttgcagagcatgtgttggattacatgtagagccatactaaagataaccataatcgtgccattttctccacacacaacagagttcagtgctccaaaatgtatgtttcctattaacttgggtaattattgacgatgctactgtatatgaactcaactacgagaatgttactgttcacctaaaaaaaaaaaaaaaaaaaacaaaaaaaaaaaaaaaaaaaaggccggccggtcgcgatctagagccccgggaattcagg

SEQ ID NO: 2079 - DNA, 1716 bp, Zea mays
aggtgcggcttaaacccttatcgccaccagtggccgcgtcctcttcatttccgccatccgtatcgtctccctagggtttggcactttggccgccgccatggcgtcggcgtcgcgtgcgctcctcatctctcgtgcgctccaggccggcgccgtgtctcgccgcgtccccgccctcctgcgccctgtcgctgctgccgcgagcctcctcccagcggtggcggggccggcaggggccgccctcggcgctagggtgcggtgcttcgcgacccagccggcgacgtcctcgctgcgggactcgtccccgaactggagcaatcgcccgcccaaggagacgatcctcctcgacggctgcgacttcgagcactggctcgtcatcatggagccgccgcctggtgacgcctccaaccccgacatcacacgcgacgagatcatcgatagctatatcaagactctcgcccaagtcgtcgggagtgaggaagaagctaggcaaaagatatactctgtatcgactcgtcattactttggctttggtgctcttgtatctgaggaactttcttacaaactgaaagaaattcccaaggtccgctgggttcttcctgattcatacttggatgtcaaaaacaaggactatggaggcgaacccttcataaatgggcaagctgttccttatgatcctaaatatcatgaggagtgggtgagaaacaatgcccgtgccaatgacagaaaccggcgcaatgataggccccgcaactttgacaggtcaaggaactttgacaggagaagggagaacatgcaaaactaccagaacagagatgggcctcctgcccaaggtttcaatggccctccacctccacctggccagaaccagatgccatcccaccatggtcagggcaacatgcctccgcaaccaccacatgctggtggcggccaaccaaactatcagccccaaatgcaaaacccacagacgggctacaaccctggcggtgctcctcactaccagcaaggtgctgctcctggctaccaaggtggacctccggggtatcaaggtggtaaccaagggaacccaggccctgcctaccaaggtggtaacactggttatcaaggtggcaacccaccacctccctaccaaggaagcaacccaccacctccctaccagggaagcaacccaccacctccttaccagggaggcagcccaccagggccaccacctccctaccgaggaggcagcccaccagggccaccacctccctaccgaggaggcagccccaacgtaccgccatattcgggtggtggcaatcctggctaccctggtggcagccctggctaccagggtcaaggaggcaactcgaacttccagtgaacatgaccacgtggcacccctgtttcagagtagccttctgcaagagatggtgcgccgtagcctagcataaatcgaacccttgttgctatcggattttcatggattgtcgctgtttgcacttaatgttctatatatagtactcaaaactatgcttggtgtctgagtgatgtacgtggaactatggatcagctcttgtgtgcacttgctgaaccagatacccagcagtaagcttttgtttgttcgttttgagtggttggttaaccacatacttgttacagtcgattctgataaacttcccatgtgaaactttgcctgcattgtccgtgagacctcagcggcccggcactcggaagtct

SEQ ID NO: 2080 - DNA, 1734 bp, Zea mays
cattgggtacctcgaggccggccgggatcgccaccagtggccgcgtcctcttcatttccgccatccgtatcgtctccctagggtttggcactttggccgccgccatggcgtcggcgtcgcgtgcgctcctcatctctcgtgcgctccaggccggcgccgtgtctcgccgcgtccccgccctcctgcgccctgtcgctgctgccgcgagcctcctcccagcggtggcggggccggcaggggccgccctcggcgctagggtgcggtgcttcgcgacccagccggcgacgtcctcgctgcgggactcgtccccgaactggagcaatcgcccgcccaaggagacgatcctcctcgacggctgcgacttcgagcactggctcgtcatcatggagccgccgcctggtgacgcctccaaccccgacatcacacgcgacgagatcatcgatagctatatcaagactctcgcccaagtcgtcgggagtgaggaagaagctaggcaaaagatatactctgtatcgactcgtcattactttggctttggtgctcttgtatctgaggaactttcttacaaactgaaagaaattcccaaggtccgctgggttcttcctgattcatacttggatgtcaaaaacaaggactatggaggcgaacccttcataaatgggcaagctgttccttatgatcctaaatatcatgaggagtgggtgagaaacaatgcccgtgccaatgacagaaaccggcgcaatgataggccccgcaactttgacaggtcaaggaactttgacaggagaagggagaacatgcaaaactaccagaacagagatgggcctcctgcccaaggtttcaatggccccccacctccacctggccagaaccagatgccatcccaccatagtcagggcaacatgcctccgcaaccaccacatgctggtggcggccaaccaaactatcagccccaaatgcaaaacccacagacgggctacaaccctggcggtgctcctcactaccagcaaggtgctgctcctggctaccaaggtggacctccggggtatcaaggtggtaaccaagggaacccaggccctgcctaccaaggtggtaacactggttatcaaggtggcaacccaccacctccctaccaaggaagcaacccaccacctccctaccagggaagcaacccaccacctccttaccagggaggcagcccaccagggccaccacctccctaccgaggaggcagcccaccagggccaccacctccctaccgaggaggcaaccccaacgtaccgccatattcgggtggtggcaatcctggctaccctggtggcagccctggctaccagggtcaaggaggcaactccaacttccagtgaacatgaccacgagtactaagttggcacccctgtttcagagtagccttctgcaagagatggtgcgccgtagcctagcataaatcgaacccttgttgctatcggattttcatggattgtcgctgtttgcacttaatgttctatatatagtactcaaaactatgcttggtgtctgagtgatgtacgtggaattctgaaactatggatcagctcttgtgtgcacttgctgaaccagatacccagcagtaagcttttgtttgttcgttttgagtggttggttaaccacatacttgttacagtcgattctgataaacttccatgtaataaaaaaaccgagaaaaaaaaaaaaaacccctccgcggacgcgtgg

SEQ ID NO: 2081 - DNA, 1737 bp, Zea mays
gcacgagaccattacctagaacatcctaatcgaaaaatcgccaccagtggccgcgtcctcttcatttccgccatccgtatcgtctccctagggtttggcactttggccgccgccatggcgtcggcgtcgcgtgcgctcctcctctcccgtgcgctccaggccggcgcgtctcgccgcgtccccgccctcctgcgcccggtcgctgcggccgcgagcctcctcccagcggtggcggggccggcaggggccgccctcggcgctagggtgcggtgcttcgcgacccagccggcgacgtcctcgctgcgggactcgtccccaaactggagcaatcgcccgcccaaggagacgatcctcctcgacggctgcgacttcgagcactggctcgtcatcatggagccgccgcctggtgacgcctccaaccccgacatcacacgcgacgagatcatcgatagctatatcaagactctcgcccaagtcgtcgggagtgaggaagaagctaggcaaaagatatactctgtatcgactcgtcattactttggctttggtgctcttgtatctgaggaactttcttacaaactgaaagaaattcccaaggtccgctgggttcttcctgattcatacttggatgtcaaaaacaaggactatggaggcgaacccttcataaatgggcaagctgttccttatgatcctaaatatcatgaagagtgggtgagaaacaatgcccgtgccaatgacagaaaccggcgcaatgataggcctcgcaactttgacaggtcaaggaactttgacaggagaagggagaacatgcaaaactaccagaacagagatgggcctcctgcccaaggtttcaatggccccccacctccacctggccagaaccagatgccatcccaccatagtcagggcaacatgtctccgcaaccaccacatgctggtggtggccaaccaaactatcagccccaaatgcaaaacccacagacgggctacaaccctggcggtgctcctcactaccagcaaggtgctgctcctggctaccaaggtggacctccggggtatcaaggtggttaccaagggaacccaggccctgcctaccaaggtggtaacactggttatcaaggtggcaacccaccacctccctaccaaggaagcaacccaccacctccttaccagggaggcagcccaccagggccaccacctccctaccgaggaggcagcccaccagggccaccacctccctaccgaggaggcaaccccaacgtaccgccatattcgggtggtggcaatcctggctaccctggtggcagccctggctaccagggtcaaggaggcaactcgaacttccagtgaacatgaccacgagtactaagttggcacccctgtttcagagtagccttctgcaagagatggtgcgccgtagcctagcataaatcgaacccttgttgctatcggattttcatggattgtcgctgtttgcacttaatgttctatatatagtactcaaaactatgcttggtgtctgagtgatgtacgtggaattctgaaactatggatcagctcttgtgtgcacttgctgaaccagatacccagcagtaagcttttgtttgttcgttttgagtggttggttaaccacatacttgttacagtcgattctgataaacttcccatgtgatacttttgctgctttgtccgtgagacctcaacggcccggcactcggaagtcttctgctcttgtcgctg

SEQ ID NO: 2082 - DNA, 658 bp, Zea mays
agtggtactgcttttcatatgttctgatattcaagtcgaacgttacttacttcttggcactgctccgacttccatgctcactcacctccctgagttctgaatccagagctgaaacacctcctgccacaactggagaacacttcactgaatcatgtggggaaacaactgctgccacaataggagaacatttgactggggagagtgatggtgcggcttgcttctctaacaccttttgctcagtcaaatccctgagctcgtcgacggggctagcgtctgtgaccgcctcatccgcagccgccacagccggcggcggcgttgaagccttcacctcatgggacggcagcgacgcgtccttcgccgccacatccgcatcctcggcgacctcatcgtgcggcgcctccacggcctccgccagcgttgagggctttgccccgcgcaacggcggcgacacctccttcaccaccacatccgccgcctcgcgggccaccgcaacatgaatcgaccgcggcggagtcctcgcgggagactgcctccgcaacttctggcgtcggcggcgccggtcggcgtcgccgccgaagcaggcgaggaagcagcccatggatccggaccctggagatgcgtgcagcgggaggaggacttgatttcgtggaatttgaag

SEQ ID NO: 2083 - DNA, 1221 bp, Zea mays
  misc_feature (229)..(229): n is a, c, g, or t
  misc_feature (248)..(248): n is a, c, g, or t
gacaagggaatcaactagaggctttggatttgtatgctatagtacccctgaggaggcaaagagcgctgtaaacaacatgcgaggtgttatgttttttgggaaaccattgtatgttgctattttccaaagaaaagaggagagaaaagccaagttgcagcaacatttcgctcagcttgcaagaatggttggacctgcgaactctatgatccccactggatatccacaagtnttattttgcccatccaagntacccatatccctcaagggtcctccaagacatggttttgtgtatccacccatgggccttagtcatgaatggagaccaagtatgttccccccagcaccaaatctccagcaaatacattcacccgtgatgccaaattcgccaaggcattacagaagcagccgaggaaggatgggtgggaatatgatgcctcttcctcatgcagttcatacaatgaactatatgacacatccacagccagctaaagaattcatgtctttgcctcgacagcgattcaatcatccgaagtacttctcaaatgatgttgtggccaacagcttgcccatccatcaaagtgacccggtttcaacaatgaatgattcttttagcaactatttggcctccgctcctcccgcggaacaaaagaacttgcttgggaacaggctctatcctcttgttgagaggcatcagcccgaactcgcgagcaaaatcactgggatgctcttggagctcgacaactctgaagtggtcacgttgctttgctcgtcggagatgttgtcggtcaaggtcgacgagtgtgtccagctgttgcaggcaaccaagcctaaggctgaggatcatgaggcgctgcacccaggattcatgctggagcctcggcctcctactgtaaatgccagttgatgaggttctgattgcgcggatgagcttctggatgcgcttgtgtttagggatatggtaacaagctagtcgctagctgctgtgttcgttctctccttctagtttgcgaagttttggtgtttggattaatctactgagccgttattgctttctatatatagaacttaatagtaataaggactatatatattcagttagaaattttttatctggacatgttatatgaatgtatgttagaacctttattcctatccaacattaggaatagttgtccatgcgtctcctatacctttcatatgatattctcatttggacatgtt

SEQ ID NO: 2084 - DNA, 1332 bp, Zea mays
ggcgatgccgcccccccaccccggccggcacgccggcgtatgtcgcccccgaggttctcttgaagactggctacgacggcgcgaaggcggacatctggtcatgtggcgtgatcctcttcgtgctcctggcaggctacctcccgttcaacgacaccaacctgatactggtgtaccggaagatcacacagagcaactacaagtgcccaccgtggttctctgtcgaggcgcgcaagctcctcgccaggctgctagaccccaaccccaggactaggatctccatctcaaaggtcacggcaaatccctggttccagaaaggactctgccctctcaccaccgacaagcccctcgacttgtgggagacctccgaggtgctcggcaaggaaaaagcctgcaggtgccgccaccaccagcgcgacgacgccgacgccgacgccgacgccgacgacgaggagaacaccaggaagaggaagcggtcgaaggtgacggtgtcttcaccaccgaccgttgccgtgaggccttcgagcatgaacgcctttgacatcatctcccgatcgagcgggctggacctgtccaagatgtttgacgaggagcacaggtcagaggcacggttctcttccagagaatccacggcggcgatcatgtccaagctgcaggagatcgttcagacgcggaatctcgacatcaagctaaacaagaggggcagggtcgagatggagggcggtcagtactgtcgaagaggcacgcttgtcatcgaggcagagatcttcgaggtggcgccatcggtgcgcgtggtggagatgaggaagattggcggtgactcgcccgagttccgagagttctacaggcaggaactgaagccatcgttaggtgacattgtatggtcgtggcagggcagtgattcgcctcctactcccttgctgccgccggcgccgaggcaggcaaccaaccaacgtccatgatttcctctgcataaaaaaatttgcagtggaattttggcacttatggttcactaaaaacatgatgttaaacatattgtcactattaagggtggctggcaaatgatttgtcactgtcatagggacgctgtactagtagcataacatttgtgataatatatcatcacgggctcataatagatatgacaatgaaaatgatttttattgatgattcgtgacacaaaccgaaggcaaaaaccagggcattttttccaaccagggcttgttcggttgcacagagattataggggattgaagagaattaaattccttccgaaaagatttaattcctctcaatctctttcgatctctcccaaagcgagcaaggtctgattca

SEQ ID NO: 2085 - DNA, 2015 bp, Zea mays
cctcgaggccggccgggaatggggcctcgggccgccggccggcgtaccaacccaaacaaaaccacacaccacctcctcgccggctcgtcatcgacatcgccatcgccatcgccatcgtttcattgcgagtctccgtttcatctcgccccctcacccccacacacactggaatccccgcgtctgaatccggcgccccccgccccgatccgcgccgaatcgccgccgctcggggtggaaccctagcccgatctcgatccgtttctccgcgatgggcgccggccgtgtctgtcgcggcggcccctcctccgtctcccccgccgcagggcggccgttctcgacgctcgccgcgtcgtcctccgcctccccttcctcggctccttcagagacggcgtccacgtcggtcaccaagacggtgaacggctcccaccacttcaaaatcgcgggctactctctctccaagggaatcggggtggggaagttcatcgcttccgagtccttcaacgtggggggattcgactgggcgatctacttctaccccgacgggaagagcgccgaggacggcgctgcctacgtctcgctcttcatagccctcgccagcgagggtaccgatgtgcgcgcgctgttcgagctcacgctcgtcgaccagagcggcaagggtcaggataaggtgcatacccacttcgggaggtcgctcgagagcggcccatacaccctcaagtaccgcggcagcatgtggggctacaagcgtttcttcaaacgaactgccctagaaacatcagactatcttaaagatgattgccttttagtgaactgcactgttggcgttgttcaatcacatactgaaggaccaaagatatacacaattccagtaccgcggtccaacatggctctacatattggtcagctattgacaagtggaaagaggacagacattgcattcgaagttgatggagagatgtttcctgcccacaaggtgattctttcagcccggtctcctgtttttagggcacaactttttggcccaatgaaggataaggacatgaagtgtataaagattgaagacatggaggctccagtattcaaggccttgctccatttcatgtattgggatgagttgccggatattgaagagcttactggtgtaaatacaacttgggtatccaccttgatggctcaacatttactagctgctgcagaccgttatgcattggagagattgaagttgctctgtgaacttaagctgtgtgaagatgttgcaataaatacagtggcaaatactttggcactggctgaacagcaccactgttatcagctaaaaactgtttgcttgaaatttgtagctctgcctgaaaatttgaaagctgtcatgcaaaccgatgggtttgattatttgcaacaaagctgcccatccctcctgaccgagcttctcgagtatgtggccaaggcaggagagcactccgtgagcccctgcttgtattcaactgaagtccttgacggtggtgatgccaatgggcgacgcgtgaaaccaaggatctaacggttggaagaggagttcctcgtgcccattttaagttgtaaagtgtttcgaatgacgggtgcttatgtggccgtgccatatcatgcatgttgtagcgtgtgggtttgtgtgtgttgtgacttccatccctctccccagccgtattgatggtactgtagagggtgttatcgctaatatataccctactgacttatgtattgcatcgctgtttcaaagcagtctgtcatcataagtgcacacaggtggaatagggcgaggatggtctggtgcaaaggtgaaataatggcacagattgtgtatgtgtgtgtcctgtttttcagaagttttaccttgcgtaggccagatttgtcgattcttagtcgtctgtatttggctgtattcaattgaattgtgaaatgtatcagttgaagttatgcgcagacattcaaaacctttcctctcgaaaaaaaaaaaaaaaaaaaactcgagagtacttcta

SEQ ID NO: 2086 - DNA, 1978 bp, Zea mays
cattgggtacctcgagccggccggccggggaaaaccacacacacacacgccacctccttgagtccttgtcggctcgccatcgccaccatcatttcgtgtcgagtctccgtttcaccctccccaaattcccctcaaatcgatctcccccgcaccccgaatccccgcgcccccgcgtctgaatccggcgccccccgccccgatccgtccgatccgcgccgaatcgccgttgctcggggcggaaccctagcccgatctccacctgtttcctcgcgatgggcgccggtcgtgtctgccgcggcggccctttctccgcctcccccgccgctggcgccgccgcggggcggccgttcccgccgctcaccgcgtcctcctcctcatctccttcatcggccccttccgagacagcgtccacgtcggtcaccaagacggtgaacggctcccaccacttcaagatcgcgggctactccctctccaaggggatcggcgtggggaagttcatcgcctccgagtccttcaacgtggggggattcgactgggcgatctacttctaccccgacgggaagagcggcgaggatggcgctgcctacgtctcgctcttcatagccctggccagcgaaggcaccgatgtgcgcgcgctgttcgagctcacgctcgtcgaccagagcggcaaggggcaagacaaggtgcatacccactttgggaggtctctcgagagcggcccatacaccctcaagtaccgcggcagcatgtggggctataagcgtttcttcaaacgagttgccctggaaacatcagactatcttaaagatgattgccttttagtgaactgcaccgttggtgttgttcaatcacatactgaaggaccaaagatatacacaattccagtaccacggtccaacatggctctacatattggtcagctattgacaagtgggaagaggacagacattgcatttgaagttgatggagagatgtttcctgcccacaaggtgattctttcagcccggtctcctgtttttagggcgcaactttttggtccaatgaaggataaggacatgaagtgtataaagattgaagacatggaggctccagtattcaaggctttgctccatttcatgtactgggatgagttgccggatcttgaagagcttactggtgtaaatacaacttgggtatccactttgatggctcaacatttacttgctgctgcagaccgttatgcattggagagattaaagttgctctgtgaacttaagctgtgtgaagatgttgcaataaacacagtggcaaatactttggcactggctgaacagcaccactgctatcagctaaaaactgtttgcttaaaatttgtggctctgcctgagaatttgaaagctgtcatgcaaaccgatgggtttgattatttgcagcaaagctgcccatccctcctgaccgagcttcttgaatatgtggccaagataggagagcactccgtgagcccctgcctgtattcaactgaagtccttgatggtggagatgccaatggacgacgcgtgaaaccaaggatctaacggctgcccagatgagcctagaagagggagttccttgtctatttttttttgttttgttgttgtaaagtgattccaatgacgggcgcttctgtggtgccataatcatgcatgttgtagcgttggtttgtgtgtgttgtgatttccccagccccattgctgctactgtagagggactgatatacatcctactgactagactgcgttgctgctgcaaagcagcttttcatcatatgccaaggatggtctggtgcaaaggtttgatcaaggggggagaatggcgcagaatatgttctgcagaagttttacctttcgctaggccagatttgtcgattcatggtcatctgtattgactgtattcaattgaaatgaaatgtatccgttgaacattcactttcaaaatgacccgttcatctgccctaccctta

SEQ ID NO: 2087 - DNA, 977 bp, Zea mays
tatcaattttaaaaccttgccgcttactgtcgacctaatgccattcctcgtactgtttatacttttggtgcatttgatgtgcaaatttataatgcccccataagatcatgacctgacctgaactaacgtattgattttcaaattatgcggggcttgatttatgtcatgatactcaaatgttttgcttgttctcctgaagctgtggactatgcgaagtttggatttgattttatacaacagagcaaccaaattggcccactcttccataacattgccctgcaacaatacatcctactttgttctcaggtgaggtaactttgaatacaatattattttcatatgcagagttttatcactagaatgtgaaattctgcaatgccgtcttattatagttgttaccaccctctatcccgaaattataagttgttttagcttttctaggttacataacttttgatatgcacctagatatacaatgtctacatacatagcaaaagttatgtgccgaaaaatgccgaaacaacctataaattggaacggagggagtatttattgaggaaatgagatctcagataagttaagattacaatcgcttctgtaactcaggtactagagggaggcttgagggataagcctggaaagaacagagatcactatcattcatgctactgcctcagtggcctcgcagttagccagtacagtgccatgactgatactggttcgtgcccattacctcagcatgtgcttggaccgtactctaatttgctggagccaatccatccactctacaatgttgtcctagataagtaccatacagcctatgagttcttctcagaagagtgatctaatgttagaacctaagaacaattggctaaggttgtgtacgattgtgttatttgcacgaatgatggtaacttagtcgtgttataccagggtatttgtatgtttggtcaggtgggattgcctggataaatctc

SEQ ID NO: 2088 - DNA, 1895 bp, Zea mays
cattgggtacctcgaggcccgcccggcaacaccgaagcagccgagaaccggaccccgcaaggccgcaacagcaagggcagcactgccgaaaccgcaggccgcagcactcgagagcgcagccaggcggcggcgctccgcctccgactccacaccaggccgctgcgtccatggacccctccccgcagtcgacgccgcccaccggagacgacccggcagcggcggcggatcccgacctaccgaggctcacggtgacgcaggtggagcagatgaaggtggaggccagggttggcgacatctaccgctccctcttcggggccgcgcccaacacgaaatccatcatgctagagctgtggcgtgatcagcatatcgagtatctgacgcctgggctgaggcatatgggaccagcctttcatgttctagatgccaatcgcccttggctatgctactggatggttcatccacttgctttgctggatgaagcacttgatgatgatcttgagaatgatatcatagacttcttagctcgatgtcaggataaagatggtggatatagtggtggacctggacagttgcctcacctagctacgacttatgctgctgtaaatacacttgtgacaatagggagcgaaagagcattgtcatcaatcaataggggcaacctgtacaattttatgctgcagatgaaagatgtatcaggtgctttcagaatgcatgatggtggcgaaattgatgtccgtgcttcctacaccgctatatcggttgccagccttgtgaatattcttgattttaaactggcaaaaggtgtaggcgactacatagcaagatgtcaaacttatgaaggtggtattgctggggagccttatgctgaagcacatggtgggtatacattctgtggattggctgctttgatcctgcttaatgaggcagagaaagttgacttgcctagtttgattggctgggtggcttttcgtcaaggagtggaatgcggatttcaaggacgaactaataaattggttgatggttgctactccttttggcagggagctgccattgctttcacacaaaagttaattacgattgttgataagcaattgaagtcctcgtattcctgcaaaaggccatcaggagaggatgcctgcagcaccagttcatatgggtgcaccgcgaaaaagtcttcctctgctgtggactatgcgaagtttggatttgattttatacaacagagcaaccaaattggcccactcttccataacattgccctgcaacaatacatcctactttgttctcaggtactagagggaggcttgagggataagcctggaaagaacagagatcactatcattcatgctactgcctcagtggcctcgcagttagccagtacagtgccatgactgatactggttcgtgcccattacctcagcatgtgcttggaccgtactctaatttgctggagccaatccatccactctacaatgttgtcctagataagtaccatacagcctatgagttcttctcagaagagtgatctaatgttagaacctaagaacaattggctaaggttgtgtacgattgtgttatttgcacgaatgatggtaacttagtcgtgttataccagggtatttgtatgtttggtcaggtggattgcctggataaatctctctgttgtaatggtcgtgtcccgaattatgtttgtaatggtcgtgtcccgaattatgttactggtgttcattattagttaaaatgcaacagaagtgtaggtctagatgctgcatagtgatctgtggatgctagaaccaagtgtttgtacgtaatactgttatgatggtactaaattgattagttaaatgcccgattatggtccctgaaaaaaaaaaaaaaaaaaaaaaaaaaaaaa

SEQ ID NO: 2089 - DNA, 1863 bp, Zea mays
taaaagagtttcttgtaggtgcgtcgtacggccagaaacacacaacggcggcctatcttcgcgctcgctctcgggtctgttccgtgaccagcatggcaaggctgccacgttcccagccacccctgggcaccaagtaaccggcccacacaatccgcaccgcgtctgtgccctacgcccatacccaaacgcacgtttccagcgcagcggccggtctaccacaccacacgccactcactcctgtcccgtgccccacaacacacaacactattaattcagtgctcttcccttcctctcggtctgcgtgcagcgtgctcgcgaggccctgcttcctgctgcgatggggggcgagacgcacctgagcgtgcaggagctggcggcgtcgctgggcgcgctaccgccggagttcgtgcggtctgagcaggaccagccgggcgcgaccacgtaccgcggggccgccgtgccggacgcgccggtgatcgacatgtcggagcccgggttcggcgcgcgcatggccgcagccgccagggagtgggggctgttccaggtggtgaaccacggcgtgccctcagcggcggtggcggagctccagcgcgtcgggcgggccttcttcgcgcttccgacggaggagaaggagcgctacgccatggacccggcgtccggcaagatcgagggctacggcaccaagctgcagagggacctcgagggcaagaagacgtggaacgacttcttcttccacgtcgtcgcgccgccggagaaggtggaccacgccgtctggccccggagcctcgccgggtacagggaggccaacgaggagtactgccgccacatgcagcgcctgacgcgcgagctgttcgagcacctctcgctggggctggggctccacgggagcgccatggcggaggcgttcggcggagacggcctggtgttcctgcagaagatcaacttctacccgccgtgcccgcagccggagctcacgctcggcgtcgcgccgcacaccgacatgagcacgctcaccgtcctcgtgcccaacgaggtgcaggggctccaggtcttcaaagatggtcaatggtacgaggccaagtacgtgcccgacgcactcatcgtccatatcggcgatcagatcgaggcaagcgacctacgtagcatcttttttttttcattctattgtgttgtgatgatcttgctccctcaagtatttctttgatgtcggacaactactaactggtacgaaccgatcgagcagattttcagcaacggggcatacaaggcggtgctgcaccgtacgacggtgaacaaggagaagacgcggatgtcatggccgatgttcgtggagccgccgggggagctcgtcgtcgggccgcaccccaagctggtcacggaggagagcccggccaagtacaaggccaagaagtacaaggactaccagcactgcaagatcaacaacctccccatgtattcggctcgcgcgggttctactgtcgtgtgcacccgcttctgtaatttcagtctaccatatttaagtcacataaccgttattccagtcgcatgcatggccacagaattggcttgtgggctctttcgtctggtttgggccattgcgggctgcttatctactctctttcccgaccgtgtttatttgttgttgttgtaagggcactaatacatgttaaagaataacgggtcttttgtccgtatattactacaatttctatagatgggattgtccacgccatttaacatattataaattttaagcactagcttgtccgcatcactaaaaatcaccaaaacctagtagtgtgcatctgtcggttgtaatcacacccctccgagggtgtataatttctttggggaaaccttctt

SEQ ID NO: 2090 - DNA, 1897 bp, Zea mays
catgagaaatgaggtcatctcaccaaatttgaagaataaactcatgatacaccacatcatattagatggagtgattccacacaccaacacccattacacgcttgcatttaaaaccgcattgccgttgctctctctaagcgcacagtgctggcatatccgatgcactgtagagctgaagtgcgtctctttcaagtgcccttgctctttgtgctacaaaaccggtgcgctattactcgttagttggattttagttttctaagaagttgaagtagggtcagggcacagttgaaagctggtgacatgtcgcagcgaacataaacgagtttctggtaggtgcgtcgtacggccagaaacacaacaacggcctatcttcgcgctcgcatagcaaggctgccacgttccgagccaccccggccccgggcaccaagcaaccggcccacacaattcgcaccgggtctgtgcccatacccaaacgcacgtttccagcacagcggccggtctaccacaccacacgccactcactcctgtcccgtgccccacaacacaacactattaattcagtgctcttccctgcctgcgtctgcgtgcagcgtgctcgcgaggccctgcttcctgctgcgatggggggcgagacgcacctgagcgtgcaggagctggcggcgtcgctgggcgcgctaccgccggagttcgtgcggtctgagcaggaccagccgggcgcgaccacgtaccgcggggccgccgtgccggacgcgccggtgatcgacatgtcggagcccgggttcggcgcgcgcatggccgcagccgccagggagtgggggctgttccaggtggtgaaccacggcgtgccctcagcggcggtggcggagctccagcgcgtcgggcgggccttcttcgcgcttccgacggaggagaaggagcgctacgccatggacccggcgtccggcaagatcgagggctacggcaccaagctgcagagggacctcgagggcaagaagacgtggaacgacttcttcttccacgtcgtcgcgccgccggagaaggtggaccacgccgtctggccccggagcctcgccgggtacagggaggccaacgaggagtactgccgccacatgcagcgcctgacgcgcgagctgttcgagcacctctcgctggggctggggctccacgggggcgccatggcggaggcgttcggcggagacggcctggtgttcctgcagaagatcaacttctacccgccgtgcccgcagccggagctcacgctcggcgtcgcgccgcacaccgacatgagcacgctcaccgtcctcgtgcccaacgaggtgcaggggctccaggtcttcaaagatggtcaatggtacgaggccaagtacgtgcccgacgcactcatcgtccatatcggcgatcagatcgagattttcagcaacggggcatacaaggcggtgctgcaccgtacgacggtgaacaaggagaagacgcggatgtcatggccgatgttcgtggagccgccgggggagctcgtcgtcgggccgcaccccaagctggtcacggaggagagcccggccaagtacaaggccaagaagtacaaggactaccagcactgcaagatcaacaagctccccatgtaattatgtagctcgggttctactgtcgtgtgcacccgcttctgtaatttcagtctaccatatttaagtcacataaccgttattccagtcgcatgcatggccacagaattggcttgtgggctctttcgtctggtttgggccattgcgggctgcttatctactctctttcccgaccgtgttatttgttgttgttgtaagggcactaatacatgttaaagaataacgggtcttttgtccgtatattaaaaaaaagcaaaaaaaaaaaaaaaaaagcggcc

SEQ ID NO: 2091 - DNA, 976 bp, Zea mays
cggacgcgtgggcggacgcgtgggcggacgcgtgggtctctctcccgaccccagtccccacccaccaccagtcttcctcgctctccaaatctcgcgacgagaaagcccatctaggaccacaggggcgcgccagccggcaggaacgacgggagaggagggcatggagccggctgagcggatcgagtcggccgggacggcgctggggaagcgtccgaggagcagggtgctgccgcgcacggccagcatggtgacggtgccgtcggcggcgaagcaggggcgccaggagcggggcgccggcgtgccgtcgtcctgctcactgccggctgcctgcgccgggatgggggccgtgccggggggttactactactgtggcacctcgttcgcggcggtggagacggcggccttcctcaaggcgtgcggcctctgcaaacgccacctcgggcccggccacgacaccttcatctacaggggcgaggtggcattctgcagccaggagtgccgggagaagcagatcgagtacgacgacctcgacgagcgcatggagcagacctgctccgtgacctccatgaaggaggccccgtccgtgtccggcgccagcggctccgaccagtccggcagcggcggggagaccgtggccgccgcctaggagccccccgggggagtggcgcaagggggcgggcggggtgtgtgttgttgcgccctggtggagcgggagcagcgacgccggccgatcggtcggcccggcccggtagattccgccatgctatagagcgcctgtgcatacagcttttagctctggagtctggattccggcagtgatgcatgcgtcagtgatttattattatagtttgttgatgcatgtgactctggaaacatggccctacttgtctgtcgaaacaaacaaacaaagagagagagagagagaaaaaagaggcaggtgtacccgggttgcaacaacaacagactctcgtccccc

SEQ ID NO: 2092 - DNA, 814 bp, Zea mays
caccagtctccctcgcacctccttcaccacctctccaaatctcgcccatctcgagccacagggcgcggagggccgcgtacaggagaagagggggtatggagcccgccgagcgaatcgagtccgggacggcgctggggaagcggccgaggagcagggcgctgccgcggacgcccagcatggtgacggtgccgtcggcggcgaagcaggggcgccaggagcggcgcgccgcctcgctgccggctgccggcactgggacgggagccgctgccgccatgccggtgggttactgttactactacggcggctcattcgccgcggtggagacggcggccttcttgaaggcgtgcggccgatgcagccgccgcctcgggcccggccacgacaccttcatctacaggggcgaggtggcgttctgcagccaggagtgccgggagaagcggatcgagtacgacgagcgcatggagaagacctgctgctcactgacctccatcaaggaggccccgtccgtgtccggcgccagcggctccgaccagtccggcagcggcggggagaccgtggccgccgcctagccggggtggccttggaggtgcagtgcaggcgtgcagcgacgccggatggatcgatcggcccggtagtttctgccatgccagagcgtctgtgcatagtacagctctggctctgggttccggcagtgatgaatgcgtcagtgattttattatcaggtgattgatgcatgtaactctggaaacatggcgttctattctatgtcgcgacaaaagaaaaagaaaaaaaaggaaaaagagagacccgggtt

SEQ ID NO: 2093 - DNA, 1390 bp, Zea mays
aaaaacaatttggcataagatacatctccccttctcacccaaccctccaagcaacattgaccgcaaagggccatccgctgcggtcagtgtaggtttctgaatcatagcttggcgatgcctgaggctagacaaatactgagctagccttcagaaaaaaaagaaaagaaagagattgagaagcagggagaaaaaatggcactggcccattgaggaagcttgagaaccagttaacaagaattgccaacatattcttggacaatcttgttaacagagttttaaggtttcccagcagagaagagcgcgtgcaaccaccacattcatataattaataagcaaggtttagagaagaggcaacatgggcacaaagatgaagaaggggatcctgaagccgttccgctatatctcaaccatcatggatggtaaggaggctgaaatgcaaattgggttcccgacggatgtaaaacacgtggcacacatcggttgggatggtcctggctccacgaacaacaacaacaataacaacagcaacaacaatagtggcggagcacctagctggatgaaggattaccactcggcaccgcttgactcgtcctcttttaggagtgagagtgggggcacggctgctgcaaatccctgggcttctcaagagatagtcatggatggagcaagcgtcggagaaacctccttcagggacacgaaaagcgaggcaggcgtcgacgtcggcgggggcgactccccaccgtcccccgccacccgccggtcgagacggcaccgctctcggggctccggcacctcatccatggacgccaccggcggcgagggcgaggagaagactaaggagaagagcaagaagggcacccgaaagaaccgcaagaagcaggacaagtcggccggcgacgacgcctcgggcacatgccaggacctccccgccgttcccaagaagtccaaccgccggaaaaacaagggaagctccgaggggagcggtagcgccgcggccaaggacaccaccgcggccgcgccggaggaggtggcggcgtcggcgtcggcgtcggcgaccgcacccgccgtggacgacgactagggatatataatccaagttgctgcggcctcgtataagaacttttggagatgaaattaacatgccgaaaggtacttaatcatatggtattcagaagggcacgtgcaatggggagttcaaggtcacgtacattagcattctcaggagtgggtgtgcacgcacaaatgccatttttttctctctgtttctttctctaatattgatccgcttttttgtggacatgttatctcgttcaagatttcgtatataaactaatactttgggcgggatatataaatctggctcactcatttaaaaaaaaaaaaaaaaaaa

SEQ ID NO: 2094 - DNA, 2066 bp, Zea mays
ctcgagccgctttcctctacgaaaaaaccatttttcagtataaaatttcgtttttctcctctcagtctccgacgccgccgcactcatccccccagacgaccaccctcctcctcctcccccacccacctcgccggaaccctagcgccgaccgcctgccgtgcccatcgacggcgatcgcattgctgcgccccgatggcgacccgcgcctccaagaattgcctctgcgcgggcagctcttcgttcgatgaccccgatgtggtcgaggtgtctccggcaaccgccgcggctgcagggtgggcctccggccaccacaagaggaagcggagccaggttgtaccgcaagaagtgattgaaatcgatgatgatgatcctgatggagtcatacttattggtgataaagcacaggtggaaaagaataagcaaactgctgtatgtcccatggattgctcaaagcatgccaagagtggttgggttcaggacatccctggtccaagcacatatgcttcaaaatataccagttcctgggttgacctgaaagtgtttcaagacgaggcagtttacaactattctgatggctacccctttgatggatttgaagaagactatgcttatgatgaagatgagtttgaggatgatggttatgacactccactcattggaagtgagtatcaatttggtttgtctgccaagtttgataacttcaatgttctacatggtctggcggcttctttaccgtggaagcagaagactgctattgagattgcaaataagaccaaacctagtaaggctgtagatgataaaatcgaagaaaaatacaaggccttcaaacgatttgatactgttgatgatcatagtgatcattattattcaaagccagaatcaagaaaggttcaggcggtaaaaaagccatcaaaagactgggtcaaacgtattcagcatgagtggaaagtcttagagaaagatttgccagatactatatttgtgagggcatatgaggatagaatggacctgcttagagctgtaattatgggaccagctggtactccttaccatgacgggctcttcttctttgacatttacttccctcctcagtatccaaatgtaccaccgatggtgaattaccgtgctggtggtttgcggcttaatccaaacttgtatgcttgcgggaaggtgtgccttagcctcctaaacacgtggactggcagtggatgtgagaagtggaacccggccaattcaactatgctgcaggtcctggtctctattcaagctttggttttgaatgcaaagccttatttcaatgagcctggctacgctatgcatgctaacacagcccacggggagaagaaatccctgacatataatgaagacacgttcctgcactcctgcaggacgatgctgtattctcttcgaaatccaccaaagaatttcgaggattttgttgctggccatttccgcaagtatgggcgcaacatcctcgtggcttgcagagcctacctggagggtgcccaggttggatgcctctccggtgacggagtgcaagacgttgacgaaggcgacaagagctgctcggtgaggttcaagcagtcactgaagaggcttcacgaggaacttctggcggagttcaccgcgaagggcgcggactgtggcaagttcctcagcgagaaggcaaggtccggagcttccacatcggcagcggacaccacgttgaggctgtaaggcggagtcgggcttgctgttggaaataaatctgccattcaagctatcctcaacacagcaagtttgatgcctgagctgccgatcatctaactgctttctgtaggtagtctatgtatatacctgtctagctcttctggtaaagacataagcgagacatattgggcgtttagggacaccattataccgtaggtatttacgtgtttataactgctggccgcagccccggcagctgtgtcgggctgtgacctcgtcctcagcttcagcttgtgctgatatgattgggacccaccatttggatatcaaaatgatgttggtctaggttagtcaaagtcctgactgattcgtttgtg

SEQ ID NO: 2095 - DNA, 2681 bp, Zea mays
cgattgggtacctcgaggccggcagataaaaatttcgtttttctcctctcagtctccgacgccgccgcactcatccccccagacgaccaccctcctcctcctcccccacccacctcgccggaaccctagcgccgaccgcctgccgtgcccatcgacggcgatcgcattgctgcgccccgatggcgacccgcgcctccaagaattgcctctgcgcgggcagctcttcgttcgatgaccccgacgtggtcgaggtgtctccggcaaccgccgcggctgcagggtgggcctccggccaccacaagaggaagcggagccaggttgtaccgcaagaagtgattgaaatcgatgatgatgatcctgatggagtcatacttattggtgataaagcacaggtggaaaagaataagcaaactgctgtatgtcccatggattgctcaaagcatgccaagagtggttgggttcaggacatccctggtccaagcacatatgcttcaaaatataccagttcctgggttgacctgaaagtgtttcaagacgaggcagtttacaactattctgatggctacccctttgatggatttgaagaagactatgcttatgatgaagatgagtttgaggatgatggttatgacactccactcattgaaagtgagtttcaatttggtttgtctgccaagtttgataacttcaatgttctacatggtctggaggcttctttaccgtggaagcagaagactgctattgagattgcaaataagaccaaacctagtaaggctgtagatgataaaatcgaagaaaaatacaaggccttcaaacgatttgatactgttgatgatcatagtgatcattattattcaaagccagaatcaagaaaggttcaggcggtaaaaaagccatcaaaagactgggtcaaacgtattcagcatgagtggaaagtcttagagaaagatttgccagatactatatttgtgagggcatatgaggatagaatggacctgcttagagctgtaattatgggaccagctggtactccttaccatgacgggctcttcttctttgacatttacttccctcctcagtatccgaatgtaccgccgatagtgaattaccgtgctggtggtttgcggcttaatccaaacttgtatgcttgcgggaaggtgtgccttagcctcctaaacacctggactggcagtggatgtgagaagtggaacccggccaattcaactatgctgcaggtcctggtctctattcaagctttggttttgaatgcaaagccttatttcaatgagcctggctacgctatgcatgctaacacggcccacggggagaagaaatccctgacatataatgaagacacgttcctgcattcctgcaggacgatgctgtattctcttcgaaatccaccaaagaatttcgaggattttgttgctggccatttccgcgagtatgggcgcaacatcctcgtggcttgcagagcctacctggagggtgcccaggttggatgcctctccggtgacggagtgcaagacgtcgacgaaggcgacaagagctgctcggtgaggttcaagcagtcactgaagaggcttcacgaggaacttctggcggagttcaccgcgaagggcgcggactgtggcaagttcctcagcgagaaggcaaggtccggagcttccacatcggcagcggacaccacgttgaggctgtaaggcggagtcgggcttgctgttggaaataaacctgccattcaagctatcctcggtcgatggggagttgggccacaccgatgcaacacaacacagcaagtttgatgcctgagctgccgatcgtctaactgctttctgtaggtagtctatgtatatatccctgtctagatcttctggtaaagacataagcgagacatattgggcgtttagggacaccattataccgtaggtatttacgtgtttataactgctggccgcagccccggcagctgtgtcgggctgtgacctcgtcctcagcttcagcttgtgctgatatgattgggaccacccaccatttggatatcaaaatgatgttggtataggttaggcgattcctgactgattcgttcgtgggatattcggtgtgtgccgcctcctgttcttttacgactgagctccagtgggtccgtttggttgctcacactatggtggttctggttcagccaatgatttgaagatcgttgaaaaccacaatatgtattgaataaccgaagcatagctttcggtacaatacatcaaaggtcaagtggaatcagatacatagggaccttcgaatgaaaaactagagattacaacatcatcagccgcacgatgatagtagctatcaccataaaaaagatgataatgaaaatcaataaggtgtgaagatcctcgtctgttatggatccactgacaataatctagatgcggatatgatcctactcgaagtcgaaatcctttgaagggtgcaaccatggttgagtacaaaacgtacttttgcagctccacctcaccacggagataattaacagatacaaagcatgtccagattaaaaatatatgccaagtatagcaatggcacatatataagtgactcatctgggctataggatagctcatctatagctgcaagggacacaacgtagctcacccaaatccgtgaggattgatatactgtgtaga

SEQ ID NO: 2096 - DNA, 1135 bp, Zea mays
cccacgcgtccgctgctgtttatgctcctgcaacaatgaatatgctccaaactcctccatttcatagcaacagccatgaaaaagagtcaggtgcagttttttcaaatagctttaacatggccccatcagtgacacctacctccccttttcaacttatgtctccaagctcaaccaactacacttccactcaaatcttcgaggaaaccaacaatttagaggacacttcaagagtctttggaggtggggataacgaaagcaacaacagtgaggaaccggatcccaagccggctgtggagatggaagacctaaaccaaggcaatgatcatacttcgaataaaacagctaactgtcaagattaccgtatggtcctgcgcaaggacttgacaaacagtgatgttggaaacattggaagaatcgtgctgccaaagaaagatgcagagcctaaccttccaatcttggaagataaggatggcctgatactggaaatggacgattttgaactcccggttgtatggaatttcaagtacaggtactggcctaataacaagagtaggatgtatatattggaaagtactggtgaatttgttaagaggcatgggcttcaagctaaggacatcctcatcatttacaggaacaagaaatctggcagatatgttgcccgtgcggtgaaggctgaggacatagcgccgccagaatgcgagtgcgtcgaggcaggaaaccctagagaagagtgcggcttctccgtcagtccttcgatcaataagaagatcatcacgtagatggctggagcatcagaaatgtatggtgtaggctgtttgccgcgcaggagcacaccgagaatcggcggttgctgggagccaagcaactgtttcgatcgaggttgtgtcgtcaaagctgaattcccacccaacctgcgtaggcctgtactatactgtttcccttgtttttgtcggccgtttcgtgtagttcgagataaatgatgagtttgcttttgtacctgtatatatttcgtctttggataattcggtgacaaacaagtcaaggtcgttatataccgtctttttgaataattacgacgattagaagttatttttttattttttttaaaaaaaaaaaaacaaaaaaaaaaaaaaaa

SEQ ID NO: 2097 - DNA, 632 bp, Zea mays
tcttcaagggcacagccgcgcggccaccaccaacaccacctggccccgtccttcctttcttgtgttgccgctaggccatacacacacgacgtcgctgctccgcatggccaacgccaatggctcgtccaccggtgcaggccatagcgacctcgtcagggccatttcgcacgagcagcaccaggcgttcatggcctccgtgccccgggccgcaccgggcggggtgaatgtgcaccaccagcagcacttccaccaataccccgccggcttgatcccagcgccggtggcactgccggttcacgcaccggtggtgtcgtcacagacgtctccgtactccgcccagatcgcggtgccgccgccgccgccaccactcatcgcatctccagaccaccgcctgcactccctgccgcctaccggatgctaccagctggactattctccatatggcaacgctgctgcgccttcgcagcagcacacatcagcaattaaggggttttgctgactggggaacgcacagcaatgcgctcatgtccttggctcatgccactagttttggtaacaacgggagcagcaatatccacaaccatggattattacctcaaaacttatccccggacaccacgcatacttggaat

SEQ ID NO: 2098 - DNA, 2211 bp, Zea mays
ttgactctctgcccagttcataattgatgggattgcttaatgatttgtgttgtcaccttgcttttatgataatcatgtggtgattgcaacagtagcactgtagtagttcctatgctttcggcagtactcggtttcctgattgagccctttctttcctgaactgttatccatcttgcagccacggttgaaggttagaatattgtttcatatgttatgtcactgttgggtactctgtttaagtagaagatcaatactggcatgcagccagccgagccaattgccattgtggtttagattgttctgttttgatatggctgttctggatttttgtggttatttatgaaatttgctgaactgtggacagacacgattagtaaaatttctaacgctgttgattatgtttgtaaacgttcagttttgcggtgaattgaatttgacttcatcctgtcattcagaaactttcagtataatgcaggctttccgccccacctgacttgatctactctggaaatgttcataacttcttgttttgttctgctcctctgtgcccaagatatgagctgttcagtttcagcaatgagctttgtgttgtatctgctatgcgacatttgacaaccgttgctttgtgctaatttatttgtgatattgttttccgaccaccatgggcttgtgcaaagaataagaaacaaagttcaaaataaaaacagtaaactgccgcccataccatcgcagcgggaaaaataaaaaccaactggcggcttgttttggcctcatctttgcaagcaagttgaaggactggtacagcaaatgctgagtggcttcccttccggatgtttgctgccgtgagtgagcggtcggccgtcatgattaattccgtggaacaccacggaaattacaagcgtggctgactggctgtgatacactcctacatcagcactgaattaccgcaatcgtgatggaattgaccgtcattatgagttggacgcatcaccattgcttcagcaagctcccgttgcccccatggccccatcaaagatagctcgcgctatttttaagccgtgcaagctcagagggaagcccggcacgccgccagctttccgtttcacttccaccccatgacatgcagatcctctcccgcgaccgcgagcgattcatggcagcgccggccatgatcgagacaggatgacgtccccgccgacgccgctgccggcgcttgcgcgccaggccatgcagtcgccgtcgccgccgacgaaggtgggaccaccgccgctgccaccgccgccgctgccggccgtggacgcggccgtcatcatgggcgtgctcacggccgtgctgctggcgctcttcctcttcctcatctacgccaagcactgcaagcagcgcggccccggcgagcggcccggcggcctgggcctcggcttcgcgccctcctcgtgcgaccgctgccgctcggggctcagcagctccgcggtgggcgcgcttccggcggtccggttcggcgacggtgacgtcgacgtgggccgcgccaccgagtgcgcggtgtgcctgggcgccttcgacgccgccgagctgctccgcgtcctgcccgcctgtcgccacgccttccacgccgagtgcatcgacacctggctgctggcgcactccacgtgccccgtctgccgccgccgcgtcaccgggggccacgtggacgactccgagccggaggactcggcggcgacgcggcagcacggccggcgctcggcggacgacgcggaggtgcaagtggttgtgcaccgcgcgtgggaccagcggtagtccaccgaaggcttggtgggccgggccgcgtacctcgaggccgccaggcatcggagcgacgacctcggcgtcctggtggtcaccgccgacgggtcctgctaggtagctggatgcgctcgtctgctgctccgagatcgatggagcttctgaatcctaggtagctcacgctcgttcacctatcggtcccgtgcatgtacatagttggggacacacgtcgctaggacgatgagagagagagcatggtagggtgaagactggaagatgcttgtaaactgtaatttgatcttggctagagattgggccacctgaagtttaatattaaaaaaagcctgccaaaaaacaatttaatcttgaaggcactttacacttcctgacttctatatgatccccgcgacccgactaaggactcctatgttg

SEQ ID NO: 2099 - DNA, 2670 bp, Zea mays
gatgttttcccgaaacctgaccagtagccgtcctcgtcttccacgttgtgtttctcgcccacctatctatatttatcataaaaaaacagccaaatcgagcgaggcgacgagggcgagtagtagttggcgagttggagcaggtctgggtctggccgtgtgagttatttcccagccaggcatctgagagctttggtcttgacctcgacagagatcgccatggacgcatcggcggaggtggaccacctcgccgccgagaggtcggccgcgcgcttcgatgtcgaggcgatgaaggttgcatgggctggctcgcgacacgccgtcgaagtcggcgaccgcatggcccgactcgtcgcgtccgaccctgtcttccgcaaggataacaggaccatgctctccaggaaggacttgtttaaggacactctaagaaaggcagcccatgcatggaagcgtattgtcgaactacgtctcacagaggaggaagcaggtatgctgaggctatatgtcgatcagcctggttatgttgatctgcattggggcatgtttgttcctgctataaaaggtcaaggtactgaggagcagcagaaaaagtggttaccaatggcttacaagttccaaataattgggtgctatgctcagactgaactcggtcatggctcaaacgttcagggccttgaaacaactgccacatttgatccaaagactgatgagtttgtcatccacagtccaactctgacctccagcaaatggtggcctggtggcttggggaaagcttccactcatgcagtggtgtatgctcggctgataactgaaggaaaggactatggtatacatggtttcattgtgcaactgcgaagcttagaggatcactcccctcttcctggtgttactctgggtgatattggtggaaaatttggcagtggtgcatataacagtatggacaatggtgttctgcgatttgaccatgtgcgcataccaagggatcaaatgttgatgaggctttcacaagttacaagggaggggaaatatgttcattcagatgtcccaaagcagctgctttatgggacaatggtttttgttcgccagacaatagtcgcagatgcttctaaggctttgtcccgtgctgtttgcattgctgtacgatacagcgccatccgaaagcagtttggctctcaagatggtggacctgagactaaggtccttgattacaagactcaacaaagcagactctttccgttgctggcttcagcatatgcatttagatttgtgggtgactggctgaagtggctatacatggatgtcactcagaaactggaagctaaagactactcaacactgcaagaagcccatgcctgtactgctggtttgaaggctgtgacaacatctgcaacagctgatgccattgaagaatgtagaaagctctgtggcggacatggttacctgaacagcagtgggcttcctgaattgtttgctgtctatgttcctgcttgcacttatgaaggagacaatattgttctgcttttgcaggttgcaaggattctaatgaagaccgtatctcaattgacatctggaaagcaacctgttggtacaatggcttacatgggcaatgtacaatatctgatgcaatgcaaatgtgctgttaacacagctgaagattggcttaaccctgttgccatacaagaggcgtttgaagccagggctctcaggatggcagtaaactgtgcccagaacataggccaagcagcaaaccaagaagaaggtttctatgagcggtcccctgatttgctagaggctgcagtagctcacatccagttggtcattgtaaccaagttcatttcgaaggtgcagcaggacattcctggacctggagtgaaggaacagctccagaacctttgcaatgtctatgccctctacattctccacaagcacctgggcgacttcctggcaaccgggtgcatcacacccaagcagggagcgctggcaaacgagcagctgggcaagctttacgcacaggtgcgtccaaatgctgttgcgctggttgatgccttcaactacacagaccactacctggggtctgtgctggggcggtacgatgggaatgtgtacccagcgctgtacgaggaggcgtggaaggaccctctgaacgagacggtggtgcccgaggggtaccacgagtacctccgccccttgctcaagcagcagctcaagctctccaggctctagtctgatcggctaccccccctggaattctccatggcggctgccttctcagaaaatctcacgcgacctccgaatgaaagtgatgtaagctactaacgattcttgttagagccaggaaagaggctctccagccaattataaatttattcctcaagctctgaggatcaagttcaagctgtggattatataggaagcacgtttaataattaataaagagggagaggatgagcatctctctgttgctgctcaagtgttgtgcgcagtgcgagtagtagaatgaatatgtatgtacgagtgcgtgtattgtatggtgaattgaagttccatttgtttgctaaaagtatatcagaaaacaatggcttgatttgcctaagtccaaaatgaaagccagattccgaacacacaaaaaaaaaaaaaaaaaaaaaaaaagggcggcagatagcgatctagaac

SEQ ID NO: 2100 - DNA, 2432 bp, Zea mays
ggggtcgccgacccgctctcggcaccaccgcccgccctatatgtacgtcatcgtcatacagggtcggaccccgggaagccgaagaagttagctgtgaggtctttaaagaggagttgttgcattgcagttgcaggttgcacagccgcggaagccagcacctcaaagccatggcggaagtggaccacctcgctgccgagagggccaccgcgcgcttcgacgtcgaggagatgaaggttgcgtgggccggctcacgccacgccgtccacgtcgccgaccgcatggcgcgcctcgtcgcatccgaccctgtcttccgcaaggataacaggaccatgctctccaggaaggagttgttcaaggacactctaagaaaagcagcgcatgcgtggaagcggattgtcgagctacgtcttacagaagaggaagcggatttgctgagacaatatgttgaccagcctggttatgttgatctgcattggggcatgttcgttccagctataaaaggccaaggaactgaggagcagcagcacaagtggttaccactggcttacaagttccaaataattgggtgctatgctcagacggaacttggtcatggctcaaacgttcagggccttgaaacaactgctacattcgatccgaagactgatgagtttgtcatccacagtccaactctcacgtccagcaaatggtggcctggtggcttggggaaagcttccacccatgcagtggtgtacgctcggttgataactgaaggaaaggactatggcatacatggtttcattgtgcaactgcgaagcttagaggatcactccccacttcctggtgttaccctcggtgatattggtggaaagttcggtagtggtgcatataacagtatggataatggtgttcttcgatttgaccatgtgcgcatcccaagggatcaaatgttgatgaggctttcacaagttacaagggaggggaaatatgttcactcaaatgttccaaagcagctgttgtatgggacaatggtttacgttcgccagtcaattgttgcagatgcttctaaggctttgtcccgtgctgtttgcattgctgtacgatacagcgcagtcagaaagcagtttggctctcaagatggtggccctgagactcaggtccttaattacaagactcaacagagcagactctttccattgctggcttcagcatatgcatttagatttgtgggtgattggctcaactggctatatacggatgtaactcagaaactggaagccaaggacttctcgaccctgcaggaagctcatgcatgcactgctggtttgaaagctgtgacaacatcagtaacagctgatgcaattgaagaatgccgaaagctctgtggtggacatggttacttgaacagcagtgggcttcctgagttgtttgcggtctatgttcccgcttgcacttacgaaggagacaacgtcgttttgcttttgcaggttgcaaggattctaatgaaaaccgtttctcagttggcatccgggaaacagcctgttggcacaatggcctacatgggcaaagtgcagtatttgatgcaatgcaaatctgctgtcagttcagctgaagattggcttaaccctgatgccatacaagaggcatttgaagcaagagcgctcagaatggcggtaaactgtgcccagaacataagccaagctgcaagccaagaggaagctgcaggtttctatgagcggtccccagatttgcttgaggctgcggtagctcacatccagctgattatcgtgaccaagttcattgagaaggtgcatcaggagattcctggacacggagtgaaggaacagctccaggccctctgcaacgtgtacgcgctgtacatcctccacaagcacctgggcgacttcttggcgactgggtgcatcacgcccaggcagggagcgctggcaaacgagcagctgggcaagctgtacgcgcaggtgcgtccgaacgctgtggcgctggtggatgcgttcaactacacggaccactacctggggtctgtgctggggcggtacgacggcgacgtgtaccctgcgctctacgaggaggcgtggaaggacccgctgaacgagacggtggtgccggaggggtaccacgagtacctccgcccactcatcaagcagcagcagctcaagctctcgaggctctgaagtctgaatcctctctctctctctctctctctctctctctctctctctgatgtggaagccagccaagatgtgtgtacgttagacatgtgtggtgggtttcagttgatacacgagggagtgagtaataaagagcgagcgagagatgaaacaaagaactgaatttgtatcgtacaacaaagaactttgccgtttggttcacatatttataacgtaatgggtaattgataacgttaaaaaaaaaaaaaaaaaaaaaaaaaaaaa

SEQ ID NO: 2101 - DNA, 1032 bp, Zea mays
actcctaagggcgggtgcctcgcggccggccggccttacactctccttttgtcaccttctcttcgttcccctcctcggctcctcgcgatccttctttactgcccgagagttctgactagccacatccagtcaagcagtaaaggcgcaccatggaggcggcggcggagaataaggaggccgagcaggagcagcagcagctaccgcacgcgcggaaggataacgcgcccgccgccgccgaggaagacgaagcggattcggaggagaccgagcgccgcaaccgcgacctcaagtccggccttcacccccttaggcacaaactcgtgctctggtacactcgccggacgcctggagcgaggtcgcagtcgtacgaggacaacatcaagaagatcatcgatttcagcacagtcgaatcgttctgggtttgctactgccaccttgcgcgcccttcttccctgccgagccccactgaccttcatctcttcaaggatggcatccgtcccctctgggaggatcctgcaaaccagaatggtggcaagtggataattagattcaaaaaggcagtttcaggtcgattttgggaggatttggtgctagtggtagtaggcgaccaacttgagtatagcgatgatgtctgtggtgttgtgcttagtgtccgtttcaatgaagacattctgagcgtctggaaccggaacgcatcagaccatcaggctgtgatggcattgagggattctataaagaggcacctcaagctgccacacagctatctgatggagtacaaaccccatgatgcttcgcggcgtgacaactcgtcctacaggaacacatggctgagaggatagataagccctatgatactcgccagcttcactgcgatggttctgaagcaaagagactcgtttatgtaccaagaacgcagactattatgcaatgtactactactcaaaagcccctacaatgtgacgcgcaacaattttacaatctaatgtgtttttttttgggtgcaaaaaaaaaaaaaaaaaaaaaaaaaaaaaa

SEQ ID NO: 2102 - DNA, 1115 bp, Zea mays
ctgtgcggcgcgcaccctcgaggccggccggtacactctccttttgtcaccttctcttcgttcccctcctcggctcctcgcgatccttctttactgcccgagagttctgactagccacatccagtcaagcagtaaaggcgcaccatggaggcggcggcggagaataaggaggccgagcaggaggagcagcagctaccgcacgcgcagaaggataacgcgcccgccgccgccgaggaagacgaagcggattcggaggagaccgagcgccgcaaccgcgacctcaagtccggccttcacccccttaggcacaaactcgtgctctggtacactcgccggacgcctggagcgaggtcgcagtcgtacgaggacaacatcaagaagatcatcgatttcagcacagtcgaatcgttctgggtttgctactgccaccttgcgcgcccttcttccctgccgagccccactgaccttcatctcttcaaggatggcatccgtcccctctgggaggatcctgcaaaccagaatggtggcaagtggataattagattcaaaaaggcagtttcaggtcgattttgggaggatttggtgctagtggtagtaggcgaccagcttgagtatagcgatgatgtctgtggtgttgtgcttagtgtccgtttcaatgaagacattctgagcgtctggaaccggaacgcatcagaccatcaggctgtgatggcattgagggattctatcaagaggcacctcaagctgccgcacagctatctgatggagtacaaaccccatgatgcttcgcggcgtgacaactcgtcctacaggaacacatggctgagaggatagataaacctcatgatactcggcagcttcactgcgacggttctgaagcaaagagactcttttatgtaccaagaacgcagactattatgcaatgtagtactactactactactactcaaaagcccctacaatgtgacgcgcaacaattttactatctaatgtgttttttttgcaaaagcatttaagtggatatttagggtttccgtccgtctttggttctgttggtaattggcacagaaatggtaaccaggatattacgttgatctaacccccaaaaaaaaaaa

SEQ ID NO: 2103 - DNA, 914 bp, Zea mays
cattgggaccctcgaggccggccgggagtcaagcagtaaaggcgcaccacggaggcggcggcggagaataaggaggccgagcaggaccggccgcggctaccgcacgcgcggaaggataacgcgcccgccgccgccgaggaagacgaagcggattcggaggagaccgagcgccgcaaccgcgacctcaagtccggccttcacccccttaggcacaaactcgtgctctggtacactcgccggacgcctggagcgaggtcgcagtcgtacgaggacaacatcaagaagatcatcgatttcagcacagtcgaatcgttctgggtttgctactgccaccttgcgcgcccttcttccctgccgagccccactgaccttcatctcttcaaggatggcatccgtcccctctgggaggatcctgcaaaccagaatggtggcaagtggataattagattcaaaaaggcagtttcaggtcgattttgggaggatttggtgctagtggtagtaggcgaccaacttgagtatagcgatgatgtctgtggtgttgtgcttagtgtccgtttcaatgaagacattctgagcgtctggaaccggaacgcatcagaccatcaggctgtgatggcattgagggattctatcaagaggcacctcaagctgccgcacagctatctgatggagtacaaaccccatgatgcttcgcggcgtgacaactcatcctacaggaacacatggctgagaggatagataagccccatgatactcggcagcttcactgcgacggttctgaagcaaagagactcttttatgtgccgagaacgcagactattatgcaatgtactactactacaatgtgacgctcaacaattttactatctaatgtgtttttttacaaaagcaaaaaaaaaaaaaaaaaagcggcc

SEQ ID NO: 2104 - DNA, 3730 bp, Zea mays
gtcttcgattccatctcccctgctgctgcctgctgcccgccttgttaccgtttaatcatacttcttctccctgcttcttcagtgttctccgccgtctcagggctcgagctctccctgtccaaggatcagcatgaatgtaagttgatttacaatccgcaccatccagacttggcatcttctgtcacagtctgcgtctctgaattctgagtgccatgtgcccatgttatctgttcgccgatctccatcacctgactgttaccttcacatgttacctagctacacttagctttcagaaacatttcatcattttaaccctaaccctgtagagaatttcttcccttcgccagatgccgtcatcccgataacctgcgccatactggtgttcctgttcgcgctgcagcactacggcacccaccgcgtggggttcctcttcgcgcccatcatcctcgcctggctgctctgcatgagcgccatcggcctgtacaacatcgtccgctggaacccccagatctaccaggcactcaaccccgtctacatgatcaggttcctcaggaagaccaagaagtccggctggatgtcactgggaggaattctgctgtgcatgacaggtaaaaatgaacagtcgctctgtaacaagcagaccatctcgttcgtctgcaactcgcaacaacagctgcagatgcagaagaggtggatggatgagcatgaacttaccctgtgtaacgtctatgtctgccattattcgttcagggtcagaagcaatgttcgcggatcttggacacttctcctacagcgccatccaggcaattcccctcacccctgaccctgcacttgataaacctgacctcctctgtgaatatttgtctgttacagttcatggtttagttctcaactgatgaattctgtcttttaaaaaaaaactgcagcttgctttcacttctctagtgtacccttcactgatcctgggttacatgggccaagctgcttatctgtcccagcaccataaccttgacgcaagctaccagatcgggttctacattgcagttcctggtatgcctacatccgaagctggtttccttgttcattcccacacaaagtatggtttcagagattcacagggcttttgcctctgtgatgaacgcagagtgtgtacggtggcctgtgctggtgctggccatcttggcgtccgtggtgggcagccaggccatcatcagcgggaccttctccatcatcaaccagagccagtctctgagctgcttccctagggtgaaagtcgtgcacacgtctgacaaagttcatggccagatatacatccctgaggtcaactggatcctcatgatcctctgcgttgctgtcactgttggtttccgtaacaccaagcacatggggaacgcgtctggtaatgatgtcctcttggcactgatcgatatgataataatgtccagagaactgatcaaaccctatgattcatgattctgaatcgctgcgcaggcttggccgtgatcacggtgatgctggtgaccacgtgcctcatgcccctggtgatcatgctgtgctgggaccgctccccctggctggcactcgccttcttcctcttcttcggctccatcgaggcgctctacttctcggcgtcgctgatcaagttcctggacggcgcgtgggtgcccatcctcctggccctcatcctgctcgccgtcatgttcgtgtggcaccacaccaccatcaggaagtacgagtacgacatgcacaacaaggtgaccctggagtggctgctggcgctgggcgacaagctgggcatggtgcgcgtcccgggcatcggcctcgtctacaccgacctcacctccggcgtgcccgccaacttctcccgcttcgtcaccaacctgccggcgttccaccgggtgctggtcttcgtctgcgtcaagtcagtgccggtgccgcacgtgctccccgccgagcgctacctcgtcggccgcgtcggcccgccgggacaccgctcctaccgctgcatcgtgcgctacggctaccgcgacgtgcaccaggacgtggactccttcgagacggagctcgtcgagagcctcgccacgttcatcaagctggacgcgctgttccgctgcagcgacgccgccggcgaccagcagcgggacagcagctactacgagcgcgagaacgcgctcacggtcatcgggagcaacccgctgcggcgccacctggccctgggctacgacgactcccactcccacgacgacggcgcgtcgtcagctggctctgaccgcgtggacggcatagagctcgccgcggcggcgccggcgccggcggtcgttaagaagcaggtgaggttcgcggtggctccgcccaggagccccggtgtggacgagaccgtgttggaggagctgcacgagctgtgcgaggcgcgcgaggccggcacggcgttcatcctgggccactcgcacgtgaagaccaagcccgggtcgtcgatactcaagaggctggccgtcggcgtcggctacaacttcttgcgacggaactgccgcggcccggacgtggtgctgcgcgtgccgccggcgtcgctgctcgaggtgggaatggtgtacgtgctgtgaccagaacgtggcggtgatgggtgactgcgatctctgcgtccggttttcgctgcgtgaactacggatctctctgctctgtgatgtgctattcctattatgcacatctcgacttgcccatgtataaattgtaacgagatgcgatggtaacagaggatgccctgacatttcccaaaaaaaaaaaaaaaaaggaatatacgcgaaaggaacccgctactgaatcaatcaatgcaaaattctgactacgtcttttaataaaaaaaacactgacacgtataagttcaaaaagagtaaaattaacatgtggtctttaaacttggcaaaggggggactgagctcagtggtaaaagctctatggtacaagctggccggtccaatttcctaccattcaggtgggaggctcctcctccgtgaaagtaggtaggcactaggcactagaatggagcagaataatgactccttgtccttttccgttaatttggaggaacatgcaaacgaacaccgtcgtcgatcagctggcactggaatccatgagcgggaacgtgctagctagtggtagcgccctgctccggttaatagctaggtagggaggattaaacaagagcaatcatggaggcaggagcgccatgattgtcactttgtattaattattatatatatagtgctgcatcgtaccgtacgtaggaccgccctgcgctgcgtgcacaggagaggggatactagtgcagattcttggaatgattcttttcttggtagggacagggtagggtagggtaggagaccagtttatttatttaattttattttgccgggctaatgtagttttggtgggtgatcatagtggcagcggcagagcagcttccttccgtggctccctcccagtggtttgggagatttggttttgctgctgctgcttgctttatctttgtttattttttagagtttgggagatttggttttgctgctgctgcttgctttatctttgtttattttttagttagtcctagctgctgctgctggtggttgcttcaggtgaaagcaatttctggctcctggcgtttttcgagatcgagatactgagaagattagtaggttgggtgcatctcttatccaccttgcatgcatacctgcag

SEQ ID NO: 2105 - DNA, 1263 bp, Zea mays
  misc_feature (1231)..(1231): n is a, c, g, or t
gtcatcggcgacggcgtcctcacgcccgccaggtccgtcttctccggcgtctcagggctcgagcccccccgccccccgggcccgccgccagatgccgtcatcccgataacctgcgccatcctggtgttcctgttcgcgctgcagcactacggcacccaccgcgtggggttcctcttcgcgcccatcatcctcgcctggctgctctgcatgagcgccatcggcctgtacaacatcgtccgctggaacccccagatctaccaggcactcaaccccgtctacatgatcaggttcctcaggaagaccaagaagtccggctggatgtcactgggaggaattctgctgtgcatgacagggtcagaagcaatgttcgcggatcttggcccccgcgcccgaaaaaaactgcagcttgctttcacttctctagtgtacccttcactgatcctgggttacatgggccaagctgcttatctgtcccagcaccataaccttgacgcaagctaccagatcgggttctacattgcagttcctgagtgtgtacggtggcctgtgctggtgctggccatcttggcgtccgtggtgggcagccaggccatcatcagcgggaccttctccatcatcaaccagagccagtctctgagctgcttccctagggtgaaagtcgtgcacacgtctgacaaagttcatggccagatatacatccctgaggtcaactggatcctcatgatcctctgcgttgctgtcactgttggtttccgtaacaccaagcacatggggaacgcgtctggcttggccgtgatcacggtgatgctggtgaccacgtgcctcatgcccctggtgatcatgctgtgctgggaccgctccccctggctggcactcgccttcttcctcttcttcggctccatcgaggcgctctacttctcggcgtcgctgatcaagttcctggacggcgcgtgggtgcccatcctcctggccctcatcctgctcgccgtcatgttcgtgtggcaccacaccaccatcaggaagtacgagtacgacatgcacaacaaggtgaccctggagtggctgctggcgctgggcgacaagctgggcatggtgcgcgtcccgggcatcggcctcgtctacaccgacctcacctccggcgtgcccgccaacttctcccgcttcgtcaccaacctgccggcgttccaccgggtgccggtcttcgtctgcgtcaagtcagtgccggtgccgnacgtgctccccgccgagcgctacctcgtcggg

SEQ ID NO: 2106 - DNA, 1078 bp, Zea mays
gggtacctcgaggccggccggagagagtccattctcacgggcagcagttctgccactctgcaagttcaacttgatccgcgcttctcgtgtcccctgccccttctgtcctcgccaccgcccagcttctcctcagtcctcaccctcgtgtgccttcggatccgcggttctcggagtcggagagagttgcaggtggtggctggtcgcttgcggtagccggtaggcgggttcgctgcgggtggtcggcggcgcgatggtttccttcgagatgaacgacctcaagaagattgggctgggcttgactggatttggagttctattcacattgctcgggatcattatgttgtttgacaagggattcctggcgatggggaatattctcttcgtttctggtgtcttactgaccattgggttgaagccaactgtgcagttcttcaccaagcctaagaatcacaagggttcaatatttttcgggtttggctttttcctggttctcattggatggcctgtctcaggaatgctggtggagtcgtatggcttcatcacgctcttcagcggcttctggccaacagctgctgtttacctgcaaaagagcccttccttcggttggatattccaccaccctcttgtgacttcgctgatcactcggttcagaggaagacgggtcccggtgtgagtggataggatcaccccgagggcatgcgaaatcgcctctactgtacagaagtaggccaattgacatatgcactttattcgtttatgttcgtcgattctacctggtttaaagagagacaaggtggccgctgttgctggtattggatcttcctacgctgctaccagtagtctgtccatagcgtaactacattgattgcaagtgagcatctgtcggttgttaataaataggcagatgtatcgatggtgataacatggtggtttctctgaatgacgatggctgagggagctgtgaactggtttggaaaccagccagcttgtgagagacagttgtgttacactgctactgctatattgttaactagttaaaaaaaaaaacaaagaaaaaaagaaaaaacaaaaaaaaaaa

SEQ ID NO: 2107 - DNA, 1003 bp, Zea mays
cgctgctttcagatatctcaccggaccgtcgtcgtcggcccctccgagaacataccaccgcgcccgccgccgcgcgcgccaccacgtccacgtacgccggccggccaccaagcaagcatggatacggtttcacagtccgagcacctgtgctacgtccgctgcacctactgcaacaccgtgctcgcggttggggttccatgcaagaggctcatggacacggtgactgtcaagtgcggccactgcaacaacctctcctacctcagtccacggccccccatggtgcagccgctctcgccgactgatcatcccttggggccattccagtgtcagggaccctgcagtgagtgcaggaggaaccaaccgctgccgctggcctcgccgacatcgactgacctcaccccgagaatgcccttcgttgtcaagcccccggagaagaaacatcgcctcccatctgcttacaatcgcttcatgagggaggagattcagcgcatcaaagctgcgaagccagatatccctcacagggaggccttcagcatggctgccaagaattgggcgaagtgtgacccgcgctgctcgacgactgcctctactgccacttctaacagcgctcctgagcctgctagagtcgtcgtgcccactcctcatgtaactgagccacgctttgatctggaggatagggccaaggagcatgtcattgagagcttcgacatcttcaagcagattgagcgcaacatctagatgtctccatttcgagtaccatcagctctatatataacctatgcatgcatatgcatccccatcttgtactttttacccccatgttactgttgctattattcttgctcttgttggattgtacgcaccctttaattgacagttgctaccctatataatgtttgccatcttatatattgtcgtcgttccttatatagggttatgatcgatataaaaaaaaaaaaaaaaaagctgtgaaaaaaaaaaaaaaaaaaaaaaaaaaaaaaaa

SEQ ID NO: 2108 - DNA, 1454 bp, Zea mays
ttgcatgcctgcagtggtggatcgatgtgaggcgcgtgattggatggacgcgccaatccaaccatgcactatgcatgcgcgccccgagatgttatgagcaggcgtacacttgcatgagcgagcgggagatggccgatcactgtgcaggggttaggccggccgtgtgtgcgtcttgcttgtctcgaatagatttatggtgcggtgcagctagccagctctccgcccgatcgctgcgtggttggtctcgtgcgtacggacccatgtgtgcggggggcccagacattattgcaggaatagaaaccctacccctatcttctctgccgccccaactctctctctctctctctctatctgtctgcccgtggcgtgctccactgattcttcttcttcttctacctcccggcctcctcccccttcttctttgcctgccttattagtatctcgcctcacaccacacagctagcagacagccagacacgcgctgctttctgatctctccccggatcggaggctcctcccaacataccaccctgccagccgcgccgccacgtccacgccggccggccaccaagcaagcatggatatggtttcgcagtccgagcacctgtgctacgtccgctgcacctactgcaacaccgtgctcgcggttggggttccatgcaagaggctgatggacacggtgactgtcaagtgcggccactgcaacaacctctcctacctcagtccacggccccccatggtgcagccgctctcgccgactgatcaccctttggggccattccagtgtcagggaccctgcaacgactgcaggaggaaccaaccgctgccgctggcttcgccgtcatcaactgagctaagcccgagaatgcccttcgtagtcaagcccccggagaagaaacaccgcctcccatctgcttataatcgcttcatgagggaggagattcagcgcatcaaagctgcgaagccagatatccctcacagggaggccttcagcatggctgccaagaattgggcaaagtgtgacccgcgctgctcgacggctgcctctaccgaaacttctaacagcgctcctgctgagcctagagttgtgcccactccccagttaactgagccacgctttgacctggaggatagggccaaggggcaagtcattgagagcttcgacatcttcaagcatattgagcgcagcatctagaggtcgttcgatgccgctgttgtagcccagtatcgatcgagtaccatcagctatatgtataacctatcccgtatcgccgtcgtcgcctcgcaatcatgcatccccatcctgtacttttacccccgtacgtgttactgttgctgttattctcgttatggttggattgtacgcaccatttaattatgaacagctgctacctatatatataatatttgccttcttttttgttcctaaaaaaaaaaaaaaaaactcgagagta

SEQ ID NO: 2109 - DNA, 1694 bp, Zea mays
ggcgcccccgcgcgtcattgagactcctgcgcgccgccgaatattattattctcatccgccgcggccgcggccgcggccagggccagttccgtccgacgcgtcgcaacaacccccagggctcaattgacgcgcgggggcgtttcggtcatccagtcatccccctcccctgccaaaggcgaagagcagaagcagaagcagcagcagcaggcgaagaggcagtggtagacatgccaaggtcatcagccggggcgtcatgcacagcagttgaccattctgagcagagcagaaaggatgatgaatatgagaggctggttacaagagctcaacatgcaacatctgatgttggcacgacaattttatctgagcaaccaaagtcaagatctttcatttggtggatgaaagttctgcttggctgcttccttcttatattagtgggctatgtcttcgtgaaatggggggtcccctttgtctttgagaaggttctcttgccaatcatgcaatgggaagccagtgcttttgggcgtccagtattagctattgttctcgttgcatctttggctctctttccagttattctagttccttctggaccttctatgtggttagcaggaatgatctttggatatggttggggtttcttgattataatggccgggagtactattggcatggtggttccatattggattggttcattgttccgtgaacgtctgcatgtatggctgacaaagtggcctcagcagatagcactaataaaactcgcgggtgaaggaaattggttccagcagtttcgggttgtcgcgcttttcagaatctcaccattcccatatacaatttttaattatgccgtgactgtgacagaaattaagttcaacccttatctatgtggttctgttgctggaatggtacctgaggccttcatttatatctacagtgggcgtttaatacgtacattggctgacatgaagtacggcaactataaaatgacaccagtggaaatagcatacaacgccatttccttcgtcatcgctatcgccctcacggtcgccttcacggtgtacgcgaagagagctctgggtgacataaaaagtccggacgatggcatcggtaaagacgaagaagatcacggcccaaatggctcaggggtgcgtatgaatcgtcgtcaggagcgtgccgacgcacgttacatagaactagatgatatgtgatggtgtgttggcccggatcttgcttggaaggaggcaccagtaggtcattaggtgcacggctacggtaggtagctagctatagtttacaagaggaggctaaaataatccacacccagctgacgtggtttgcgtgattcgtttcgtgtgctttgcctactgcactgccatactgtctgaatctgaaggtgcagggctactcactactgagttactgaccgagcgatgctgctctcaacgatgtttctgtgaccatcagcgtatcaatcagtccttgatctgaagcctacactggagcttcatgttgaagcatacattggacttgagtagtacatttgtatataacgtaactgctaatagagttagcatatgatctagttttgaacatgaagctcgtgggctgttcagccatgttcggtcccatcctgtctctgtctcaaattatatgttattatgggtttagaaaaaaaaaaaaaaaaaaaaaaaaa

SEQ ID NO: 2110 - DNA, 2946 bp, Zea mays
cgggccgaaaacggaggctcgggcacgaactcaaaaataagctaagtccaagcgtgtggaaagacaccgaacctaaagggcatgtcttggggtgaagggcatggcggaacggagggaaaacggcacggaggcgcaaggcgacgggcggcatggctgttcggccttgcgtctgggctgaaaacgaggggttcgccatggcgcgcgggccgaaaacaacggttcggccacggccgcgaaaacgggctaagtcccagcgtgtggaaagacaccgaacctagagcgcatgtcttgagtgaaggtaaaggtggaacggagggaaaacgggaggaggcgcgcggcgacgggcggcagggctgttcggccttgcgtatgggctgaaaacgaggagttcgccatggcgcgcgggccgaaaaaaacggttcggccacggccgcgaaaacgggctaagtccaagcgcgtggaaagacaccgaggctgctacgtaggtctcggttgaagggcacggtggaacggagggaaaacgggaggagacgcaaggcaacgggcggcagggctgttcggccttgcgtttcgggtgaaaacgaggggttcgccatggcgaacgggccaaaaacggattttcggccacggccgcgaaaacgggcacgtggaagggcacgggaccctcccgtggtccccccgcgtgagacgtggaagttcgggtgcacccgtgagggaaaacgggtcacgctagcgaaacccctgattctgagcaaaaacgctgtgtccagccatcttagatgggtttcgtggggtactgggaaaatgccctggttttctgaaggcagaactccccgaagtcctgggagggggtatgcccctcaggtatagtagggggtagggaactcgtgcagccgaaacccgggcgaaacgctgctgaaaccatagcgtttccagcgtctcctccaggtctcctcggccgagccccgcaccccctcgcggcctagccgtggccggtcggcaccctaccgcgcccagctccggctggcgctgttggctgcctggccggccgtggttcggccgtgacgcagccacgaccggctatggctggctaccgccggccagacgccctggacgagtggctgcaccgtgggatggcccgttgctcgatgcgttttccgtttctcccgcgctcggtggaccttcggtcgccgtcctcgcaagcagacccgccgcgcccagcgcggagggatgctttggatggctcgaccgtagcggctacgctggcgcatgagttgtcttggacccgtgactgcttggaggacccccgctgccgtgcggccgactcccggcgcccgtgtcccatcgctcgtgcgggcatcccgtgcctgctgcgttgagaagtgcttgcgtgctgctacccgtcccacgggaagccgtgctcgatacacgttgccttcgtcgagctcaccccccggggtgcggctcgtcggctcgagagcgcccgcggcgtttgcctcgtgccgccgtcggcctatggccggcggcaccgaggacacctcgctggcgcttttggtctcggatgtggctcacgctgaaggccggagacgcgttggcgtcacgcgcccaagaatcggtccgcccgaacgaacgacggccagcccggcacgacgcctccgcgcggaggccggcgctggcccgtctgcgaggacgtgctacctggttgatcctgccagtagtcatatgcttgtctcaaagattaagccatgcatgtgcaagtatgaactaattcgaactgtgaaactgcgaatggctcattaaatcagttatagtttgtttgatggtacgtgctactcggataaccgtagtaattctagagctaatacgtgcaacaaaccccgacttccgggaggggcgcatttattagataaaaggctgacgcgggctctgcccgccgatccgatgattcatgataacttgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcgttagtgtctggtaattggaatgagtacaatctaaatcccttaacgaggatccattggagggcaagtctggtgccagcagccgcggtaattccagctccaatagcgtatatttaagttgttgcagttaaaaagctcgtagttggaccttgggccgggccggccggtccgcctcacggcgagaaccgaccggctcgacccttctgccggcgatgcgctcctggccttaactggccgggtcgtgcctccggcgccgttactttgaagaaattagagtgctcaaagcaagccatcgctctggatacattagcatgggataacatcataggattccggtcctattgtgttggccttcgggatcggagtaatgattaatagggacagtcgggggcattcgtatttcatagtcagaggtgaaattcttggatttatgaaagacgaacaactgcgaaagcatttgccaaggatgttttcattaatcaagaacgaaagttgggggctcgaagacgatcagataccgtcctagtctcaaccataaacgatgccgaccagggatcagcgggtgttactaataggaccccgctggcaccttatgagaaatcaaagtctttgggttccggggggagtatggtcgcaaggctgaaacttaaaggaattgacggaagggcaccaccaggcgtggagcctgcggcttaatttgactcaacacggggaaacttaccaggtccagacatagcaaggattgacagactgagagc

SEQ ID NO: 2111 - DNA, 867 bp, Zea mays
  misc_feature (699)..(699): n is a, c, g, or t
tgcaccatcgcaattcacaagcaaagcaatcagagccaagcacccaccgtcctcctttctttccttcgactcatcaaagcatgtcttgctgcggcggcaactgcgcgtgcacctccggctgcaactgcggcagcggatgcggcggctgcaagatgttccctgacgtggagaccgccggcgtcgccagcgtgaagcccacggtcctcgccgcccccgccaccaaggcgagcgccggcgggttcgaggcggccgccgagggcggcggctgcgactgcaacacctgcaactgcggcaccagctgcggctgctcctgctgcagctgcaactgagccacccgcgatgacgagacaaccacccggcctcccccccacccatcgtactacaactatgtagcggcgtctaaataagatccctccaccggccaccgccattgttccttcctgtcgctgcatggttgcctgcctcgtgcccgggctaatatacatatactatctatgtgtttcagcattaaaaaaaaaaaaaaaaaactcgacggcggggaggacccccgctgccgtgcggccgactcccggcgcccgtgtcccatcgctcgtgcgggcatcccgtgcctgctgcgttgagaagtgcttgcgtgctgctacccgtcccacgggaagccgtgctcgatacacgttgccttcgtcgagctcaccccccggngtgcggctcgtcggctcgagagcgcccgcggcgtttgcctcgtgcccgccgtcagcctatggccggcggcaccgaggacacctcgctggcgctttttggtctcgatgtggctcacgctgaaagccggagacgcgtttggcgtcacgcgcccaagaatcggtccgcccg

SEQ ID NO: 2112 - DNA, 1596 bp, Zea mays
gcacgagaccattacctagaacatcctaatcgaaaaacagtgcccccaccaaaccacccctgtgcgattcgccgccatcattgtgagcaagctcgagcgcgtctgccgccaccgcttccgttgcttagctctgttctcccgccaagaaggcgaaggggagacggttggttgagttgagttgagccagccagccagccagtggcggggcgtctgctctcggttgctttgctatggggatctgcgcgtcgtccaagcgcgtggagcaggaggaggacgagaacgtggtgtacgtggtggtggacgggcagggcggcggctgtggagggggatggggaggggacggccgtggcgcggcgtgggagcggacggtggccgcctccctcttctcgcagaagggcaagaaggggcccaaccaggacgccgtcatcctctgccagggattcggcatggaggacggtgtgttctgcggcgtgttcgacgggcacggccgctgcgggcagctggtcagcaagctggcgagggaccacctccccttcatgatcctgagccagcggaacgcgctgctcctgggctccgacgacgacggcgacggcccggccttcagcgacgcatcgcccgcggcgtcgtcgtccacggacggcagccgcagcgagcggtcgtcgccggcgccggcgcagatgctggaggagtggcgggaggcctgcgccaacgcgttcgaggccatggacagggagctcggggtccaggctaaggtggactgcgacttcagcggcaccacggccgtgtgcgccatcaagcagggggaggacctcgtcgtcgccaacctcggcgactccagggccgtgctggcgaccgtgtcggagacgggctacctgaaggccgtgcagctcaccaccgaccagaagcccagcgtgcctcaggaggctgagcgcatcaagcgctgcaacgggcgcgtgttcgcgctcaaggacgaggcgtcggtgcctcgcgtgtggctgcccgacgaggactgcccgggcctggccatggcgcggtcgctgggcgaccaccgcctcaagcggcacggcgtggtgtcggagccggaggtggcgcaccgccgcgtcgcgccgggggacctgttcctcgtcctggccacggacggggtgtgggacgtgctcagcaatgaggaggtggtgtccatcgtctgcgccacgccaaggaagcagcacgcctccaaggccgtcgcccaggccgcggcgcagcgctggcggaccaggtacccggcgtcccgcgtcgacgactgctccgccgcctgcctcttcctacgggaccaggactgggccaccagcgtcgccgccgcgcccaaggcgaaggcggccgctagccgctagtgctagtgctagtgccagccggggcagacggcggacgaagcttgatccggcgacaagcccgccggcgtagccctcgtcgcactctgccgttaagctcttgctttactgctgtggcgcaacggcggatgttagtgtaccgggagtgtaattaagtgctgtaacatagtgttaattaagaagatctggtgttttttttttgcaacaaggagatgaggagagaaaaaaa

SEQ ID NO: 2113 - DNA, 1284 bp, Zea mays
  misc_feature (1019)..(1019): n is a, c, g, or t
  misc_feature (1238)..(1238): n is a, c, g, or t
cctcgaggccggccggggcgtaccggccccctttcacccaaccgcccacccctcgtttcctgcaattcgccgccatcgttcgctgagcttgagcgcgtctgctgcctgccaccaccgctctctgctgctctgttcgttctcccgccgggcagaggagggcgagggggcccgttgagcgagcctccgtcggtatggggatctgcgcctcgtccaaacgcgtgcggcaggaggagcaggactccccccgcgtccgcccgcgcgtccgggacgagcagggcggcgggggagaaggcgaggacggccgtggcgcccgcgcggcggcatcccgcgcgggtggcctccctcttctcgcagaagggcaagaaggggcccaaccaggacgccgtcatactctgccagggattcggcatggaggacggcgtgttctgcggggtgttcgacgggcacgggcggtgcgggcagttcatcagcaagctggtgagggactacctcccgttcatgatcctgagccaccggaacgcgctcctcatgggctccgacgacgacgacgacgacccggccttcagcgacgcgtcggcgtccgcgtcgtccacggacggcagcgggcagtcgtcgccggcgccggcgcagctgctggaggagtggcgggaggcctgcgccaacgcgttcgaggccatggacaaggagctcaagctccaggccaacgtggactccaacttcagcggcaccaccgccgtgtgcgccatcaagcaggggaaggacctcatcgtcgccaacctcggcgactccagggccgtgctggcgaccatgtcggacacgggctacctcaaggccgtgcagctcaccaccgaccacaagcccaacgtgcccccaggaggctggagcgtatcaagcgctgcaacggccgcgtgttcgcgcgctacactgatgtatccaacgagtatatagccttggcctcgccatggcgcgctctctgggcgactaccgcctcaagcgccacggcgtggtgtcggagccgnaggtgacgcaccgccgcgtcgcgccgggggacctgttcatcatcctggccacggacggcgtgtgggacgtgctcagcaacgaggaggtcgtgtccatcgtctgcgccacgccgcggaagcagcacgcgtccaaggccgtcgccgaggccgcggcgcagcgctggcggaccaggtacccgacgtcccgcgtcgacgactgctccgccgtctgcctcttcntgcgggaccaggactgggccagcagcgtcgccgcggccagggccaa

SEQ ID NO: 2114 - DNA, 1134 bp, Zea mays
actttaaaactgccacccaacgcgctcctccgccgccgtctccagcacacgcttccccttccctcccgctcccattcacgtcgtctctttcctcgagcctccgcttcgccagcgacgcgcccttctcacccacctcgccgaggaagtattcaccgatggagacgccgctgtcttccaggaggatcacccgctcgctcgccgccgcatctgcccagaagagcgccgccgccgggccggactccgccgccctcttctcccgcgccaagaacgccgccgctggggagacccagcctcgcgccgccctgcacgacatcaccaacgactcccccatcgtcgggctcgcggcgggcgccctccacgccaccgataccacccccgcctccaccgccgccaagacccgccgcagggccccgcgtcgcacgcccggctccggggaggcgctcctgcgcggccaggtcaaggcgctcctccacaaggtcgaagaggagcagggctgcgccgccgcggccctcgtcaggcccgcgcgcatccaggcgctgctcggtgtatccaggtcgccggcccagcttcttgcgccgacgccagccaacacgccgcagatcgagcccgtccccactcccagggaaggcctcctcctgcttgatggcgctacggtcatgccctgcgtcctagacgaagaggaactgctgattcctaagcttcaggtcattgcagcttccctacatccacctcatcaggcagaggagaagctcggggactgccagctgaaccgtgcgctggtgttcgatgactcccctgagaaatgtgaagagtccagtggatcatccgtctcgtcaaccttctccctccaggagagcagcaccggcagctacgtggacaagtcatcatcacctgaggacgacagctcctctgcctggtccattcaggtccatgccacctctgagaagggcgacgaagaagagctgggcgtggaggagctggcagcagagtacactgacgaagaggaggaggaggaggactgggacgaagacagcgatgacgactgctacgatgatctgtgcgaggagatgagcaggatgaccgtgttggaggaggaggagaagaagaagaccgtgctgccgcagttcgagggga

SEQ ID NO: 2115 - DNA, 3265 bp, Zea mays
cccttgaagatgtcgagcaaacccatcccattttaactgatgaaactagtcctatatggtcaagtgaggagcaagtagacggttcttgtcctgcatcggaaagccgggagcaacctgttcctttcaaggtggttatactcggaccatggcatgatgtgccaaatagcatcctaagatcaaggcctccttcaaactactcacagtccatgcaaggatcagatctatatgttggaaatgtggatgtattggatctttctaaggagcagttggactcgaggttaaaacctgaagaacaaggagcggaggatggcttatttgcctcagtggaatatgttgagcaaacacatcccaattttactgaggagaaagtagatggttctattcctacaccagcaagttcggagcaacctgatcagttggaggtggttagaccatgggatgatgcgccgaatagtaccctaaggtcaaagcctccatcaaactactcacagccaatgcaaggatcagatctagatgttaggaatatggatgccttggatccatctaaggagtggttggactcaaggttattgtcaaatacggtagagccatcaagttcctcaaatggaggaggcacatctgttgagaaagacaacattgaaaaaacagaacgcttgtcaggcattgacaccgtcacccctggactggataatgtccagggatcaaatccctcagcagagccatcaagttcctcaactggagaaggaaactcagctgttgaaaaacacagtgctgaaatgacagaatgcttgttaggcatgggaattttgaaccctgcactgcataatgtccaggtattgagtccctcgacaccaaaagaatgcttggtttctagcgcagacaagtcagatgtagcaaataggtcagatgaaattaatcacagtctccatgattttaaccaaagtaatcccaagccagtgctgaagggaagagtctccaaaatgatgtgcccaagacttgcgtttcaactgccaaaagtgttgcctgtatgcgaacatcacaaaagggagatgtcattgccttccaagcatgttagtccacggaaagcaacaaaaagtagctttagaaagcaatatgaaggaccaaacagacatgtttcacgtcatactgaacatcagaaaaccaaactcgttatgaaggacagaaatacaggtcctgctcatatgagaagttgtaggccaacaaagcaaattgattgtacttgctcaagtgcttccttggattcatctacaaagactaaggaagtaaatgatgcagaaccaagatgttctaaatctgtaaaaacttttgagaatgtcatggccaagaaaagaaaacgacctattctatcatatgatgaagatgccaaggccatgcagatggaagtgaggatgcgcaggagacacagggaaagtggtgtgatgaagctgcgaagatccacagaaaattctgatgaagcgatgtgtccaggaaattcaaataatcaacttaccaatgatcatacgaaggcaaggaagcagagaagggccaacaaagacaataaaacaccaccagtgaacgctagtgttccatgcacacagattgatgctgcacgattagcatcagatcagcaaagctttatttgcacgcgacccattgatagaccttactggactggaatcatgaagattggccaggaatatatttcattggttgcacacctgtcaaatcaagcatgcaagaaggtgcaggaattatcgatgtcattaccaccactaatgaaagtaacaaagcattcaaagttgaaagcctggccagggaggtggaaggcatcggaacctactgctgaatgcgttggcttgtatttcttctcagataatatgaggtgtgtgccctaccgtcctacctatggacgattgcttagtttgtcttttctggtacatggtttaaaatgtacttgttgcttttgtagggaactggatcaacttgtgcattatctcaatgatcatagcttagtcctaaaatatgtcgttggctttgccaagctgctgatctccccgtctgttttcctaccagagcaatgccaaagtaagtaccatattgctgatttcacaatgtaatttgcaaatgtcatggatacgatatgagctaagccactgagccaagcaaaaaggtcctgtgttgaatgcagtcacattgcaaaatacaggggtaagacttgcctcggttattcgttagacaccacatgaaccacttatgtcagagccgccaacactggttctgtccatggatatgatgacagtgttcctgttttaaatttgcgaccatgaactttgatgccactgtgccttggtgcaattttgcattatattgcttctactgtccattaggcgcacacttaaaaagttctttgccgttgaattcttggtagttttatagttctggcagctttactttgttctatggctaatattttcagcttacttatcaaaccctgtcttttgtagcgttccaagggaaacgctatctgtggggagtgttcaagcgcaggatgaatacggggagaatacatcatgtgaatgcaaagtgacacccctagtccaataaatccatgttgtgaagggtatcgctagctcaaagagacaacagttcgccaagcactgttgatgcctttttgagctgagaccgacccctgtgatcataagcagccccgcgagaactctccccctacccaggctatcgggccttgtcattgtgcggacgtctgaggtcggagcacttcatttgtttgggagctggaaaaatgaaggtgcactggttggtttctctgaacttgtgaaagggttagcgaaggaccgtactgtaatgttcatggcctggaggaatgatgcagcaagtaggatcagaaatcagaactagccagcgacaatcacgctccagcttctgaaacgttgctgtagccttttgttgatgttcaggactgggagctagattgtcacgatttgacactgaggacgttactgtgcctgcaagcctaacctaagatgtatcaagcatcaagtgctgctgctgctgctatggaaggtcttagccaaaattaaattatgtttctaagctctgcatgcatcttaacctgcgctaataggttttcttgatggcctcaatgggagcagcaggaacctactactttttatgcgcataaactggcacttcgcatgatgtacttgttcataagttggtcaaaaagtcggttccgtggggtaaatcc

SEQ ID NO: 2116 - DNA, 4849 bp, Zea mays
ctctcctttcatccatgacttggtgagtgagtgtgacttccatatttaaactagttccactccactaggactagcaatatggtgctattggttccaccattctctagacatacacttatatgagcttttgagattttcctgatatttatttgaatttctcaattaggcttagcccataaatcctaacatattggtgtgttacaaattacagttctgtatggtatgcaatatatgtttatcttcctgttcttggttgtgtgatgatcttggattcttgggcaacgaaacagagaagtcgatttagctaggactagcacgatataaagtaatttgagcagtaacttcaacttatattgaaaacatttgcaaattgcaattcaagttccaaggcatcctatccttcctcaacacgccccaaggcaagctagtcccttgcaacctctcaacccataatacctaaacatagcaacctctctctctccaccctgattgcgcgggaacaacgacgctggaatgttaggcgcatctcgtagcaccaccaacagcacggcgtcgagatgagcggtggtggcgacggcggcgacaaggaggccttcttccactgcctggaccgcgtgccttccggcctgcacctcgacgccgatttcccttccgatgacgaagaagacgacgaggatgacgtccgcgtctccttcacctctgccgccggcgaccagcatttcaagagcttccggtaccaggcggccgtgccggtggaggatgacgaggatgacgacgacgatgacgacgacgacgaggacacgtccaagtacgacatgtggatgtccgacgagcccatgtccatccaggagcgccgccgccgcctgcaccaggggctcgggatggccagcagccgggacctcgcgctgcgccggcacagcatgaagaaacgccccgccgatgtcccgcgggccatgtcccggagcgtgtcgaggtcaaagccaccgccgtcgccgatcccagccaatgcggcctcggccgccaacgtgccgagcactacctctgtggcgcaggcggcggctgccgcgccgcggccggcgaaggaggtcatcacgaggcggcgctcggacagcaaccttgtcgtgcgcgacggtgcgtcggtctcggggaagccaccgtcgcagcagcccttgcgacgcgttctgtccttgccggctcggcctgacgcccgcgacagcacgcccgtcgtcgggaaacctcaagccggggctccgcgtgggttgcctgtcgtgccgccgcaggcagcgccagggattaaaggcggcaaaggcgatggcgacgaggggagcaagaacaatcgggacggcgagaaggaggtcgccgtcgtggccgccagcacgcccaaggacgcttcgtcgagcacccagcagcagacgggcgtgctggggcttgaggagttcgagaagttcatcggcaacacccccatcatgaagctcatgcggcgtggcacgagccagaaccagcccgcgccgctgcccgccggcgtgccgcccaaggccgacaagtcgggcggcaagaagaagggcggctggctcaagaacatcaagtcggtggccatagggttcatgcaggacaaggacgccaacgccaagtcgggcgtcgtgtccgcggcggcggccgtgcccaagtccgtcccaaccaatgcctccgccgggtctgctgcgccgccggccgcgggttccgagcggcccaaggtgcaccagtatggcaagtcgagcaaggagctcaccggactctacatgtgtcaggtactaccgggcaccggccagcctgctggcctggcctagagcacgcgcgcggctctcgctggctggctgcacaggtacgctacgcactacatgagggtgagacggaaacctatggtgaatgaaacaggagatccaggcgcacgaggggtccatctggagcatcaagttcagcgcggacgggcggcggctggccagcgccggcgaggacagcgtggtgcgcgtgtggcaggtggtggagaccagcgccccgccgtgctcgctggcgatggatggcaagtcaggcccgctggccccgctgccgtcccccggcgcggccgacggggcgtcttcaacgacgacgccggcgctggcctccatgcccaagaagccggccaaggggaagagcggcggcagggacgcgctccccgagcacctcgtcgtcccggacaaggtgttcgcgctggctgagcagccggcgtgcgtcctcgagggccaccaggacgacgtgctcgacctcacctggtccaagtccgaccaggtcgaccttttgtgcccgtagccattgctttgctttgcacacccgtccctgatacagctccaagcacagcgacagcacgacggagcctctgatgagcgcttgttctcgcagcagctgctgtcgtcgtcgatggacaagacggtgcggctgtgggacacggagagccaggcgtgcctcaagacgttcgcgcacagcgactacggtgagcaaagcgagcgactgctgatagatgggcggctgcttgcttctgccaaccagctggttctgacatgccgccacgcccgatccttgtgcagtgacttgcatccagttcaacccggtggacgaccggtacttcatcagcgggtcgctggacgccaaggtgcggctgtggagcatccccgaccggcaggtcgtcgattggacggacctcaacgagatggtcaccgcggcctcctacacccctgacggccaggtctggcccatcaccacacacactgtctcatcctcaccattgtattcatctctgaacaaaatcttttgaagggggcgatcatcggctcgcacaaagggagctgccggctgtacaagacagcaggtactccttgcattgtcgccatattcagtagatgctagcaatgctgtttgctttcaccatctgtggtgcttgattattgtttcaccattggaatagactgcaagcttagcgcagaggcgcagatcgatatccaacccaagaagcgcaaggcgcaagcgaagaagatcaccggatttcaggtacacaaacacaaagcaacaagcatttcagctacatggcttgtttatgtatgatcttgccatggtcctgggcgcagtttgctccggggaaccctgccgaagtgctggtcacatctgccgactcgcagatccgtgtcttcgacggcgtcaccatggtccaaaagttcagaggtacggcagacacagattaaaagatcttggtgcgtgcaagtgtgactgcacgaccatctcatcgattcccacgcgtccgcctctctgttttccaaaggtttcaagaacacgagcagccagatcacggcggcctacacctcggacgggcggtacgccgtgtgcgcgagcgaggactcgcacgtctacctgtggcggaccacccgggtgccgcctgccgcggccatcggcatcggcatgaagcccaaggcgtggtgcaccatccgctcctacgagaacttctactgcaaggacgtgtccgccgcggtcccctggacgcagtcgccgtccccgccgggcgccggcgacggcagccccactggcggcagcccggcgtcggcggacaagccgccgcaggtcgcgtcatgcaacgacgagtcctgcagcgtcgccgccaagccggagggcggcgatccgagcagctgcagcgccgccgctgccgagcccagcagctccgcgcggcagggtggcgccaagggcgacggcggcaacgcgtggggcctggtggtggtcacggcgagcttgggcggggagatcagggtgtaccagaactttgggatgccgttcaggatcaaaggccaggccaattttttctagtgattttgggcactcccgagactgcaattcgtttggctgttcctgttggtgacttctcttctcctaactatatcattttgtgtatgtgatgtgcaatgaaaatagtcaagggtgccatgatttggcgtgttttagctgctgagaagggatttttacttgtaccaaaattagtcaaagaaagaactttttaatatataacatgataatgcaagaaataagaggtttatatatagactagtataatggatagttcgttataccggcatataaattattcgataaaatattagagcacaacgattacatgaacgaacaatatatattattattggcttcaatatttcataaatttttttatcaacaatcaatacaaaactaaactgaggtggcgacgagggaggagaggggtgacggttacgtggccagaggggaggagggaggtgaagcgtgtgggatgctcgagccgattgtgtccgcatattacatggagagcgggagtaaacccgcgcctacgtaaaacacgcgtgatgcacgacgacagtgaaaactgatgctttatagtagtagagaattacgctaaaacaaactaaaaagaaaaatataaattaatcagacatccaaagatatctaagaacaagataaaaatggaagaatatgcaatttattaattccagcacggcaagaaacaaaaaataataatcgctacaaacatccaatgtgtttggtttatctttctaaaccatattcgatgccaagaatatagaatctcaatcaaacggatacaacaacataatagatttctaaaaaaactacaaattcatatggttcaattcagaatcatcttctaccctagatttttcagattcttgtcattcatgttacctagctatcatgcttttatagaatctataattgacagttgttttgaccaaaatatattttagtttttcccaccaagcgtcaactcatattagctttgcatctc

SEQ ID NO: 2117 - DNA, 1514 bp, Zea mays
gacccacgagtccacccacgcgtccgcccacgcgtccgcccacgcgtccggtcttcgggcgccgccccccccccccgcccacgcgtccgagtatctctctctcccgcgcgcgcgggtgagccggggaccctcctacgtctcgccaccctgctggtatagcccgccggtcgtccacgccatggccacccaatatgcgcggctctccctgccatgccgcctgccctcgccgctccctccgccggtgccgacgacgacccgccggctgccgcgcgccgcggcggcggcggcgtccacctccccgcggtgcccacgcgtcgggggcgcggcggccacgcgcgcccgcggcccgtgccggcctcgcgcctccgagggcgaagtgcagcagcaggaggcggaagcggaccaggtggtggacagcaacatgctgccctactgcagcatcaaccgcaaggagaagaagagcatcggggagatggagcaggagttcctccaggcgatgcaggccttctactacgaaggcaaggcgatcatgtcgaacgaggagttcgacaacctcaaggaggagctcatgtgggaagggagcagcgtcgtgatgctaagcccagatgagcagaagcttttggaagccgccatggcgtatgtctcgggcaaccccatcatgacggatgatgaattcgatcaactaaagctgagactaaagaaagaaggaagcgacattgtacaggaaggtccaagatgcagcctacggagtcgaaaggtctacagtgacttgactgttgactacttgaagatgttgctcctaaatgttcccgcagctgttgtagctctggcactattcttctttttggatgatttcacgggatttgaaatcacatatcttcttgagttgccggagcctttcagtttcatcttcacatggttcgccgcactgcctttaatattttgggtagcgcaggcgatcactaatgtcatagtgaaggacttcctgatcttgaagggtccgtgtccaaactgcgggaatgaaaacctctccttcttcggtaccatactgtcagtgcctagcggtggctcaaaaaacagcgtgaaatgtgcaagttgtggcactgagttggagtacgactcttcaacccgattgatcacactcccagaaccggctgaggctaaataagtgatggcgtggtttcgatttcgctagcaggaaagacggcccggccggcccgcagattcttgatcgacgacagtacgaagcaagactgttcttggatcgggtggcaatcgtggagtgatgtatgtttgctgtgctagtctgtgtgtatatatatttgaacaagtttagacacctgtattatatagatctaatgaaatgggtatatgtatgtgcatagagtgtacaaagaaaaatttaataagccgagttattgtgtaaaaaaaatcgaaacctagacattgctgttacctagtcggctactacaaacaatgagggataaacaagcaaataaacaacgatttctcga

SEQ ID NO: 2118 - DNA, 2205 bp, Zea mays
atccggggccactaaacgcagatttcctcggttccttgtacgttcagggccggacgacggggacagacagcggtgtcgcgggggcacctgcttcccaacgccgtccgcacctgctgccctgtcgtccgccctccttcccttctcctcccctccaactgtttcctcaacctcccgacccaaccacggccgtgcccgccaaggcgccaaccgcacagcagcagctggggtgctgacgtgctgtgggtggttctgttgtccatggcgcggaagcatcagcatgttgccatatttaccacagcgtgcttgccgtggatgactgggactgcggtaaacccactgtttcgggctgcataccttgccaaggctggagattgggaggtcacgctggtggtgccttggctgtccaagggggatcaggagctcgtttatccaaacaagatgaggttcagtttgccggcagagcaggaaaactatgtgcggcggtggcttgaggaacggactgggctgttgccgaagtttgacataaagttctatcctgggaagttttcaactgagaaaagaagtattctacctgttggagacatcagtcagacaatatctgatgataaagcggatattgcagtgctagaagagccagaacatcttacttggtaccaccatggacggaggtggaaaagcaagttccaaaaagttataggtgttgttcatacaaactatttggaatacgtgaaaagagagaaaaatggatacattagtgcgtttatcttaaaacacattaattcttgggttacagacatctattgtcataaggttataagattgtctgcagcaactcaggatgttccaaggtctgtgatttgtaatgttcatggagttaaccccaaatttattgagattggcaaattgaaacatcagcagctatgccaaagagagcaagcattcttcaagggtgcatattatatcggaaagatggtatggagtaaaggttacacagagcttcttcagcttcttcataagcaccaaatggaattgtctggccttaaaatggagttgtatggcagtggggaagatgctgatgaagtaaaggcatcagctgagcgactgagcttagatattagagtctatccaggccgtgatcatggagattcaatattccacgactacaaggtcttcataaacccaagtacaactgatgtggtatgcacaacaactgcagaagctttggcaatggggaagattgtgatctgtgcaaaccatccttcaaatgtttttttcaaaagatttcctaattgtcacatgtacaatactgatgaagagtttgtgagactaacaatgaaagctttggcagaagaacctatcccactgtcagatgatttgcggcatgaactttcctgggaggcagcaacagaaagatttattagggttgctgatattgcaccaactgtgcctgtgggacaaccaccaccctcctcgcagcatttcatgcgcatctccccagatgaactgcagaagaacatggaagaggcatctgcatttttccataatacaatctctgggtttgaagctgtgcgttgtgtgttcggtgcaataccaaacacactgcagccggatgaacagcaatgcaaggaacttgggtggaatttgcagggatagcattagcttttcttgcgatgctgttgccatggaccatagaatgaaccagtctaactcaacggcaaaaagctttgtcggaaaggttctcagattgatcaaacatacattctatgtggtgttctggtgtggggcactgcattttttcttcatatatcagaggcgttctgaagttcctggatgcatcgtatcttctgattgttaatcttaagcagtctgaagtgcacactagtattacagtctcatatatgtggactgtttttcatcatgttgtttcccaggattgacgcgtgtgttgaaaatcttattgtataataagatgccccttgttttcgcagccaaaaaaaaaaaaaaaattgctacaccgcctaaaatctgtatgctagttgatactacctgtgttctcgataaataaaaaagaatagaaagggctagtttggaaacccaattttctcaggggttttcattttcccaaaggaaattaattcattttttttttgggaaattgaaatcccataaaaaaatgggggtaccatactagccccaaaagttaaa

SEQ ID NO: 2119 - DNA, 1635 bp, Zea mays
gagaaagatgttattgctatcactagaacagttgttgcaaaatgtccctagtggctcactggatattacaacatcagtaaagtggtagcattagtagcagtgtagagcgagacgcggcatatgcgtagaattctttttttcatccaaaccgaccgggcgtgcggggagggtgaggccatcctgtgtcatatactctcatgtctgcgcaaggccaagggaatcgtagtatatacggacctaccgcgcgcgacatgtctaagtcgtgatccaactttgcgttctgtgtctggatcgtgatgggaaatatattcaatttattgatacgttacaagaaaaatacaaagaacagtctagaagtttctgttctctcagacacacatcaataaaacacgcaggtgaataaaatacaaggaaaaggatcacatgaatcttctaaaatctgatatataaccaacaatagaaaagaatacattttttttttttttttgaatcttctaaaatctgatatataaccaacaatagaaaagaatacaaggaaaaggatcacaagaatcttctaaaatctgatatataaccaacaatagaaaagaatacaaggaaaaggatcacaagaatcttctaaaatctgatatataaccaacaatagaaaagatacaaggaaaatgatcacatgaatcatacaatttccaattgttgtctgcatgcttatactagtacatattacagccgccactgcctgcaggggattcaaactgtcgcccgccaggacacacaacaaccagcagccagggactccacgccttcaggtgatccttattcaagcacaccttcgccaaccccatccaacagtcagctttagacggtttgcactacaacagaaaataggagacaaccatcaggtaatccttattcttaatcaaaatgatgtaactagtttagacaagtgatccatgcacggttgcaccatgattcctgagagtttccgccatttcaggttctagccaaataaaattcagttttatggctgttgtaccatgcatatatgattaggtagtcaaaccatctctgaatctgggcacaaagatatctttatttttcattttctgcaaggcgaatgagcacatctatctcaatcattgcaagcaaaccgatgaagaataggggggacacatctcacatcaccgctcggatggaacgcactttgccaggtgaccaagaggaattcggagagtaagaagaggcatgcaaaaataaaagccctagcagctaggaaacgtagattggagagtgtgtcaaacctctgagtagcaacgagacgaaggaaaatgagtgcgcgagggaggaggggacacagaggtgtcgttgccgaaccctacgtcgcttttccccttctcgaactctagcgtaacgcgagagagggaggggatccagcaccgcgatgccgggggatgcaggcgccgaccatggagggggatgggtatggagcaccgcgacgctgcggcgctgcgccgagggtgaggggcgtcggcgtttggccgggaagcgtcgaggtcggggatggacctccaggcggaggctggctaggaggctaattagcagtaccgtcgagacgcgccgtcgttgattgcagatttt

SEQ ID NO: 2120 - DNA, 2865 bp, Zea mays
  misc_feature (2864)..(2864): n is a, c, g, or t
ccctcgattccctctccctattcgcgttccccacttccgttcgccgccgacaccgcgtgcgctctctccccccctccgtctctgtgtgcgacgactgggtgggctaccgctgccgccctacccatgtgctgaggcttctgcctacctcttcgccggcgaagagcgcccagcagatccgtcctcgcttccacgctgcagttgaagatttgatcagctatcgccttcgatgcagttgaatatttgatcagctattgacttcgctgctggcctgttttctcctttggagaccaaagaagccatggcgggccgggaggagagatatgtgaggtttcatgactggaaatcagagcaatctgtttctgttatttcagatagggtagtatcagaaaaagggcataacatctttggcttgttaaaggacagaacagcaggagccttttcattcctggggaactcttcacattctgaagccctaaacaaattaggcctaggggagaagtcaaaaacaaaagttcttgatcctcaagggccatttttgcagagatggaacaagatatttgtgatatcatgtctttttgcagtttttgtggacccattgttcttgtatgtcccagtaattgatggtggcaacaactgcctgtacttggacaagaagttagagaccacagcaagtatcctgcgctttttcacagatatcttctatttactccatatactgtttcagttcagaacaggctttattgctccctcttctagagtgttcggtcggggtgccttggttaaggacacatttgcaatagcaaagcgatatctatcaacattgttcctggtggatttcttagcggttctgcccctccctcaggtgtttgtgttggtggtgctgcctaagctccaaggtcctgaagttatgaaggcaaaaattgtactgttggttattattatttgtcaatatgtgcctcgactgctccgaataataccactttaccttcaaatcacaagatctgctggcatacttacagagacagcatgggctggtgctgctttcaaccttataatttatatgcttgccagtcatggctttggagctctttggtacattctttccatccagcgagaagacacctgttggagacaagcatgtatcaatcagactggctgtgatcctacatctttgtactgcgggtatcattcacttgcaaataattctttcttacaaaatgcgtgcccaacaaatagcactgccaatccagaccctatatttggaatctttctaccagctctccaaaatgtttcacaatcgacgagtttctttgaaaaactattctattgcttttggtgggggctacaaaatctaagttcccttggccagaacatgaaaacaagcactaatacattggagaatctgtttgctgtttttgtctcgacatcgggtttggttctatttgcactacttattggtaatgtgcagacctatttacagtcagcttctgtgcgtatcgaagaaatgagagtgaaaaggcgtgatacagagcagtggatggcacataggctactccctgagaatctaaaggatcggattatgcgccacgaacaatataggtggcaagaaacaagaggggttgacgaagagggccttcttaaaaatcttccaaaggatcttagaagagagataaagagacatctttgtttgtcacttctcatgaaggttccaatgtttgaaaacatggatgaacagctgttggatgccatgtgtgatcgtctaaagcctatgctgtacacagaaggaagctgcatcattcgcgaaggtgatccagtgaatgaaatgctcttcatcatgagaggaacactagagagtaccacaacaaatggtgggcaaactggtttcttcaactctaatgttctaaaaggtggagacttctgtggtgaagagctcctcacgtgggcccttgaccccacttcagcttcaaatcttcctggctcaactaggacagtgaagacgttgtctgaagtcgaagcttttgctctgagggctgacgacttgaagtttgttgccacacaatttaggaggctccacagcaaacaacttcagcataccttccggttttactcacagcaatggaggacctgggctgcttgcttcatacaggcagcttggcacagatactgtaggaagaagctggaagaggctttatatgagaaggagaagaggttacaagcagcaattgtaagtgatggcactacttcgctcagtctcggtgcagcgctctatgcttcacgttttgctggcaacatgatgcggatcttacggagaaatgccaccagaaaggcccgtttgcaggaaagagtacctgcaagactgttgcaaaagccagcagaacccaacttcttcgctgaagatagctgaacttgtaccctgtagcaagcagggattcatggtccaaccggtgaagtttgtgcagaagttaagattggatgctgtagatagacagatcaggtgctctaaagccgtctggtttaaatcacctaattcgcgaaaaggcctggtccgagttagattctccgttgaaataaatttgaagctgacgttaaaaaaaaatccgcttttgctccacgttaaattctggcttccatagtggtcggactagggtgctgagataagggtattgagattttttagatctgtgtgaaaagattttctgtaacgtaatatctgaaggctgtcttatcctctgtaggttattttaaaaaaaacacgtatatttcgattgtatacaggtttcatgtattataaacactctaatttaccttgtgcatttgaaaaaagagagaagatgctgtgaatataatcgattaattgtttgtana

SEQ ID NO: 2121 - DNA, 1942 bp, Zea mays
agccccgccctgtgcctctcgcggtcacggcacggacggcaccctcgggcctcaggtcccaccctcgcctccgcccgcggccccgggcggtaccctcaccgccgggtccacctcgcctccgcccgcacaaacagccgaccgcccccctggccgcgacccgcgcccagaccacacgagcgcagtgcacgcaggcagaggagggccgcgcgagctctgcgcggtggcctgtggtggggcgagggaagcgaggcgaggcggcccggcagccgcctcctgactcagtcggtgggagctggaggtgcgagctgacggtccgggtcaccgaccggcagcacggcggccacagcggaggcaaccggcgggggcggcgaccccggggccgcggcgaggcagcgctgggacctgccggccggaaacattgcaatggggaaagaagttgttgatatgtctactgatgaagaatcagattgcgtagttatgtgtccacctaacagaaatgctgatcatgaggaagctgtgagtggcagccatgatgaagattcttcaggaaggcaagagaacccttatgctgtgaactcacatatgaaaacccgtggccaggaagatgtgtctgtaaacccagacctgctcaagctgattcatcagcaggagtcttctgtcagcaattcaccatcaaaacctgcaggagctagacagcaagggtctagccatactgtccctgagtcatgcactattgcacctgaaagcaggtcatctggagcaggaacttgtgctccaatttcttatcccaccagcagcggggaaaaactttcagatataagtagctcctcaccaagaagcatgacaaagagtccatcagtcacatgcaggaagcctctccaatctgacaatacttctcacagtcaagaagaggactcatattctgtcacttcttcaactgtaacttcagcgagagctggaaaaactaagaagacaactgttgctgttgcacctacatttgtctgtgataatcgtgctgagaagagaggagagttttacacaaaattagaagaaaagcgcaaggctttggaagaggagaaactccaagcagaggccagaaagcaggaagaggaagaagaagctctaagacaactgaggaagaacttggtcgtccgagcgaaacccgtgccgagcttctaccaagaacccccaccaaaggttgaacttaagaaggtgcctccaactcgtgccaagtcaccaaagctgacgcggaggaagagctgcagcgacacccctcacacaccagagggaggaaacggcggcggcgcagtgtgctgccggctgcaccgccacagcgtcgggaactccaaagacatcggcggcaaggcacaatgctctccaaagactggaccagctgctaagtccagggcgcccccaaatccagggaagacccgagggcttccatgagaagaaagcgggacagcagccaagcgccgccgctgtacaaacctgacccgtgaagcatccattgccatgccgtttttcatcttaattcatataccctcacatcacccggaaatatggcctcatgccccggcagcagacagtgtgcctggtgctggattgttttttttttggcgttgcccttgtaagaacctggctgccactgccagagaccgtgcgctgtgtccgtgtctgtaaatttgctgcaagttttgtatggggtgaccgagtcggtcctgtgtgagaaccaaacggccgggcatattgtcattgcgtgggggcagcattcgctgatactatgtaatgtgacctgagtgagctgttgtaacctgttgtgggcatattggcaaagcgattctgattgctgtcgaaaaatttgaccaggtcatgcatgattctttttttttcttttcctttcttttcttcctgtgaacataccagttaatcaatcaggaaccag

SEQ ID NO: 2122 - DNA, 1943 bp, Zea mays
gcacgcctccacctccttgtcccagacgcaccctcctcacctccgcccgcggccccgggcggtaccctcaccgccgggcccaccgcgccccctcgctgcctcgcccccacaaacagccgaccgccccgcgcccagacacacacacacgagcgcagcgcacgcagcctgcaggcagaggacgagtgctctcctctgcgcgaagcgaggcgcggtggccggtgctggggcgagggaagcgaggcgggttggggtcggcggccgcctccgctgactcagtcggcgggagcaggaggtgcgcggcgcggggacctgacggtcccgaccgaccggcaccacggcggccgcggcggaggccatcggcgggggcggggaccccgaggccgcggcgaggcggcgctgggatctgcccggcaaggtggccgggaacattgcaatggggaaagttgatatgtctactgacgaagaatcagattgtgtagttatatgtccacctaacagaaatgctggtcacgaggaagttgtgagtggcagccatgatgaagattcttcaggaaagcaagagaacccttatgctatgaactcacatatggacagcaacggccaggaagatgtgtctgtaaacctagacctgctcaagctgattcatcagcaggaatcttctgtcagcaattcaccaaaaaagcctgcagtagctagacagcaagggtctggccatactgtccttgagccatgcgctgttgcacctgaaagaagatcatctggagcagggaatattgctcgaattcctcatcccaccagcagcggtgaaaaactttcggataaaagtagctcctcaccaagaagcatggcaaagaagagtccatcattcacacccaggaagcctctccaatctgacaacacttctcacagtcaagatgatgactcatattctgtcacttcttcaactgtaacttcagcaagagctgggaaaactaagaagacaactgttgctgttgcaccaacattcgtctgtgctaatcgtgctgagaagagaggagagttttacacaaaattagaagaaaaacgcaaggctttggaagaggagaaactccaagcagaggccagaaagagggaagaggaagaagaagctctaagacaactgaggaagaacttggtcgtccgagcaaaacccatgccaagcttctaccaagagggacccccaccaaaggttgaacttaagaaggtgcctccaactcgtgccaagtcaccaaaattgacacggagaaagagctgcagtgaaacccctcatacaccagagggaggaaatggcagtgcagtatgctgccggttgcatcgccacagcattgggaacgccagagatgttagcagcaaggcacaatgttctccaaagagcgcctcaaaggctggatcagctactagatccagggtcaccaaatccagggaagacctgaaggcttccgtgaagaaagtgggactgccaagcgccgcgaacttcgctgtacaaacctaactcatcaggcattcactcccatatgccatttttcattttaatttatacctcacatcaccaaaaagatggcctcgtgttatttttgcattgtccttgtaagaacctggctaccagagacctgcgctgttcccgtcctgtaaatttgttgaaggttttgtaagggggtaaccgagtcagtcctgtgagaaccaagcgggtgggcagctgatgggatattggagtgacatattgtcgttgtgtggcggcattcgcgcgttctatgtattgtatctgagctgtaacttattgtggacattggcaaagcgattctgattgttgtcgcaaaaaaaaaaaaaaaaaaaaaaacaacttttcgttcgcgatctagaattaaaaaaaaaaaaaaaaaaaaaaaaaaaaaaaaaaaaaaaaaaagggggccccggacgcgtgg

SEQ ID NO: 2123 - DNA, 2038 bp, Zea mays
gatgggtcccacctcccttgtcgtccaacagaagccctgaacgtgaaaaggaatctacatttgctgctggtagaagcaggcgtgttgaagtggagcgtacattgactgactcacagcgtgatgaatttgaggacatgctgcgagctttgacattagagaggagccaaataaaagacgccatgggatttgccttggataatgctgatgcagctggcgagattgttgaggttcttacagaatccttgacactcaaggagacgtctattccaacaaaggttgctcggcttatgctagtgtctgacatccttcataacagtagcgctcctgtgaagaacgcatctgcattccgaacgaagtttgaagcttctttgccagatgttatggagagctttaatgacttgtatcgcagtatcactggaaggattactgctgaagctctgaaggagagggttatgaaagttctacaagtttgggcagactggttcctgttttctgatgcatttcttaatgggctgagggctacttttcttagatcaggcaactctggtgttgttccgtttcactcgttatgcggtgatgcacccgaaattgaaaagaaaggtagctctgaggatggaaatgatggatttaagcttaatgaagacggtgccttggctactggaaaggcagcagcgacaaaggagctattagggctcccactagctgaacttgaacgccgctgtagacataatggcctctctctgtgtggtggtaaagaaatgatggtcgccaggctgcttaacttggaagaggctgagaaggaacgaatatacgagaaagatgttgacatgaaatatgtgcagggtgaacagcatgtggttggaagagaggacagtggtgtgaatgctcatagtacttcaaggtttggtgaaggttctaatggtgatgaattagatgtctctcggaacagtacgagagctggtaaaggacgttctggtggatctgcttctgccgaacttgaatcatttccaagcaagaagccgaaatacgatcctgttttgccagcttctaaatggagtcgagaggatgacatcagtgacgatgaagataggaaaggtggccgaggcttgggattaagctattcatccggaagcgatattgctgatggtctcggaaaggtcgatacaacagaagctagtactgaccacacaagtcgtcatcatgatacgattgttgatgaagagcacaggcagaagttgaggcagattgaaatttctgtcatgcagtaccgtgaatctcttgaggaacagggtctgcgtgacttggatgagattgagaggaaggttgccagccatcgaagacgtctccagtcagaatatggtttatccactccagctgatggtgctaacagcaggcgatcttctgaaagaacatcatcgtcgtcggagcggaaagagaggcatcgcgatgcacatgatcatcctaggaaacggggccggagccagagtagaagcttgagccctccaaggaagtcacaggagagggatcgagagcacaatcgcggtagggaccggtctcatggcaacgacgtggggagggatagggtacgcgggaaaagtgcaagccaagggcgagacgaccaccacgacagaagccgagatagagagaaggacaggagaaaagggaggtgaccgacccgaaaaccctcgtcaccatgcaccatttgccctaagcgaagggcccaggagcattatttgagctgggctacacgcccaccagcatctccaacggtaaacatatcttcgcaccaggcaggttaccctggtctgctccatgcttcgtctgtaataggagtttttgaggattaagttgaggttttttagagaagacttgttcgtaactttttttcttctttttttgcggattattcagatgtacccgatgtgtagtttatgctcaaaaccaatgtcgaatacagccagacccagaattgtcagtatcagacaaccgaggtatggactgcgattctgttcttccctggtggtgggctggtacgtgt

SEQ ID NO: 2124 - DNA, 3093 bp, Zea mays
cccccccccgatggggggtctgttccaaagaagggcagtaggtatgttccatccttcttgccaccatcatttgcaaaatagcctgagaaaaagaaggaaggggagaggccaaaggaaaaggaaaagggaaagccacgagtaatagatagattcttggaggaaatcaagcttgaacaagagcagcgagagaagcgccatcaggatcgagatcaccgccgtgaaggtcgccatggcgatagctccatgtcctcgagccggtttgatgaactaccagatgaatttgatccgactgggagatttccaggatcatttgatgatggtgatcctcaaaccaccaacttatatgttggcaatctatctcccaaggtcgatgagaattttcttttgaggacatttggtcggtttggacctattgctagtgtcaagattatgtggcctagaacagaagaggaacgcagaaggcaaagaaattgtggttttgttgccttcatgaatagaacagatggacaagcagcaaaggatgaaatgcaaggtgttattgtgtatgactatgaactgaagattgggtggggtaaatctgttgctcttccgtcacaggctttgcctgctcctcctccaggacacatggcaatcagaaataaggagggtggtacagctacagtcatactttctggtcctggcggccctgctgttgcatctattaaaccacaaacctcagagctggtccttacaccaaatgttcctgatattgtggttgctccacctgatgatgggcatcttcggcatgtgattgacacaatggctctgcacgtacttgatggtggatgtgcttttgaacaagctgtaatggagagagggcgaggaaatcctttatttgatttcttgttcaatcttaaatctaaagagcacacatattatgtttggaggctatactcatttgcccagggtgatactctacaacgatggagaacagaaccctacatcatgatcacaggaagtggaagatgggtcccacctcccttgtcgtccaacagaagccctgaacgtgaaaaggaatctacatttgctgctggtagaagcaggcgtgttgaagtggagcgtacattgactgactcacagcgtgatgaatttgaggacatgctgcgagctttgacattagagaggagccaaataaaagacgccatgggatttgccttggataatgctgatgcagctggcgagattgttgaggttcttacagaatccttgacactcaaggagacgtctattccaacaaaggttgctcggcttatgctagtgtctgacatccttcataacagtagcgctcctgtgaagaacgcatctgcattccgaacgaagtttgaagcttctttgccagatgttatggagagctttaatgacttgtatcgcagtatcactggaaggattactgctgaagctctgaaggagagggttatgaaagttctacaagtttgggcagactggttcctgttttctgatgcatttcttaatgggctgagggctacttttcttagatcaggcaactctggtgttgttccgtttcactcgttatgtggtgatgcacccgaaattgaaaagaaaggtagctctgaggacggaaatgatggatttaagcttaatgaagacggtgccttggctactggaaaggcagcagcgacaaaggagctattagggctcccgctagctgaacttgagcgccgctgtagacataatggcctctctctgtgcggtggtaaagaaatgatggtcgccaggctgcttaacttggaagaggctgagaaggaacgaatttacgagaaggatgttgacatgaaatatgtgcagggtgaacagcatgtggttggaagagaggacagtggtgtgaatgctcatagtacttcaaggtttggtgaaggttctaatggtgatgaattagatgtctctcggaacagtatgagagctggtaaaggacgttctggaggatctgcttctgccgaacttgaatcatttccaagcaagaagccgaaatacgatcctgttttgccagcttctaaatggagtcgagaggatgacatcagtgacgatgaagataggaaaggtggccgaggcttgggattaagctattcgtccggaagcgatattgctgatggtctcggaaaggtcgatacaacagaagctagtactgaccacacaagtcatcatcatgatacgattgttgatgaagagcacaggcataagttgaggcagattgaaatttctgtcatgcagtaccgtgaatctcttgaggagcagggtctgcgtgacttggatgagattgagaggaaggttgccagccatcgaagacgtctccagtcagaatatggtttatccactccaactgatggtgctaacagcaggcgatcttctgaaagaacatcatcgtcgtcggagcggaaagagaggcatggcgatgcacatgatcatcctaggaaacgtcgccggagccagagtagaagctgcagtcctccaaggaagtctcaggagagggatcgagagcacaatcgcagtagggaccgagatagggtacgcgagaaaagtgcaagccgagggcgagacgaccaccacgacagaagccgagatagagaggacaggagaaaggggaggtgaccgacccgaaaaacctcgtcactatgcaccatttgccctaaccgaagggcccaggagcatcatttgagctgggctacacgcccaccagcatctccatcggtaaacatatattccgcaccaggcaggttaccctggtctgctccatgcttcgtctgcaataggagtttttgaggattaagttgaggttttgtaaagaagacttgttcgttactttttttgtggattattaagatatatcctatgtgtagtttatgcttaaaatttaaaaccaatgttgaatacagccagacccagaattgtcagtatcagacaaccgaggtatggactgcgattctgttcttccaggaaaatgggctgttacgcgtagatctttgcacggcgtgagaataccgtcggttgtgcgtgggcgcatgcgtcgacgacaatgcatgctgcttaacgtgctcc

SEQ ID NO: 2125 - DNA, 594 bp, Zea mays
cacacgaccggtactcgttctcgggccgaagaccccactaagcgtcggacgacctttttttttttttttggagttagaatgctatgaattccaaaccagagaagattcaaataaaacagagactaaaaaggctgttcaaacagtaataattcttgcacatgaacactaaaccagaacgataacaggaaacaaagatacagtcagtactcagtagtttgagggcacctacggaaagcaagtaatactacagagggtagacgttccagtgcttaatgatgaaacatcatcagtacaagcaaacgtgtttttcatcatacaccgtatcactttcacaagtggctgcagtcattccgcagcataaggagattgacttcgagaagcagcatcaactttgcgcagaggagcagggctaccaggagatggggacctctcattgctacgcctttcaggagacatctccttagaaggagaggccttttgcaaagcagggcttcttgggctgaggctgcgacgaggagatggagacctctcattgctacgcttatcaggagaaacttctctagccgagaggtttttgtggggaggaactttagg

SEQ ID NO: 2126 - DNA, 636 bp, Zea mays
  misc_feature (31)..(31): n is a, c, g, or t
cctggattaccgccaatgaaggtagacgttnccgcgtgccaccaaacttcccggttcgtttccatccttccgatgtcattgagtttggttccgataagaaggctatgttccgggtgaaggtgctgaacacgctcccatacgaatcagcaagaagtgggaagcagcaggggctgcagcaagagcaagtcctccaggcagcatgaatggagacaccagtcaccatcctatcatcagcgacactgtactgtatagcaatcggtagagacacgacactccaacacgtaaaaaaagcataaaagatacgtcaaaacagatgtgggttttgcatccatgcagatgcgaaacaggattttgaatcctagcacctaacggatttaaatgatgaagtttcagttctacgagaggaactgagttgtacgatagggataacttagctgttgtcggactgtgtacattgttggtatcatcacccaaaatattgtacatctagaagccatattgtaattacggcacgtatacagtaacactttgatcatgtaatacagtatatagttgtttacggcatgtatgcttactttgataaaacatgtaatacagtatatctggcgctgagtcagatagggtaaaaaaaaatat

SEQ ID NO: 2127 - DNA, 2677 bp, Zea mays
gcacgagaccattacctagaacatcctaatcgaaaaaaagttctagaagcagggttgcacgggcagcacggcataacacctccctccactgatccagttccagtcgtccaacgtcttctctttcgcaaatcgcaagcaaacttcctgttcagctgagctcagccgaaggttgccgtgctcgcgcgcccatggcgctgctctccgccacttcacccgccaaggcgcacctgccggcgctcctcgtctaccacgacgagccgcagcagcaccagcacgctctcccgcctgcacacccgcagtgcttcggcggcggcgggggcaaggccaggcagcgggcgcggggccggtgcgcggcggcaatgcggcctctggacgcggccgtcgctcccactcccacgcccgcggccggcgaggcgccgcggaagaggccccgggtgctggtggccggcggtggcatcggcggactcgttctcgcgctggcggcgcggcgcaaggggtacgacgtgacggtgttcgagcgcgacctgagcgcggtgcgcggggagggccagtaccgcggacccatccagatccagagcaacgcgctggccgcgctggaggccatcgacatgtccgtcgccgaggaggtcatgcgcgtcggctgcgtcaccggcgaccgtatcaatggcctcgtcgatggcatgtccggctcctggtacatcaagtttgatacgtttactcctgcagctgagcgggggctcccagtcacaagggtcattagccgcatgacactgcaacaaatccttgctcgagcagtcggcaatgatgcaatattgaatggaagccatgtagtcgattttatagatgatggcagtaaggttactgccatattggaggatggtagaaaatttgaaggtgaccttttggttggcgccgatggaatatggtcaaaggtgaggaagacactattcgggcattcggatgccacctattcaggttacacttgctacactggaattgcagattttgtgccacctgatatcgatacagttgggtaccgagtatttcttggccacaaacagtacttcgtctcttcggatgtcggtgctggtaaaatgcaatggtatgcttttcacaatgaagaggctggtggcactgaccctgaaaatggcaaaaagaaaaaattgcttgagatattcgacggatggtgtgataatgttattgatttgataaatgcaactgatgaagaagcagttcttcgccgagatatatacgaccgcccacctactatgaattgggggaaaggtcgtgtcaccttgcttggtgattctgtccatgctatgcagccaaatctgggccaaggtggctgcatggctattgaggatggttaccagctggctgtagagctagagaatgcctggcaagagagtgtcaaaactgaaactcctatagacatagtttcctccttgaggcgctacgagaaagagagaaggctgcgtgttgctattatacatggactggcaagaatggcagcaatcatggctaccacctatagaccgtacttgggtgttggtctagggcctttatcgtttttgaccaagttgcggataccacaccctggaagagtcggtggcagattcttcatcaagtatggaatgcctgcgatgctgagctgggtgcttggtggcaacagctcaaagctagaaggaagacttttaagctgccgactttctgacaaggcaaatgaccagctttatcaatggtttgaggatgatgacgcactggaagaagctatgggtggagaatggtacctcatcgcaacaagtgaaggaaactgcaatagcttgcagcccattcatttaattagggatgagcagaggtcactctttgttggaagccggtcagatcctaatgattcagcttcttccctatcattgtcctctccacagatatcagaaagacatgctactatcacatgcaagaataaagctttctatctgactgatctcggaagcgaacatggtacctggattaccgacaatgaaggtagacgttaccgcgtgccaccaaacttcccagttcgtttccatccctccgatgtcattgagtttggttccgataagaaggctatgttccgggtgaaggtgctgaacacgctcccgtatgaatctgcaagaagtgggaatcggcagcaacagcaagtccttcaggcagcatgaatggagacactggctaccaccactatcatcagccacactgtactgtacagcatccggtaaagacacaacactgcatcacggaaaggatacactcgttctcgaatatttgtcgtctgctagttcaattttaaactaaaacgtgacaaatgaaaaaacgaaggaagtagaagatatgtcaaaacacatgcaatttttgcatccatgaagatgccaaacaggatcttgaatactagcacctagcggattgaaataatgaagttgcagttctgcgtgaactggattgtacgatagggatagacaatttagctgttgtcggactgtgtacatcgttgtaccatcaccggaaatattgtacaccgagaagccatattgtaattacggcatgagaacagtaacactttgatcatgtaatacagtatatagttgtttagcaaaaaaaaaaaaaacccgaggggggcccggcccaatccccttagggg

SEQ ID NO: 2128 - DNA, 1886 bp, Zea mays
cccacgcgtccgcgctgcaacagatccttgctcgagcagttggcgatgacgctatattgaatggaagccatgtagtcgattttacagatgatggcagtaaggttactgccatattggaggacggtaggatatttgaaggtgaccttttggttggtgccgatggaatatggtcaaaggtgaggaagacactattcgggcactcagatgccacctattcaggttacacctgctacactggaattgcagattttgtgccccccgcgagcctttcgggtgggtaccgggtatttctgggccacaaacagtacttcgtctcttcggatgtcggtgccggtaaaatgcaatggtatgcttttcacaaggaagaggctggtggcactgaccctgagaacggcaaaaagaaaagattgcttgagatatttgatgggtggtgtgataatgtcatcgatttggtaaacgcaaccgacgaagaagcgattcttcgccgagatatatacgaccgcccacctactataaattgggggaaaggtcgtgtcaccttgctcggcgattctgtccatgctatgcagccaaatctgggtcaaggtggctgcatggctattgaggatggttaccagctggccgtagaactagagaatgcctggcaagagagtgtcaagactggaactcctatggacatagtttcctccttgagacgttatgagaaagagagaagggtgcgtgttgctgttatacatggactggcaagaatggcagcaatcatggctaccacctatagaccgtatttgggtgttggtctaggacctttatcgtttttgaccaagttgcggataccacaccctggaagggttggtggcagattcttcatcaagtatggaatgcctgctatgctgagctgggtgcttggtggcaatagctcaaagctagaaggaagacctttaagctgccgactttctgacaaggcacatgacgagctttatcggtggtttgacgatgacgatgcgctggaacaagctatgggtggagaatggtacctcttcgcaacaagtgaagcaaacaacaatagcttgcagcagcccattcgtttaattagggatgagcagaggtcactctctgttggcagccggtcagatgctaatgactcagcttcttccctatcattgccctttccacagatatcagaaaggcatgctactatcacgtgcaagaataaggctttctatctgactgatctcgggagtgaacatggtacctggattaccgacaatgaaggtagacgttaccgcgtgccaccaaacttcccggttcgtttccatccttccgatgtcattgagtttggttccgataagaaggctatgttccgggtgaaggtgctgaacacgctcccatacgaatcagcaagaagtgggaagcagcaggggctgcagcaagagcaagtcctccaggcagcatgaatggagacaccagtcaccatcccatcatcagcgacactgtactgtatagcaatcgggagatacacgatactccaacgcgtaaaaaagcgtaaaagatacgtcaaaacagatgtgatttttgcatccatgcagatgcgaaacaggattttgaatcctagcacctaacggatttaaatgatgaagtttcagttctacgagaggaactgagttgtacgatagggataacttagctgttgtcggactgtgtacattgttggtatcatcacccaaaatattgtacatctagaagccatattgtaattacggcacgtatacagtaacactttgatcatgtaatacagtatatagttgtttacggcaaaaaaaaaaaaaaaaaacatgtaatacagtatatctggcgctgagtcagatagggtatgaattggtcttccc

SEQ ID NO: 2129 - DNA, 1633 bp, Zea mays
  misc_feature (1)..(1): n is a, c, g, or t
ngcggcggcggcgtccccgcggtcgcccatgccgcaggagacgccggcgatgcagaagcggaggcagcgggggctcgtgtcgcgggtgtggaagggcatcttcggcggccgcgaggacgtcgagaagctgctgcaggcgctgtccaaggaggaggaggccgtgcgggcgcgccttcgccgccgggcccgcgcctcccgccagtccgcgcacaacgtcctcgccctcgccgccgcgctcgagattgttgccgttggatacgccatcatgaccacgagatcgccggacatcagctggcagatgagggcagtcagggtgctacccatgttcttggttcctgctctagctgctctcatctactcgaccattacaaacctcacgaaaatgcttgacaacagagaccaacaaactcttgaaaagctacgaactgaaaggcaagccaagattgatgaattgaaggagagaacaaattactacactactcagcaacttatacagagatatgatcttgacccagctgcaaaggcggcagcggcaacagttttggcatcaaagttgggtgcggattctggactgagagtctttttgggagatgaaacaagcagggatgcagcaataggtagaagtaatgataacaatcttggaccaactactggacttaggcaaagaaaaggacacgtaaccaatggtgctggaagggcccaatcccttgagccatttgatggctccaatgtgtatgatggcagtgatgaaggccccagccctcctaatcagactgttgagcactttagaggtccatcgggtaatgatggggggtggcttgcacgagtagcagctctgcttgtaggagaggatccaacacagtgctacgctctaatctgtggcaactgccatatgcataacggtcttgcgaggaaagaggactttgccttcgtcacgtactactgccctcactgtaatgccctcaatggatcccggcaacatgatgaccatgaattggtacctgattctggcaaggagagtcctgattctcaatctggcggaatcattggccaagctggtgcaagccttgcaacctcaggtgctgcgagtcctgttgcaagcagcctaccaacccttgaagaactctctgcagaggaagattctggggagaaggcgagcagtgaccaacctgccaattgaactcatcatttcctgtatattgtgttctttgtggagtattgttttggatttgactctgggtatcgaaatttttgtacctaccatgtagtatatatggactaccatgcttcctgcatgattgtggtggtttttatcgtggcttccccccctagggtaccaggacaacgcccatttgctggcgtcttgtcgcaaccgaagggcttgaacagtgatgcatcaactcacaaattggatgtattgttctttgtttatggagtgtatagtatttgaaagactttaggcatcgttttcattttcattttaattataaccgagttctacgtttaccgatgcatgatgcatcaactcacaaagtgcctttgtttttcagttatctgtgtggggggggtgctgaagctcggaatgtgttggtggcatcacgtctagtgttgtgtgtttagtgcttgtgtcaaa

SEQ ID NO: 2130 - DNA, 1403 bp, Zea mays
ctacctctccaccccctcctcgtgccgtccacgcaccaccggcgcgccgcgctgccatggccatgaggccacgcgccgcgctcgccctctccctggcagccggcgtcccgctggtcctcctcctcctcctcctcgcgcccggcgcgcgcgccgacgacggcagcggcgggtgcggggcggcgggcggcggcgaggcggcgccgggcgaccgcgcgcgggccagggcgctgaagatcgcggccttcttctccatcctcgtgtgcggggcgctgggctgctgcctgcccgtgctggggcggcgcgtgccggcgctgcgccccgacagggacgtgttcttcctcatcaaggcgttcgcggcgggggtcatcctggccacggggttcatccacatcctccccgacgcgttcgagaagctcacgtccgattgcctctccggcgggccgtggcaggacttccccttcgcggggctcggcgccatggtcggcgccatcggcacgctcgtcgtcgacaccgtcgccacgggctacttcacgcgcgtccacttcaaggacagcgccgccgccgccgtgggcgccgccgccgtcggcgacgaggagaagcagcagcagcaggcggcgtcggcgccgcacgtcgacgacggagcagacggcgacggccacggccacggcgggcacgtgcacatgcacacgcacgcgacgcacgggcactcgcacggcgcctcggcgctcgtggctagcgtggtcgcggccgaggacgacaaggagcacgcgctgcgccaccgtgtcatcgctcaggttcttgagcttgggattgtggtgcactcggtgatcatcggcatctccctcggcgcgtctcaagaccccagcaccatcaagcctcttgtggtcgccctcagcttccaccaaatgttcgagggcatgggtctaggcggctgcatcgttcaggccaagttcaagctgcggtcgatcgtgacgatggtgctcttcttctgcctgacgacgccggtgggcatcgtggtgggcgtcgggatctcgtcggtgtacgacgaggacagccccacggcgctggtcgtggagggcgtgctcaactcggtggcggcggggatcctggtgtacatggcgctggtggacctgctcgccgaggacttcatgaaccccagggtacagagccggggcaagctgcagctcggcatcaacgcctccatgctcgtcggcgccggcctcatgtccatgctggccaagtgggcctagtttactagccacttttttgctctgtgccctctcgattccagtttttttagttgagttgctgtaaaaatactactgttatggagaaacgaacgaatacaacaactctttttttctgaaaaaaaaaaaaaaaaaaaaaaaaaaaaaaccccaacc

SEQ ID NO: 2131 - DNA, 991 bp, Zea mays
ttgggtccctcgaggccggccggggaaaggctcgcgtatgccttccccctcctccacctttttcccccgttcgagtgctcgagctccgaccaaatctcgcagcggtagcaatccccgagcggccgagcccgaagcgggatcagtggaggacgagtggacgacaccctcgattctgacctgcggtcggcgcgacttacagagaaccggagatgcagcagggcgacagcacggaggcgcaggtgacgtgggaggaccagcagaacatcaaccgcttcggtcgcctcaacaaccgcctccacgagctccaggacgagatcaaactcgcgaaggaaacgaacgagaaccttgacgatgctgggaacgaactcatcctgtcggacgaagatgtcgtgcgcttccagatcggggaggtgtttgctcacatgccgagggacgacgtcgagactaggctggagcagatgaaagaggatgcggctaagaagctggagaggctagaggaggagaaggaatccgtcctcgcccagatggccgagctgaagaagatactgtacgggaagttcaaggacgccatcaacctggaggaagattaagagtagtactggagttgtgacgacgtggccctctctttctagttcaggtcctgtttttgttcccctgctccccccacagaagcgcttggcccgctcgtgtaatggaagcttgagtctctcagtctttcagaagctcttttcaccaagaacccagaatagttttcattctgcgggtttatacggattgaagctaatggcgctgggcccatgaatcctttttcagtttgattgtacttggtgtatgtgggtacatcgcttgccctatttcctagtacttactagcaagcctgtgactgtgagtaccggaaaacagtggagataacgggcatgtaggtcttgttttctgcctaaaaaaaaaaaaaaaaaggtggtcaaaaatacgagggggggcccggtaccca

SEQ ID NO: 2132 - DNA, 820 bp, Zea mays
  misc_feature (784)..(784): n is a, c, g, or t
ccggtcttcttcgtcccctccgtcgccttcacacctgcttgccatttgcgatttcaccgtcccgtcccgtggcgcaacgaccgccgccttccggccacccggtcgcggctcccccggattcgcgcccaccgcgcctccggatcgtctcggagatctgccgctgagggagttgcatataatctgagctggtgctcctcaagtgttcggaagaggtccctgttttattcgtttttgttggtgcgattgcgagtgtaatggaggaagtggaggaagcgaacagggaagccgtggagagctgccacagggtgctcgccttgctctcccagccgcatgaccccgcgcaggccaggagcatagctctgggcacggacgaagcatgtgccaggttcaggaaggtggtctctctactgagcaatggaggagcggggctaggagaagccgggccgtcatgcggaagcgcaagcgcaagccgtcctagagctaagcttgttagcagaagacagaatccagggttcttgacccagaaaggcttcctggacagcaacaccccggtcgtggtgttgaacagcgcccatccttctactacctccgcgcaggtgtaccctagaactggagctctcgtcgatgcacagagcgtgcaccccctcggagtcggaggacctcccaagctggtccagcccttgtccgcgcactttcagttcggcagtgtgccggctcggtatcagttcccgaatcagcagcagcagaagttgcaggccgagatgttcaagagaggcaacagcgnggtttaaccttgaagttcgagagcgccagtggcact

SEQ ID NO: 2133 - DNA, 749 bp, Zea mays
ttttttttttttttttgaacatggcaagtgcgctttggcgggcaggtgccattgttcaaagagaagtaagaagttgcgggtgaagaggtcgattaaggttcctgccgttagtaacaagatcgctgatatacctccggatgagtactcgtggaggaagtatgggcagaagccgatcaagggttcccctcatcctaggggctactacaaatgcagcagtgtgaggggctgtccagctaggaagcacgtggaacggtgtgtggatgattcggcgatgctcatcgtgacatacgagggcgagcacaaccacaccggaatgccagctcagtcagcagcagcagcagcacaggtgtagccgtgtagtcgtagagaactcatcatcagttcatcactgcacccccgcctccccctccttgaggacgaagtggcaccaccaacatggcctctgttggtcaccaggtcgtcgagatgtctggtcctgcttgcgcccacaagatctgtagcgagaatggagtgtgggtgtacacaagactttctaatccatttgtgggggcagctggctgtcgctcaggattatttattgtggtcttgttgagaggtggaagggagaaggtaaaagtttggcgggaacgggatagccgtgtaaactacttgttcatagtccaatcgtcagcggcaactgccttcatttcatttctctactacggttctgaaatctatttctgttgtttagcataggaattctttttttt

SEQ ID NO: 2134 - DNA, 915 bp, Zea mays
  misc_feature (2)..(2): n is a, c, g, or t
antccacatccacagcacttttactgtcctctaaatttatctttgttgactttattaaaaaaagagattatcttcattttgcagcccggactccgctctcagaaccgagatcctcaaaacccttttccctcctcccttctcccctctcggatcgagtgcttgagctccgaccaaatctcgcagcggctgcaattccgagcccgaagagcggatcaggcgaggacgacgccttcgattctgatctgcggtcggcgcgacccagagagaaccggagatgcagcagggcgacggcacggaggcgcaggtgacgtgggaggaccagcagaacatcaaccgcttcggtcgcctcaacaaccgcctccacgagctccaggaagagatcaagctcgcaaaggagacgaatgagaaccttgatgatgctgggaatgaactcatcttgtccgatgaagacgttgtacgcttccaaattggggaagtgtttgctcacatgccaagggatgacgtcgagactaggctggagcagatgaaagaggatgcggctaagaagctggagaggttagaggaggaaaaggaatccatcctggcccagatggccgagctgaagaagatactgtacgggaagttcaaggatgccatcaacctggaggaagattagcagtactggagtcgtggcgatttgaggtgatgtttctttctagttcaggtgatgtttttttcccttgctctccggctctcccacaaacatcagtcttgtgatgctggcctgcttgtgttagcagttctttcaaaagctttattacccagaagaacccagaaaatagttccattcattccgcgggtgtatatgcattgaagttaatggacctgagccgatgaatcccttttcaaaaaaaaaaaaaaaaacacccccccccc

SEQ ID NO: 2135 - DNA, 805 bp, Zea mays
  misc_feature (67)..(67): n is a, c, g, or t
cgccccctttttttttttttttttttttttttttttttttttttttttttttttttttttttttttnggacggcaccaactaccagttctcattatgtgttatatactagtatgttgatctgtagatggtgcagctatggtatatggcaaatacaaacaagcaggcgactgccacctgccagaactagatatacatgtatgtacttaatccagggtcatcagactgtgtacgactgctggatggtgtcgatgtctaggcccttgagcttcacaaccgactccacatgccccttcagcgtgtgaagctccctcagccttgcaatctcggccctccgtttggcctcttcggccatctgattcagctcgttcaccctgtcaggaaacagcttggcatccggtggctgcagcccgtggagcgtcctctgcgcgtgtgcccacttgagcgccctctcctccttcccgaagtccttcttccttgtaaatgcaatcctttgctcaatgacaagatcccacgctttgccactcagagcatatcggatgaggaacttgaggaggtcgagcgggaagtagaagacgaggttgtagagccacaccacaccagcccagccccatccaatgccttcgatcgaagtgaacccccagtccgcgtatacagctaccagtgtagctatcagctgcgcgaccaggaaggcaaacactagtagaaagcccgggcgctcagcgaatgaccagctgcgagacctcgtcacgaagatgagagcttggctgatggtgctaacttggagatatacggcagaggcgagtc

SEQ ID NO: 2136 - DNA, 5494 bp, Zea mays
  misc_feature (709)..(709): n is a, c, g, or t
  misc_feature (1166)..(1166): n is a, c, g, or t
  misc_feature (1402)..(1402): n is a, c, g, or t
catctgaatccgtattcgaatacacatccgaattttatatcaattatttaaaaatatatagaatgaatttaatgtttattttttttgaagattaatagcctcaatgctaaaaacaagaatataaatttacatagcaaaatctatatgttatttgttcatagtcgaagaaagaagaccaaaaatttgacatccgaataaatatccggatccatccctaagtttgagttagatttgaagaaattagcaatatttttatctctaatttttaatataaaattagacgagtaaaatacaatggtcattgaatttggcctaccgtgtcacttgggccctgaactcggaaaacaaataaaatggctcctctagtttagtcagcctaattggttttactcaaattatatgctgatgtggcaatgctatgttggagcatactaattaaagtccgaggaccgaagtgatatactatgccaagtttaaagacctaagtgacacatcatatcaagtttggggtcttaagcaactctaatatggcatgtcacgtcgatatcctatttgagcaaacttgattttagacttttttgtatggggtaactaagttagatgactcgttttactgattttctgagtttagagaccaaatgacacatcgtgctaagttcgaggatcgtttatgcattttactcaaaatagattaaagatttatctcacnacactaatctaatgatactaattatatacaataaatattattattatttatatatttgattaaagctaaaaatgatataagtgagaatgacaaccattttggtatggagggagtagacgtgttgttgggctaatgccattcttagtggggttccataagcattaaataggctagcattttttgatgatgtgacagtgtattaatgacgagagagatgaaagtagttatatgggtatgaaatcatgtgtatactgtttctaagatgtttgtgtcttgcatgtgacctaggaaaacaacaaacatgaaactatgcattatgtgagactatttcatcatagtttcaaatattcttacatgatgtgttaatcgtgtccatgaaactctcactgagaacggcctaaggagagtgggtccgtcttactaagtacggcgtaagattgcctacaacgaatctcgnaagccccctcccctattattgtgcatcgtataggggctacaattgccctctaaagcacacaacgtcgcccctcctactctatccaacgagaatcgtctctctcacccaagatgtaccagctctgacgttgtccacgcgagagctcgtgtcgtcgctcggaaggtttcgttggggcctgcgctttcggagacgaacgcaactcaccggcctttgtcgtgactcgacagtggagcccntccggcatgcgcagcgacgacgagccaccgagtcaggctcctaggagagttactcgttcatgaagcaacaagtcgcaggatctccatcgtcgaccaccgccgccggtagaagaagaacgttgccccgactccgatacaaccacccgcaaactatgccttcgccgctaccgaggtcgtcgcgctcgctgagcccatctcttggctgtccagcgcgccatcggctacacatggatggagagagattgcgtggactagtagttgagaagaaatggtattatttgtttcaggtggggcatgaaggataaatatagaggaaagcgctgcagagagaggtgatatagtgatataggtgagatagattgctgacgtggctagatagtgtgatatagggagtgaaatatagagggggctattgaagacagtcttaggacctgcttgattgaacttgtagatgtttgtcagctcgaaaacaagaagcccaaataaatagctagtttttttttgtttgtttagatgttgaaaaaataaataaaaaactaagtccatatgggaaattgctgtagctttctgagtttagaaagcgaatagaatcaccaaaaatgttataattagtctcgtaggagcataaatccaagcaattttttggagaagtctaaaagcaactataggcttgttcgatttattctcatcacatgtggatcgaagtggattgaaatgtattttgacctgttatggatttaatcccacacaatacatatggattaactacaaaatgaacaagtccatacctccaacaaacagactgagatggttcaactgttggtttccactagagcccggctctattgagatggttattgatagccagtttgaagagatttggtaaccttgcatctagaaatctcgaatctgatgatgttaccgcccatatttcccttcagctggcatttcatcgagcacttcattggcatgaagaaacaactccattgtcatttccctccgtgagaagtagggagggaaatgcgtgtgagtctgattccactcaaacggtcacacccacccatcttctcctggtcgcaggaccagatgcatgtccttttcttttgacctttcagcgactcccatggatggatgcaatgcaactgcaaccacgtcaggaacatgtgattccaggggccctacgcctcacgtcacgtgtccacgatgactcgttaatatgcggactaaaatcaatcagcgtctccaaatcatgcatcttatcagatcacagggttctccatcatcttctatataatattattattaataataataataataataataataataataataataataataataataataataaaataataataaaaataataataaataacaataactgtatcatcacgacgatgccgtgcaacgaatgaatgcatctccgcacgttacaggttcatcagaatttcctcccgacaagcattccagccataattgtataccaagagagttcatacacacacgcgcgcacacaaatagtgatgcgaagctgtactacgagtttattcattccaaaggaaaaaaaaagagagagcatctgtgttaggtaagcttcaatctcttcgtagtatcaaaatgcaaagatgccatgtccaaacttgtcacctattaaaatatgcaacttcctctctctttgcgcctatgggcagaagggtaaggaaaaagaaaagaaaagaaaagaaaagaaaagaaagcaagtcccaaagtttagtttactaccggtccaccacccgtaaataaactactccatacaaacatctgcgtccagtggggcagtgtttttccatgtgagagcgtagcaacagtcaacaccagcccactttcacactgactcgtgcctttgacatttctgacccccccaccaggtcaccaagtcatcgacccaactggtccccaccagccaaaacccatccccagccgtgcgtcgcctcccagatccatcactgacggccaggatcggatcaacggtcacgccttttctaatctaatttctaacccggccccgcaataaaactactcccgagggcgcggggctttttcaaagcggggaggggagggacgagacgagggacccggctgctattttttatttatacgaaccggcgtccgtcctcggccgcgaaaacgaaatgcgaatttatttgtttatcaccttttgtttttggggttttcttcccccctcccccctcccctcctctcttcgttcactcctctgcgtccggtcttcttcgtcccctccgtcgccttcacacctgcttgccatttgcgatttcaccgtcccgtcccgtggcgcaacgaccgccgccttccggccacccggtcgcggctcccccggattcgcgcccaccgcgcctccggatcgtctcggaggtgagctcgcggctcgggcgattgccccccgttttttttgagggggtacggattttcgtggcggtttggtgcttgccgcctttgtctggccgcgagttcctggcgtgcgaatctttggattattatttagggcgcgttccgtccgtgcggtgggggttctcctcgcgtccgttttgatgcgtccgcacgcaagagatcgtcgccccggatcgtttacttgccgcggccggcgaccgtcggtctcggcgtccgcgcccgccgcttctgggatttcttgcggagacggctccccatcccgtcgtcccccgtgatccgctccgctcacgacacgagctggctagctctactaataggctttctccgatgcctgttgcgtgcgtggtgaactgttcttgcgataaaagagctgagcttctgagccttacgtaggatctgagtgattcttttttttaacctgctgtccagatctgccgctgagggagttgcatataatctgagctggtgctcctcaagtgttcggaagaggtccctgttttattcgttttttgttggtgcgagtgcgagtgtaatggaggaagtggaggaggcgaacagggaagccgtggagagctgccacagggtgctcgccttgctctcccagccgcatgacccggcgcaggccaggagcatagctctgggcacggacgaagcatgtgccaggttcaggaaggtggtctctctactgagcaatggaggagcggggctaggagaagccgggccgtcaggcggaagcgcaagcgcaagccgtcctagagctaagcttgttagcagaagacagaatccagggttcttgacccagaaaggcttcctggacagcaacacccccggtcgtggtggttgaacagcgcccatccttctactacctccgcgcaggtgtaccctagaactggagctctcgtcgatgcacagagcgtgcaccccctcggagtcggaggacctcccaagctggtccagcccttgtccgcgcactttcagttcggctcggtgccggctcgggatcagttcccgaatcagcagcagcagaagttgcacgccgagatgttcaagagaagcaacagcggggttaacctgaagttcgagagcgccagtggcactgctgggacgatgtcgtcggcgaggtccttcttgtcgtctctgagcatggacggtagcgtggctagcctggacgccaagtcatcgtcgttccatttgatcggtggacctgcgatgagcgatccgctgaacgcgcagcagcccctcgaggaggcggtgcacgggccgtggggaggatgggaccggcaagtgcgctgttacagggaggtgccactgttcgaagagaaggtaggtacatctgctacccctgtgcttattattgttactattttttaaaaaaaaattcaagatttttaatacgatcgctgttccttttttttttatttcagtaggaagttgcgggtgaagaggtcgattaaggttcctgccattagtaacaagattgccgatatacctccggatgaatactcgtggaggaagtatgggcagaagccaattaagggttcccctcatcctaggtatgtactcaattatgactagtctttcttggatgcatgccttttattaaacattgctttaaaatacctgtgatgatcc

SEQ ID NO: 2137 - DNA, 910 bp, Zea mays
attccacatccacagcacttttactgtcctctaaatttatccctgtcggcattattaaaaaaagggattatcttcattttgcagctttgaatcgcctctcagaaccgagatcctcaaaacccgttcctctaaacccttctcccctctcggatcgagtgcttgagctccgaccaaatctcgcagcggctgcaattccgagcccgaagagcggatcaggcgaggacgacgccttcgattctgatctgcggtcggcgcgacctagagagaaccggagatgcagcagggcgacggcacggaggcgcaggtgacgtgggaggaccagcagaacatcaaccgcttcggtcgcctcaacaaccgcctccacgagctccaggacgagatcaagctcgcgaaggagacgaatgagaaccttgatgatgctgggaatgaactcatcttgtcggatgaagacgttgtacgcttccaaattggggaagtgtttgctcacatgccaagggatgacgtcgagactaggctggagcagatgaaagaggatgcggctaagaagctggagaggttagaggaggaaaaggaatccatcctggcccagatggccgagctgaagaagatactgtacgggaagttcaaggatgccatcaacctggaggaagattagcagtactggagtcgtggcgatttgaccctctttctagttcaggtgctgttttttcccttgctctccggctctcccaaacatcagtcttgtgatgctggcctggttgtgttagcagttctttcaaaacctctattacccagaagaacccagaaaatagttccattcattccgcgggtgtatatgcattgaagttaatggacctgagccgatgaatcccttttcaaaaaaaaaaaaaaaaagcggcctcgagctcag

SEQ ID NO: 2138 - DNA, 1017 bp, Zea mays
tgcatgcctgcagctccgacctgaaaaccaagtataggggtggccaatgcatcattagtaaaagagctactatgctctcagatcacagataacatactgtaggaagatattaagcttatgtattgtctgacatcagcaaaaaaaaaaaataaaactatcagaattgagttcggagtttaagagcaaaggagattaccaaaaacaaagacgctaccacaattttttttaaacgaaccaggcaggagagctgccgattatatttataaagaagaagtggtccggatcgaactaatcaacaaaacaaacaataggcggttggattgggacatcaacacgctgacaccatacaacttaactcgccggttggattgagacatcaacacggcaccacactcaccgccgacacagagtgcccaaacaaacacaggcagcggcaaccccacacgagagcatataaaactgcttaaggtcatcgttgtcaagcaaggatgcagagcatccagcaactccgactttccaaagcagccgacagacgaaccaaacgaaaagcagacagacaaccctaagcgaaaggtctcaacaggtcatcgttgccgggctcaaggcacagagcagctccgacttccaatcttgaccctccgccctgccttcggtttttgcccgaccttcgaaacattctggaccacgaagaagggaggttcgcctcatgttatcgttgccgagccacatcccctgacatagcagctccgacttcacgttgcaaaaccccacctccacctgcgtaccaggcgccgagacagcgtctggccgaaacctgcgagacacagcaagctgcctctgccgtcgccgctgccccgtcgtcccgcacaatgatgaagattttggggcatgccgccaccaccaccctgcgctagtctgagccactagccgacgctgctgcagactccagcctctctaggccagaacggtcagaggcggtggcgcctagcaacgaccgtcgtcgtcgacatagcccgt

SEQ ID NO: 2139 - DNA, 4656 bp, Zea mays
  misc_feature (3840)..(3840): n is a, c, g, or t
tcgagggccgcttttttttttttttttgggagctggcgggggtggggattaagaagtggtccggaccggactaaacaacaaacaacgtgcggttggattgagacatcaacacgccaacaccatacaactcaactcgtcggttggattaggacatcaacacgatatttcactcaccgtcgacatagagtgcccaaacaacacaggcagcggcaaccccacttttttttttttttttgctaaaggtcatcgttatcaagcaaagatgcagagcatccaacaactccgactttccaaagcagccaacaggcgaaccaaacaaaaagcagatagacaacccgaagcgaaaggtctcaacaagtcatcgttgccgggctcaggcacaaagcagcttcgacttccaatcttgaccctctgccctgcctccggtttttgcccgaccttcgaaacattctggaccacgaagaagggaggttcgcctcgtgttatcgttgccgagccacatccactgatgtagcagctccgacttcacgttgcaaaacccccacctccactcgcataccaggcaccgagaagcgaagcaacagccgaaggcaaagtcctggccgagacgaacttcagaagcgacgccttcaggaagggagtgacgtcactgtgacgccaccgtcacctgtccgtgatggaccgagctttcacccaaggaagatagcactggggtgtgacgcccttaacaggggaagcgacgcccatgggcgtcaccgtcgccgagactttcgcccaagagcccccagcacaacgtctggccgaaacctcgagacacagcaagctgcctccgccgtcgccggtaccccgacgtaccacacaaatgatgaagattttgggcctgccgccaccaccaccctgcgctagcccgatcgactagccgatgctgccccagacgagaggaggtcccgccactgcaattccggccgactgcgcaggcctgccggcgcaccaacgccgacctccaccccggctcatgcgctagcccgggaccagcctgccgccgcctccgacggatggcatgcggaggccgccaacctcgcgcgccagatccagccttccgcgcgccaacgccgctccccctgggggcgccagatccagccctccgcgcatcaggtacgcgagcacacagtccaggcacacctccaacccccgagcagcagcgattgccgtcgcggcacgcaggcgccgccaccgggctagcctcgcgggcgcgcacccagccacaggcccgttgcctgagtgggcggacgccgccaccgtgggttggacgcacgacaaggcagcaagcacccgcccgacgccttcacccctagccgtgcgagcaacccaccagctagctccggcggcggcaaggcaaagagatggggagggaggggagttggcagccacccgagtcgcgagggggcgaagccggggccgaccacgccgacgagcaactcacggtgaccttggcggctgtgcccgcccagatccaccagagggagacggagatgccccgccgccgccctccccgcaagcagccgaaccttccggcggccagctcaggcagcggcgcggcagggagaggcccacgaaggggcggcggcggctactagggattatggggagcgtccgagtcgcccgacgcggggcaaccaggacgcggggagatgacacacggatttgatatccgtcggatatctgatttatgatccgtgacctcccggcctgcaacccggcgtaacacaataacatcgcaaggagcacgcgaagacaaccgacggcaccaactaccagttctcatgatgtgttatggtatatggcaaatacaaacaagcaggcgactgccacctgccagaactagatatacatgtatgtacttaatccagggtcatcagactgtgtacgactgctggatggtgtcgatgtctaggcccttgagcttcacaaccgactccacatgccccttcagcgtgtgaagctccctcagcctgcaaaggaacatcaacgagcctatggttagcttacatcgacactatacacctgattgatttatgttgacaaagaactggatgctgtttttttttatctcagttctcccctgattatagatatcccaaagcatatggagagatcatgggaaacgctgacatcggtgccctttctttcccctcaagcgataccatctccacggacttcaacatcttaccttgcaatctcggccctccgtttggcctcttcggccatctgattcagctcgttcaccctgtcagggaacagcttggcatccggtggctgcagcccgtggagcgtcctctgcgcgtgtgcccacttgagcgccctctcctccttcccgaagtccttcttccttgtaaacgcaatctgcaaaaccccggcgattagcgacacaccgaccgcgcgtgcatggaattcactcaaacaggtgctgtgctgtgctttgctgtgcatgacaaaacgagcagtttatattgatcaccctttgctcaatgacaagatcccacgctttgccactcagagcgtatcggatgaggaacttgaggaggtcgagcgggaagtagaagacgaggttgtagagccacaccacaccagcccagccccatccaatgccttcgatcgaagtgaacccccagtccgcgtatacagctaccagtgtagctatctgcattcagagagaatcgaagagctcggtcaacgggacctattcctttaactgaattttttttattgagggtcacagttacagagcaaaagttcagagagcataccagctgcgcgtaccgagccgggcaaacactagtagaaagcccgggcgctcagcgaaggatccagctgcgagacctcgtcacgaagatgagagcttggctgatggtgctaacttggagatatacggcagaggcgagtttctggtaatcatcttgagctgtcttctcaaggctttcaacgtggaagatcctctaaaaacaccattgaacagtaggatcggagtcagttgtatgtctcagaaccagccacgaaactcgatgctgcactactagcttcataggccgttttgttatcaaaacgttcaatggagattgttaaggggccgttcgtttcttccggaatggaggcatggaacaattcctagccggtttgtttctctaatttatataagttttgattagctggaataattcctggtccattcctgtggtccatttctggacaaacgaacaaggcttaagtcatacagacgcgggcggtcgtgcgccgagaagggttgaagttttaataaaagagattcgaatagaagttagaacagaaaaaaagttttatgatccttacagggaaaaagtttgtcttatatgcagcccagaagaagatgacagtcatcactgccaggtatccaccaagcacaattccagttgtgaaaatctcggccagcttccagcgggccggtagaggcgaaggcttcactcgatccttcgatatggtcattatggtacctgttgataccagaaaatggttggggcgaaaatgaaaaatgatgtttacctctatccaccatcatattgtgacagacaacacatggatgaaaggaaacaagaaagggatgtaccgtcatttagaattgcaataataagtaccataaatggtgggaaatcgaactcccatatgagggcaagtagcataaatcctagctgttaaacattgagcaaccaaatgtgttaattccagattattcacaaaatttcaaggatcaagacgaatctaattaaatatgtggttctaattaatttgctgcataacataaacagntaaacccgattaaaaaattaacaaccaaaataagtactcaaataaatgcacaaacatatttcacacaagtatgcaacagaaagatacacaaccactgtagccaaaggaggccaatataataaagttgcacaacttctagttctaaagcacaagccaagaaaacataccacaatacgtattgtaatggaaacagcatagatctgcaaaggtgaaggtggatcagaaaaaaataactattttttgaaaaaaagcaggtttccttctgacatacagtgtagttcttcatcctctggaaaatcgcccggctggtaagaacggcactaattatcacactcaagccaggttctgtcaggacaatgtcagaagcactcctggctgcatcagtggcatcagcaactgctataccaatatcagctttctttagggcaggggcatcatttactccatcgccagtcattccacaaatgtgttttcgtgcttgcagacgttttacaatctcatatttgtgctctgagaaaagggaaaaatacttaatctgtcatcatgtttttttctgctatctaccctttggatttttttcgtctgctactgatttgaaacataccagggaatacgccagcaaaaccatccgctttctcaattaaatcgtcaacaggtaaaacagcaatagactcatccttattctgtcccagcaaagcagaggaagggtacatgttagtacccatgcctaagcgacgtcctgtttccttcccaattgctagctgatcacctggaaaaaagaagatctacatcagatggctggacaagattatatca

SEQ ID NO: 2140 - DNA, 1615 bp, Zea mays
ttttttttttttttttggaacggaactgccgattatattaataaagaagtggtccggatcagactaaacaacaaacaacaggcggttggattgagacatcaacacgctaacaccatacaactcaactcgtcggttggattgggacatcaacacgacaccacactcaccggcgatacagaatgcccagacaacacaggcagcggcaaccctacacgagagcgcacaaaactgctaagggtcatcgttgtcaagcaaggatgcagagtatccagcaactccgacttcccaaagcagccgacaggcgaaccaaacgaaaagcagacaggcagcccgaagcgaaaggtctcaacaagtcatcgttgccgggctcaaggcagagatcagctccgacttccaatcttgaccctccgccctgcctctggtttttgcccgaccttcgaaacattctggaccacgaagaagggaggttcacctcatgttatcgttgccgagccacatcccctgacgtagtagctccgatttcacgttgcaaaaccccacctccactcgcataccaggcgccaagaagcgaagcaacagccgaaggcaaagtcatggccgagatgaactttaaaagcgacgccttcaggaagggagtgacgtcaccattacgccaccgtcacctgtccgcgatggaccgggctttcacccaaagaagatagcgccggggatgcgatgccctcaataggggtagcgacgtccatgggcgtcaccgtcgccgagactttcgcccaagagcccccaacacaacgtctggccgaaacctcgagacacagcaagctgccttcgccgtcgccactacctcgtcgtctcgcacaatgatgaagattttggggcctgtcgccaccaccaccaccctgcgctagcccgagccactagccgatgcagtcgcagacgagaggaggtcccgccaccgccattccgaccaactgagcaagcctgccggcgccgacctccaccccggctcatgcgctggcccggggccagcctaccggcaccaccggccagccctccgtgcgccggcgtccgcttcctgccctagaggctctagatccaacccccgcgcatcagatgcgcgagcacacaacccagacacatctccaacccccgagcagcagcaattgccgacgcggcacgcaggcgccgccgcgagccagccacgcggacgtgcacctagccgcaggccgattgcctgtgtgggcggataccgccgcggcgggctggacacgcgggcagtgcagcaagcacccgccgccgccttcaccgctagctgcgctggcaaccttccagctagctccggcggcggcgaggcaaagagatggggagggaggggagttggcagccgcctgagacgcgagaggggcgatgcgggggtcgaccacgccggcaagcaactctggcggccgcgcccgcccagatccgccggagggagacggagaggccccgtcgccgccctccctgaagctgccggaccttccggcggtcagctcaggcagcagcgcggcaggaagaggcccacgatggggcggcggcgactgctagggattctggggagcgcccttttcgattaggatgt

SEQ ID NO: 2141 - DNA, 2006 bp, Zea mays
  misc_feature (1263)..(1263): n is a, c, g, or t
  misc_feature (1430)..(1430): n is a, c, g, or t
  misc_feature (1895)..(1895): n is a, c, g, or t
ttattcaagaagttactttcaacatagattagtagaagaggaatgtgaaattagaattgtacttaacatcactttaaattttgctgcgtactgccactatttggtatgcgagagttctcatgattattgtgggaaaatgacctttccatgtgaaattcctacattagatccccctccacgagctccaggacgagatcaagctcgcgaaggagacgaatgagaaccttgatgatgctgggaatgaactcatcttgtcggatgaagacgttgtacgcttccaaattggggaagtgtttgctcacatgccaagggatgacgtcgagactaggctggagcagatgaaagaggatgcggctaagaagctggagaggttagaggaggaaaaggaatccatcctggcccagatggccgagctgaagaagatactgtacgggaagttcaaggatgccatcaacctggaggaagattagcagtactggagtcgtggcgatttgaccctctttctagttcaggtgctgttttttcccttgctctccggctctcccaaacatcagtcttgtgatgctggcctggttgtgttagcagttctttcaaaacctctattacccagaagaacccagaaaatagttccattcattccgcgggtgtatatgcattgaagttaatggacctgagccgatgaatccctttccagttcagttttcgctgggtgcatgtgggattgtgggtacatcactagccctattttcctgcaaacctgtgagggccagaaaacattcagtatcatttgcacccttaccttggctggcagtgccgcagtgctctcaccagcttcggtgatattttggaaagtatttaggggctgtttagaaggaaagtattttttatagttttagataatgccatggtttatagaaatattatagtgttttatacatgagatctttggttgcattgttttcagttttcaaaaccatagtattctatatatatagtgtttttaaaacaatagtattctagatactatggtatcttagaccattggaagcgtgaaagggtttctagctgaattggttaagtggtctgagtagcacttcttatgttctaggttcgacttttaccgtgagagcgaatttcaggttgtggtttatgcttaaaaaaaatctacttgtctgtcccacgccaaagtacaggtctaagggttggttttggtcatagtcctttctcacatggtacaggtctaagggttggttttggtcatantcctttctcacatggactacggtattgctctatatgggaaggggttcgggggcatcgtctgtcccatgccaaagcacatgtctaagactcaaacatagacttatgagtagcattgtttttggatacttttgtaaactttagagctaaaaaattggcatcaagtgctntaatgtttatagagctctaaaatttatggaagtaatccaaacagatccgtggatctcagtaattttagtgtgtgtttggttggtgagctaattggaattgagcggctccattctagtttctaagaatagagcaatttcattttgtgcttggcaatcagaatagaaccgctccattttttatttggttgaagaatagaataaagtggatgtattccgttcattgtttggttggaaagtcatataagtgtggaagggagaagaagaaagagtgctcacatcttggaaagtcatataagtgtggaagggagaagaagaaagagtgctcacatccacgagagcgctcgcatctggttgtttggtggagtagaagcattacaaatatttgttatatatagactcaagagccacctcgcttctcttccgttggaaaccaaacatctataaaatcggaatggagtcactcanttctcttccgctcttcagtagaaagatggaaacaaagagtgtcgctgtgtccgtgtacttgagtagaagatgaaatggcagggccgatagtttagaaaaagagaggaaagg

SEQ ID NO: 2142 - DNA, 914 bp, Zea mays
  misc_feature (909)..(909): n is a, c, g, or t
tggtaatcatcttgagctgtcttctcaaggctttcaacgtggaagatcctagggaaaaagtttgtcttatatgcagcccagaagaagatgacagtcatcactgccaggtatccaccaagcacaattccagttgtgaaaatctcggccagcttccagctgtccggtagaggcgaaggcttcactcgatcctttcgatatggtcattatggtaccgtcatttagaattgcaataataagtaccataaatggtgggaaatcgaactcccatatgagggcaagtagcataaatcctagcacaatacgtattgtgatggaaacagcatagatcggtgtagttcttcatcctctggaaaattgcccggctggtaagaacggcactaattatcacactcaagccaggttctgtcaggacaatgtcagaagcactcctggctgcatcagtggcatcagcaactgctataccaatatcagctttctttagggcaggggcatcatttactccatcaccagtcatcccacaaatgtgttttcgtgcttgcaaacgttttacaatctcatatttgtgctcagggaatacgccagcaaaaccatccgctttctcaattaaatcgtcaacaggtaaagcagcaatagactcatccttattctgtcccagcaaagcagaggaagggtacatgttagtacccatgcctaagcgacgtcctgtttccttcccaattgctagctgatcacctgtgatcatttttacactaacaccaaggttcaatgcccttcgtattgtttctgcactgtcatgccttggaggatcaaagagtggcataagagcaacaaaatgccatggcccaccgggactctctggggggggggggggactagtgagccctgcagcccggggggccccattagttntagag

SEQ ID NO: 2143 - DNA, 1682 bp, Zea mays
  misc_feature (1106)..(1106): n is a, c, g, or t
ccttttgttaatagttgcagtctcatactctcattggactttgaggcaacatatcctctcctagatcctcaccagattacaacctttacttaatcagtcaattttgtttaattttttggtgcaagttatactaatagactagcatgttttcttttttgaaacgaaccaggcaggagagctgccgattatattaataaagaagaagtggttcggatcggactaaacaacaaaacaaacaacaggcggttggattgggacatcaacacgccgacaccatacaacttaactcgccggttggattgggacatcaacacggcaccacactcacctccgacacagagtgcccaaacaaacacaggcagcggcaaccccacacgagagcatacaaaactgctaaaggtcatcgttgtcaaacaaggatgcagagcatccagcaactccgacttcccaaagcagccgacagacgaaccaagcaaaatcagatagacagcccgaagcgaaaggtctcaacaggtcatcgttgccgagctcaaggcacagagcagctccgacttccaatcttgaccctccaccctgcctccggtttttgcccgaccttcgaaacattctggaccacgaagaagggaggttcgcctcatgttatcgttgccgagccacatcccctgacatagcagctccgacttcacgttgcaaaaccccacctccacctgcgtaccaggcgtcgagaagcgaagcaacagttgaaggcaaagccgtggccgagacgaacttaagaagcgacgccttcaggaagggagtgacgccaccgtgacgccaccgtcgcctgtccgcgatggaccgggctttcacccaaggaagatagcgttggagatgcgatgccctcaacaggggaagcggcacccatgggcgtcaccatcgccgagactttcgcccacgagccccaagcatcgcgtctggccgaaccctcgagacacagcaagctgcctccgtcgtcgccgctgacccgtcgtcctgcataatgatgaagattttgggacatgccgccgccaccaccccgcgctgtccgagccactagccgacgctgctgcagacgagaggtcccgctncagcctctccaggccagaacggcccagaggcggtggcaccaagccacgaccgcccgtcgacatagccggtcgcagtcataccagccaaagccacgttgtgtcggccacgccagccgcaaccgttgctggacgccagacgttgcccctcccacgcacaggtgcgcgcccctgcctcgcgggcaccggatccggcccgggcctagccggatctgggaccaccttgccacccgccgccgggaaggacgtcccgcgccggcgagcactctccagggggcgaggcggccacgcctggcacgagcccaccaccacggtggacgccacccatgccacagcccggcagatgacccgccggccgccgcggacgcagccgttgccgtcaccacagacgaagcgcaggagcccagagccggcagaaacgccctgccgccgccttcactgctagccgcacgagcatctggccggctagctccgacggcggcgaggtagagcgaggtgggagaggaggtggcggcggctagggttggtgccgcccgagctgagcgacgcgggggaatagatgcactgttctgctgatgt

SEQ ID NO: 2144 - DNA, 2491 bp, Zea mays
ttcctcctcgcccaccaccaccgcacgccggacaaaaccgctctcctcgccacattcgcagcccccctcgctcgcgcacacgccacaccacaccaccagtacactgctctacgccggcccggacagtacagcagcgggcggctggctgcctaatctctccagctctttcgtcccctcgccacgccgcccaccgctgccgcatcatccgcccgttgcccgccgtcgtcgcctggcccgcggcttccgcccccattcgccgtcgcagcgcgccgagccccgtcccagatcgccgcggcgcttcctgccgccgtcggcgcggcgcagggttgaaatctatttgaccactcagttataaccatttctggtctgaagatgcttcgtcaatgacatctggaaactgtaatagtatgcgctgatcttctatgcttcaccacctgactatcaatgggctctttcctgtggaaacagcccagctacctcttcattttgataattcttcaccttgttgctcatgaggcaagaacgctgagttcagatggtgaagcacttcttgccttcaagaaggcagttacaaattcagatggagtctttctaaattggcgtgagcaagatgcagacccctgcaattggaagggtgttagatgtgatagtcatagcaagagagtgattgatctgattcttgcataccacagattagttgggcccataccacccgaaattggaaagttaaatcagttgcaaaccttgtcactgcaggggaacagtttgtatggttcactccctcctgaactggggaattgtaccaagctgcaacaattgtatctacaaggaaattatttaagtggatacatcccttcagaatttggcgatctggtggaactcgaggcattggacttgtccagtaatacattgagcggatctgttccacattctcttgataagttgtccaaacttacatcattcaatgtttccatgaacttcctgacaggagccataccatcttctggttcacttgtcaatttcaatgagacatcctttgttggcaaccttggtttatgtgggaagcagataaacttggtgtgcaaagatgcacttcaatcaccatcaaatggtctgcagtcaccttcaccagatgacatgattaataaaaggaatgggaagaattcgaccagacttgttataagtgcagtggcaacagtgggagctctcctattggtggctttaatgtgtttctggggttgctttctttacaaaaattttggaaaaaaagatatgcgtggtttcagagtggagctctgtggaggctcttctgtcgtgatgttccatggggacctcccttactcctcaaaagacatcctcaagaagctagagactatagatgaagaaaatatcattggagcaggaggcttcggaactgtttataaacttgcaatggatgatggcaatgtctttgctttgaaaaggatagtgaaaacaaatgaagggctagatcggttctttgatagagaacttgagatattgggaagtgttaaacatcgctatttggtcaatctccgtggttattgcaactccccttcatcaaaacttttgatatatgattatcttcaaggtggaagtctggatgaagtgcttcatgaaaaatctgaacagttggattgggatgcacgtattaacattatacttggagctgcaaaaggcttgtcttacttgcatcatgactgttcgcctcgaataatacatcgtgatattaagtcgagcaacatcttgcttgatggcagtttcgaggcccgtgtatcagactttggacttgcaaagcttttagaggatgaagaatcacatattactacaatagttgcaggaacatttggctaccttgcaccagagtatatgcaatttggcagagccaccgagaagactgatgtctacagttttggggttttggtactcgaaatactcagtggaaagcggcctactgatgcatccttcattgagaagggactaaacattgttggatggttaaattttcttgctagtgagaaccgggagagggaaattgtcgacctgaactgtgaaggagtgcagactgagaccttagatgccctgctctctcttgccaagcaatgtgttagctcctcgccagaggagaggccgacaatgcacagggtggtacagatgctggagtcggatgtaattacaccgtgccctagcgacttctatgattcagagtagtctcctggacaagccacgctgctgctagtttcccgtgggggcgcattcctttattctttgcgtatattgtgtaaatgcattgccgcggtgtttggtctccaatcggctggctcaacgggtgacttttttttgcgtctgtatacctatgtatgtatctgtcatggtacaagttggctatatgctgatttaataataagagagaacttactagtaaaaaaaaaaaaaaaaaaaaagacggggggcccggtacccaaaaaaaaaa

SEQ ID NO: 2145 - DNA, 2573 bp, Zea mays
aaaacgagggtggtttagctagctgttcgtcccgtgtcccgttccagtcctcgcccaccaccgcacgcggacaaaaccgctctccgctcctcacgacctcgccacactcccagcccagccggccacccctcctcccgcccccggccggcccgccactcctcactcgcgcacaccacctccagtcagtccagttcccgcagtgcagcagcggccagcggctgcctaatctctccagccctttttcgtcccctagccacgccgcccaccgctgccgcgtcatccgcccgtcgtcgcctgccccgcggcttccgcccccattcgccgccgaagcacgccgagccccgtcccagatcgccggccgcgcttcctgccgccgccggcgcggcgcagggttggaaatctgtttgaccactcagtgagtggcttcatgttaaatccatttctggtttcaagatgcttcaccaatgacatctggaaactgtaatagtatgtgctgatcttctatgcttcaccacctgatcatcaatgggctctttcctgtggaaacagcccagctacctcttcattttgataattctgcaccttgttgctcatgaggcaagaacactgagttcagacggcgaagcacttcttgccttcaaaaaggcagttacaaattcagatggagtcttcctaaattggcatgagcaagatgcagacccctgcaattggaagggtgttagatgtgatagtcatagcaagagagtgattaatctgattcttgcataccacagattagttgggcccataccaccagaaattggaaggttaaatcagttgcaaaccttgtcattgcaggggaacagtttgtatggttcactccctcctgaactggggaattgtaccaagttgcaacaactgtatctacaaggaaattacttaagtggatacatcccttcagaattcggcgaactggtggaactcgtggcattggacttatccagtaatacattgagtggatctgttccacattctcttgataagttgtccaaacttacatcattcaatgtttccatgaacttcctgacaggagcaataccatcttctggttcacttgtcaatttcaatgagacatcctttgttgggaaccttggtttatgtgggaagcagataaactcggtgtgcaaagatgcacttcaatcaccatcaaatggtctgcagtcaccttccccagacgacatgattaacaaaaggaacgggaagaattctaccagacttgttataagtgcagtggcaacagtgggagctctcctattggtggctttaatgtgtttctggggttgctttctttacaaaaattttggaaagaaagatatgcgtggtttcagagttgagctctgtggaggctcttctgttgtgatgttccatggagacctcccttactcctcaaaagacatactcaagaagctagagactatggatgaagaaaatatcattggagcaggaggcttcggaactgtttataaacttgcaatggatgatggcaatgtctttgctttgaaaagaatagtgaaaacaaatgaagggctagatcggttctttgatagagaacttgagatattgggaagtgttaaacatcgttacttggtcaatcttcgtggttattgcaactctccttcatcaaaacttttgatatatgattatcttcaaggtggaagcctggatgaagtgctgcatgaaaagtctgaacagttggattgggatgcacgtattaacatcatacttggagctgcaaaaggcttgtcttacttgcatcacgattgttcgcctcgaataatacatcgtgatatcaagtcgagcaacatcttgcttgacggcagttttgaggcccgtgtatcagactttggacttgcgaagcttttagaggacgaagaatcacatatcaccacaatagttgcaggaacatttggttatcttgcgccagagtatatgcagtttggcagagccaccgagaagaccgatgtctacagttttggggttctggtacttgaaatactcagcggaaagcggcctaccgatgcatccttcattgagaagggattaaacattgttggatggttaaattttctggctggagagaaccgggagagggaaatcgtcgatctgaattgtgaaggagtgcacaccgagaccttggacgccctgctctctctcgccaagcagtgtgtcagctctttgccggaggagcggccgacgatgcacagggtggtacagatgctggagtcggatgtaattacgccgtgccctagcgacttctacgattcagagtagcctcctggacggacaagccacagtggtgccgctagtttcccgtggaggcgcattcctttattctttgcagatattgtgtaaatgcattgccgcggtgtttgtttggtctcctccaatcggctggttcaacgggtgacatttttgcgtctgtgtttatctgtcatgctacaggttggctatatgctgatttaataagagagaacttaccagtgtgtgtttaaacaaaaaaaaagcgcccaaaaaaaaaaaaaaaggggggggag

SEQ ID NO: 2146 - DNA, 1782 bp, Zea mays
ttggcgcatatgggcccacttgtcagtcgcgttcttcgaggtaccgcggtccccctgtccccaacctcgccgattctccgttctccacagtcctccacactcgccgagcgacaccgcgcgggacgaccgagcaagcagagcatgcaaccgtcgtgcctgggcgcatgcagcggtggaggactagcactctccgcccgccgcctccacggcccctcctactgccgcgtcgcgccgcatagggcttccgcctcgtgctccgccggtggcggcggcaaggcatcgccgcgggggaaggacaacgtctggagcgtcgataacgagcgtgccgccaaggaggcggtccggggcccgaagcaccgccgcaggaaacgccccagtggtcgccgcctgccgccgccgaggaggaaggggaaggatgcggggtcgagggttctagtgtctggagccatgctcgtggaggtcgagactgtgctccaaactcaggaacctgttataaagccttcttgggatacatttgcaagtagtttaactggtaactggaagggtgttggagctatcttctcaccaatcacagcagagatggagcccgttggggttgggaacaaagaagagtacctttatgactgctacactctttctcacattgagagatcttttgatggtggtcatggctctgagatccgaaggaaaacaaattgggtcccaatcaatccttttggggaagctgagaagcagatcacatcatatgatggtgggagtcaaagcacttccagtggaaagggaattgctgatttaccttcatatgagtcttttgatctcaacaggagtgctgtgcttgatgaagaaactttttctatggagcctggaattgtattttttgaggatggatcatactctagaggtccagttgatatagcaattggtgaatatgatgaatcaaaatacttcctttcaccaacatataagtttgagcaatgccttgttaaaggttgccacaaaagattgcggattgtgcatacaattgagtttaacgaaggaggagctaacatacaaattgtaagggttgctgtgtatgaagaaaaatgggccagcccagcaaatatccatgttgaagatgatacacttgttgaccttaaaccgttctctcaaaggagccggaccaaaccgtcagaactgacaggctcctggaaagtatacgaagtcagtgcaacaccaattttcagtgataaagtgcaagaactagagggcggttctccattggtctacttgtgcatggagacggtgaagaagagaaacctgccagatagttcagttttctttggggaggaggagatgctcgacgtgcaggatgtcaccgtgctttggttacctggtggcgtcactgcctatgttgacataagcgaagacggcatactctgtatcggagttgggtggtactccgaagaaggtatcaacctggtgatggagagagactatggaaccgatgggaggctcagggaggttcggtcgaaaactgaagtaaagcgcaggtggtatcaatcagttccataaaaacccaaagtttttttttaattttctgcttaaattaatctttgtttctaaatagcggcctaggatcagtatctaatacaccaaaccttcccgtttgacaggatcgatgtacttcatagctaagctgtaactttttgttgcctatgtagaatgtgaatgttctggtttgaacgataagaaaaataagcttaaaatccattctcatacaatgccccaaaaaaaaaaaaaaaa

SEQ ID NO: 2147 - DNA, 1942 bp, Zea mays
aggccaaactaagaaacgccaagttgccagccaaacgaaccagctaaaacaagggggggcagcaccgcggcgcggcgcggcgtggggacagagccctcgtgatcgatccgtccgtgggatctcgcgcacgccaggattggagagccgcggcctccccccgccccaaccagccatgggttcccgcgcggatcgcggctcttagacgcggaggaggagagagacagggggaggggaaggccgaggcctaggaggcgtggtgcagcgcgcgagcgcgttcgttcggcatggaacagaacgacggctcgttcctcgccgtgcgacgcctctccggcggcgccatccaccaccatcgccaccactcttcgccggctgaggtcgtgggcgtgtccacggcgtggatcgggaaggggcttacgtcgtgcgtgtgcgcgcaggggacggagagcgacgggcgcctctccttcgatttgagtcccattcaggaagagtgcttgcataggttgcagaaccggatagaggtgcagtatgatggttcaaatctagagcatcagaaagcactggtggccctttggcatgcttcttttcctggaactgaacttctaggattagtatcagaccagtggaaggagatgggatggcaagggaaagatccatctacagatttcaggggtggtggttttatatctttggagaatttactgtatttctctaagaaatatccaaaatccttccatgagctccttcgtaagcagaatggtgatagagcattgtgggaatacccctttgctgtagctggtgtaaatattacattcatgctaattcagatgcttgatcttcaagcagctaagccaacgtcattggttggagcagttttcctaaatctactcttagaaaatgatcgagcgtttgacattctttactgcataaccttcaaactgatggatcagaaatggcttgaaatgcacgccagttacatggatttcaatgtggttattaaatctacacggcgccagctcgagagggagctgttgctagaagacatccagaggatccaggacatgccatcatacatgcttctcacctgctagcaattgaacttggtcatacctaacattgcagcaaggtagtgcatctccatacactcgaagaagttgcgacgttggaaccacgtataccgagctcagtatggggggcgtgggcgatctaggttcatggactgtggatgtgctgctttaaattgtcgtgtttacctacttgacaacgaccttaacaccgaatgccttttcgtttggacgatgcgctgcatcttggagctaactttcgttgtaaacaggactacaggaggatcgtggaaacttgtctgaatatgatttgtagccatgtgtatgcataatcttgccgctttactgaaaaaaggcagattaaggctaattatagccttatagtcatttgagttgggctgggtaccttgtgtggggcccataacgaacacagacatgccttatttatttcggcctaatagcctattgggttggttggtcctgattagcttgggatcggagtaaaatagttgaaacatcactgcagtgcatactgttgcagatccgggattcaaatctacctatggcgaagctctcaaaatctgagattaatgtaatgtaatcactcaactgctgcactgccctccgccaaagccgtaaggcagatggcagcaccgcgccgctagattgacaagagacgaggagatgtatggtcacgagcagggcaaccattcagaatagatgtgtgcctgtgtttatatagttcatttttcaaactgtaaaacgtccatgtgattaactaaaaaaacaatgcccagactactaccggcggcctcaggcatccttacataagtggtacgattgcagatgggagagggtttcgctagatctcaaagggatcc

SEQ ID NO: 2148 - DNA, 3870 bp, Zea mays
  misc_feature (2767)..(2767): n is a, c, g, or t
ctctgacaaaaaaagtgatcaactttatgtgtggtaaataggtatgcacggttagttatttcaatgaaacatgggtgatggagtaaaacatgaaacacaaataggaaaaatatgaaggtgtgcgttgtatcgaggaacatggaataaacatcctatacttcaattggcagagtaagcacaccttaattggcagaataaacatgagatttacggtctataggtctaggagagacatgtattttggtgagtatggaaaggaataggtaaccatttgtttactacaaaaccatactatctgttctgaatagaagttgtaggttgtccaaatgaactgctgccagacgtcaattgtaggaagcaaattatacatgtttattgtgacagcaaactgcagaaggcaaactgaatgcattggcgaaaggcaacggcgataactaagcaaaaccaacacggattctaggagtcggaaacagactcgaaatccaccaacggcaacactgaactatcaaatggttggttcatctctgcatatcgtctgactctttcatatagtaggtgaaaatcacaccaaaattgaaaggggaggggggacaatgagccgtttccaaaggagtaaacaaattcgaaggagcatcatccagtaaagaatccaaatcgactggtgcacagtaataaaagtaattccttgtacgatcgcccgacgatagcttgcctgtaggtctggcctagccaaggcgttcgaccgagaagggagagcgggtggagggaggcgagtggctggccggttgccggctagcctacaggcctggcccggcccgtgtggaggaggggcactgcgctggagcgatggagccgttgagtgtggctgcggcatgcggaggcgctatgcagagcgggactttgtgagagggtatgtgcatgcccccgtgtgaggggtgggaggagaagccgtcgagcctgatcgtcgccacctgtgtgacgagcgcgagtaagggagggagcggaatatgagtgccgacgttgaggaagatatagatgtgagatgcagaaacgcaccacgggcatgtgcctatgtgagaggcgggaggggaagtcgctggcgccgtcaagcatgagcgtcattgccgtctcatgtgtgccgagcgcgagaaaggatgcgggcgaagatgagcatcgtcgttgcgaggaagatgatgggtgatgcagaaacctactacgcgcctacgcctgtggaagaggtgtgagggaaagtcgctggcgccgtcgagtgtaggcgtcaccgtcgtcgcctgcgtgtcgagggcaagtaaggaagggagcggaagataagcgtcggctccgtgccttcgctgtaaataaaagcgacaagacgaaatttctagatgcttgacacattgatcttaccttggaagattcgaacacgaaaggcaacagtgaagaggacaatccaggctcattgtggtccttaccgttttccaccgcgctcttatctcaccgtgtatccgaaatctgacggctggtagaaatagagcatacgtggacagcctatcatagcaggtttgcgtcaagctctattatatagaaatttgaacatcctttctttgaaagttcggttttcttggggaggaggaccggaggagatggtcgacatgcaggattgcaggatgtcaccgtgctttggttacctggtgctggtggcgtcactgcctatgttgacatcaatgaagacggcacactctgtatcggagttgggtggtactgggacgaagacgaagggatcaacctggtgatggagagagactatggaacagatgggaggctcagggaggttcgttcgaaaactgaagtagagcgccggtggtatcaatcagttacataataacccaaacattcttttattttctatttttctgctttgataacctttgtttcgaaatagcagtgtaggatcaacatctgatacacaaaacctgcccgtttgacagcattgatgttaagctgtaattttttgttgcttctgtggaatgtggatgttctggtttcatcaataagaaaaataagctttcaattgccgttgtcctatgcgtcatattttatgctacacagctacagccacagaatgactcgttcagaacgttatattttggccacttgctgtggagtatgctgacagtttttgagaaacccacgctgcatgcctgcgtctgatctagatcttcgcccattaggtgacaagattgatgaccttgatctgtctttgacatcttttattcgtctttgataaactgatttatctctgaacgtcaatattcttgagtgaaattcagatctggctcatcctttggggtcgaaaattccacctggatactccgagcttcagcagccaccttgcttgaagtctctgggagaccggcactgactgaggtcgtgggaacgtttgctttctacgccaaacgtctggcccaggctgaagcaaggaaaccgcaataattcgcgccaccatcgggacggccggacgggagccacgccaaactaagaaacgccaagttgccagccaaacgaaccagctaaaacaagggggggcagcaccgcggcgcggcgcggcgtggggacagagccctcgtgatcgatccgtccgtgggatctcgcgcacgccaggattggagagccgcggcctccccccgccccaaccatgccatgggttcccgcgcggatcgcggctcttagacgcggaggaggagagagacagggggaggggaaggccganggcctaggaggcgtggtgcagcgcgcgagcgcgttcgttcggcatggaacatgaatcgacggctcgttcctcgccgtgcgacgcctctccggcggcgccatccaccaccatcgccaccactcttcgccgggtacgcgcgtggcgctggccccgtcgtttgggtgcgctgtttgccttcgtgcagactgcaggggctcacggttgtggttttctcccccttccgttttcctgcgcccgcagctgaggtcgtgggcgtgtccacggcgtggatcgggaaggggcttacgtcgtgcgtgtgcgcgcaggggacggagagcgacgggcgcctctccttcgatttgagtcccattcaggtaaaagctcgttctcattccgttattttattattgcttactagataaatgccaggtaaaactagtaccatgaatccataaagcgtaaagtatgaacatgtttttgtagtttgcgctgctgaaacggtttttactgtttgagctgaagctattttctagaaaatgttggtaaattagattctcctagctattttctagggaagtaagttgtcgagcctcccgcctgtgaacgagcaaaacgaatcgatgctagcgcgggcacgccgcacgcgtgtgagggagcggggcgtggggcaggcccacgtgtcggcgcagcataacggggtgcgcggctaagaaggcgggaggacgatcgcgggcgcgcgcacgaaacagaaacaggttggacgaaagccatccgtagatatctctcttcgacacagggcgttgttaacatctctgttttttccctgcgacatgggatcattatgaatgatgaatcctcccctgaaagtttgaatatgaactggcaatattgttatgggaacataaagggggtatttgagtccgataggagcgactgtggaagccgtactgtctttagcacaatgtatggttggtattatgattcgctcagaaggaggaaaactgtcatgtaactgcaattgcttcttcgacaggtatggtcttttgtgaattgtgattgcttggtgtgttctccaaatgcatagggcgatgaaaaattcttgctctcgtttttttcataacgta

SEQ ID NO: 2149 - DNA, 1483 bp, Zea mays
acgacgggacggaagccaggccaaacgagagaagcgccaagttgccagccaaacgaacaaagctaaaacagggcgggggcgggggcgtcgcttcgtggggacagccctcgtgatcgatccgcccgtgggatctcgcgcacgccaggattggagagctgcggcctccctccgccccaaccagccatgggttcccgcgttgattgcggcgcttagacgcggaggaggagagagacacggggaggggggaggccgaggcctaggaggcgtagcgctgtgcagggcgcgagcgcgttcgttcggcatggaacagaacgccggctcgttcctcgccgtgcgtcgcctctccggtggcgccatccaccaccatcgtcaccactcttccccggctgaggtcgtgggcgtgtccactgcgtggctcggtaaggggctttcatgcgtctgcgcgcagaggagggagagcgacgtgcgcctgtccttcgatttgagtcccattcaggaagagtgcttgaataggttgcagaaccggatagaggtgcagtatgatggttcaaatctggagcatcagaaagcactggaagccctttggcgttcttcttttcctggaactgaacttctagggttagtatcagaccagtggaaggagatgggatggcaagggaaagatccatctacagatttcaggggcggtggttttatatctttggagaatttactgtatttctctaggaactatccaaaatccttccaggagctccttcgtaagcagaatggtgatagagcattgtgggaatatccctttgctgtagctggtgtaaatattacattcatgctgattcagatgcttgaccttcaagcagctaagccaacgtcgttggttggagcggttttcctaaatctactcttagaaaatgatcgagcgttcgacattctttactgcataaccttcaaactgatggatcagaaatggcttgaaatgcacgccagttacatggatttcaatacggttattaaatcaacacggcgccagctcgagagggagctgttgctagaagatatccagagaatcgaggacatgccatcgtacaggtttctcgcctgctagcaattgaacctcctggtcgtaccgaacattgccacaagatagtgcagctccatacactcgaagaagaagctgagaggttggaaccacgtacaccgagcgaagggtgaatctaggttcatggactgtggatgtgttgttgctttgaattgcgctgtcgtgtttacctactccgagtccgacaacagcctcgacgccgagtgccttttcgtttcaacgatgtgctatatcttggggccacggaacggcagatcctagctttctttgtaaacaagaggatgtggaaagttggctgcgtatgctttgtggccatgtgcatggataatcttgctgctcgcctgaaagaaaaaaaggccgatcttaagaccaaaaaaaaaaaaaaaa

SEQ ID NO: 2150 - DNA, 2877 bp, Zea mays
aattgtgcaggttaggagagggtatctgcctaaagattttgttgttccaaagtctccagaaagaatattgttttgtggttggcgccgtgatatagaagatatgataatggtacttgatgctttccttgcgccaggatcagagttgtggatgtttaatgacgtccctgaggttgacagagaaagaaagctaattgatggaggtttggacttcagtcgcctcgataatattactttggtgcatcgtgagggaaatgctgttattcgccgtcacttggagagccttcctttagaatcattcgattctatcctgattttggcagatgaatctgtagaagattcagcaatccaagctgactcaaggtcacttgcaactttgctgctgataagagatattcaggcaaaacgtcttccatgcaaggaatcattgatttcacatgttccccgagggaccttttctgaaggttcttggataggggagatgcaacaagcatctgataaatctgtcataatcagtgaaattttggaccccaggacaaaaaatttgttgtcagtgtcaaaaattagtgactacgttctttcaaatgaattagtgagcatggcattggcaatggtcgccgaagatcggcagataaataatgtcttggaggagctcttcgctgaacaaggaaatgaaatgcaaatacgaccttctgatatgtaccttagagaagaagaggaattaaatttctttgaggtcattctgcgagctaggcagaggaaagagattgtcattgggtaccgtcttgaggcagctgagcgtgccataatcaatccaatagacaaagtttcaaggcgaaggtggtcacccaaggatgtttttgttgttatatccgagaaagaatgaggtttatcagatcacagttgacacaaaagcaagctcctgaccagtgaccacacctaatgaagaacaggcagctgcgccgcacacacacacacacaccgaccagcgcatagagctatttgattcagatgcgcatttggcagaaggcaagcgctgagcgcgaaggagtaaaagcatgatcagatattcagatctttgatcagtctagactgacaccttaggtcgccctttacaaatatgacttaaaaaggatgtgaacagagtagtacagcacatgctttggaagtttggatattcttgtccgtgtaacttcccacatgaacaacgagcaaagcatctcctgcatatgcatcaattaatggcttaaagctattgagtgctgatactgagcagttttccagtgagcctgttacaccctctggccatagagcgtagacgacagcgacagttcagcattctgtacattgcataggcgcattctgttgccagtccatgtaaacaacatgagatgtcggccagtccatgtaaatatgtaatctggaagatcatctgtaggtactgttgcggtgttggatcttgtgaagaatgcagagagcaatgccgaagcgtgtcaccttgcctcattgtacttgagcagatatatattatgtccaacaagtctatgcttcacaacgaatactcaaaatctttgattcataaactcaacaaaagatctgctgttgtgatttatgcacacttccatggatatcatcccaactgattctagctggggttttcatgataaaaatgtaggtgtaactccaaaatcctacttactgctgggccccaagaattcgatgcagcccagcccaaccacctcccagcttatccttctcccggtctccctcggctccgctctgccgcagccgcgggaaatggtcgcgctccacctccacgccaagcaacccacgcctcgtctcctccccgttccaccgagccatgcccgtacccgtacgcccacggcggcggcggtcaacgtgagccacgctgcgcctccgcccgacgtcgtcctcgactgcaaacggctggacgggctgatgaagtccgggaggctgggggacgccctggacctgttcgatcggatgcctcgcaagaacgtcgtcgcgtggaccacggccatctccgggtgcacgcggaacgggcgccccgaggcggctgcgaccatgttcgcggacatgctggagtccggcgtcgcgcccaacgacttcgcgtgcaacgcggcgctggcggcgtgcgcggccgctggcgcgctcggcctcggcgagcaggtgcactcgctcgccgtgcgggcgggcttcgcggccgacgcctggatcggaagctgcctcatcgagctctactcgaggtgcggctccctgcgggcggccgaggaggtctttcgccggatggaggcgccggacgtcgtggggtacacctcgctcgtctcggcgctctgccggaacggagagctcgcacgggctgtggatgtgctctgccagatgacgaggcaggggttgcagccgaacgagcacacgatgacgagcatgctggcagagtgccctcgtggaattggtgagcagatacatggatatatgctcaaggtaatgggttcgcagagcgtctatgcatccactgcactgatcgacttctactcgaggtacggtgactttggcacggcgaaaacggtctttgaaaatcttgagtccaagaacgtggtgtcgtggtgctccatgatgcagctgtgcattagggatggaaggttggacgatgcgctgcgagtgttcagtgagatgatttcagagggcgtccagccaaatgaatttgcgttctcaatcgctcttagtgcctgtgggtctgtttgtctggggcgtcaaattcactgctcagccatcaagcgtgacttaatgactgacatccgagtatctaatactttactctctatgtatggtaggagtggttttgtttcagaactcgaggct

SEQ ID NO: 2151 - DNA, 2524 bp, Zea mays
cattgggtacctcgaccccccccggccctaccccgggccttgcgtggcgatcgagttgccaccagacaactcggctcggctcgtcgtccaccgaccctcctcctcgctccaagcttccctctcccctcctcctccgtcagctggggagctagctagggagcggcgccggcggctgatcgagcggacagacagctgaacgagccggaaatggcggcggggcgcgcgccgtggctcgccgccggcctcgtggcggtgctgatggtggtggccgcgcgcgcgcggttcgtggtggagaagagcagcgtgcgggtgctggcgcccgagcacatccggggccaccacgacgccgccatcggcaacttcggcgtgcccgactacggcggcacgctcaccggcgtcgtcatctacccggacaccaagcccacggggtgcgacgacttcgacgccaagttcaaggccaagtcccgccgccccgtcatcctcctgctcgaccgcggagaatgctacttcgcgctcaaggcgtggaacgcgcagcgcgcgggcgcggcggcggtgctgatcgccgacagcgtggacgagcagctgctgacgatggacagcccggaggcgtcaccgggcacggagtacatcgacaagatcaacatcccgtcggcgctggtgaaccgcgcgttcggcgagtccctgaaaaagatggcgcagaaggtggccggcgcgggcagcgaggaggtggtggtgaagctggactggcgggagtcgatgcctcacccggacgagcgcgtggagtacgagctgtggaccaacagcaacgacgagtgcggcgcgcggtgcgacgagcagatggcgttcgtgcgcggcttccgcggccacgcgcagctcctggagcgcgccgggtacgcgcgcttcacgccgcactacatcacctggtactgccccgaggcgttccgggcgacgcagcagtgccggtcgcagtgcatcaaccgcggcaggtactgcgcgcccgacccggagggggacttcggcgccggctacgagggcaaggacgtggtggtggagaacctgcgccagctctgcgtgcaccgcgtcgccaacgaaacgggctgcccctgggcctggtgggactacgtcatggactacaagatccggtgctccatgaaggagaagaagtacaccaagacctgcgccgaggacgtcgtcaccgcgctcggtctggatctcaagaaggtgctggagtgcatgggcgaccccgaggccgacgccgacaacgccgtcctgtccaaggagcaggaagaccagatcggtagcggatcgcgaggcgacgtcaccatcctgccgaccctggtcatcaacaacgtccagtacagagggaaattggagcggacggcagtgctgaaggccgtgtgcgccggcttcaaggaagggaccgagccccgcgtctgcctcagccatgacatcgagacgaacgagtgcctgcacaggaacggcgggtgctggcgcgacgaggccaccaacgtgacggcctgccaggacacgtaccggggccgggtgtgcgagtgccccgtggtgaacggcgtccgctacgagggcgacggctacactgactgcaaagctattgggccgggcaggtgcgctctcaacaacggcgggtgctggtcggcgacgcgagggcaccagaccttctccgcctgcacggagaccgcgctgacagggtgccggtgcccgccggggttccatggcgacggccacaaatgtgaagacctggacgagtgcagggagaagctggcgtgcacgtgcccggactgccagtgcaagaacacgtggggcaactacgagtgcaagtgcaagggcaaccagctctacatccggggcgaggacgtctgcatagctaacagcatgtcgaagctcggctggttcatcaccatcgcggccgtggcgtgcgtcctcggcgtcggggtcgccggctacgtcttctacaagtacaggctcaggtcgtacatggactcggagatcatgtccatcatgtcccagtacatgccgctggacagccagaacaacgagaaccagcctctgcggcagcacgattcggaggctctgaggcactaaaggggccccaatgcaagatgcgcacatgatctcgacagatataatctgctcctgtttcgacgacgatggtttgcttcgcttttgtatagcgcgtagaaaacaaaaaggaggacggtttgtactgtgccgaggacagagttgagctctagagagtttagacaggtaggcatttcgctcggctctcttgggagctagtagtcttgtgggtcaagagccgtttaaagcacacaaacagcatgtagaaaaaaaaggcgtatacgagctgctatacatgtacattgtacagtagacaaatcctactacggacaatttgttactgccatatttggtatgcgcgggagtttcaccttatgattggtaggagtaaggagtgtacttaaaaaaaaaaaaaaaaaaattgtgtggaatgggactgcagccttgc

SEQ ID NO: 2152 - DNA, 964 bp, Zea mays
ccggccgggaacggaaggcctgcgctccacggaccacggcaacggggctcgggagggggtaccccggggcggcccgcattcacatctgtagccgcgcctctccgtatcactccgcgcctctctcccgccaggccgccgcccaagcaaccatggtggccgcgctgctccgccgcgcgctccacctccgccgtgtgctcccctcgcccgccgtcaccgccgccgcctcccagcgcctcatccccgccttctcgaccacccccacgccgaccccgaccacctcccagcagaacgccgccaccactacgatcgacctctcctccgacgagagccgccgccgcctcctcaataggttggtgtaccggagcaagcagcgaggttttctggaactggacctggtgctggggacctgggtcgagcagcacgtgcacgccatggacgaggccaacatccgcgccctcctgcaagtgctcgacctcgaaaacccagatttgtggaaatggttgactagccaggagcagccaccagaggatctgaattctaatccggtgtttgctgccatcaaatcaaaggtcacagataacctgaccaagcatgcttctcctgagacccgatctacaccaggtcaaccatgggttagaggatgggacgacataaagaaaggcaaagatggacccaagtatggaaatcagtgataagctgcttgaaatggggatgacggctttccatcctaaataatagctgtccgcccaccccaccccccaatatgcttgttttgtgattgtgtagaataaagtgaactgcgaccggcatgtgtgaagtttgttaaattgtagaatcagcttgtaactatggatggtactcctgatgtttgcctggcaattccagccttccaggtatcgtctactacttggaaatatgttatattatgcattgcagtctgttagtgatggcaatcgttgaagcc

SEQ ID NO: 2153 - DNA, 898 bp, Zea mays
ggtaccctccgggctggccgggattctgtagccgcgcctctccgtttcactccgcgcctctctcccgccaggccgccacccaagcaaccatggcgaccgcgctgctccgccgcgcgctccacctccgccgtgtgctcccctcgcccgccgtcaccgccgccgcctcccagcgcctcatccccgccttctcgaccacccccacgccgaccccgaccacctcccagcagaacgccgccaccactacgatcgacctctcctccgacgagagccgccgccgcctcctcaataggttggtgtaccggagcaagcagcgaggttttctggaactggacctggtgctggggacctgggtcgagcagcacgtgcacgccatggacgaggccaacatccgcgccctcctgcaagtgctcgacctcgaaaacccagatttgtggaaatggttgactagccaggagcagccaccagaggatctgaattctaatccggtgtttgctgccatcaaatcaaaggtcacagataacctgaccaagcatgcttctcctgagacccgatctacaccaggtcaaccatgggttagaggatgggacgacataaagaaaggcaaagatggacccaagtatggaaatcagtgataagctgcttgaaatggggatgacggctttccatcctaaataatagctgtccccccaccccaccccccaatatgcttgttttgtgattgtgtagaataaagtgaactgccaccggcatgtgtgaagtttgttaaatcgtagaatcagcttgtaactatggatggtactcctgatgtttgcctggcaattccagccttccaggtatcgtctaagaaaaaaaaacccggattaaaattcaaaacctttggagggtaacaaacacatgg

SEQ ID NO: 2154 - DNA, 2313 bp, Zea mays
gtagtagccccagatggtccatctcggacatattctctaccctcgagtgtccatgaccagactccagatttggagttaaggaggagtaagagacaaaggactgaaaagtctctgggtgatgattatattatttatctagtggatgaagaaccacgctccctcacagaggcatatacatctccggatgcagagtactggagggaggctgtccgtagcgagatggattcaatcatctcgaacggaacttgggagataactgatctcccagctggttgcaagcctgtgggctgcaaatggatctttaggaggaagaggagacccgatggtactattgaaaagtacaaggcccgtcttgtggctaagggttttactcaaaagaaagaggaggattattttgatacttattctccggtggctcgattgcccactatccgtgtgcttttggcgctggcggctgcttataaacttcttgtccatcaaatggacgtaaagacagcattcctagatggagagctggaagaggaaatttatatgcagcaaccagaaggatttgtggttaaaggacaagagagcaaagtgtgtcgcttgattaaatccttatatggtcttaaacaagctcccagacaatggcatgagaagtttaataatactctgaccactgccgggttttgtgtaaacgaagccgacaagtgtgtgtattatcgcttctctgggggcaaaggtgtcatcatgtgtttatacgttgatgacatattgatatttgggaccgatttggaggctatcatggagacaaaaatattcctctccaagaactttgatatgaaggacttgggtgaagctgatgtaatattgaacatcaagctaataaagggtgaggatgggattactttgtcacaatcccattatgtggaaaaggtcctgactcgctttggacatatggactgtaaaccagtcaccacgccctatgatccatcctacacgctcagtaaatatgaaggcgagcctgtgaaccagctactatattcgcagatcatcggatctctcatgtacctgagcagtgcaactagaccagatatctcatatgcagtatgcagactggctcgttattcggccagtccaggagatagacactgggtagccttgtacagagtgcttcggtatttgaagggagcgatgaatcttggtattaaatataccggatttccgtcagtacttgaaggattcagtgatgcaaactggatctctgactcggatcaaatgaagtctacaagtggctatgtgttcactttagctggtggggccgtgtcatggagatcgtctaaacaatcagtgtcgacacgttccaccaaggaggctgaattagttgcacttgattcagcagcattggaggctgaatggttgagagacctgttgtcagaccttccaatgctagcaaagccgataccggctgtcctagtatactgtgacaacacttctgtgttgctgaaagtgaacagtagaaaggacaaccaaaaatcctcgaggcatatcagaagacgacttgattcatgtcggcatgctagagagacgggtgtaataaccgtagattacatcaagtctgaaaggaaccttgctgatcctttcaccaaagggctggctcaaaagccaatccaagcagcgtgcatgggaatgggactcgtaccctgttagcggtttcaactgcggataactgtcctgtgtgaccggagatcccgagatccaggctccaggaaacgaagcactgtgaaaccaagagcacaaaagataaagagtctcatgagctgctgtgctctgtctgtatggcaggttgagcgatatgctcttaatgaagtcaatgctataagcagggaaattgtcctacagaatttccttaatgatttcacctatatgagctgactgtggggtcgcagtccaggagagaatggggttttctctctagtgagctcatgaatagatattaaagggcatgaccgtaacgccctgccccgtaagagaagcagataatctgcctagtactatgtgccttttgtgcgaagattctcacactagggtttgtggatcaaggcgtagtcctccgcttactcgtgcagggttggagtacactgggataggctttggttcaaacctaacaagtacctctgccgaaaagtagtatataaacagtacgggagctcaatgacattgatcagaaaataagagtgaaaatggtggggattgctgttcatttgaggggttttccctttattttcttcattaaacaaaggggccgactgggtgggccgctactaggctgga

SEQ ID NO: 2155 - DNA, 4481 bp, Zea mays
ctcatcgcaacattcttcgtattgtttagaagccatccgtctatgaatcgaaaggaataatttatgtgtcatcggagcgcacagccgaacaggcacggtgatagtacggattcatgtatttcgtttcgatcccctcgcttttccgcgaatgaagctaggaatcatcaaaggcacggcaacccgattccaattgtataattattcggccctatccatcgaccagccacgatcagttacattcatcggcggattcttctcagcacgcacctcttcgctttcggtagccgcgcgccggctccgatctataccgaacccgcaccgcaccactcccctgctcgcgttcgatcacaacggcacaggaatatttcattcgagcgagtgcgatctcaggtggccggggctagctggagtagtcgatctcattcccgaccgtacatgtttatatacacgttaacacgtacgatacgattaaacccgggaagtggctataaattaataaaggcgccgaacgcgatcggttctctgttggtcgcgaatcggatcacatcgccgtcgtcggccgggttctgaagctagctagatgcagccatcatatcgacggcacccaggcaatggaagcagcataatgtgcctcccaagcaacacatagagaatctcgccaaagttcgttcacgtggaacggccaccggggggactaaaaatataagagttgactcgcttaatttggggggaaggttgtatacggtgtagtgtgtagtgatcggcacagacctactaattaaatcccgcaggcctgcagctttgctttctctgcggaaagagtatgcacagcaacgaagcgctgtgggaaaactttgagcggcgggaggggtgggggccagatgagacgagagcaggacgtatgacatgatgattgaatggaaaaagcagcaaagggagggacggaggagtcacggatctgctgttttctttttctttcttttgctcagattttagagagagaagctagctggatggatgaattgtgtatagtcacggacgagggcaccgaccgttgggtgcaaatgctgctgacacggacggacgaaacggagggaggagctctccgcctctcccttgtcctttggtgtgaggccgggcccgcagcacgcagcacaatctattcaacggcccattttaagaatccccagcagccccatggcgtgaggcccacgcggctacaacactagagcgtgtacagagcgtaccttagaatgcgatgtttactttacgaagtttaaaataagtagtgagatacgaaggtttccaaaaaaaatataggctaacacgcacatcggtttctatcttaaataacagtccatcatccttttaggttgccaggctctaatccaaagctagtcgccgatctaacaaagcacctacgggctacggctttatcctttaacttccttgtgacgttctagcttttggtggacaccaggctttagcctttcgccctttcctgcccaacttgatttattgtatagtatataccacgagagcgcagtccatagggcgcacgcactagatgcaaccgtgccgtgcaggccgcggttcgcctctgaacaaatcccacgcagtagatttgctcctagtcctatataaagtgagagagagagaaaaaaaaaacatagcgtagtactagtagctttgcaaatggaccggctttgccccccaggaaattccgcgagccgaatctcacggcctcgatggaatcggcagtcacgtgtcgataccactcccccggtaaacttaacttagtgcagagaaaagtggcagcggacagaaagcgcaccacacactgtactcgaactcgactcgacccccgtactagtactcacagagaagcatgccgccgatgctaatgcacgcatgtggaggatcccattagtagtctaaaacgcatcgcagattggacccctaataaattaataagtgctgctgcagtttgtggatcgccgaatcgaggacaaaagctactactgctatcgaaaatggtcgccgccgtggcctgtagtaggtgtgtactagcctgtaggtgtagtgtagtacgcgtagacgaagggagaaaagtgaaaaagctactcgtaggttgggctcgtgctcccgtcgcctttgacatgtcacgctccacaatgcgccgagcatggggggaggaggaggacccaccggagagaagagatggaaagcaagcaaaggggggaaggcgggcagtggcacacaggccggtggtcgatggctggagatccgcgttctcgaagtgctcgctcgctttttcttcctcctcatttccatttccaccgcgttttttttatcctgcactttacactgtactgtatgggctgcgcctgctctgctggtgctgtgtagtgtagtgcctcctgtcaacatgactcctccaaaaggaaccaatgctgtcaagacccccaaaaaaaaaggtcagtgccgtagcagcctagcgaaaggcaaatgcgaggtggagagtggagacgtggagtggacgactggagtcgcctcgcctatctatgccccggccattacgcggcttaacaaagaaaaaagcgtcgttcttggctgccgcttcacgtcacgagagcagagaggcagaggcaactgcgtgcgccgcgcctgcacgcgggcccgggcaccgggagtccggtacgcacgcacgaaaggagtggcagttgccttgtctcctctcctctcctccgaggctccggcgttccttccccatgctggttggtttccttggtcgcatcttttctggagcgcaggccgcggctttgactggagaacagctgcctccgcctttgcagtcctaccgtaccagcagaacttttggggcgtgtgattagccatgaaccgtactactagctggaccccaccatgaggaatcgcgtcccccacaacacggcaagctagctagctaccaagcaagcaagcacgcacgcacgcagactgatccatctgagccgtctcgtgtaccgagtctctgctacacccagcgcgcggtaaaaaccgacgccacttctacggactgccactactcggtgactgaccgaccgcaacgtagtacgttggccttgacgggacggggatgacgcaccggacaagtcaattttgtacagacaaagatctgtcccgggagtaccctcgcgtcatttatgcggtgtgggcgagaggagagaccagcgcccgcacgcagcgctggtgggaccacgctgcccattcggcagatgcgatcccctctactgctggcctccatcctggccgtggacgatgtgaacagggccagatcgccactccacgttggtaacatgatgcttcagtacaactacaagcagatttggcgtcacgctgaaacaataatacatgtcgagggaagctccaagtatagtagaataccatagcttttcgtatctaagctttggccgatctcctcattaatacaacaagccaacactaccccaaaaaaaaatactactagcacatctgagaaacaaggtaccagaaagatattccaggggagaacagaagttagtgccaattaccagtagtacagctaactgcgtctaaaattagcctactatgctgcaacttggagcatctctacatttactactcaacaaagctcgccgcctgaccccgggagccagcggatctcattggacaacgagtgccgccaccgcgcgggaccaacacgccggcagggcccctcccgcctcgtcacagcaggacctggagcgaggcgttcttgctagcgccgcagacggggcacgcctcggcggcggcctcgcacgcgcggcacaggcagaggtggcggcacgggagcagcagcacggacgcgtcgccgcctccgcaggacttgcacgacggcggcgaggagccccgggacgcggcgtcgcagtcgtcggcgacggggcccggcggggaggtctcgaagcagcaggaccgcgcgtcctccgcctcgccgccgccacaacgccggcgccgggctgctgctgctgctgcagctcgacccggtccagcgtggcgcggagccccgcggcgacggcctcgtggctccgggcgacgcccagccacgcctgcccctcggcggccagctgccggagcctctcctccagctcggcgttgcggcggcgggcgcgccccagctcggcctccgccagccgcagccgccccgccgcggcgcgctgcacggccgccgccaccgcgcgcgcgtgcctccgccgagcctcctgcagccccgcacgcatcctctcggtctgcggcaagaccacgcgagcaagagtcagacaacgtgtgggggagctcgccggatctgtcaagacggcaacgactgactaccacgcacctcgagccgcaccagcgcgtcgatctccatgccctggcggtagagcagcgacaggacgccgttggtggtggccgccgcccgaccactg

SEQ ID NO: 2156 - DNA, 1641 bp, Zea mays
ttattagctcaatgatgatagcggtgtagtgagacaacgtgacagtctgggttttagtgtctgggttttagtgtgttgttaattttcagcattgatattctttgtgcctagtcatctctttcactatattgtgcaggctgattatttaagttcattattgttccttaattcctgtgcacactgttttgatcttgatattcatgcttgatttctaggcttataatatttgatctaaaaccctgatttggtaagataggactgtcacgttagtcgaggatctttgatcaccacttagcgttggagggctgtttagtgcagcaacccgctattttgagagcaatattttgagataaacaatcatgtttattagtttaatctgccctcttcatctgcaagccatgtttaatttccaaatggacctgtgtagctattttacatgtttacatgtcttagaattgctactgttcattgctgctataattacatatggcatttatctgagttatatgcctgttttattcggaattagaatatttaatttatttaaatatattgaaagcatgtcacttatttctctaaatttacaacaatccagaaaaccaattcgtattatggcctccagttctgatgtcattaagcctgaagcgttcgacggcgcaagctttaagcgctggcagattaagactcgcatgtggctcactgacctaaaattattttgggtagtgacgtcggctgttccccaggctgcatcagatgattctgatgatgcagcgaaggccgccgcactagcggagaaggccaagtgggacgaagccaatgaggcatgcttgtctcgtctgctgaacgtcttgtcgaaccgcttatttgacgtgtactctggttttacctccgccaagggtctatggactgaacttgagaacgagttctctgaagttgacaatggcaatgagtcattcacaacggaaaactacctcaactataaaatggttgagggaaggtctgttatggagcagctacaggagattcaactccttgttagggacttggtccaatatggctgcgtcctaccagacagttttcaggtgaatgcaatactggcaaagctcccgccttcttggcgagactttgtgacttcacgccgccacatgaagaagcaaatgactctcactgagttgtcagctgcgataaatgtggaagagcgtgcaaggtccagtaacaagccatcccagcaactccaggctcacgttgttgagaagggtggagatagaaaattccagaagaagaagaagaactctccacagaagaatatgaaccaacctaagtccaaaaagatgaagaagaaaaaggaggactttatctgctacgtttgtggtgtctccgggcatacagctcggagggccaaacttaggaagggaaaaggtcctccacctcagcgcaaagaagggaacgtggtggttaactccaccccagggtatgcacttcaggcctgtatggcaagtccatcagatgactggtggatggatttcggtgctactgttcatatttgtgctgatcgatccatgttctgttcattccagggattcaacagcgcaccagtcttgatgggaaatggtgttccggcagcagtttgaggtactggac

SEQ ID NO: 2157 - DNA, 624 bp, Zea mays
  misc_feature (616)..(616): n is a, c, g, or t
atagtagaataccatagcttttcgtatctaagctttggccgatctcctcattaatacaacaagccaacactacccaaaaaaaaatactactagcgcatctgagaaacaaggtaccagaaagatattccaggggacaaccaaagttagtgccaattaccagtagtacagccaactgcgtctaaaattagcctactatgctgcaacttggagcatctctacatgtactactcacaacaaagctcgccgcctgaccccgggagccagcggatctcattggacaacgagtgccgccaccgcgcgggaccaacacgccggcagggcccctcccgcctcgtcacagcaggacctggagcgaggcgttcttgctgttgtcgccgccgccgccgttgcaggtgagctcgctgcgcggctgggtgtcgccaaacgcggcgacctcgaagggcgccggcgccggcgccggcgcgcacccgccgaagccgagctcgtcgaggaacgcggagccgccgccgccgaccgtggcgccctccagtgccctgaaggcgtgccccatgtcgtggggcaggaaggcggggttgagtaggtgctgcgcctggacggccatggacaccggcctgtncttgcggg

SEQ ID NO: 2158 - DNA, 1347 bp, Zea mays
acgtttcctagggcacggtaatgccatgccgtgagagcaagagaggaggtagggaaaaggaagttggctttcctggcggcggcgcgctgcagcctggtctttcggccgtgctgcagcctggtctttcggcgctcgcgaattcctggccgtcagctgcgcaacctcctctagttcggctccataactatggagatttgctccctgctcagcaactcgcctaaaatcgctagctctctgttcctattcctcctctcggttccagtcacggtttggatcgattccttcgattcttggtgttctggtgttaatcctgctggtggaagaaggtggaggtggccctgcttgtgcgcagcgcggttttcctgcgctccgttgtctcaccagtgcacctgtgtggtgctctgtctgttctgattattgtccaccgtggactggtgcctgggctccctgttgcgtggtgttcgtcttctcgggctggtgtcgtggacgtctccctcggctccggcagcggctctagtatctccgtcaacctcccgccgtgcaggcccggacgtgggcgacggaattggttttctgggacagaaccttgtgttcgctgagctggtcttcccacgtagacaatctacgtgttgtgagttattcgttgtcttactttatttactgtttaattttgtgcaatctgctagtatcaaatacttgggtgtgattgcactgttgtgggcggatttatgtgttcgatgatgatagcggtgtagtgagacagcgtgacagtctgggttttagtgtattatcattttcaacaaaaaaaaaaaaaaaacctagtcttctttcactattgtgcaggttgattatttaagtttattattgttccttaattcttgtgcacattgttttgattttgatattcatgcttgatttttaggctcataatatttgatctaaaaccatgatttggtgagataggactgtcacgttagtcaaggacctttgatcaccctttagcgttggaagattgtctagtacaggaacccgctattttgagagcaatattttaagataaacaatcatgtttatttgtttaatctgccttcttcatctacaagccatgtttaatatacaaatggatctgagtagctatgtttcatgttttcaattactgaaattgctactgttcattgctgttataattacatatgacatttatttgagttatatgtttgttttattcggaattagaatatttaatttatttaaatatgttgtaagcatgacacttatttctctaaaactacgacaacgacgggccaactgtttggtgaaaaaccggagcccttatttctcctgcag

SEQ ID NO: 2159 - DNA, 1788 bp, Zea mays
ttttttttttttttttaaataaaaagggcctggttttcataatttcaacacacaaccaccccgtagggcttagggttctaacttgaaactgcagtaaggcccactcagcccgtaattcttcagccgccagcgatccagctctagcgtttcttttttccagccccagaagctcgacgccggcggtgctccacgggagccaccagccccacctccatcggaggcagccaccggccacgggagcagcacgcctcctgcatcaactgctggcagccaccagccacctccatcgttggctacttggctccctcctccttggtagaagatggccccatcctcgtcctccagctccgatggacatggccatgctgctccgcgccctgggactggtagagttcaagtggcgttgcctaacgcagatgctgctgctgaagctgatgcagaggttagtggtggttatgctgaatctaacgagccaaattctactggtgctccatcatgtgggtctggtgtcgttcccaatgattctgagtctatagttgccaaaacattagagaagttgccaccagagcttgctgcactagctaaagatcctaagaggcatgctaaatctaaggaccctgggtggaagtatgggttctggccatatgaagggaagaaggatatggttcaatgcatattttgcaaaaaggtggttcctgcaggaatcaagagattcaagcaacacatcgcaggtggttatgcagtcgtcgagaggtgtccagctgcacctgcaatgatcaggaaagaaatgtttgattttttggtgaaaaatgcaagaaaagaactgaacttgcagcaaggaagggaatgggattctgaaagtggaggtggagtgcaagaagtacctgttgtgccaagttcagggacaagagttaaggaaaataaaaggaaggttcaagcatccattggttcttatatggatccagttaagcaagggtcacagaagtacaccaaaaatgttgcttcaatgttgtgcaaatcacctgaagaagtggtcagtgagagacataattcaaagagttatcaaccttcaatggagcagtgtacacagaaatctaaggaatcaaagcaagtagttgatgaccatgttgcggatttcttgtatgagaatggaattccattgaatgttgttaactcaagaagctgggaaataatgttagagtccataggacaatatggtcctgggtatctgtcaccttcgtaccatcagttgaggaattcattacttgagagggcagtagacaagacaaatgaggtgagaaagaagcatgaggaagcatggaaaaagtatggctgcactctcatgtcagatgcatggactgacacacggcaccgtcatctcataaacttttttgtcaagagtccagtgcttgttgaaaatgaagaaaatgaggaagacgttgacatggaagatgaagaagatgatttcaatgaaatgcaggacgacgaagatgacgaagaggatgaggatggtggaggtggagctgcaggggccttccgagtggatgatgctttactttgagcatttactcattccatttcgtttccaggaattcagacaatcatacttgttagtttagttaatttcagtttcagaattcagactcctttttttatcaatgttccatgctgtgtaatgtactatccaagtgttctactgttctggagtggaacagccaagcagcaaaaaaaaaaaaaaaaaacttcaaaaaaaaaaaaaaaaagaaaaaaaaaaactcgagagggggg

SEQ ID NO: 2160 - DNA, 975 bp, Zea mays
gcaatgtcaacctccgcagttgtcgttggctgcattaacaccactccagagcagtacatctggtgtaggtccgcaacagaaaagttgttctgcgagctgggtgcccactaacgtctcaggcagaagcaaggcggcgttgccttcgcatgatcctgaaatggaggtagatccatggaatctgctcgaagatggcacaagctgcccctcaacagcatctggaagccatggcgcgagtggagtgacgggtgaccatgctaatctgaaagcgtgcagctggcttaagggtgctgtgagggtgaggaggacagaactgacctacattggctctttagacgatgacacctgacgtgtgtatgattattttggtgaattgtggaggaaattagtctcacctgttggcactggagtgaatggtggaaaccaaccatggcccttggctttaggatggttgttgttggtgtagaatacatacacatcgctgcccccgttttgttttgttttgttttagggccttgtgggggcggctgtatataatggaaaaacatttgatccattactgaggcatggcccgagaagacaccttcaaatgggcttctgtgtaagcttgcttatttgagaagtaggaagccatgcagtagattttgtatccaaaagccgtgtacttgtttttgtctgatatgtaatctagcgcatgtcacacatatgtattcccttcctttgattgaagggctaatggtatgatgtctttttttttttgataaaacatgaggggtgagagcccctactggaaattaaataaaaaatatgtacaaggagttacacgtttcttaattactcctgttgtaaaatatagttttttctaaccctctttttttatgcccacattcaaataaatgagaggtcaaatagacatacaataggatgtaagggagcaagacgatgggctcggatggtaccttaatagaggtgtggaaa

SEQ ID NO: 2161 - DNA, 2121 bp, Zea mays
cagctctccaaacagctgcaacagtgtcggcttgtagccagccgaactctcccatttttgttagggagtgttcatcgactgttcatgtttgattgctctgcttcgttgagaagcttttgctcgtttctgtccgcgacgcggaagaccagccgtttctgccgcaagacacggcgacgaaaccgatgtgcggaacgagagcccccggtatccaggaaaaccagcgcccgcggccgcttgtttgccgtcctccctcccgtatatatcaacccgcccaccacacctccaccccaaacacacaacacaaccaaccgcctcagtcctcactcatcactcgcacagtcgcaagtccaccaatcgccaagcaaaaagcccgagaaagaaagaacaaacaggagacacagatggcggctgcagcgaaggcgtcgtggatggtggcgatgagcgtcggggccgtggaggcgctcaaggaccaggcgggcctgtgccgctggaactacgcgctgcgctccgtccaccgcgccgccaaggccaacgctcccagcttcgcgcaggccaggaagctggcgccgcccgccgcggacaaggccgccgcggaggaggggatgaggaccgtcatgtacctcagctgctggggccctaactagctagggcctctgctagtttcggcttcctgcaaccgtaccgagctcggcttcaaatctgatccatgactggttgccttgccgacccactgtaacataggagtatagcaccacgatgatgatgatgaaaagttctgccacttgatttcagttcctcaaaactctgaatccctacgctactgtgctggcatggaaataaaatgaagagtgcatttctgttcataaaaaaaaaaaaaaaaactacggaacggtggccctaaggattctagatcggattgtttgcctaattaatataagtatccatgaattggaatggatactggatgcattctgaaacaactgaacagctctaaggtcttattcgtttgtatcgaattgcatctttaatcgtttcaactaattaaagtttatataaattagagaatcaatccggttagaaatcgtttcgatttatcaatccggtacaaatgataaggcctaacatgtttttttctgggtggattggcgtgtgccactctgccagacacgtacgagtctggtacaaaccacaatagctctggaatgccttctttaatgtcacctaaaaatttggtgcagcccggaaaccagggtgtttatagtcccccacaaaaagaaagatagatcctacccgcagtagaaataactaaaacgttatctaatagtaagtttataggtgggatatatctttttttctgtggggggctataaacatcctagtttgcatccggtctgtaccatttttttttccgtcgcatggcggtgcgctttggtcgtttaaatagaacttgttttgacacgggaggagtatcttttatcgatggtacctataatacaacatctgagatcttctgttatttcaactttccactgaaatctactgaacgaaccttataaaaacagtcgctaaagaacaagcagctgaaccatcgatagattatcatagccacaaaatatctagtactgatagcaataaaaaaaatattaacagtcagcctatttaaataggtcccatgggtactatcgatgttcatgattagagtctactgatgaatcaaattccatatgcttctggttattacgagaattcagcgtggtgtcttcgttgagaaatctaattaatcgttgaatatatatatttataataaatttatatagatctactccagtagacgagtagcgaaattcgatgttttccgtacgagatgtatgactcatgtatgtaactgccagggacgtctgcatctgaatctgataggccagggcaggtgtctctgttgcatcagcaaacttggaagtggaaagggaccgcgcacagggccacaggcacagatacgacgaaggcagcgcggaaaccatgtcctcgagcccgctggtttgaagttcctccgtccgtctctcccatagttcttgacgctgattcgtgtcccagaggccagaccatgtggtaaaaaacctgcag

SEQ ID NO: 2162 - DNA, 810 bp, Zea mays
atctcgtccaactcgcgaccgagagaagagagggcaagggagaagattgccgccgctaccgagctggtggttggtcaccgctgggacctcggctggctgctcgtgtgtgcgctggggtggagtcgtcagcgttcgcttcatctattgacggtgtgcggtccctgggccacctcgagggcccgccggccgccgccgggcacctcagcacaacactctccccagctcgagtaaccacagcgagaaccaatcgccaagcaaaaagcccgagaaagaaagaacaaacaggagacacagatggcggctgcagcgaaggcgtcgtggatggtggcgatgagcgtcggggccgtggaggcgctcaaggaccaggcgggcctgtgccgctggaactacgcgctgcgctccgtccaccgcgccgccaaggccaacgctcccagcttcgcgcaggccaggaagctggcgccgcccgccgcggacaaggccgccgcggaggaggggatgaggaccgtcatgtacctcagctgctggggccctaactagctagggcctctgctagtttcggcttcctgcaaccgtaccgagctcggcttcaaatctgatccatgactggttgccttgccgacccactgtaacataggagtatagcaccacgatgatgatgatgaaaagttctgccacttgatttcagttcctcaaaactctgaatccctacgctactgtgctggcatggaaataaaatgaagagtgcatttctgttcaaaaaaaaaaaaaaaaaaggggccaaaaaaaaaaaaagcccccaaaaaagcggcc

SEQ ID NO: 2163 - DNA, 2532 bp, Zea mays
  misc_feature (2448)..(2448): n is a, c, g, or t
  misc_feature (2462)..(2462): n is a, c, g, or t
acgccatcaacagtaccattcagatcggaatcccagttagctctctgtgccctacctgtcagtgacacagaaatccagtcggcggggctgccgcctgccgcatcctcccctcgcccaccgtcgacgacttgatcccctcccaccgttgaggccgcctcctcacggcagcgagccagcgactcctctcttcttcgtctcctacaagtagccagacaccactccgactttgccggcaacccgtcgacagcgacgaggcgcagcataaggcatacgggcacggcggccatggcgaccagctccaaacccgccgcgcccgtggaccccatggtcgtgctcgcccacgagttccccgaggtgtcattcgactacgacgagagggatgtagcgttgtacgcgctcggggttggtgcctgcggcgatgacgccgtcgacgagaaggagcttcacttcgtgtaccacagggatgggcagccacacattaagacccttcctacttttgtttctttatttcccaacaagaacagcaatgggcttggatttgttgatgtgcctggccttaactttgatgcaagccttctactgcatggtcaacaatacatagagatctataggccaatcccttcgtatgccagtgttgtaaacagggttaaagtagctggtttgcacgacaagggtacctgctccctcccatcctgaattgataatttttttactgactggatgatacatatacttttttatcaccatgctccttgttattttttcatccttaaaattattgtccatgtttccctatttcaacttcttttttatggtagctctaactcatgttatttcttgatatgaaatatttaaaatttggttgaactaggggggtggttcagcattttgttatagactaacaattgtcaataactccatattgagataataagaaccacatattttattttttgcacatcaatgaatgaaacacatcataaagctacaaaccatttccataaaatcataatgaagaacagtataccgttgtccttcacgtgagtgcctcaaataaaacctgtttattatcatgtgatagttttgtgcttgtagtagaattttgaagttggagctttgttcttggaggaatgaatggttattgtgaaaaagatctttatttttcaactatatcacgtgtaactattaacttggtcctttcaactttatctctgtgcttgaaagtgcccagcacccactcctgcagtacttttggtcaaactgccaaagtactacttggtacttagtgttagatgtaaatagtgtgcatgtatttagtctctagtacagggtgctgtttgcactttgtacttcatatttggctctttggccgttgcaataggctgagctgcacattcctagcacttagcacctttaattttaatcatcataaatgccggccgggaatcgatttcaccactgattgcttcctttctgccatttgccgtaactgcaaaaatataagggattatactacctccgttctcaaatatttgtcgtccgctagttcatttttgaactaagatacgataaataaaaaaacggagggagtattcaattttattgaattgattctaccgatgcactattttaatgtgcagggaaagcaactattcttgagctcgaaactaccacaagcctcaaagagtcaggggaaattttatgcatgaacaggagtactatctacttgcgtggtgctggagggttttcagactcttcacggccatactcatatgctacctatcctgctaatcaagtttctcgcatttctattccaaattcggcaccttctgcagtatgcgacgaccagacaaagcaatcccaggcattgttatacaggctatctggggattacaatcctttgcattcagacccagatattgcacagcttgctgggttcacccgtccaatcctgcacggcctctgcaccctaggattcgctgctcgcgccgtcataaaatctttctgcaacggcgaaccgactgcggtgaagagcatcttcggccgtttccttctgcacgtctaccccggggaaacgttgtccactgagatgtggcttgacggccagaaggtgcactaccaaacgaaggccaaggagcggaaccgagctgtcctctctggatatgtgttgctccagcacatcccctcgtcattgtaagtaaaagttttgtttcttaaaattggtgcccgctgaaagcatttggcttggctgtgataaattgagcacgaggtgggctgccactgtaatgatagccatgtatgggtctgcacataacacattcgtactgtattgataagaagcacgtaccacttaaatacgcaaaaaaaaaaaaaaaaaaaaaaaccaaaaaaaaaaaaaaaaaaaaaaaaaaaaaaaaaaaaaaaaaaaaaaaaaaaaaaaaaaaaaanaaaaaaaaaaaaanaaaaaaaaaaaaaaaaaaaaaaaaaaaaaaagggggcggccttttaaggattcaaattttatttcccggg

SEQ ID NO: 2164 - DNA, 1599 bp, Zea mays
ctgcagctatagtctataaaaacaaaaatattatataaatagtagaaacccggattaaaaccaagcgaacgtacttcttaacagtcggaactcggaatcggaagtggcgtgaagcaacgaaacagcgacacgccatcaacagtaccattcagatcggaatcccagttagctctctgtgccctacctgtcagtgacacagaaatccagtcggcggggctgccgcctgccgcatcctcccctcgcccaccgtcgacgacttgatcccctcccaccgttgaggccgcctcctcacggcagcgagccagcgactcctctcttcgtctcctacaagtagccagacaccactccgactttgccggcaacccgtcgacagcgacgaggcgcagcataaggcatacgggcacggcggccatggcgaccagctccaaacccgccgcgcccgtggaccccatggtcgtgctcgcccacgagttccccgaggtgtcattcgactacgacgagagggatgtagcgttgtacgcgctcggggttggtgcctgcggcgatgacgccgtcgacgagaaggagcttcacttcgtgtaccacagggatgggcagccacacattaagacccttcctacttttgtttctttatttcccaacaagaacagcaatgggcttggatttgttgatgtgcctggccttaactttgatgcaagccttctactgcatggtcaacaatacatagagatctataggccaatcccttcgtatgccagtgttgtaaacagggttaaagtagctggtttgcacgacaaggggaaagcaactattcttgagctcgaaactaccacaagcctcaaagagtcaggggaaattttatgcatgaacaggagtactatctacttgcgtggtgctggagggttttcagactcttcacggccatactcatatgctacctatcctgctaatcaagtttctcgcatttctattccaaattcggcaccttctgcagtatgcgacgaccagacaaagcaatcccaggcattgttatacaggctatctggggattacaatcctttgcattcagacccagatattgcacagcttgctgggttcacccgtccaatcctgcacggcctctgcaccctaggattcgctgctcgcgccgtcataaaatctttctgcaacggcgaaccgactgcggtgaagagcatcttcggccgtttccttctgcacgtctaccccggggaaacgttgtccactgagatgtggcttgacggccagaaggtgcactaccaaacgaaggccaaggagcggaatcgcgctgtcctctctggatatgtgttgctccagcacatcccctcgtcattgtaagtaaaagttttgtttcttaaaattggtgcccgctgaaagcatttggcttgtctgtgataaattgagcacgaggtgggctgccactgtaatgatagccatgtatgggtctgcacataacacattcgtactgtattgataagaagcacgtaccactcaaaaaaaaaaaaaaaaaaaaaaaaagtgcagcaagatgtacccggacatggctgagcaggtgaccaccaccacccaggctctcatcat

SEQ ID NO: 2165 - DNA, 1254 bp, Zea mays
ggccggggtgtcataccctatgtggagccggagccgccagtgcctggcccactacgaaattgtacccatccccaaccagatcccccgcttctcccgcaaccgcgtcggcgatggcatccgcggcggcggcgaccggcgacggcgagaaggcgcacgcgcacctagggcagcctctcctcgtgccgccgcagccccctcaacaaccctactacgcctacccggccgcctcctacgtgcagcccgccccaccgccgccgccggccccgacgctcgtcttcgtgccgtccccctgctccccgatgctcgtgcgcctccgccgcctgcgcccgcgccgcgcgtcctgcctccgccgattctgcgcgcgcgcgctcccgctcctcctcttcctcgcgctcctcgcggggctcgccttcctcctctacccgtccgccccggccgcccgcgtcgccgacctccgtgtcgacagcttccgcgcgcagccgcccgtcctcggcctcggcctcgcgctgcggctccgcgtcagcaaccccggcttcgtcctcccgctccgctaccgcgcggtctccgccgccgtctcctaccgcggacacctgctcggggccgccaaagcgtggcccgggtccggcgagcttgcggccagggatgaggtctatgcggatgctgaggtgtgggtggacgccgggaaggtgctggatgacgtgatcgagctcatcggggacgtggccgcggggtcagtgccgcttgagatcgtatctgaggtagtcggctcgatcaaggtgttccgtttccacattcctgtgaaggggctcatatcgtgctcggtaagtatcagcccagtgactcagggaatcataagccaggattgctactaagcgcgagtgtgggaggctcccgattcccgaggatattttaaacctgcagagcctgctcgatggaactgaagtacttactatctgtatataatctggatatggtgttgtgttttgtgtaggctggaataatgtagtaatgagtaacggatagcatgctgttggaccacaggggtatatgttatcttgcagtacgtatcagaactgcctatgtctattttgtagctggtgggatgccaccttagtatagttccgttctcgaatatttgtcgtctgcgagtttatttttaaactaaaccgtgacaaataaaaaagaacggagtagtaagttaatcatgggggatgattttactagggaaaagtactctgcgttgttaccactgct

SEQ ID NO: 2166 - DNA, 1251 bp, Zea mays
  misc_feature (3)..(3): n is a, c, g, or t
ccnggccggggtacccctacggggcccgccacgcgcccacccatccccaaccagatccccccgcttctcccgcaaccgcgtcggcgatggcatccgcggcggcggcgaccggcgacggcgagaaggcgcacgcgcacctagggcagcctctcctcgtgccgccgcatccccctcagcaaccctactacgcctacccggccgcctcctacgtgcagcccgccccaccgccgccgccggccccgacgctcgtcttcgtcccgtccccctgctccccggtgctcgtccgcctccgccgcctgcgcccgcgccgcgcgtcctgcctccgccgattttgcgcgctcccgctcctcctcttcctcgcgctcctcgcggggctcgccttcctcctctacccgtccgccccggccgcccgcgtcgccgacctccgtgtcgacagcttccgcgcgcagccacccgtcctcggcctcggcctcgcgctgcggctccgcgtcagcaaccccggcttcgtcctcccgctccgctaccgcgcggtctccgccgccgtctcctaccgcggacacctgctcggggccgccaaagcgtggcccgggtccggcgagcttgcggccagggatgaggtctatgcggatgctgaggtgtgggtggacgccgggaaggtgctggatgacgtcatcgagctcatcggggacgtggccgcggggtcagtgccgcttgagatcgtatctgaggtagtcggctcgatcaaggtgttccgtttccacattcctgtgaaggggctcatatcgtgctcggtaagtatcagcccagtgactcagggaatcataagccaggattgctactaagcgcgagtgcgggaggctcccgattcccgaggatattttgaacctgcagagcctgctcgatggaactgaagtacttactatctgtatataatctggatatggtgttgtgttatgtgtaggctggaataatgtagtaatgagtaacggatagcatgttgttggaccacaggggtatatgttattttgcagtacgtatcagcactgcctatgtctattttgtagctggtgtgatgccaccttagcatagctccgttttcgaatagttatcgttccctagtcggcaaataaaaaagaacggggagtagtaagttaatcatggtgtatgattttactagaccatgcatgatgtatggtggtcctcccggcacgtagcttatcgttctccgtgtggcgtttgaattcaagcgtg

SEQ ID NO: 2167 - DNA, 1497 bp, Zea mays
cattgggtacctcctccccgcccgccgggcctccagcccctcccgtccgcaaaaaagaaaaaaaccacaaagagattcctctcaccaccaccaaccctagacgatcctcctccgccatgatgcgggacggcgtgcctccgtcggtggccggctccggcggcgcggcgggcggcgacgggcccaggcgatgctcgcagtgcgggcaccacgggcacaacgcgcgaacctgcacggcgcggcccgtcaagctcttcggcgtgcgcatcggggacaagcccatccggaagagcgccagcatggggaacatcgcgcacctcgccgcggagggcagcggcggcagggaggaagggtacggctccgacggggagcgcccgcacaagaagcgaggtgaggcatggactgaagaggagcacaagaagtttctgcttgggttgaataagctagggaaaggcgattggcgtggtatatcccgtaaatatgttgtttcaaggacacctactcaagtggctagccatgcgcaaaagtatttcaatcgccaaacaaatgtgcatagaagaaagagaagatcaagcctattcgatatggtgattgatgacccgtctgatcaacttccgctctcgcgttcatcttcacaagaaatggagcagcaacatttagatgatccacagcctgttgcagccctgcctgcacctgtggtctctccagctactgtggtacctcctgtgcctgtggaagtgtctgcttcagttccatcgccagttcaggtcccagttccagtttcagccccagtgatgacatctcagcctatggaacaggactcagataccacaagttcaattgctggagaggcaggaacggtgatgccaggagccatgcccccctatctttatccaatgatgattcctcctccatactaccatactgcttttgtaccaatgccctgctacggttatgttcctttttactgtgagccacaaggtgctgcacaggctccgcatgaggttgtcaagccagtggctgttcattcaacgcctccactgaatgccaaagacctttacaacatgtctgaattgagcctgaagggcgactcgaatgcaaacggtggtgtgcctgcttcccccttgcctccgaagccgatcggtagaccagagaggcaatctgctttccatggcaaaggacctacacctaccggtggctcgtcaggtggactgattcctgcagtcaagtgaattcgattatgctcctaaacatgccttcatgtgtatgtaatactagaaatagccaaatcgtaatagccgcctgtgctgctaaaatggtggtgtgttttctagcaaaatatctatactgctcattttagccttcaccagtttggaagtcatgatccgagggtaaatatattgttagcttgttgtttttgcaaaaaaaaaaaaaaaatccccatcaatttgccccaattttcttcatcaatccttaaagttatcaattattatttgtttt

SEQ ID NO: 2168 - DNA, 953 bp, Zea mays
agcatgaatctggaacgagaacagttgatcagaatgtttggggggagatccgcaacttcaggaagtgtctgctgaagatgtttgcacagcaggacaaggatgtgttgtttatggagactgtcataagcctggccagacaacggagacactgcatgattgagtgcatccctgtcccttgtgaagtgtcaagcaatgccccaatgtacttcaaaaaggctattgatgaagctgaagaagaatggacccaacatgagatgaagaaggttatcccgacaagtgcaagccgcaacttgaggcaagtcatcccggagaactttgcctacttccatgtggagttcgggctggaccgtggctttgttcatgtaatagatgacgagagcaagttcagtgctggatttggattgaatgtcattagagggatgctccagttgccagaggaggacatgcaccgtcgacgaaggcacgagtccatggataaccagaggcaggctgttgctagcttcatgaaagattgggagcccttcgattggacgaagcaacttgattgaatgtgaatacagttttgagaacgctcgaagaaaaattgcacgacttgtactaaaagattttgtaggaaacttgtattgatgttatgctatcactttgttttgtttcccaacatatatgtttatttccccagaaactaacaggcgcatgttctagctgtaaaatgatatcgactgagcaatgactgtcatttaaacttgcataaaaaaaaaaaaaagtgtgactaattttaaaccttcacgctttttgttattcttgcctatcatgcaggtttcttggtatgaacatagatttcacctggtgccttggttatccactgaaaactcagaagaggtttcggcttccatctgccatcgaaggtaagctaccaggtaatattatgtttctatatattgagcgggctgcag

SEQ ID NO: 2169 - DNA, 5715 bp, Zea mays
  misc_feature (262)..(262): n is a, c, g, or t
  misc_feature (3366)..(3366): n is a, c, g, or t
  misc_feature (4709)..(4709): n is a, c, g, or t
  misc_feature (5075)..(5075): n is a, c, g, or t
  misc_feature (5130)..(5130): n is a, c, g, or t
gagaaccactagtgaaaatcgatttttaactacagttcagttatgacaaccgttagttgaaattgattttcactagcggatgagatatgaaatccgccattaaaaatcttttttaggaaatataaactgggttttaaaagtagcaaaataaaaaatattatggacccccacactgacagcgatcgaattacaaagtttcgtaacttttagagatctacaacttttatttatatgattttacgtacaaggtcatttgagaaantaaaaaatctagataaaatgaattttactagcggatttcataagaaactgctagtagaaatgcacgattttcactggcgcttttttttaagaaaaccactagtacaaagttgtttccacgggcagttcttaaatcgggccagccaatttgttttcactggtactcgataaccaaaatcgcttgtagaaattagacttcaccgcagacatagagcttttttactagtgttttttatagtttttagagaaaaattgagctatagctctctatttataaaatagtatgtgctctatttttaattataagatgttttatgttttaatataatttttatatacttgtaagtacatgtataatataattaatataacgaaacttaaatatcttataatttagggccagttggaaatatagcactcaaaattttaaaaattggaaattagttcatttttatacctctctatggtatcaaaatgaactagctatctaattttgtacagttaagggacatatatacaattattaattctataatttatcattgagaagtagtcctagctaagtaccactagaggacccggaaaacggtaaacaagaaaccgccggaggcagaaaccggcggcccgaaggctggctcgcggaggccgggaaaacggaatgcggcagcggacagtcggacacctccctgcctccctggtttctaaccgcgactacaaaaaaaatccgagcctttcttcccccacttgcgccgctacggtccaggcgttcttgctgcctccctcgtagactagactctagaccactatatatacagtactcgtccccgttttcttcctcaccaacttctcatcatcagccaagtgtaaagagtgcgaagaagcagtagcaaaaggattccattctcgtgttcttggagtggtccatcgatcgagctccgtgaaagagagagagagagagcaagcaatggcgacagcagggaaggtgatcaagtgcagaggtgcgtgcgtcttctacctccacctttcgtgatggctactagctagctagcagcctaaatcactggattgattttgttcttggatccctctgcagccgccgtggcgtgggaggccggcaaaccgctgtccatcgaggaggtggaggtagcgccgccgcaggccatggaggtgcgtatcaagatcctctacaccgcgctctgccacaccgacgtctacttctgggaggccaaggtctgtgcctgctgcatctctagccgcagaacgttgatatgcatgagcatgacagatctgggcctaaccagtgatttttggctgaatcttgtcttgtgcaggggcaaaccccggtgttcccgaggatcttaggacacgaagcgggagggtatgcttccatctccctgtcctcttgtgctgttactgttttctctactgcctgtactgagctcatcactttctttccactgtttttttagatgtgcacctatgtgtcttattatcatgcgattctactagtttaatttagcgcgtcggttctaaacatagctcgtcaattcatgattcatctcgagcacagctggtttggcagtggatttaagatccactactaaagaaagcaagcgtgcatattttattgaattaattgggtataaattaaagcctcatgtgcagattcaaggaacacacaacgtcagccatgagcccatgacacaaagaatctgcacttaagatgtttattctttcatttttttctccataagacggatagagacaagctacagcagccaggaccactaatactagctctgttaatacgtctatttccaagctaacgacccgctcttggtcgcagcatcgtggagagcgtcggagagggcgtgaccgagctcgcgccaggcgaccacgtcctcccggtgttcaccggcgagtgcaaggagtgcgcccactgcaagtcggaggagagcaacatgtgcgacctcctcaggatcaacgtcgaccgcggcgtgatgatcggcgacggtaagtcccgcttcaccatcagcgggcagcccatcttccacttcgtcgggacgtccaccttcagcgagtacaccgtcatccacgtcggctgcctggccaagatcaaccccgaggcgcctctcgacaaagtctgcatcctcagctgtggtatctcgaccggtaagcaaagatgccatttccattccatggccatgccgtgctttagcaggatggcttacagcttactgaactgtcgccgtcgttttggtgcaggccttggcgcgacactgaatgtggcgaaaccagccaagggctcgacggtggcgattttcgggcttggggctgtaggccttgctgtaagtggtggtggaagttttatgaggtttattttttttcatatgattggaatatgtatggaatgaacactcactgtatactatatatgtttcaacgtacatgatcgatcaggctatggaaggtgctagactggctggtgcatcaaggatcatcggcgtggacatcaacccagcaaaatacgagcaaggtataactaaactaattaatgccatcttaggccttatttttttacaccaatccagctctgattaatgtggattggaattaaatctatatcataatccatactccaaaataatccaaacctaattaattttttatccagttaaacccatcctaaactataacaaaggctttgtgaattttttaaactatagaaggcatagattctatccatagctcactagatatgaaacaaaatccataaaaatattatacaaatttatattagaatccatgtattaaaaataagtaggtttgaaagatacatagattaaatgatggatttaatctcaccataagattgagtgtgaggtatggattcacccagttcagaaccggattaaatccatgatgtgatgtcatttcatccattgcaaccgaacaagaccttatatattatgtgtgaaatggcagttttgtacttgtatgattcttgatgcctgcggcacagagaacttacttccatttgcttttcgtttttcagctaagaaatttggctgcactgaattcgttaaccccaaggaccacgacaanccagtgcaagaggtgtgcttagctttgtcgcagtatatatattactgacggcgatcctttgttcaggacaaagaaactaaaatcctacatgtatctgatatccactgctcgttggtgctcctgtgttgcattgcaggtgctgattgagctgaccaacggcggcgtcgaccgcagcgtggagtgcaccggtaacgtcaacgccatgatatccgccttcgaatgtgtccacgacgtatgtgctcgcctcagctcaatcttgtgcgattctatcaccaccatcatctgctttcaggctgaaatggaactccgaaatgcaaatgcagggctggggtgtcgccgtgctggtgggtgtcccgcacaaggacgaccagttcaagacccaccccatgaacttcctcagcgagaagacactcaagggcaccttcttcggaaactacaagccccgcaccgacctgcccaacgtcgtcgagatgtacatgaagaaggtaagccgccgcctgaagaaccttggagtacgtacctgacctgcttacggttcaaccgtatccctgactgacgatcaacatgcgatgtgtgtgtttgtgttgtgtacgtacgtaggagctggagctggagaagttcatcacgcacagcgtgcccttctcggagatcaacacggcgttcgacctgatgctcaagggggagagcctgcgctgcatcatgaggatggaggattagagcttcattgcaagcttgctcctcctgcagggcaggcatgtcgcacagcaaatgggcatgaaaagttgaaggcgctccagtcctccagcttgtgtagtacacagtagcaataaaacgttagtgtttgtcctgtgcccatcctgtattattctgttccagggtttcacctttatcgtcagtgtgtggtcaggtttcaacccttctcagaacaaccccctcccagaaaaaaaacaaaggaagaagtttgtgtccaggtttcagaatcccctgtctgtaattaccattttgcatgacaataatgagatactgtagatattaataatgttccagaccttcaaggcctcactccctcgcaaattgcagatttacttgaggtaccattcggtattcacaaaatgtaacgtaaatagtagtgattaacactcgattaccagcgataggcagtttgaataagacggtgttagtttctagtgtggtatctgattacggttggacttaaataaacatatgtttaacgttatcggttaccatgtccacgttatagataggtgaaccaaacaacacctcgattgtcatgactctttaggcccccatttgtttccgttatttctaggcaagactcttanggtcgccgatttattcgcatcatcagattcttgttgattctccttgattactagtttaattttttttattcgggacaatagctcgatggcagggtaggtgtttgacaggattatacgattctcgagaccgtcgctgtcaaataagcggatgctatagatagtacaagtcaacaatttaggttctctgtgtcagtgccgctttgtccagtagggttccaagcatgtccatgggcccgggccgatcactccctgtgctgtcagcacatcaacggttttgtaaaataatctgtacgtatcagttttgaattgaaagttgcttccattccacaagtcaagaattggattccgcacgttattatatatcanccatggttcccgtgaagcgaatgagcagattctgacacgctgtagcaaaggaccngggaatcagtcaatcagcaaactaattctgatgtgcagtacaaaatagtgttttgtataactatatacccttactgagcaaggccttaggctgtctccaacaacgtcctctaaatttcatcctctaaaagaatattctctgtcctttacagcacactctaaaagatttcgtcctctatatcttatcagtctccagcaacatcccctaaatttggtcctctatatctacaatgctaccagatttcattatttatattgtttttacctatcgcttttataaaaagaatatttttttgtacatcacgaaattgaaatacttattacaatatattttcattttatggagaaattactcatcattcatatatagcaaaacaatgtatcacaaatttgtattatatattttccttcttgtatacgcaaacaaaaaaccgttagtctctatcaaaattaaaatagtttgactaagctattcgcaactgtattatgcaacaatccagcatcggacaccatttttttaacacaatatgcatgcatgcaacgtgggtaagtcaatcaacagtggtcgtcacgtacacaagtgtca

SEQ ID NO: 2170 - DNA, 852 bp, Zea mays
tcgaggggccggccggacacggaaacaaaatctacaatcaaccaactgcaaagcagaaacagcagcaaagatccatctttctctctgagtttccggagcgaccgggggagttgatggcgaccgccgggaaggtgatcaagtgcaaagcggcagtggcatgggaggccgggaagccgctgtcgatcgaggaggtggaggtggcgccgccgcaggccatggaggtgcgtgtcaagatcctctacaccgccctctgccacactgacgtctacttctgggaagccaaggggcaaactccggttttcccaaggatcttgggccatgaggctggaggcattgttgagagcgtcggagagggcgtgaccgagcttgtgccaggtgaccatgttctgccggtgttcactggcgagtgcaaggattgtgctcactgcaagtcagaggagagcaacctttgtgacctcctcaggatcaatgtcgaccggggcgtgatgatcggcgatgggcagtcccgtttcaccatcggtgggaaacctatattccacttcgtcgggacctctaccttcagcgagtataccgtgatccatgttgggtgcctagcgaagatcaaccctgaggcacccctcgacaaagtttgtgttctcagctgtggtatctcaactggtcttggtgcgactctcaatgtcgcaaaaccaaaaaagggttcgacggtggcaattttcggccttggagctgtgggccttgctgccatggaaggggccaagatggctggggcatcagggatcatcggtgtggacttgaaccctgcaaaatacgaacaagccaagaagtttggctgcaccgactttgtaaacccaa

SEQ ID NO: 2171 - DNA, 1906 bp, Zea mays
ggggatgccctccttgtcctggatcttggccttcacattgtcaatggtgtccgaggactccacctccaaagtgatggtcttccccgtcagagtcttcacaaagatctgcatcttggcggcgatggggggccgcctgcggcggcggctaggtaggttcttgctgcctcccttagctcgtagtctagactctagacctctatatatatggtggggcccccgggggccgccgggaccaacttctcatcatcagccaagtgtaaagggtgcgaagaagcagtagcaaaaaggattccattctcgtgttcttggagtggtccatcgatcgagctccgtgagagagagagagagagagagagagagagagagagagagagagagagagcaagcaatggcgacagcagggaaggtgatcaagtgcagagccgccgtggcgtgggaggccggcaagccgctgtccatcgaggaggtggaggtagcgccgccgcaggccatggaggtgcgtgtcaagatcctctacaccgcgctctgccacaccgacgtctacttctgggaggccaaggggcaaaccccggtgttcccgaggatcttaggacacgaagcgggaggcatcgtggagagcgtcggagagggcgtgaccgagctcgcgccaggcgaccacgtcctcccggtgttcaccggcgagtgcaaggagtgcgcccactgcaagtcggaggagagcaacatgtgcgacctcctcaggatcaacgtcgaccgcggcgtgatgatcggcgacggcaagtcccgcttcaccatcagcgggcagcccatcttccacttcgtcgggacgtccaccttcagcgagtacaccgtcatccacgtcggctgcctggccaagatcaaccccgaggcgcctctcgacaaagtctgcatcctcagctgtggtatctcgaccggccttggcgcgacactgaatgtggcgaaaccagccaagggctcgacggtggcgattttcgggcttggggctgtaggccttgctgctatggaaggtgctagactggctggtgcatcaaggatcatcggcgtggacatcaacccagcaaaatacgagcaagctaagaaatttggctgcactgaattcgttaaccccaaggaccacgacaagccagtgcaagaggtgctgattgagctgaccaacggcggcgtcgaccgcagcgtggagtgcaccggtaacatcaacgccatgatatccgccttcgaatgtgtccacgacggctggggtgtcgccgtgctggtgggtgtcccgcacaaggacgaccagttcaagacccaccccatgaacttcctcagcgagaagacactcaagggcaccttcttcggaaactacaagccccgcaccgacctgcccaacgtcgtcgagatgtacatgaagaaggagctggagctggagaagttcatcacgcacagcgtgcccttctcggagatcaacacggcgttcgacctgatgctcaagggggagagcctgcgctgcatcatgaggatggaggattagagcttcattgcaagcttgctcctcctgcagggcaggcatgtcgcacagcaaatgggcatgaaaagttgaaggcgctccagtcctccagcttgtgtagtacacagtagcaataaaacgttagtgtttgtcctgtgcccatcctgtattattctgttccagggtttcacctttatcgtcagtgtgtggtcaggtttcaacccttctcagaacaaccccctcccagaaaaaaaacaaaggaagaagtttgtgtccaggtttcagaatcccctgtctgtaattaccattttgcatgacaataatgagatactgtagatattaataatgttccagaccttcaaggaaaaaaaacaccccgaaaaaaaaaccggccaagcggcc

SEQ ID NO: 2172 - DNA, 1663 bp, Zea mays
catcattgggtacctcgaggccggccgggaccaacttctcatcatcagccaagtgtaaagagtgcgaagaagcagtagcaaaaggattccattctcgtgttcttggagtggtccatcgatcgagctccgtgaaagagagagagagagagcaagcaatggcgacagcagggaaggtgatcaagtgcagagccgccgtggcgtgggaggccggcaaaccgctgtccatcgaggaggtggaggtagcgccgccgcaggccatggaggtgcgtatcaagatcctctacaccgcgctctgccacaccgacgtctacttctgggaggccaaggggcaaaccccggtgttcccgaggatcttaggacacgaagcgggaggcatcgtggagagcgtcggagagggcgtgaccgagctcgcgccaggcgaccacgtcctcccggtgttcaccggcgagtgcaaggagtgcgcccactgcaagtcggaggagagcaacatgtgcgacctcctcaggatcaacgtcgaccgcggcgtgatgatcggcgacggtaagtcccgcttcaccatcagcgggcagcccatcttccacttcgtcgggacgtccaccttcagcgagtacaccgtcatccacgtcggctgcctggccaagatcaaccccgaggcgcctctcgacaaagtctgcatcctcagctgtggtatctcgaccggccttggcgcgacactgaatgtggcgaaaccagccaagggctcgacggtggcgattttcgggcttggggctgtaggccttgctgctatggaaggtgctagactggctggtgcatcagggatcatcggcgtggacatcaacccagcaaatacgagcaagctaagaaatttggctgcactgaattcgttaaccccaaggaccacgacaagccagtgcaagaggtgctgattgagctgaccaacggcggcgtcgaccgcagcgtggagtgcaccggtaacgtcaacgccatgatatccgccttcgaatgtgtccacgacggctggggtgtcgccgtgctggtgggtgtcccgcacaaggacgaccagttcaagacccaccccatgaacttcctcagcgagaagacactcaagggcaccttcttcggaaactacaagccccgcaccgacctgcccaacgtcgtcgagatgtacatgaagaaggagctggagctggagaagttcatcacgcacagcgtgcccttctcggagatcaacacggcgttcgacctgatgctcaagggggagagcctgcgctgcatcatgaggatggaggattagagcttcattgcaagcttgctcctcctgcagggcaggcatgtcgcacagcaaatgggcatgaaaagttgaaggcgctccagtcctccagcttgtgtagtacacagtagcaataaaacgttagtgtttgtcctgtgcccatcctgtattattctgttccagggtttcacctttatcgtcagtgtgtggtcaggtttcaacccttctcagaacaaccccctcccagaaaaaaaacaaaggaagaagtttgtgtccaggtttcagaatcccctgtctgtaattaccattttgcatgacaataatgagatactgtagatattaataaaaaaaaaaaaaaaaaaaaaaaaaaactcgagactagttctctcgtgc

SEQ ID NO: 2173 - DNA, 1900 bp, Zea mays
cattgggtacctcgaggccggccgggaagaacctccggaggcagaaaccggcggcccgaaggctggctcgctgaggccgggaaaacggaatgcggcagcggacagtcggacacctccctggtttctaaccgcgactaaaaaaaatccgagcctttcttccctcacttgcgccgctacagtccaggcgttcttgctgcctccctcgtagactagactctagaccacgccggcccattgggtaccctcgaggccggccgggaccaacttctcatcatcagccaagtgtaaagagtgcgaagaagcagtagcaaaaggattccattctcgtgttcttggagtggtccatcgatcgagctccgtgagagagatagcaagcaatggcgacagcagggaaggtgatcaagtgcagagccgccgtggcgtgggaggccggcaagccgctgtccatcgaggaggtggaggtggcgccgccgcaggccatggaggtgcgtatcaagatcctctacaccgcgctctgccacaccgacgtctacttctgggaggccaaggggcaaaccccggtgttcccgaggatcttaggacacgaagcgggaggcatcgtggagagcgtcggagagggcgtgaccgagctcgcgccaggcgaccacgtcctcccggtgttcaccggcgagtgcaaggagtgcgcccactgcaagtcggaggagagcaacatgtgcgacctcctcaggatcaacgtcgaccgcggcgtgatgatcggcgacggtaagtcccgcttcaccatcagcgggcagcccatcttccacttcgtcgggacgtccaccttcagcgagtacaccgtcatccatgtcggctgcctggccaagatcaaccccgaggcgcctctcgacaaagtctgcatcctcagctgtggtatctcgaccggccttggcgcgacactgaatgtggcgaaaccagccaagggctcgacggtggcgattttcgggcttggggctgtaggccttgctgctatggaaggtgctagactggctggtgcatcaaggatcatcggcgtggacatcaacccagcaaaatacgagcaagctaagaaatttggctgcactgaattcgttaaccccaaggaccacgacaagccagtgcaagaggtgctgattgagctgaccaacggcggcgtcgaccgcagcgtggagtgcaccggtaacgtcaacgccatgatatccgccttcgaatgtgtccacgacggctggggtgtcgccgtgctggtgggtgtcccgcacaaggacgaccagttcaagacccaccccatgaacttcctcagtgagaagacactcaagggcaccttcttcggaaactacaagccccgcaccgacctgcccaacgtcgtcgagatgtacatgaagaaggagctggagctggagaagttcatcacgcacagcgtgcccttctcggagatcaacacggcgttcgacctgatgctcaagggggagagcctgcgctgcatcatgaggatggaggattagagcttcattgcaagcttgctcctcctgcagggcaggcatgtcgcacagcaaatgggcatgaaaagttgaaggcgctccagtcctccagcttgtgtagtacacagtagcaataaaacgttagtgtttgtcctgtgcccatcctgtattattctgttccagggtttcccctttatcgtcagtgtgtggtcaggtttcaacccttctcagaacaaccccctcccagaaaaaaaacaaaggaagaagtttgtgtccaggtttcagaatcccctgtctgtaattaccattttgcatgccaataatgagatactgtagatattaataaaaaaaaaaaaaaaaaaaaaaaaaaaaaaaaaaaaaaaactcgaggagggggggcgtgtacc

SEQ ID NO: 2174 - DNA, 935 bp, Zea mays
cggcgggcgggacttaattacccgccgattcctccagcgccagcagtatatatacaggtctcagcccggccttccggcctcgccaaaccctatctagcaacgaaccgcaaagcagaagcagcgacaaagatccatctttgtgtctcttcttctggcgacagggatggcgaccgccgggaaggtgatcaagtgcaaagcggcggtggcatgggaggccgggaagccgctgtcgatcgaggaggtggaggtggcgccgccgcaggccatggaggtgcgcgtcaagatcctctacaccgccctctgccacaccgacgtctacttctgggaagccaagggtcaaactccggttttccctaggatcttaggccatgaagctggaggcatcgtcgagagcgtcggagagggcgtgactgagcttgtgcctggtgaccatgtcctcccggtgttcaccggcgagtgcaaggactgtgcccactgcaagtcagaggaaagcaacctttgtgatctcctcaggatcaacgtggatcgtggcgtgatgatcggcgatgggcagtctcgcttcaccatcaacgggaagccgattttccacttcgtcgggacctccaccttcagcgagtacaccgtcatccatgtcggttgcctcgccaagatcaaccccgaggcgcccctcgacaaagtttgtgttctcagctgtggcatctcaactggacttggcgccacgctcaatgtcgcaaaaccaaaaaagggttccacggtggcgattttcggtcttggagctgtaggacttgctgccatggaaggggccaggatggctggggcatcaaggatcattggtgtggatttgaaccctgcaaaatacgaacaagctaagaaatttggatgcacagactttgtgaacccaaaggacacagttgccgcccgtgcaagaagtgctt

SEQ ID NO: 2175 - DNA, 758 bp, Zea mays
attgggtacctcgaggccggccggggcgccagcagactctttttaatagccgacctcaaccaacgtcgagaggaaacccactgttgcagcgcgagtgtagcaggctgcacacacaaggaaggggacaaccacaagcgcctaagatcccgtcctccgcgtcgagatctttgccgaggcggtgaccgtcgagggatcgccatggcgttgagggcgtcccccgtgtcgcatggcaccgcggcagcgccgctgccgcctttcgcgcggaggaggatggcccgtggggtggtggtggccatggcgtccaccatcaacagggtcaaaactgtcaaagaaccctatacccctccacgagaggtacatcgccaaattacccattcactaccacctcaaaagcgggagattttcgattcacttcaaccttgggccaaggataacctactgaacctactgaagccagttgaaaagtcatggcagccacaggacttcctaccagagccttcttctgatgggttttatgatgaagttaatgaactgagggagcgggcaaatgaaatacctgatggatactttgtttgcttagttggtgatatggttactgaggaagccttacctacataccaaacaatgcttaacactcttgatggagtccgggatgaaactggtgcaagtccaaccacgtgtggcggttttggacaagggcatggacagctgaagagaacagacatggtgacctccttaacaagtacatgtaccttact

SEQ ID NO: 2176 - DNA, 4797 bp, Zea mays
  misc_feature (2212)..(2212): n is a, c, g, or t
aaggtcgaatctttttcactcatacatttcttggctttttgttaagataagtgtaatatttattattattaatttaatatctgatgtgaatcatatgtttactccgatattaaatttattttatgaatatcaaatatgattatattgcgacggatattgtactagtgttttttctaattggagtcactccgttttagttactttgtaaccaaacaacaacaaaactgggacagaacagctccgttctacttggctcttcaaccaaacactacctaagagtttcatcaacaaaatactcgctccatttcaatttatatttcgtttgactttttaaccttaggtttgactgactcgtcttattaaaaatttaataattaatattaatttttgttgtgatattgtttagtgtataatatactttaaatatggctttatttttttcaaaaattgattaggacaagtcagttagatgtattttaaaaaaagttaaataaattataatttagaacagagggagtattttgttaatccgaacaactgggtctaagttattttctgcacaaatgaaccggttgcatgggatccggatcatcggcagtcgaacagtctgacaggtcctccggcgtcgacgcgtgagagcagtcgactgccgagtatcccaatccgttgcatccgtcggtgacgggcgaactttgaatgcacgctaccaaaagaggttggaaacgctgactactcagcactggaaaaagtacactgaaaaacttgttgaagtgaaataacgacaaaaagaaaatatggagtttttcatggcggaaaggagcctgccagcctgggcgacccttttcaatagccgacacgtcgagaggagccccttgttgcagcgtgagtgcagcaggcacagggaaggggacaacgtcaagatcctgtcctctgcgtcgactgtcgagggatcggcatggcgttgagggtgtcccccgtgtcgcatggcgccgcggcagcgccgctgccgccgctcgcccggaggaggatggcccgtggggtggtggtggccatggcgtccaccatcaacaggtgagcacagcggatccctcgcctctcgctgtcttcctgaccgtgagatgcttttttgcggaaacgtgtcggttgttgggagccacaatcgttggggtaagtgatattcccgatctgcattgacttggtctgctggatcgaagcaaatcactggtgaaagttttacctttgcgattgattcgtgatctgggtggggcagagatgccacattgtttttttcctcctcccaccccctcgtttttatcgagatccacgattttggatacatttgtgactgatttgttgtcttcatctctcagttgattttttttatctatcagtcgattttttttttgtttcatctctcagtcaattgcggcggtattagtacatgcagaaagtagttggctgttgatgtctcaaacttgttcaaatctgctgatggcgattgagatgtcgtgagcttaagaaacgattggtttacatcagggattaccatcccgttttgaaatcgaattccaccaggcgccgaaaacgagattaccgtcccgtttacatcagggattaccatcccgttttgactttacattctttctaaggctctctccggcaactctatgtctcattccctattgcaccttttattttaaactccactaaacaaacaatgttatctacagcaaacaatgttttatacgtgtaatattacatcctaatttgtcaattaaacaactagattttgtcactctatttgatgatgataataaatatgttcgttttagagactatgatgtaagaatttgtcaaacttcactccaatcataacataacttatgttcaccggacgaaattaggattcatatcaattaatcacgattagtcggacgacttaagcgattaatcgtgattggtccaaaccgacttggacgattaatcgtgactaatcgctattaatcggacgagtaaacattgagcgtcacaagaacactttgaaatatagatgattatcaatagtcaaactgatgcatttgatactctgaaacagtaagaaagcaatcactacctgccatcaaacataagaagtggttactaaactgaggatgaaatgataaagatgtattgttaattgtggagtgtcgtatatttattaacatgaattttncagtgtgttggttgtgctttagttgatcaaacattgcacttggttctcctaccttagtgtagcatatatgttgcaattttaacgttagcacttaaacctaccccattagataatactccctctgtttcaaattatacggcgttttgactcttttgggtacataattttgttatgcacttagatataaatcatgtctagatacataacaaagagaatgaaactagagaagccaaaatgtcttataaatgggaacggagagagtgttcatgtttggaaaattccagtaattgcttcagatggttgctttgtttaggttaaattgtaaaagcccgaggcaagctgtctatgcaaagatcagaagcccttcctaccattgtaaataagttgtttcactctgctccatgtggcttatgaattgctaaagaaatctcttggtcactgtaacttttttcccaagaaatatatggaagtttccagtcccaggttttgtgttagataatttgtttcctaaattttctgcaagaaacaagtggaagttcccagtctatagtatagtttgttctagttttctggaagaaatatgtggaaatttacttcctgaagatttcgtggtagataggttgttgtgaattgcacacatttccttttgttttcccttatgaatggatcaccttgccaactacttcccttactctgcaatgttcattttacattttttgattacttgggtgcttttactagggtcaagactgtcaaagaaccctatactcctccacgtgaggtacatcgccaaattacccattcactaccacctcagaagcgggagattttcgattcacttcaaccttgggccaaggataacctattgaacctgctgaagccagttgaaaagtcatggcagccacaggacttcctaccagagccgtcttctgatggattttatgatgaggttaaagaactgagggaacgggcaaatgaaatacctgatgagtactttgtttgcttagttggtgatatggttactgaggaagccttaccaacctatcaaacaatgcttaacacccttgatggagtccgggatgaaactggtgcaagtccaaccacgtgggcagtttagacaagggcatggacagctgaagagaacagacatggtgacctccttaataagtacatgtaccttactggacgggttgacatgaaacaaattgagaagaccattcagtatctgattggttccggaatggtaagcgattaagtactattatatatcttcaaggattttgatatctgtttttccctttccttccatttatagcttttcaatgaatcatgaaatcaccgacatttgcttttgataatcatgtgacaactgttgtatagtaacatgcaatattttcaagtcgttcgattaatcacgattattcgtccaagtcggcttggaccaatcatgattaatcaagtcgttcaacttgaaaacactggtaacatgttgaagaattggagaaacggggaaaattaatgatgtggagtgagctgttttggataacttgtagtcataagtgtaatttatattttcatttcggattcgttccgcaatggatcctgggactgagaacaacccctacttgggtttcctctacacatcattccaagaaagggcaacatttgtgtcgcatgggaatactgcaaggcatgccaaggagtatggtgatctcaagctggcccagatatgtggcacgatagcagccgatgagaagcgccacgaaacagcctacaccaagatagtcgagaagctcttcgagatggaccctgattacacagtgcttgcgtttgctgacatgatgaggaagaagatcacgatgccagcccatctcatgtacgacggtaaggacgacaacctgttcgagcacttcagcgcggtggcgcagaggctgggcgtctacaccgccaaagactacgccgacatcctcgagttcctggtccagaggtggaaagtcgcggagctcacagggctgtctggagaagggagaagggcgcaggactttgtctgtaccttggcgccgaggatcaggcggctggatgatagagctcaagcgagggcgaagcaagcaccggttattcctttcagttgggtttatgaccgcaaggtgcagctttaatcaagaacgctaggcaatgtgggcatttactacgtatatcattttcagtcctggggttctctataagaaacagtctctaggttatctagcagggtagaattcaactactcgtggatctcactcggtgcaaagtagtgcaaagtacgctatctgttgttaccgtgcaagctgcagagtttggattactatgtgggcctggtggtggagaggaattctgtggggtgcctgcagccagttatgagtggcagctccatcgcaactgagttgttgtattgaatatgttacaggacctatagtaaccgaaagtaataatatggagtttgtatatcgacaagcttgctttggtgattgatgagaatctgaagtaataatatggagtttgcataaaaaaaaaaaaaaaaaaaaaaagggggggcccggtaccca

SEQ ID NO: 2177 - DNA, 1735 bp, Zea mays
gcgccagcagactctttttaagaaccgggggccccccggcccggcgggaaacccactgttgcagcgcgagtgtagcaggctgcacacacaaggaaggggacaaccacaagcgcctaagatcccgtcctccgcgtcgagatctttgccgaggcggtgaccgtcgagggatcgccatggcgttgagggcgtcccccgtgtcgcatggcaccgcggcagcgccgctgccgcctttcgcgcggaggaggatggcccgtggggtggtggtggccatggcgtccaccatcaacagggtcaaaactgtcaaagaaccctatacccctccacgagaggtacatcgccaaattacccattcactaccacctcaaaagcgggagattttcgattcacttcaaccttgggccaaggataacctactgaacctactgaagccagttgaaaagtcatggcagccacaggacttcctaccagagccttcttctgatgggttttatgatgaagttaaagaactgagggagcgggcaaatgaaatacctgatgaatactttgtttgcttagttggtgatatggttactgaggaagccttacctacataccaaacaatgcttaacactcttgatggagtccgggatgaaactggtgcaagtccaaccacgtgggcggtttggacaagggcatggacagctgaagagaacagacatggtgacctccttaacaagtacatgtaccttactggacgggttgacatgaaacaaattgagaagaccatacaatatctgattggttccggaatggatcctggaactgagaacaacccctacttgggtttcctctacacatcattccaagaaagggcaacatttgtgtcgcatgggaatactgcaaggcatgccaaggagtatggtgatctcaagctggcccagatatgtggcacgatagcagccgatgagaagcgccacgaaacagcctacaccaagatagtcgagaagctcttcgagatggaccctgattacacagtgcttgcgtttgctgacatgatgaggaagaagatcacgatgccagcccatctcatgtacgacggtaaggacgacaacctgttcgagcacttcagcgcggtggcgcagaggctgggcgtctacaccgccaaagactacgccgacatcctcgagttcctggtccagaggtggaaagtcgcggagctcacagggctgtctggagaagggagaagcgcgcaggactttgtctgtaccttggcgccgaggatcaggcggctggatgatagagctcaagcgagggcgaagcaagcaccggttattcctttcagttgggtttatgaccgcaaggtgcagctttaatcaagaacgctaggcaatgtgggcatttactacgtatatcattttcagtcctggggttctctataagaaacagtctctaggttatctagcagggtagaattcaactactcgtggatctcactcggtgcaaagtagtgcaaagtacgctatctgttgttaccgtgcaagctgcagagtttggattactatgtgggcctggtggtggagaggaattctgtggggtgcctgcagccagttatgagtggcagctccatcgcaactgagttgttgtattgaatatgttacaggacctatagtaaccgaaagtaataatatggagtttgtatatcgacaagcttgctttggtgattgatgagaatctgaagtaataatatggagtttgg

SEQ ID NO: 2178 - DNA, 1780 bp, Zea mays
cattgggtacctcgaggccatggcactggcgccggcgccgcccggagccagacgcagaccccctgcctgttgccctgtcgcagtctagcatcaggcatccatcggcgagagcgagagcgagagcgttcgcagcaagcctacctcacctcaccttgcctgcctgtctgtctgtctccagagctgctcttgtccggagacggagccgactgaacatggccggagatccgggggacgcgccggaggtgggaggcggcggcatacgctccgtgctcaccacggcctcgctcgtcgctccctccggggacgaggttcagtttcgggagatcgacggcaagatcatcggcctctacttcgcggcaaactggtatccgaaatgcgaggctttcaccccggtgctggccgcggcgtacgagcagctcaaggagcgcggcgccggcttcgaggtcgtgctggtgtcgtgcgacgaggaccggccgtcgttcgagcggttccacggaaccatgccgtggccagcggtgcctttcggcgacctcagctgcaagaagcgcctcagcgagaggttccaggtggagggcatcccgcgcctggtggtgctcgctccggacggcggcgcggtggtacacccggacgccgccgacctcgtgcaccgctacggcgagagggcgttcccgttcacggccgcgagggtggcggagctggaggcggatgaccagcgcaagtacgcgtcccagacgctggagaagctcttctccgtcagcgggaaagagtacgtgatgaacagtggtaataatgaaaaggttccggtctcgagcctggtggggaagacggtggggctctacttctcggctaaccattgcgcgccgtgtatcaagttcacgacgaagctggcggccatctacagcagcctcaggggcaaggcggaggacttcgagatcgtgtacgtccccatggacagggaggaggacgggtacctgcgctcctgcggcgacatgccgtggctggcgctcccctacgacggcgcgccgtcgcgcgcgctggcgaggtacttcgacgtgcgggagatcccgacgctggtggtggtcgggcccgacggcaggacggtgacgcgggacggccggaacctggtgaacctctacttcgacatggccttcccgttcacggacgcgcagatcaggctgctgcaggaggcggaggacgaggcggccaaggagtacccgcggtcgctgcgccaccggggccaccgccacgagctcagcatcgtgtcggagaagtccgggggagggccctacatctgctgcgagtgcgaggagcagggactcggctgggcgtaccagtgcatcgcctgcggctacgagatacacctcaggtgcggccagaatgcggagggcggcagcgcaggaactgcttagctagctaggcgacggcagcataacagcatcactggagtactggtgtctacctactagactgctgcatgcgtattggacttgtgcatggtctgtgtttgatcccaacaaacgtcagcttgctaagtctgatgctaaagtagtcaaatagatagatgagaaatgcatggccttccttgtaaggcttagtaggtggttagatgagtgaacaacaaaatgaagctgcagcaatcaatctactgtggcaggtgttatgcaaatcttgctgcactgcccaaccaaactactgcattttccagtgcgccttcttcgagcctaatttgacaccactgaaattaggctttaagaaaaaaaaccaaaaaaaaaaaaaaaaa

SEQ ID NO: 2179 - DNA, 671 bp, Zea mays
gcccctcggaaaatacattgaccctcgtcatctacaccctctctctctcccaaatcctctcactgcgaatctgcgatggccgttgcgcagcgtctcaccgcgctggagctccaccattgctgctgcccaacacctcgtcatacgtcgcgcctagacttgagctcgctgcgcgctgggagccccgccgagttcgctgttgagcaccgccgcggaagactcttcctgccgtgcgtcgtcgcaagactgcgatccatttccgagcttcgaggaatcaacagtcaagcttcggcgaccaagagatcgaactcttcgagttctacgaggctgaagatcctgagcatctgtttggtgaaggttacctttggtgcaatctatgcttaggtaaagaagaaggcgtcgaggcggatctccaggagttccggggcttcgatgagttcgaggattaggctagcgactacccccagtcagctgcctgtggtgggtttatttacgttggctacgtttctattctgggtactttgattatattatgtaaatgactctagtcttttatattattacttactctttattgtattcgaagcattgtgctatgatgagtcatttatgtaatcgctgtgtacgcgaatttctgatcctggcacgtacatggttcactgaatttggggggt

SEQ ID NO: 2180 - DNA, 569 bp, Zea mays
cgtagctgcgcatcgcgcccaccaggccgcccaatctcctattcatcttctccaaactgcctctccccacccatctcgcccatgttcgcgaaacccagagccgaaccgcccccagtcgacctcggctctccggcgagctgccctccatgtcctggccacacagtcgttcgtcgcgccgatcgcccaggaagatctgcgatgcgctcgtcgttgccgagatcgcgattcgtttatgagcttcgaggaatcgatgatcaagcatggcgacaaagtgatcgaactcttcgagttctacgagatcgaagaccctgagcatctgtttggtgaaggtgccttcggtgcaatctatgcttaggtaaagaagaatgcgtcgaggcggatctccaggagttccaagacttcgacgagttcgaggattaggctagcgacctcccccagtcagctgcttgtggtgggtttatttacgttggctacgtttctattctgtgtactttgattatattatgtaaatgactctagtctttaatattattactcattctatattgttagcaaaaaaaaaaaaaaaa

SEQ ID NO: 2181 - DNA, 533 bp, Zea mays
ctctatcgttaaaactgcctctcctatgcggacatccatttcctctctcccagatccaaatcacaaaatagcacatgcggttccatgtgctcctcgcctccatctctagcggtgtgcagcagcccccggccggcgtcctggcggtcccaaaggccccctgcccagatcgcgactcatttctaagcttcgaggaattgacggtcaagcttcggcgaccaaatgatccagttcttcgagttctacaaggctgaagaccctgagcatctgtttggtgaaggttgcctttggtgcaatctatgctcaggtaaagaagaaggcgtcgaggcggatctccaggagttccaggacttcgacaagttcgaggattaggctagcgacctcccccagtcagctgcctgtggtgggttgtttacgttagctacgtttcaattctgtgtactttgatttatattatgtaaatggctctagtctgtaatattattacttactatttattgtaattcgaagcattgtgctcaaaaaaaaaaaaaaaa

SEQ ID NO: 2182 - DNA, 1329 bp, Zea mays
ttgcattgtcttttgatatattacacttgtgacgtcacatatgtgtggaaatggatcctggcacacatatggtatgcgctcggttctaccccctggaaccgggtgtgacatttgttgagtacgttgatgtgtactcactcttgctttcacaaacaccaggttgcctttggtgcaatctatgctcaagtaaagaagaaggagaacggtgttgaggcggttctccaggagttccaggactttgacgagttcaatgattaggctagcgacctcccccagtcagctgcctgtggtgggttgatttacgttggctacgtttcgattctgtgtactttgatttatattatgtaaatgactctagtctgtaatattattacttactctttattgtaattcgaagcattgtgctatgatgagtcatttatgtaaaaaaaaaaaaaaaaaatttctgatcctggcacgtacatggttcgcattcggtttaccttccaaaaccgggtgtgacataagtggtatcaaagccgtgctgactgtaggaccgctgacctagagtagcattggccgttttaaggacttattgattattacttcatctcatccttgattctgcttcaaaatattagtcaccttgactaattctatgttgtgctcctatatgcccccttgacaaaaatatattttattctagtatggtctatacttctctcaatctattagatctgatctcttcttgtgcttgcgacatctttgtagatgccccctgaccatagcctttagtcttttgggactctttcctcatccattattaaattgctacaatttgaccatctctattccattttgttattgacatgctcgtatccttgcatttttaatacccttatcccttaatctaaagcacttacccttgtacctctactgcctatttaaacatttcagttatatgtccatgatcttactgtcttttgagaccctttcctattctcttgttaagtctctatctttttggcaaattgtactttcttggtcttggtatgctcgtaccattggaatcttgcatactcctatttttatatatgcttacctttatatcccaatatctgtttgaaatatttcggttaacatgcccttgaccacccttgtttcctaatgatccatgagtgatcattttattttgcgcacctgtggtaatctcgttgtttccttgtaacttccttcggtaatgaatttttttacttcaactcttctgtcggaacctcacttatcttatccttgattgttttctccaccttgccatttggtgagtcttgccttgactctgtccatggatta

SEQ ID NO: 2183 - DNA, 2710 bp, Zea mays
  misc_feature (159)..(159): n is a, c, g, or t
  misc_feature (191)..(191): n is a, c, g, or t
  misc_feature (513)..(513): n is a, c, g, or t
ctgtcaagggttctaaatacttaatgatcgacggagattgaaatcccacatagatccccactttcctgtgtgggcccatagctgttctctgaggtggtgagattggaatgtatacacaacatccaaatttacgcaaatgggaaatacttggaggatttncacgtaccatttgtattggggatgttgaatgntatgcagttggtcgtaattgtataaggtcagcagcgtgcagaactgcatgaccccaacacgacgaaggcaatttgcaattcatcaataatggccttgctatgagtttaatcctcttgattagtgactcagccaaaccattctgggtgtggacatacggtaccgagtgctgtacttgaatccccagcgccatacaataatcattgaatgcctgagatttgaattcagcagcattgtccattcggattgaactaatccgatgttcaggaaaatttgcctttaacttgataatttgagacattatcttggcaaatgcatggttgngtgttgatagtaaacacacatgtgaccatctagtagatgcgtcaatcagtaccatgaaatacctgaacggcccagaagttggcataatgggcccacaattatctcccttgaatcccttcaagggaatttaagcggttcagctttaattttgagatatgatggtctcaaaaataagtttccccagttgcacatgcggtgcaaaacaaaatcctgaggatttgggaaaacttgttgtgggcagattatggccaattgaattgcctgtaattttcctcatcatccctacgccaggatgaccaagtcgatcatgccaaatttggaatgcatcaacatcttggaaaattaccttgtatgcaacatgtgcattgctcttaatatatgtatagtacaaccctgacgtgagtgatggaattttctcgcatatgcgcttgccatatttattcggcttggtcaagaagagaaactcttcttgattttcatcatgggtttcaatatgaaatccattttgccggatatctctaaaacttaggagggtacgtgtagaatcaggatacaataatgcatcctcgatcacaatttcagtacccatggggagggtaatagttgctcgaccagagccaactatcacagcatcgcgtccggcgatggtcaaaactttcccatctcttttcttaagagtctgaaagtatttgatctccctaagtatagagtttgtggtacaactgtccacaaggcataattcctcttccgtcgagttgtcatcattatgcatctatacataaataaaaattctgaataagaatttgtgtgatgcaacttagtactatacataacatgatatttaaatatcacaatgtcgaaacaatattacaataatggtatggcgactcatccaatgagttcgcactactcacaggacccaacactggtcttgtagagtgtgttacatctcaacacatgagattgtagtcctctacttattacaacaacattataaagacagtatagaacaaccacacaagccacagtgatcatgactcaaatctccaagcatgagagatttatgccaaatctccaaatggatcctttgacatatactcaatgatcatatcatcagattcatcttcttgcagaagtgggggcttgttgtcaaccccattgaggtgctctttagcaagagtgttcttcaggtcaccagaagccagtgaagaacttccaacctcaattggtgcttcagtagaattgaaatgagcctcaaaaccaggcttatcagactttggcttctttagggattgttgatacaaaagaacaaggtgcttagggcaagtgcagtccctagcaaaatggccctcagtaccacatttaaggcaagctctgttgcccttagatggtagaggcttgccatttccttttccttttcctttacctttcttgtggaatttgttcttcttgaatttgtgaggtccaggaggattcttgaagtttttcttgaatcctttcttattctcagtcttatgcacattgaaatgtacctcaggcagaggggcagacccaggagggcgctgctgagcattctttagaagaagctcatgatgcttttctgcttgggtcaatgtgtgcatgagttgagaatatctctggaaattgctagagcgatactgctgatgcaatatcctgtcctctggaagcatggtagatagagtcttctctatcttgtctgcttcagtgggctctttctcacaaaatttcaatttagaacaaatgctatgaagagcatggttatattctgcaacagatttaaaatcttgcagacgaaggtggttccactcatggttggctgacggccatatgagctccttttgctgttcatagcgctctttgagagatttccacaagttatgagggcatctctccataaggtactcttgtttaaggtccttatggatgtaaagcctcagaaggaaaagtgctgtgttctttttaacatcattcactggatcagtaccagtgatgggtgctgctattgcatcaatgatcccacgagaagcaaaagttatttcaatatctgaagcccaagttgggtagttatgcccatcaagggcgagttcctcgaactctttggttgacatgttcctacagtcatgaccatggacatcccattatttacgcataaattatagtcacaatggtgatgttg

SEQ ID NO: 2184 - DNA, 592 bp, Zea mays
ccggccgggctcttttcttccacaaataaaccacaacaacccctacgctaatgaaccccctcgtgtgccgtcctgctcctgcgcacaccgcgaaactgctgcgccgcctcacgagccttctccggccatcttcttcgaccctgatgagctgctcgcgtcgctccctacccgattgtgatccgtttccgagcttcgagggatcaaagatcaagcgttggcgaccaagtgatccagttcttcgagttccacaaggttgaagaccctgagcatctgtttagtgaaggttgcctttggtgcaatctatactcaagtaaagaagaaggcgtcgaggcggatctccaggagttccaggacttcgacgagttcgaggattaggctagcgaccacccccagtcagctgcctgtggtgggtttatttacgttggctacgtttctattctgtgtactttgattatattatgtaaatgactctagtctttatattattacttactctttattgttaattcgaagcattgtgctatgatgagtcatttatgtaatcgctgtgtacttgaattaaaaaagaaaaaaaaaaaaaaaaaagcgggcc

SEQ ID NO: 2185 - DNA, 894 bp, Zea mays
acaaagcagcaagcagggcaggttttgcgaagcaaagcccacgagcacaggatgaggatgcgtgcgcgggcggcatcggcatcctgcgtcggcggctgtggtggtgctgctcctgctcctgctactggtgggcgtctgcgcgggcgccgtgtacaaggtaggcgacctggacgcctggggcgtgccgccgccgtccaagcccgacgtctacaagcgctgggccaagtccatccacttcgcgctcggcgactccatctggttcctgtacccgccgagccaggactcggtgctgcagctggcgccggcggccttcgcgtcctgcgacctgtcgcgccccgtggccaggctcgccgacggcaactccttattcaacctcaccgcgcccggccgcgcctactacgccagcggcgcgccgggccactgccgcaggggccagaagctctgggtcgacgtgcccttgcccaacggcacctacctccagccctccgccaccgacctcgccgcgctcgcgcccacccccgccgccgacccgcccgccgggttcgcgtccgctgccgccgccgcgccacaggggggcaacgcctcgcccgcgccccgcgccgccgccgccgctggatccgtcgtcgcactctccttcgcgctccagatcctcctcctctgactgtgcggtacagtagctgattagctacctctatctcgctagttttgagatctccattttttgtgtgtgctgtggaacgagagtgagaacagttctttcttggctgaaaattgaattgaatgcatgatcggagggagattggatctccatttgctttctttttttctgttggcttctactgctactgtctctttccattaattaaattccttcaatcaaaaaaaaaaaaaaaa

SEQ ID NO: 2186 - DNA, 2846 bp, Zea mays
gtgatgtcaggaggcaatcaaatgatttccagggcgtaatgaaccatttgtatgatgtgatgtatgaatttagtttctcccttccccctgattatgcgttggtgataagagctcttggttctctagaagggactgcaaaagcactggatcctgagtttaaagttattgagagtgcatatccttttgtaattgggagactccttgcagaccccagccctgatatgaggaaaatattgcgggagcttcttatatgtgacgatggatccatcagatggaatcgactggaaaggctgattgcagctatatctgaacagtcatcagaatcttcaagcgcatcaggagctgactccagtgagaacgccaatggaagtcctgagtggagatcatttgatatgcattctgtgattgcagctacagaaaacccgaaccccccccggcccgggggcccgcgctcgctctactccccgaaaccctacgctgcccttctttccctccccgtctctccctcccgtgcgggcggcggagctgatgagatcccggccatggcgggccccacctcgcggctcctcatcctcgcccgccgcgccgaccgacgcagatgcctcccttttctcgttccccgcgccttgcaggccgcccccccgaccttttctccggcgttgccgctacctccctgcctccccgcctcaacgccggtgatgagctattcaagtgcatttacaagtgtacatggagagaggccttcatcagaatatgcaaagatcaggaaggagtcactggaaacccagtttggaagaatattgggttcaagttcacgcaggcattttgctgaccgtggctttggtccattccttgctctatacagggctgctactatctcctttcatgttgtaaaactcactatttggcatttgttgctcaatgatatgcataaaagagcagaaaagtttcgagagaccttgatacgcttgggtcctttttatatcaagcttggccaagcattgagcacacgccctgatatacttcctagtgcgtactgtcaggagcttgcaaagctacaggatcaaataccaccgtttccaactcgcattgcactcaggaccatagagtctcagttgggttctcgaatttctggatttgtttgctgatatcagcccagagccgattgcagcagcatcactggggcaggtttacaaagctcatctacgatctggagagcttgttgcagtcaaagttcaaaggcctggaatggcgcccttgctgactctagatgcacttttgttccacatgattggaggacaaatgaaacgatttgctaaggctcgcaaagacctattggtggccgttaatgagattgtcagacacatgtttgacgagattgattatattttagaaggaaaaaatgctgaaaggtttgctactctttattcacatggttcaagtggggtcaattctgaagctagtacaagtatcaaggtcccaaaagtttactggaactatacatgtaaaaccatattgacactggaatggattgatggaattaagctaactgatgctgagcgcatcagcaaagccaatttgaacaggaaaagaatgatagatgagggtctctattgctcattgcgacaactgcttgaagaagggtttttccatgcagacccccatcctggtaatctagttgcaactgaaggtggatctctagcatattttgactttggtatgatgggagatattccgaggcactatcgtgtggggcttatacaaatgcttgtacattatgttaatcgggactccttaggcttggcgaatgacttccattcactaggatttgttcctgagggaacagatttacttgcagttgcagatgcgttgcggttttcctttggtgatgtcaggaggcaatcaaatgatttccagggcgtaatgaaccatttgtatgatgtgatgtatgaatttagtttctcccttccccctgattatgcgttggtgataagagctcttggttctctagaagggactgcaaaagcactggatcctgagtttaaagttattgagagtgcatatccttttgtaattgggagactccttgcagaccccagccctgatatgaggaaaatattgcgggagcttcttatatgtgacgatggatccatcagatggaatcgactggaaaggctgattgcagctatatctgaacagtcatcagaatcttcaagcgcatcaggagctgactccagtgagaacgccaatggaagtcctgagtggagatcatttgatatgcattctgtgattgcagctacagaagacctatttgatttcattttatcgaggaaaggatggcgggttcgggttttccttgtccaggacatcgttaatgcttcagacgtgttccttcaagaagcgacattcccatatgtatatgcgaaagtgggaaagataggggacctaaatccagagagaagtaagatgatcaggaggctggtgaatactgtgcaatcgttccgccaagctatcaatttggctccagatgcttggagcgccatgctaatccgcactttgttgaaacctgaatcacaaaaatttgttcttgatgtgtttttggccctggctaaccattccagttacaagattccagaaacattctggctatttatgtcaagatttctaaattacttggacaaacaagatatactttaggaacggttaatatatcaattcctctttttttgttttatggcttgaatttatttattttagatcggtcgccactggccaatgttgacttaaaaagctgttgctgctgttctccggctggtgctgattccaaaattcatatttttttgtcc

SEQ ID NO: 2187 - DNA, 723 bp, Zea mays
cactcctatgggcgatgccggcgccggccgggccgggcgatcaatactatactactatcacagtaggaagctaggaggaaatcaaagcaacaaagttgctggccgagagaagcaaccatgagacctcaggcgtcgttactcgtcacactggctgttatcgtcgtcgtccttgcagctctgccactcagcaaagggacggaggaggaaggaggaggaggggaggcagtcgccgccgtggacgccgccgccggaacgagctcgtggccatgctgcaacaagtgcggtttctgctacctgtctgacccgccgcagtgccaatgcctggacttctcgacggtcgggtgccacccagagtgcaagcagtgcatcaggtacaccgccgacggtggcgtcgacatcccgcccgtgcacgcctaccgctgcgccgacatcctcttcaacttctgcgagcgccgctgcactcccgccgcagttgctgctagcaccaagtagacggatgcatatgcatgccatcgttgccgccgtgtgtgccgcttcagagaagaactaaataaatgttgccgcgcgctgttgatgcgcgtgcatgcctctccttgaataaaccaatatttctataaaaaaaaaaaaaaaaggcccctacttaagtttgaaaaataaatggcgctgcttcaaaaaaaaaaaaaaaaaaaaaaaaggaaaaaaaaaaaaaaaaaagacccctaa

SEQ ID NO: 2188 - DNA, 682 bp, Zea mays
gccggcccggccgggcggccagcccaatactatactactatcacagtaggaagctaggaggaaatcaaagcaacaaagttgccggccgagagaagcaaccatgagacctcaggcgtcgttactcgtcacactggctgttatcgtcgtcgtccctgcagctctgccactcagcaaagggacggaggaggaaggaggaggggaggcagtcgccgccgtggacgccgccggaacgagctcgtggccgtgctgcaacaagtgcggtttctgctacctgtctgacccgccgcagtgccaatgcctggacttctcgacggtcgggtgccacccagagtgcaagcggtgcatcaggtacaccgccgacggtggcgtcgacatcccgcccgtgcacgcctaccgctgcgccgacatcctcttcaacttctgcgagcgccgctgcagcactcccgggcccgccgcagttgctagcaccaagtagacgggtgcatatgcatgccatcgttgccgtgtgtgccgcttcagagaagaactaaataaatgttgccgcgcgctcttgatgcgtgcatgccactccttgaataaaccaatatttctataattattgtagtatgtccaactatcttaagtttgaaaaataaacgcgctgcttcataaaaaaaaaaaaaaaaagaaccggcccctacgc

SEQ ID NO: 2189 - DNA, 3345 bp, Zea mays
  misc_feature (1223)..(1223): n is a, c, g, or t
ggcccctgttcccttacacaaataaccaacccaggcgtgcccctgccccccttgttcccacaacacaaacaaccaacccgatgttccaatcagccacatcttatgttcgagagaaccgaagggcctctgtcgtcgggatccagaggcccggtcggtacgtgtcagttcctgcacagacaagaacgggaactggagccgacctgccagcaagaaacccacggttcttggcgaacccaagtggcgagccaagcagccatgtgaggggtgttgcacccggcaacacatcgtcctcagcaatgccgtcagggcagccttcggagaggctgacctactctgggcagtcgatattcttcggtggccccatgctgaacacccctagcctgggcgcccagaggaacgaggcaggcgcaagagcgcgtccggagggaagcagagatcctaatgcccagcagcgtgacatccggggtgagaaagcgaggacaggctccttgccagtatttgctcctgggacggtccagaggaacccgccctttgacaaatgacctgctcctgctcatgaagtttatctgaagtgcgatgatgccgttacgctggaacacccccagcctgaagagttggcagatagttagggctgctctactggggttgccagacgggcggacaaggcagccgttggattgaaggctgctgccctgctggcactaggcaggtgctaacgagaaccacaaatattgctcgcagtcagtgctgacatttttcagtgttgcgggggcgatggagtgactgacgcacactgtgtttgtgttaggagttcatcagatacttgatgcgcgacagataggaagagctaatttctggcgatgtcaaacgctgatttgcagctgactttgtagcgtcgattgtggtcactgtgtggtgtgtgtgtgccatgggatactagtagacatgtgtaaaatggttagtcgaggtgcacctttcggacactgctcgtgcgtacttgcttgcttgctagtaacaggtcttgagtttattcttgtagcatctccctttgtatggtgcgaaccatctctgcattttgttgtgctgttcgttgctcgcgttgttttgtcgccctttgcgtggctagcggaggcagcagccgcgtggcacgctcagctgaacgtcaaggcgccgctggctgcatctctctggttgccggcgttggaggtttcccggcggcgcantggacgcacaccatatatgccccgagcaatggaaatgaagagctggctggtttctgtctttctgcagggtgttcacagttcactgctgtacatctgtagatattgcagaggcagaaggggcaagcagataaaacctcgcgggctttgctagtttgcttcaccccttcccttctccccaccgcccccgtccccgtcccccaccactggcactcaggtgaagggattcctgtgccgccgcctgccctcgccttctgcctcccggcgcccactcggccttgcggataatttgcggctcggtcccgggcgtgctcagtctcggttccagtggccgcttcgatgtacctgaccgccgtttccttcccccccgcagccgccttctcgtcctcatcccagaagctgctgcctaggtcggccggggtcggccggcgtctggtggtgcgggcagacgtcaaggtcatatcgacgggcgaggcctgccgccgcgggctcgccgccggcattgacaagctcgccgacgccgtcagcgtcaccctcggccccaaaggtgagtctcccgtaagcttgcttcggttcctgttatcttgctggggatgtattgaggttttgaatatcgattgggtgtcaaatcttgtctggtttaccttcgttcagttaacaagttgcttacaatacgattttctgacccatttggacctaaaatgttcgagctaacggtacactacgattcacctgttgctgctggtgttatgagggcagtgagctttaggacatttctatgcagagtagttacttcaagattcaggtctcttgaccttgtgttgttgctccccagcaatctcccctttcgagtcacatggttacgtagctacttcaaactcgttgattggtttctaaccattctactcttaacttctcttatgcaactgtcattttgttggatagggtagttccatctaatgctttggatggattatactagcattgatttcatgtagctcttcatccatacatgacaagactagtcctaacaatcaccccctaatcttgtcatgataacatgtggatctctgacatctttatgtatgtcacacgacaccttcacaacactttcatgatttcatcatcttctagcagcatcacactggtgtcacctcctactggcatcacactatcaccaacaacaagagcatcacaccaccatcttttctggtttgacaccagcacaaagagcatcacacttcatggttgtcagctttacataaactcttagcagcttcacaccaccatctcatcaaacacggcttcacaccaccacttcagcttgacatcactcatgtgatgatgacctccaccacgcttctgctgcaccaaacagcggctatgtcacgatctcaccagttagcataagacgaaccagcacctagccacatcaaattttgctctaggatcaacaagctctgatactaattgttggaaacagaatccttttttcccctgatatattaacacaagtagtttcacttcacacggctcacttggtcttcacaaccaagctacacataaacactagcttactacacaccatacactagcttgatcttcacaatcgagccctatcttctctatctggctcacatagctccaacttctgttgggctgctgcttgctggtgcctttacttcttatttataggtgaaaagagagtaagaaaacagcccctagtggctagtggctttccaagaaactaagaggaagactagagtaggctgactcactaacaaaagaccatcagcagctaggattctactaacactgatttcatgtagctcttcatccatacatgacaagattagtcctaacaggtcaaaagtgtaaacttcggagcatttttcagtgaagattctatttaagctcttaggttcatatctcatgctgttcttactatacagatactctgtgcgtcttgtactctattgattgttgaaagctcagatgttcattgcagggaggaatgcttgtcgccgtgccctgctctgtgtcccacgcgtgtccctgcttcagcgccctctcctccctgccctggagctcgcccatctcccatggccgcccctccctgctgcag

SEQ ID NO: 2190 - DNA, 4553 bp, Zea mays
  misc_feature (3906)..(3906): n is a, c, g, or t
  misc_feature (4055)..(4055): n is a, c, g, or t
ctaggaagagaaggaaaggggaaggctggtttctgtctttctgcagggtgttcacagttcactgctgtacatctgtagatatcgctggggaacaagaggcaagcagagaaaacctcgcgggctttgctagtttgcttcaccccttcccttctccccaccgcccccgtccccgtcccccaccactggcactcaggtgaagggattcctgtgccgccgcctgccctcgccttctgcctcccggcgcccactcggccttgcggataatttgcggctcggtcccgggcgtgctcagtctcggttccagtggccgcttcgatgtacctgaccgccgtttccttcccccccgcagccgccttctcgtcctcatcccagaagctgctgcctaggtcggccggggtcggccggcgtctggtggtgcgggcagacgtcaaggtcatatcgacgggcgaggcctgccgccgcgggctcgccgccggcattgacaagctcgccgacgccgtcagcgtcaccctcggccccaaagggaggaatgttgttattgaccaagatgatgtacctaaagtaattaatgatggtgtcacaattgccaaggctatagagctcccaaatgcacttgagcatgcaggtgccacgctacttcaagaaatagcatccaagacaaatagcgctgttggtgatggaactacaacggcaattgttttggctcgggaaatcatcaatcttgggttgttggcagttgccactggtgctaacccagttgcattgagaaggggtattgacaaagccgttcatgagctaattaagatcttgaagagtaaatgtatccctgtgagtacaaaggaggacataaaagctgttgcgtcaatatcatctggcaatgatggatatgttgggaatctcattgctgatgcattggagaagataggtcctgatggtataatcacaattgagtcatcatcttctatatacactacagttgaggtgcaggaagggatgaaggtacatttatgtggctatgaagattttttgaagtgcaaatttatattcagaaactttgttgtactctgtcagtgatggatttattccaaggtctgtcaaaactcaaaagtaccaagtaatgattatttcgaacatgttaagagggacagaacttgctttgaatcatttcttgctatgtggaacatgcgtgtagaggcgctatccactactgttgcgctccaccgagccttgcagatagacaagggatatatttctccatacttcatcacaaatcaagacaaatcaattgttgaattcgaaaatactagagtgcttttaactgatcagcgtgtgaatgatgttcaagagatacttcccttgctggagaagacaacacagttgagtgtccctttattaattattgccgaggatgtgtcgcatgaggtatattcaacactggttcttaacaaactgaatggattgctaaatgttgcggttgttaaatgtcctggtttgggagatgaaaagaaggccattctccaagacattgctattatgacaggtgaatatgtggaactggacaactgttgtttcaaggcttcatattttaatgtacagattttagtctcatagaatgtggcatttattagaagtaacttttcacatttagcagttcatgttacatgggaggcaaagctacattttgtttaatgagcttctaagttcagcattttttagcttccactagtgttttgaggcatcataaggattacacttcattttgtgttgcatggtatgttgcttccacatcatatatggtccctgagtagttctctttatctataactaaacaggtgcagatttctttgctagtgaccttggctggggtcttcatggcattacttctgatcagcttggtatggctcagaagatcacaataactagtgaatccacaactatcatagcacatccttcaatgagaccagagattgaggccagaatcatgcaactgaaaaaagatctagaggagacaacgagttcctatctaaaagaaaggttctctgcaagaatcgctaaactttcaagaggtgttggagtcatcaaggtgtggcaccatgtcttggaaacctatatcccaatagtttttatattaaaatggatgtgggcttgatgtgtcatgtgtgcactgcatagattttcaagatagagaagtgatttattctcacggtagaatttgattgtgtgtgtagtctcttgagttgtgatataaagttttctagtctgtttcttgagatacgaaaggaattattttgtatttcaggttggggcagccactgaagctgaactcgaggataggaaactgagagtagaggatgcaaagaacgcaacttttgcagccatcagtgaaggcataactcctggtggtggggtgacatatgttcatttatcaaagcatattcccagcatcatggaccttgtggacgacacagaggagaaaatgggtgtaaatatagttgggaaggttggttttttatcatccactgacatttaatacttgttctgcaggttgcagaagatttctgttagtttgtttttttactcctttgcaaaatacttgcaacattcagcatccgaactctgaaatttgccccttttttggcactaggcacttcttgtccctgctatgacgatagctcgcaatgccggggcagacggtccagctgtcgtggagaagcttctcgccagcgagtggcgggttggttacaatgcgatgactgacgagtttgaagaccttgtcgctgctggtggggcggacccgggcagggtcgccagacgcgtgctccagaactctgcttctatcgcagggcggattcttatgactcaggctatgatgtttgacaagaccaagaagaagaagtctcccatccccgagattcctggtattccaccgcttcagataagccaaaaagctaaggcttgagctgttggatgctgccctggtgttgttggctggatgagttgtgttgacctaggaagcagcagaatgcccagtgagctgcccaaaccaggtagaacagtgagcacttggaatgcccatgttacactcgttatataatttggtggtcggtgcagtattacttgtcatgtctgcataaattttgcattggcgggtgagtcggcaaccaatttatgtctgacttgggaacgtaaacgaacgaatggttgatttgttgctacatagagggccccctttgggcatcatctcgagcaaagctattttgccttgtatctccctttgaaagcagatctgtttcatcaattaacatacgaggtaacacagtagcttgtaggaaaagaaatagatcgttctgtcaaggagttttatctttcccgcgtaagagcgtccccccaaaagataggtctatcgacatcattcatgcaaaacagctattaataaacagataaagtgaccatttaaacatgatagacagatggtaatacggaaaatgcatatcacagtgtagtataaatggtgtcctgacatgttaaacgaccatttagccgaatagtaaaaagagaatgcatcacatagttatttacggtactactttacgtagggtttgctaccagagctaattactaaaaattcactaaaattagcatgatagactaattttttaaccaagtttctaactattagctaagcttatctaatttgagctaaaatttagcctaactagtaactaaccatagcttatccaaacatgtccgtaacataattatttttagtactattttatgttagtcaagatgaagccatgtttttttttgaaatgactatccttcatatcaaaataaactagttcctagaatcatggctcctttgaatgcagagattttagaggatttatataggaatttcatagnaaaaacgtaggaaacagggaaaaaaatctcgcaatccaaaggagccttcactctaagttaagctagcttaattagagaaaaagaacaaaatatatgaaaccaaataagtgcaccatgaatatatatcatctgtctattgataataattngttgctgtaaatattagtgtttttttagtaaatccaatcaaacttaaaatagttactttagaataatcctagaagttgatttaatttgggttgaagtatgttgttacaagacagtaatcatgctctatcatatattttttggttaatacattcgagtgggaatcctccccctgccctagctttttctcgaaaaggtactgtacaaggatgcaatgtgttttcataaagacaaaagataatggaacgtgacaactacctacatgcttgagtggcatgacaagctcagatggggcatcttaaaaacatgtgtattgatctggtgtgcgactaagtgggcaccatcctgttggggagtttgatgagtctacaaataaaaaaacttgacatacaggatataagaacaccacatgacattgcattaagaatactttacgtagcttggtgatcattcaatagagactgtaggtaacataactcatggtgtaagtggttgtgagc

SEQ ID NO: 2191 - DNA, 368 bp, Zea mays
ggcatcagctgagctgagctgagctggtccatggagagggattactcgtccacggacggcgggggctgcgagatgcccgggaagaaggcgaggaagccctacaccatcaccaagccccgcgagcggtggagcaccgaggagcacgcccgcttcgtcgacgcgctgctcatgttcggacgcgactggaagaagatcgaggagcatgtcggcaccaagacgacggtccagatacggagccacgcccagaagtacttcctcaaggtccagaagcttgggctggccgccgggctgccgccgatgtacccgaggcgccacttcgccatgcagcagcagcagagctcggtggccgatggtagcagcgcggccgc

SEQ ID NO: 2192 - DNA, 1460 bp, Zea mays
atctttgcgcttggggcaatgacgcagcttatgaggtcataccgaggcgcgtcaattgctggttgaaaactatttccaaaccccctctttggcccactgggccactgagaatttctggaagggctccttttcctcggataagcaatcttgagtcctgggtcttcgctgccagtgccagcacgcttgtggccaagaaacgttgggggcagtttggacctcggagcagcatcatccatggcgggagaggaggccgggaggaggggcgttccctctctgctgaacccgccgtccgcttccagcgaggggcagcaagagcacatcgcctctgatgtcacacagctcatcggatggacacctctggtcgagctcaagcgaatcgccgccaaggaaggggtatgcgcgcgcatcgtcggcaaggtggaggcgtaccagcctctgtgctccgtcaaggatcgcagcgctctgagaatgatcgaagacgcagaggagagggggctgatctcgcccggcaccacgacgctcgtggagccgacgagcggcaacctggggctgggcctggtcctcgtcgccctccgcaagggctacaggttcgtcgcggtcatgccaggccagtactcgctcgacaagcagatcctgctgacatacatgggcgcagagctgtacgtaacagatccatccctcgggttcccgggcataaccgccaaggtcgaggagctcaagaaggagctgcccaacgtgcacgtcctcgaccagttctccaacagagcgaatcctgaagcgcatgttagatggactgggcctgagatctggaaggacaccgccggcaaggtggacgtattcgtggccggttcaggctcgggaggcacggtgtctggcgtcggcaagtacctcaagacgcagaaccccagcgtcaaggtcatctgcgttgagcctgccgagagcccagttgtttcaggcggggaaccaggcagccacaagatccagggaatagggccgggattcataccggaagtgctggacacctccgtcatcgacgaggccgtcacggtgaccaccgaggaggcgatggcgggcgcccggaggctggccagggaggagggcctgctcgtcggcatctcttccggagccaacctggcggcctgcttgaaggtcgcggcgcgagaagagagcaaggggaagatgatcgtcaccgtgtttccgagcgggggcgagaggtacatgacctccgacctgttcgccgccgccagagaggagtgtattgccatgacgttttgatcttcccccccaccccacagaaacatgtacggattaactggaggataaaaggacaaccgatatgttactccctcagttattgaaatagtattcgttttggccttgtaaccttttgttttgcaatcagctaaagttggttacaagaattgatgtgctctaactttaatacaaaaaaaaaaaaaaaa

SEQ ID NO: 2193 - DNA, 856 bp, Zea mays
  misc_feature (804)..(804): n is a, c, g, or t
  misc_feature (811)..(811): n is a, c, g, or t
ggacacaatggcacaatattatcgctgccctcccctttcgtcatccatgacttccctccccgccgcggtcatggccaccgcgacgacgctgcccctaggcctcctcccctccaaaacgctgaccctctcccctctcccttctgcgcgccgatccctctccatcgccgccgtggagccccggcgctggctcctccgagccgccgctgaggaggcgcctgaggccgtggaggttgagttcgtggagcccgaggcggaggcggaggaggagcccgcggtaccggagcccgtagaggcgcagctcgccgccgcgggggctgggaaggacgccgacatcttcgctgttgtcatgattggttcaagacaatacattgtgatgccgggcaggtatatatacacacagagactgaaaggtgccaatgtcaatgatcagatcatattaaacaaggtgctactggtgtcaactagagaaaaagcttacattggcatgccagtggtgaccaacgctgctgttcacgcagtggttgaagaacagggacgtgatgataaagttatagtcttcaagtacaagaagaagaagaagtaccagaggaaacttggtcacagacagccaaacacaaggttaagaatcacaggcataagtggatacgaagagtaccctgctgacccaatacttgaccctgctgcagcttaagctaaattgtaagttatgtagttacaaatcggctggtagtacagtagcatgcaagttttgttcttgtttactttttttttctctggaaggaacacctttcacttttcatcaancagttgntccatgtatttatttcatgagctctttactctggtccttttaaaa

SEQ ID NO: 2194 - DNA, 981 bp, Zea mays
atccacaatatgctcccttggggtccctcgagcccggccggcactccttcgtcatccatgcgtcccctccccgccgcggccatggccaccgcgacgctgcccctccgcctcctcccctccaaaacgctgactctctccactctcccctccctgcgccgctccctctccgtcgccgctttggagccccggcgctggcgcctccgagccgccgccgaggaggcgcctgaggccgtggaggttgagttcgtggagcccgagacggaggctgaggagaaacccgcggtaccggagcccatcgaggctcagctggccgccgcgggggccgggaaggacgcggacatcttcgctgttgtcatgattggttcaagacagtacatagtgatgccgggcaggtatatatacacacagagactgaaaggtgccaatgtcaatgatcagatcatattaaacaaggtgctactggtgtcaactagagaaaaagcttacattgggatgccagtggtgaccaatgctgctgttcacgcagtggttgaagaacagggacgggatgataaagttatagtgttcaagtacaagaagaagaagaagtaccagaggaaacttggtcacagacagccaaacacaaggttaagaatcacaggcataagtggatacgaagagtaccctgctgacccaatacttgaccctgctgcagctttaaattaaactgtaagttatgtagttacaaaacggctggtagtagagtagcatgctagttttcttgtttctttctttttttacttctctgtcttgaaaaaggaacacttttcatcacaattttccttgtttttgtgtgttccaaatgctgccagtcaaccaactgtaccatgagctatcttgttcttgttcttttttcacatcgtgtatgctactagccagttgtattgcacgaccggtcctaaagaagaggtttctttctttttgttaaaaaaaaaaaaaaaa

SEQ ID NO: 2195 - DNA, 6566 bp, Zea mays
tttgcaaaacttagctccaaaatattgactttgcaaaaacttagctctccaaccttcttagatgtatcaaataggttcctagtggtgtatgcaacttatccaaagtgtgaaactagatattctttatattttccaagttttaccccttttgtggttagttttgatctgtttctgacttggaactaagttgagttgacttatgcacctgtgaatcaaatgttagacaaactagttagtccataagactgtgatagacatcaagcaccaaaatcaattagagaaaatggttaagatcatttccctttcagttatggtagccaacgagttgattaccaacttcataatagaacgagtcggttactcctgtaattctcctagatttggactctctcctagtagaccttgtactcgtggttgagtccatgagcccttatgcacatgttgtgttttataaagcttatctagatcagggtttactttctcgttccgaaaacaccgaatttcgctattttttctcgtttttgttactcactaagaaacggatttcggtcctgtttttaactggatttcgtttcaaaaatataaaaatataaaagtcaaattttggtcagcgaaacgaaattcggatcttccaaacgaaattgtgaaccctgatctagatacacaagtaatttcagttttggtccgatcacagcaaaaaatacttacttttcgttggcttcctacacaagagttgaaaataaattaatttcattttgttgttttgttctgatcgccaaaaaaaaaccttagccgataaaatttgaatcaactttgatgtgctactttaaatcccacaaaaagattattgtagtggacaaaaattcgctatctttgtcgtaatgcgcgcggtcctggaacgacgggcagcgtttcacttttgcaaacaggaatacgtaaatacgtagacgtcgagaagcagggacgggatcctgttgacaatgacagcgacaaggatgcatgcaaatggagagggaggacgtgaacgtcttccgccgttccgcgacgacccggacattcgggtcaattttccagtctaacagtcatgcggaattgcggatgcccgctgcggcctgcaagctacagctactacacccgcgcgcgcgttggcactcgcactcggcagtgcccgcctgataattagggcggaggaaagagtttttgtccgaggaatcaacctatcaacctgtccaaaataagatgatatattataattttattttttaaatttggtaagatgatcatatttttcatgttaatattaactaattaattataaggaataagatggtgattgtccaattcattctattctacaaataataaaaagtaagaagtaataagataataaactaatttctcaaactaaatatcctaaaaaagatcgatcaaaacacttggacgaaatcgaagtcgtgaaaagatgcacgtgacgacgtatttagaccctgtttaggaggacttcgcttcaaaattatagtttcggtttttcagcttcacgatgaaacaacttcaatatattgataaaacgagtttcaagaatgtctggcttgcacatagactccaacttttgtaatacaattaatttgtatgagtttccttaattacatttaatgattagctggtgtagagagagacatgaatcggtagatcatataaccaatggtatggtggttaacttttgtgcaacctttaaggagatttaaaaatttcatgaaactgaaccctagtttcagttttcttaagctaaagctagtgaaactaagactgtttggatataaaaaactaaaatagactttaaaattattgaagcgaactcccgaacatgcattaaccgcggtcgcctcctgctgtcattggtcgttgtcgtcgtcgtcttcctccctctccaatctccatccatcctcgtccgtcctcaagggtctaagaccaaaattaactgagcagggagggtgttgttaggtggggcgccgtcgcaccacaccacaccacgggtgtgcgacgcccggccaggaacggcgatggtggcgggcgcgggatggagaagaatttaatggcggtcggcctcgtccgatcccgaccctctttctctggcggcatgcatgcatggtgcttgccctgggggctggcgggcgcttctatcatgcatgccggcagcatgcgctggctctgccctcatggcgcgtgcgcggccaccactctcgtcccttcaacccgctgccacacgcgttgcgcttccgcgctctctagttatctctgctgcagcagcacgaacgccgcgtctgcagctccatgggatagggacggtccaatggcgatcaggctagcaggcagcaggccgtcccctgtcctgtgcattaactccgatcctccgccgtgatcggagagaccaaccacccgatcccacggccgatccgatccgatcagcttgctcgcaatattgttgctagtaccagtgtttacacgtactaagcaccatcattgacccctcagtattgctcccagaacagaactgacactgaggcgtgaggtctgtctgaggtgtgtgattaataaaacagatgatgattatccctaaatcgattccaaagctcccagcctgccaccacgtagtgacgtagttagtggagcctcaacgctccacacacttggttcgcactagcatcggtacgtagttatttttacaggtgttgccgagcgggcgggggcgagtgtcatctcctttcgtttcttttagagttttttctttttggtcgttcgtggtggtggtggcaatagcggcggacttgcggtcgttgtggctcgccgtacctaaggagggcaaccacttcggttgcggctcgctccctgcggcgaatcattcattagccagtggcgctcgtcgtcccgcgtgccgtccactcgggctcttgatcgaccacccaccctgtccactcgagcgcccctgtttctggcggctggcgccggtggcccggcgggcctgcctctgccctcttggctcttgcggttgcggctgtcatttttttggtggttggagcacgcgcactgctccgggcgtcctgaacaacggacctggacgtggacggcccggccggtgcaccttgtcgctagtcgctacccaagcccaattgcccatcccgcgcgttcaaccaccaccacgccgcaccgcgcgttcaggttcaggattgctgccttgtcttcttccccggtccgcaagaggggaaagagaagttgaggtctgccagcaggcctaccctgctctgtaaaactcatctaaatctgatgtactgccacctgcatgttcatggctagatccggcagcatatagcggcagggtgagatatttctagctactgcagtgtgcagcgcgggaacgtaggacggacggagcaggggtcccgtcgtcatctcacttcgtccctgtcgcgcttaatgctgccattaaactgactgcttgcagctcatccgtgctggcgagctccactaataaatgcgtgcgtatctgtgtgcatcgcggcagccggcagggaagggctggacaggattgcgcgtctgcgcttcagtctccagttcccggtgacgacgcccactagtctctactagataggcagcgccggctgctgctgctgccgccgccgatcagggctttcgcctgccgcccgcatggctccggcgtccgagacggagctgcaagcaccaccaccaccaccggcgtcggctaaggagatcaagtcgccggaggtgctgccggagccaggctcgctgtcagcgctgcagcgcaagaagctgggtgcgcacttcatggagagcgacgagcgccgcgtctcccgcgccaggacacctctcggcgccgcctatgaaccgccctccgccgccgctggcggcggcggcaccacgccggtcaacatccgcggcgagcccatccaggacctgtcgaggaccggggggtgggtggccgccttcttcatcttcggcaacgagatggcggagcgcatggcctacttcgggctctccgtcaacatggtcatcttcatgttcaaggtgatgcaccgcccgttcgccagctccgccaacgccgtcaacaacttcctcggcatctcccaggcgtcctccgtgctgggtggcttcctcgccgacgcctacctggggcgctactggaccatcgccatcttcaccaccatgtacctgctggggctcatcgcgctcaccgtgagcgccagcgtgccggcgctcgtgccgccgcaggagggctgcgacaagctcgccatgctgctgggcgcctgcgcgcccgccgcgccctggcagatggcctacctccagacggcgctctacgtgacggcgttgggcgcggcggggatccggccctgcgtctcctccttcggcgccgaccagttcgacgagcgcagccccgggtacaagcgccggctcgaccgcttcttcaacctcttctacctcgccgtcacgctcggcgccatcgccgccttcacggccgtggtctacatccagatgcagcacggctgggcggcggcgttcggcacgctggcgctggccatgggcacctccaacgcgctcttcttcgtgggcacgccgctgtaccgccaccggctgccggggggcagcccgctcacgcgggtggcgcaggtgctcgtcgccgccttcaggaagcgggacgcggccttcgacagcggcgacttcgtcggcctgtacgaggtcgccggcgccaagtccgccatccgtggcagcgccaagatcgaccacaccgacgacttcagatggctcgacaaggccgcgctgcaggctggagggtgacctcgccggcggcgaggacgaggaggcggtgaacccgtggcgtctgtgcacggtgacgcaggtggaggaggtgaagatcctgctgcggctgctgccggtgccggcgtgcacggtgatgctgagcgtggtcctcaccgagttcctcacgctgtcggtgcagcaggcctacacgctgaacacccgcgtggcggcgctgcacctgcccgtgacgtgcatgccggtgttcccctgcctggccatcttcctcatcctggcgctctactaccagaccttcgccccgctggcgcgccgcctgacgggccacccgcacggcgcctcccagctgcagcgcgtcgggctgggcctcttcttctccatcctgtccgtggcctgggcggggctcttcgagcggtaccgccgcgggtacgccgtccgccacggatacctcggcctcttcctcacgcccatgccggacctcagcgcctactggctgctcatccagtactgcctcatcggcgtggccgaggtgttctgcctcgtcgcgctcctggagttcctgtaccaggaggcgcccgacgcgatgcgcagcgtcgggtccgcgtacgccgccgtcgccggcgggctcggctgctttgtggcgtcggcgatcaacaccgcggtggacgccgcgacgcgggacgatgaggaggggcggccgtcgtggctggcgcagaacatcaacgtgggcaggttcgactacctgtactggctgctcgccgtgctcagcacagtcaacctgctcgttttcgtcttctttgccaagcggtacaagtacagggtcagggtcgacgtgccgaccacagttgctgttgataagcagtagctagccgctagcgccattacaaggatttgagtttggatgtgctgtaactattgattactgggaataccataaaacatagatcttgtaccgtcgcggcaatagaatagaccagccggaactggtgcctggtggagtgggagcttcagccttgggcctccatctggagatcaagtatccggtgactgctgtcagctcaggagcgtgatagcatgatgaaccacatcgtactgctgactgttcatcagtaattccccagttgctttagctttgctacaacctgtctcgttgatggccgaactgctacagactattttttttgaaacatgcaggaggtctgcctattatattgataaggaggaaaagacatgttatgatttaagacaacaaggataggtccgtaggcatagaagccactagccagatgaaaacaagaaatagaagccttgtaattatgaaaagcatctaagaaaaagataaaggagctgtgtggcggtctggcccctgccagcttccaggccgccacctcacatttaattttttaaattgctcgcaattcgagaatatgtggtcaaagattctcgtatttctttcccgccatattgaccagatcactagaatcaacaacaactcgaggtctttcctattgcatcccgacaacatgacagatctcttccatcatgggcaacagagagtgaaagcgccctccacccccaagttagatggcttcaggtcctcaatagccacccaaacaacaatgtcctcccaaatccatttagtgaaccgacattcgacaaaaaggtgtattccatactccaggggcccattacacagaacacaagatggtgcatggggccaatttctggttgccaaacgatca

SEQ ID NO: 2196 - DNA, 3300 bp, Zea mays
  misc_feature (2860)..(2860): n is a, c, g, or t
  misc_feature (3208)..(3210): n is a, c, g, or t
ggcttatagtttttgtctggaaggatggtttgcttcgtacgtgttcgtccgtcccctagtggccagcgaaatgtgacgggcttttcgatcacctgtggccattcgagacgagtacggatattaaaaataattaaggaggtgtttgacgagacgttgatggtattttatcgcgctgattctcggtaggatgccccaatcacatgacgcgcaaccctcattggatcctctgcatgcatatattgtactatagttaattaattgtgtcaggttttgttagcctagatttatttgattgttttctgagccacgcactgagaggatcgatcggagctagcgagaacgatcgatcgatggatcgctagattaagtttgtactatgcgttaattgcagatggcggagcggcgtggaagagagcagaaggcctgtcgatgggcatcaactacgggcagatcgcggacaacctgccgtcgccggcgagggtgtcgtacctggtccggtcgatgcaggtgagcaaggtgaagctgtacgacgcggacccgtacgtgctgagcgcgttcgtcgacacggatgtggagttcgtggtgggcatcggcaacgagaacgtgtcggcgatggtggagccggcggcggcgcgggcgtgggtggagcggcacgtgcagccggcccgcccgcgcacgcgcggcacccgcctcgccgtcggcaacgaggtgttcaagggcaacgacagcgcgctcaaggcgagcctcctgccggccatgcagtccgtgtaccaggcgctgaccgcggtgggcctgcagggccgggtgaacgtcagcacggcgcactcgctggacatcatgggcagcacctacccgccctccgccggcgcgttcggccccgacgccgtgccctacctccagccgctcctggccttcctgtccgcggcgcggtccccgttcctcatcaactgctacccctacttcgcgtacaaggccgacccgggcaacgtgccgctcgagtacgtcctgttccagcccgacgccgccggggtcaccgacgccggcacggggctcaggtacgacaacatgctgtacgcgcaggtcgactcggtgtacgccgccatccagaagctgggccacaccgacgtcgacgtcaaggtctccgagaccgggtggccgtccaggggcgaccccgacgaggccggcgccacgccggagtacgccaggacgtacatcggcaacctgctgcagaggatcgagatggggcagggcacgccgatgaggccgtcggcgcccgtcgacgtctacgtcttcgcgctcttcaacgagaacctcaagcccggcccggcctccgaacggaactacggcttgctctaccccgacggcacgcccgtgtacgatgtcggcctgcggggataccttccacccatggactattcacaaggcaccagagaggtagatcttgttcttggtctttgcacttgcacacctccctgcctcctgcccattcccatcaggctatcacattgctctcgtacttttggtcttctgcagggggtccgtttcttcgtcttcatcagcctcgttgccattgtatcgatcactctcagcttatcctgagagcatgagcattgccgtaaagttgatgaagaaagcgcggagactgaggacttcttgctgctaggatagcagatcgattacaaggtaagacccttatccctggaccaagatcttgggtactttagcttctatgttggacaaaactggcgattcagttaagcttgaaccaccattgttcgctaggagcataagcttgcagaaatcttactggttcttttctcctacatgcagccctcggagaagcaactaaagtcggcatgttccatcaggcaagctttagaagcagaaatttgtctctgacttactacacggccagccaaaacggtcgaagtggtttttgatgacatccagcagccaaaactggctccgcgctgacagtaaagtagaactgactgaagattgcgggcgacacgcgcccaatgcacgcatagtccatttaatttgttctggagatgtcttctttatccaactcagcaactgtatatttgtatatcggccaaaaagaaaggaaataaattcaggtcaaggctggccatttatactagttttttttttaaatctgtgagctctgattgttttgtgtttctttttttaaagtaaagtgcatttccggtccttaatttatgtaggtgtgttaacctgtccataaatttttaaagtgttctaaacaaccttatgcatacaaactattcgagagtgggctttatgccttttcattcttcataagacattttatcgcccttgatggaattctgtctagaacaaagcatgcgactaagatagcttggctccccaccatgccttaggtaaacccaaactatctaacatgacattaaccaagtttgtcaaagttcgcttttccgttcagcgactctatttgattaaggctagtagggacatgttgtgtaacgcccaaaaaatcattttgggtaatttcagaaaaagtttactccgagatttaaataattatgttttgaaacaagagattaaataaaagatccaaatatgaatgaagtaccattagcgaattatatagaattaggtaagtgatctcttaataaagattatacaacaaaatgttttctataaaaacaaatgaatatgaacttttgaatatacttttaatttgactacacatccaaaacaatattttcttgaaataaacaatgtgtgtatgttacatattggagacaatttttaaatgaatatagtagttaatataaaattatagttgcatctcatactgagttttcgatatgtncatttgaacttaagtttgaaaatctaaatcatatttgaaattgtgatttggatttggaaatagaaaacagaaaaaaagaaaagagagagaatccgcgctgggccgaattccacgccgaccgccccactctttcttccacacggcccagcacccttactccggtcacggtcactgcgaaccggggccaactcaccagccttttctagccgatcgatgccctattttgcgtggaccacctcatcatcttcgccaccaacagaatcaaccgcgagcagaacacctcgtcctcagccgcgccgtgttccgctcagcccgtcctatggttttgtgggcccgaggtaaattgannntgatggacctcctagacaatataaaaaattctataacatacaacggagcagattaacactttgtatataaataataatatttattaaaat

SEQ ID NO: 2197 - DNA, 2043 bp, Zea mays
  misc_feature (2042)..(2042): n is a, c, g, or t
gacacaagcaaagcgagcacagacagacaccgttacgcgagcacgcaacgcgacgaggagaggagaggagacgcttaccgagcgaagagcactaggctccgccatcgacgtacgcacgcaagcgcgtgaagcgtcctcgactcgcctttcggttcggttcctcgccgtcgcggccgtcctcgtcgggcgaccgctctctcggcattctttctatctggttgctgtgtgtggattggaggccttgtgagctcgcggaggcggcgcggttcatggccgtggcggagcggttcggaactcggtggccgccgtctcgattcttcgttgctgtgctcctcgtcctgctcacagatggcggagcggcgtggaagagagcagaaggcctgtcgttgggcatcaactacgggcagatcgcggacaacctgccgtcgccggcgagggtgtcgtacctagtccggtcgatgcaggtgagcaaggtgaagctgtacgacgcggacccgtacgtgctgagcgcgttcgtcgacacggacgtggagttcgtggtgggcatcggcaacgagaacgtgtcggcgatggtggagccggcggcggcgcgggcgtgggtggagcggcacgtgcagccgtacctcccgggcacgcgcatcacctgcatcaccgtcggcaacgaggtgttcaagggcaacgacagcgcgctcaaggcgagcctcctgccggccatgcagtccgtgtaccaggcgctgaccgcggtgggcctgcagggccgggtgaacgtcagcacggcgcactcgctggacatcatgggcagcacctacccgccctccgccggcgcgttcgggcccgacgccgtgccctacctccagccgctcctggccttcttgtccgcggcgcggtccccgttcctcatcaactgctacccctacttcgcgtacaaggccgacccgggcaacgtgccgctcgagtacgtcctgttccagcccgacgccgccggggtcaccgacgccggcacggggctcaggtacgacaacatgctgtacgcgcaggtcgactcggtgtacgccgccatccagaagctgggccacaccgacgtcgacgtcaaggtctccgagaccgggtggccgtccaggggcgaccccgacgaggccggcgccacgccggagtacgccaggacgtacatcggcaacctgctgcagaggatcgagatggggcagggcacgccgatgaggccgtcggcgcccgtcgacgtctacgtcttcgcgctcttcaacgagaacctcaagcccggcccggcctccgaacggaactacggcttgctctaccccgacggcacgcccgtgtacgatgtcggcctgcggggataccttccacccatggattattcacaaggcaccagagaggcggtccgtttcttcgccttcatcagcttcgtagccattgcatcgatcactctcagcttatcctcctgagagcattgccgtaaagttgataaagaaagcgcggagactgaggacctcttgctgctaggatagcagatcgatcacaagccctcggagaagcaactaaagtcggcatgtaccatcaggcaagctttagaagcagaaatttgtctctgacttgttacacggccagccaaaacggtatcgaagtggtttttgatgacatccagcagccaaaactggctccgcgcgctgacagtaaagtagaactgactgaagattgcggccgacacgcacccaatgcacgcatagtagaattttccatttaatttgttctagagatgtcttctttatccaactccgcaactgtatatttgtatatcggccaaacagaaaggacataaattcaggtcaaggctggccatttatacttagttttttaaatctgtgacccctgattgttttgtgttttttttttaagtaaggtgcatttccagtcccttaactttaaattatgtaggtgtgttaactctgtccataaatttttaaagtgttctaaccacccttatgcatacaaaaaaaaaaaaaaaaaaaaaaaacaaaaaaattatna

SEQ ID NO: 2198 - DNA, 1098 bp, Zea mays
gactgcaaggaactaactggtccgggaggtgcaggcaggagaggcgagctgaccgatcgatcaccaggggataccgtaccgtggcgtggtgggggagagagagagcgagatggccgcggcggagatagtcgtcgtcgtcgccgtcgtgaccttgcttctcgggctaacgtcgtgcatggcagagagttcggtatggagggaggaggaccggcgcgtccgaggagaggtgacgtacgagcagagggccctggtgctggacggcgccaggaggatgctgttcgccggggagatgcactacccaaggagcacgccggagatgtggccaaaactcattgctaaagcaaaggagggcgggcttgacgtgatacagacctacgtattctggaacgttcatgagcctatccagggccagtacaacttcgagggaagatatgatcttgtcaggttcatcaaggaaattcaagctcagggtctctacgtaagcctcaggatcggtcccttcatagagtctgaatggaaatatggaggatttccattttggctacgtgatgtcccaaacattaccttccgaagtgataacgaaccctttaagcaacacatgcaaagatttgttacagatatagtaaatatgatgaaacttgaaggactttactacccacaaggaggtcccattataacttctcagattgagaacgaataccaaatggttgagcctgcatttggctcaagtgggcaacgttacgtcagttgggcagctgcaatggctgtagaccttcaaacaggtgttccctggacgatgtgcaagcaaaacgatgctccagatccagttgtcggtattcattcctatactattccagttaacttccaaaatgatagcagaaagttctagccagtctaaaaacaacttattacatggttagatcaatacgtgcaacgggcttatttatggagaaacgtttgttggaccaaactcagctaacaagcctgcattatggactgaaaattggacctcgcggtatatgtgctgcaatattttcacttgttagttttacaattggtggaatacaacatgcttaatggtacaaaaaaaaaaaaaaa

SEQ ID NO: 2199 - DNA, 4622 bp, Zea mays
  misc_feature (660)..(660): n is a, c, g, or t
taaggggggggattacttaatgaatccggaataataatcatcgtgttatagaattgtaataggtgacacttggtaagagtcaccaagaaggcataccaagcaagggccatcaccaaggttttcttggctcttggtcatcctgcgaccgtaccccttaaatttggcgacgcttgagaagggtcagtatcgaccagtagactgaatgaagcaaaataagaggtgactagatggtcatttgtgtggtgtgttctggtggcgatcgagtggtactccattactgtcttccaagttccatccacaacgtctgacgtattgtagttgtagcgagcatgcaaacttattaaagacggccagcactgttcgttggcgcgccataatgtgttgctgcggcatgcatgcatgcatgctcatcgaccccactcgcagaactgacgcaacaaattgaattgcctgtcgatgtttttatctttttataaaaaaaccctgcaatcttaagcccgcgacacggcgacaacaacgattatttgttgaaccaccggggcagtacttgctgcatacaacaacgattttttttttaaaaaaaaattattgaaccatcgtctcaccattttttccagctgtctcaactgtccgaccgattggcaattcaatggccgaaantaaagtggtgcgtaattattatgggaggcatctaatcttctcgtacgccatgtgacattgtgtgtctcccaaaagaaaaaacattactacgtacgtgtactcctacacttgagctcgtatatatctgtggtagttttattattattttgaactcaagtgcatatatactcacgagcaaaataaataaataaattaattaaatcgtgcagctgccaagcttatactacctgtgataagttcgtcatttgaaacccttgtaccacggtcgttgatccatattttaataagtcgtccaacccctagcaatataaatggactctcagcggtaatctctgggtacaataataatgctcctaaattagcactagtagaatagtggtagtaaaaattaaaggagaaggccggtcaatcgaaacggcaaggaaagcgatagcgacgaggagtgggctgggccggggcttggcggcaataaataggcggccgggtcatcggccaaccccccatcgccgcctgctctctacctctgcactccaatcagatcatcagatagatcactggccccgtgctgattaccgcgcttcccatctgagcagccagcctcccagggtacagggagagacgcagaagagacagctgctgcctcgctgagacgatggccggaggcggagaccactcccagacgaacggaggccacgtcgaccagagggccttggaggagggcaggaaggaggagttcgctgaccagggctgcgccgccatggtcgtctccgtcccatttatccagaaggtacggtggtgctgtgagagatcaaaaggcactggccgagatctctctctcgtctgccgtgttcttcggctcttcccccgtccgcttaatactctctctctctctctctctctctctcaacatcaacgttattcatcatgtctcggtcaaattatggagttttgtgctgctcactgcatttgcagatcatcgcggagatcttcggcacctacttcctgatgttcgcggggtgcggcgcggtgacgatcaacgcgagcaagaacgggcagatcacgttcccgggcgtggcgatcgtgtgggggctagcggtgatggtgatggtgtacgccgtgggccacatctccggcgcgcacttcaacccggcggtgaccctggccttcgccaccagcgggcggttcccgtggcggcagctgccggcgtacgtgctggcgcagatgctgggcgccacgctcgcctccgggacgctgcgcctcatgttcggcggccggcacgagcacttccccggcacgctgcccacgggctccgaggtgcagtcgctcgtcatcgagatcatcaccacattctacctcatgttcgtcatctccggcgtcgcacggacaacagagcaatcgggggagctggctgttttgtttgtttgtttgtttgtttctttcttttccggtcgttcaacccgtacgtactgtgcatatatatttgcagatcggggagctggctgggctggccgtgggcgcaaccatcctgcttaacgtgctcattgccgggtgagtacttacgatatatatacttactcttcgtgacgtgctcattgcctggaatatacatattttgtacaaaatttaagtagtacaaattataataagtactactacaaattataaggagcagccagcagggttgtcgtcgtcacaagaataactttcaagattatttttgttttacttttcattcacaatgcgtgcacaaaagtgacgacaaactgcctagctagagtatttacccaacaagtcaagtcaaaaaccaaaagagagaattagaatatagatattttttatagtggggctttgcgttgtggacgatgtgtctcgatctgtctgccgagcagggttttatggagccataaagaccgtcacatgagtagagtagggcagggaaaaatgagcttttaaagtgtggttggtgagacaccggtgcaatgacattaatatgaacgtaataccactccactccactgtccttccagcttttaaagtgtgtttgcagaaaactgcagagataatgtgaacaccatatatatacttacttgttattagtaatgacaacagtcctaaaattacacgctgcccacggtgctccgaggtgcagtcgctcgtcatcgagatcatcaccacattctacctcatgttcgtcatctccggcgtcgccacggacaacagagcaatcggggagctggctgggctggccgtgggcgcaaccatcctgcttaacgtgctcattgccgggcccgtctccggcgcgtcgatgaacccggcccggagcgtgggcccggcgctggtgagcggggagtacacgtccatctgggtgtacgtggtggggccggtggtgggggccgtggccggggcgtgggcctacaacctcatccgcttcaccaacaagcccctccgcgagatcaccaagagcacgtctttcctcaagagcacgagcaggatgaactccgccgcctccgcctgatggatctccatggccggtaatttagcctacaaaactatatattcacccgtgtcgtcgtgtcagtacgtgagaggatatagatatataattcctgcgtgcgtgtgcgtttgtgtgtggatggaaaacatatggaagaagaggtatggtttgtgtgtggatggaaaacgtactgtgcctgccttcgaccctgggcaacgtcgctctaccccgtgaacgtgcttaacctgttgccgcatgttttgttaactcaattttaatgtgttggcgagatcatacgcatcaaaaagaaaaaaaaaaagcccgcctgggcgcgccccgtacgacacatacagagttccatccctccagtctatgacacacacgcgtgcgtcgaagaagactgaaatggaagagagaattaactgagcaagaccgaccccaaaaaatagataagcatccggtgtaggtagttaggtattagacgactatatacagtaaaatataaacaaataaacatgatttggatggatggatgaaccgatggtgttcgatcgcaagggcaacaataacatatacgtattcgcgtttcacattactattttcgccatgaaagatcattgatatgtaaatttgaagtcattacgaattcacataatatcaaattatatatttctaataaaatagaaacatgctacaacaacaatgttagggtgcatttggttggagagccaattgtcactactggacaaagttggaacactcggcaaagaagcttatttgccgagtgtcaacgacgaacgctcagcatagttaacggtcatcatctataaacgccgtcttctttactgagcatcttgtttcgctgagagcttcacgctcgggaaaacaacctttgccgagcgttgttatatgacgagtgttttgcacttggcaaaggttgtctgtgccgagtgtcgtagttcgccgagagtggcacccgacaagtgtagaatggagcggctccattccaatttctgaaaatggaaccatttcattttatgtttggcaagtagaacaaagccgctctattttttgtttggttgaagagtagaatataacgaagccgttccattcattgtttggttggagagccatacaagtgtgaaggggagaagagaaaggagagcgctcacatctgtaagagcgctcatatttgatcgttttggtggagcaggagcattccaaatatttgccatatatagactgcagagccactgcactcctcttccgttagaaaccaaacattacagaaatggaatcattcaattctcctctctcttctcaaccaaacacacctttagtttttttagcaaataaagcatcttcaatactatatcacgaaaagttttcatggcacttcatcacctaattgactagtactcgtttgaggcgatggcatagaaccaaatctcctcagcatatgacctcg

SEQ ID NO: 2200 - DNA, 1322 bp, Zea mays
attttgggtccctcgaggccggccgggatcgccgccgcctgctctctacctctgcactccaatcagatcatcagatagatcactggccccgtgctgattaccgcgcttcccatctgagcagccagcctcccagggtacagggagagacgcagaagagacagctgctgcctcgctgagacgatggccggaggcggcgaccactcccagacgaacggaggccacgtcgaccagagggccttggaggagggcaggaaggaggagttcgctgaccagggctgcgccgccatggtcgtctccgtcccatttatccagaagatcatcgcggagatcttcggcacctacttcctgatgttcgcggggtgcggcgcggtgacgatcaacgcgagcaagaacgggcagatcacgttcccgggcgtggcgatcgtgtgggggctagcggtgatggtgatggtgtacgccgtgggccacatctccggcgcgcacttcaacccggcggtgaccctggccttcgccaccagcgggcggttcccgtggcggcagctgccggcgtacgtgctggcgcagatgctgggcgccacgctcgcctccgggacgctgcgcctcatgttcggcggccggcacgagcacttccccggcacgctgcccacgggctccgaggtgcagtcgctcgtcatcgagatcatcaccacattctacctcatgttcgtcatctccggcgtcgccacggacaacagagcaatcggggagctggctgggctggccgtgggcgcaaccatcctgcttaacgtgctcattgccgggcccgtctccggcgcgtcgatgaacccggcccggagcgtgggcccggcgctggtgagcggggagtacacgtccatctgggtgtacgtggtggggccggtggtgggggccgtggccggggcgtgggcctacaacctcatccgcttcaccaacaagcccctccgcgagatcaccaagagcacgtctttcctcaagagcacgagcaggatgaactccgccgcctccgcctgatggatctccatggccggtaatttagcctacaaaactatatattcacccgtgtcgtcgtgtcagtacgtgagaggatatagatatataattcctgcgtgcgtgtgcgtttgtgtgtggatggaaaacatatgaaagaagaggtatggtttgtgtgtggatggaaaacgtactgtgcctgccttcgaccctgggcaacgtcgctctaccccgtgaacgtgcttaacctgttgccgcatgttttgttaactcaattttaatgtgttggcgagatcataaaaaaaaaaaaaaaaaaa

SEQ ID NO: 2201 - DNA, 1973 bp, Zea mays
  misc_feature (1891)..(1891): n is a, c, g, or t
  misc_feature (1898)..(1898): n is a, c, g, or t
  misc_feature (1945)..(1945): n is a, c, g, or t
  misc_feature (1965)..(1965): n is a, c, g, or t
  misc_feature (1970)..(1970): n is a, c, g, or t
ttgggtacgggggcccgtacccgcgacttcctgagacggaggactcctttcccttctgtcatctgagactcggaagcctcggccgccgccgttaccacctccttgcgccatggcggagaagtcgccggcagccgacgtggaagccggtctccttgcccacctcaactcagcgggagaggtccccgactcacgctctttcgcttcctccctcggcgtctcccacctcgaacttgagggcgtcatcaagagcctctcagctttccgcatcgtcgacagcacagacatcatcaaggagacatgggtgctcaccgaggaggccaagggctacgccgccaagggctcccccgaggcacagctcgtcgccgcaatttcaccggagggtgcctctaaggacgcactcaaggcaatattgggagatgctttcgatgttggcatgaaggcagccgcgaggaacaagtggatagggttcgagaaggggaataaggacttagtccttaggaaggttgagagcgtaaaggatgagctgcaagagcagcttagaagactagagaatggggaggttgtttctgataaagtgatcgatgatttgaagagaaggaaacttattacgaaagagaaatcaatttggtactctctaaagaaggggtctgagtttgttgtaaagagaaaaacgttggctactgatgtgacaacagaacaccttaggagtggtgactggaaggaccttgaattcaaagactataattatggagctcaaggtcaacctatagccaaaggttatgttcagcctttgatggaggttcgtgaggcaatcgagaacatctttattatgatgggattcactgagatgccaaccaacaatttcgtcgaaagcagcttctggaatttcgatgcactgtttcagcctcaacagcatcctgctcgggattcacatgatacatttttcctgaaagctccagcaactacaaaacagttgcctgacgactatcttgagaaagtaaagcaagttcatcagtctggcggttatggctccaaaggatatggttatgattggaaacgggatgaagcggagaagaatcttctccgtactcatacaactgctgtttccacgagaatgttatacaagcttgctcaggagaaaccttttactccaaagaggtattactccattgatcgtgttttccgcaatgaagctgttgaccggactcatcttgctgaattccaccagatagagggacttatctgtgattatggtttgacacttggtgatctgattggtgtattggaggatttcttctcaagtctaggcatgtccaagctgcgtttcaagcctgcctacaatccatatactgaacccagcatggaaattttcagttaccatgatggtttgaagaaatgggtggaagttggtaattcaggcatgttcaggccagagatgttgcttcccatgggactgccagaaggtgttaatgttattgcatggggtctttcacttgaaaggccaacgatgatcctttatggtatcgacaacataagggacctgtttggaccaaaggttgatttcaacctcatcaagagcaacccactatgccgattgggactgtagtgactagtgaggtacagggactctgaagcttgatcacaatgtgccaaagaatttgttttccttttttgttgtgctcccttgaagtttgaacaccgattcatgtatctctggttatggctcaagaaaaccgctcatgatcggccatgttcaggtcctgaaatccctactaattctaaagctctggctaagctatggaatcaggggtcagcaatggcttttctactttattttggtgtgacaagtttttggggttgctgaatcaaaggatttgggggcaccaatggnctttgcnggctgtccccaatgaggccaaacaagcgcaaaccatggcagaagcgngccaaaatcaaagcttggangaccnggg

SEQ ID NO: 2202 - DNA, 1632 bp, Zea mays
ctagttcgtatctggaggaccggcgttcagtttctgggggaccacgctcgctagatccaggtgctgctcgtccgcccatcaatcagccgctatataactccacgcgcccgcccgccggggcccacaaacaagccgcaaagcaagcacacgagaaaaaaaaaatcacaatgagctcatgggttaccaagtcgctgccttttctcgtggctccggcagtggcctcgcccactgccgccctccagctcacctccatggacagagctctggtttccctgcccgtgtcagcgatgttcgtctacgagaaccccatcgatcgtccggccgagaccattagaagagctctgtcccgtgcgcttgttccctactacccaatggccggccgcctcgccgtcactggggaccagctgaagctcgcgtgcaccggcgagggcgtagcgttcgtcggtgcgtcggcgagctgcaccctgcaggacgccaggctctgcgaccggcgtcccgtggtcagtgtcgaggacctcagtatcagctatgccggccagtacagcgaggaccctccacttctgctggtgcaggtgaccgagttttcctgtggcggcttcgttgtcggggtgacgtggaaccacgtcctcacggacggcgccggcatggcgcagttcttgaaggccgtcggcgagtttgcccgaggttccccttccccttccgtcttgccgatgagggtggacgacaccctctctgaactccccccgccaataaccaccatgactaaggcactcgtcagcagcaagcccagagacatgccgtcctcctacatcacagttcccctgagcttcgtcgaccgcatcaagggcgagttccgtcgtcgcagctacggcagcggcagcggccaggtgtcgacgtgcactgcgttcgacgtgttcaccgccgccatatggaagtgccgtgcccgcgcgacgatcggcagcgccgccagcccggacgcccccacggcgctcgccttcacggtgaacgtgaggaagccggccaaggccaaggacggctactacggcaacgtcttcgccttcggcctcgctgcctcgacgctgcgcgaggtcgcggacggcgacatcctggaccttgtgacgctggtcagggacgccaaggcacgggtcccgttcacgttcgctgacggagccgcgcacatcgccgacgagatgggcggtcggctcaagggcctcgacggctacgacaccctgtacgtcacgagctggtggaacctcggcttggacgacgttgacttcggcagcggcggcgctgagcgcgtcatcgggtgcatggagcgcaaggtggtgccgggctgcttcctgtgcgggaaaaaggacaaggccgagggcgtcgccgccatggcgctctgcgtcaagcaggagcacgctgaggctttccatgcggagctacgaagcctcaagtgacgcggagaccttacatgtttgtccgtgtttcaattttaataagagcactttaaactcgtgcgttacaataaaaatatataatactacgataatttatatgtcacgattggtctgctgcgccgccgccgccgcgcgggcggatcggcacaatatacaatcaaaccaaaccaaaacattgatgacaaaa

SEQ ID NO: 2203 - DNA, 4092 bp, Zea mays
  misc_feature (1924)..(1924): n is a, c, g, or t
tgcaggtcgtattcattttttgtgaaaaaggaaaaatcaaagtcataattaaaatatattatatgctaaataatattatagtaaaaattaataataattatgggttttaataagatgacccagtcaaaattcgtgttaagaagtcaaacaaattataaatcgttaagaagtcaaataaattataaatcgaaacatagcgagtaaaaattatgatgtaacgatagataaagtccggaaagtttggaacccgtcatccaagtgaatttgattaaacgacacgaactcgagctgacacatgagggcaaaaagataagcggggtggtctttccgttctccagaagctagtagtacttactggtgtattttcccattatatacccacagcatttggcacgaaaacacggcccgacccgaccgtgttgatccatcttctccaaacccttttttctcctctttttgtgtttgctgttgattgagtttctttggtcgccatttgtgatttgattcatggtctctcccttttctcttttcgtgcactttcttccgttgaacgccatttcgctaggcagcagatctgcagtttgactgagtaaaaagagacgctctgtcctgtatggaaaagtcaatgagcatgccagctcctcctgtcccctcccacctataaaatcgcccgcccaccgcatcccctccgctgcaccaaaaacccaagcctcctctgccacacacacacctcgccagcaccacagccaccgccacagtcacacagtcagcgagagagagagcatggacctgctgaaccccgagcagatctccgagttccgggaggcgttcgcgttcttcgacaaggacggcgacgggtgcatcacggtggaggagctggcgacggtgatggggtcgctgcaggggcagcggcccagcgcggaggagctgcgcgagatgatccgcgacgccgacgccgacggcaacggcgccatcgacttcgccgagttcctgggcctcatggcgcgcaagaccgcggggggcggcgccggcggcggcgccgaccccgacgaggagctgcgcgaggcgttcaaggtgttcgacaaggaccagaacgggtacatctccgccaccgagctccgccacgtcatgatcaacctcggcgagaagctcacggacgaggaggtggagcagatgatccgcgaggccgacctcgacggcgacggccaggtcaactacgacgagttcgtcaggatgatgatgctctccgacggcgccggcgccggcgccgcagccacgggccaccaccaatgaacccatctccacctttcatcagcctagcgcttcccatcacgtcccttgccgatggagtggcggatcactccatccgtctctgcttcccttttctttttcaccccctcaaaaaaaaaaaaagatcagcgtccgtctctctaatgtaacgtacgtaatgtaatgtaactgatcaaatattcaacaagaaatttaattaccgaatggacggatgaattcgtaacatcgtacgtacctacgtgaaccatctacattcaaaaatcaaagctgcagcgctgaaatttatttgggattttggtttgacccacccaccgacacacaggtggtgccagttggaggagggctttattttattttgtgtctactcccccggcggctctcctcaagcatgaccttctctctctctctttaccatactgatcctaatctttaaccaaaattaagcagtcctgattttgttctgtgaaacgaaggaaagtgttatttacgaaagataatctttaacgccccatttggattgaattccattctaataataataatttaatttaggcaaagatcaattaagctaatatgattttatatgagaaatatttgtatactgttattagtaatatgttggagatatttatgngctacatttttattatagaggagtgagctaaagaacaatttataagttgcaacataaaaacatattatgttaatacataaaatcatttttcccatacttcaccacccatgaagttgaaataggcttatttctgagttttagagagtgatgaaatgttaaattccaagcgaagctactttattgagtaaattctaattcgactcaaataatagatccaaatgcctggtaactaaaaatatataataatttaaatacttttaatctttagaaagaaaactgattttattttagtgacaaatagatcgatttcttttcttcattccacggagcaagcagcaatcttgaggactttgacgacaaattgttaccccgactagagaggcagacataaaggtagcaatgggtacataacccgtatactcgttgggacataatgacatgtatgggttaaatttattacccatgggtatattaataggtacaatattgtatccattggatagatgagtacaactatgggtatatactactcatacccatgtactcatgggataatttgtacccggctcaaccatatatatatatatatatatatatatatatatatatatatatatatatatatatatatatatatatatatatataatatgatcaacttgcatgtttctacattatttattattttcttcttttatctacacacatttgatgattgataattttaatacgctatatatttattagatttatgttatttaatagaggtttagcgggtatctaatcgggtgtgggttacccgacgggtttctttacccatgcgggtatgggtattggtacaatttcatacccgtgagcgggtacgaggtttttgacgggtatgattttatcacgtgtgtacgggtatgtgtaaacattatccaccaagtatgtacccgttgccataggcaggtaggctgggcacctgttcgggcatcaccgctggccacgatgaacgtggtgcgtaaggccttacaaggagcacgacattgttacttaatacgaggtgatgagcctataactcctcaccgttcgtcgtcgtcgttgcagctattccctaaccctactagcctatgagcttgggggcatcatgctttggcgcacacgtggtgctctcccatagcacgacgacgtgcgtggactaagaggagcggtgtgtgaggactaggaggagaccgatgaccttcaagttggcgcacaaggagcaaacttttccaagcaacgatttgcttcaaatcaaatagaaactacctagatagtatcgtttgattcaatttatcttcctattcaagccggtaaaaacaatctgacatagtaacaatgatgcccaggcttcgaatgcgggctggctccgccattgtatactagaagacaacaccacacaacctactaagagtactagcattctagcaacactagagagctactaatagaaacaatgaacatttacacatcaactacttgaattacaatggacatttacacatcaactacttatattataatggtcatcaactacttcaatatatccaaccacatcaactacttcaatccatgcacatcaactacttcgatcgagactacaaactagtactaaaggtctcttgattaatggctcacaacgttatagctcatcttacaagtagtttttttactctaggaaaataattgtattagaatatatattcctaataactaaacaaaaatagatggccaaagaataccattgtcatctaacactaaatttctacttgtttgagttatttggccaaagactcacatgtatgcagatggaataaacaattagagaaaacatagaaaatatatgaaaaagaaatcaactattggcatgttcccgacgatggagccgtggatggcgatggagcacacagaggtgggcggtcgtcggagctcaagtgctagtggcggtgtgcggaggctgggtgcggggtgcggtagagacgatgactgcgtggagtgagtgagtaaagaagtgtgagagagagtcggctggttagggttacataaacctgttttgccgagtgcccgagatctagcacccgaatttttttaaataacactttgccgagtgttccgaggacgacactcgtcattttttttataaaaaa

SEQ ID NO: 2204 - DNA, 5454 bp, Zea mays
cgctagatcaagagctgtgtgcgcctggccccttgcctcggtttctgtgcacagaagtatttattagttgggaaaaaatgataatagatggtgaataggtatgaaaaatgatattttatgattatagtagggtataggggaaggatttagggggaactgctgtatagagtggagatatagggggaagagaacgctgacgtggcacgtgagtgagatatagggggagaaatttagggaggaccgctgaacacagtctgataagaggtcgcttcatcatgcctcctccatgtgcacgtaccttgtgcctgtctgtcacatagcccgagaaagacgtgggtatccaaactaccactagccttttaaggtttctatgaattatgtccgaaaaccttattatctatttactcgtagcactagttgctaccactaaaaaaatacatattttttttaaaaaaaataatcaaccggccatcatgcccgttattattaatttcaaaccaatacaccatcccctccatcctctcgtttttttcccccagccattaaccaaacccacaggacacgatgggccgccgtctacgtcttactccaaggaacccaagcccatgttacaacaacggtggtaggtagctaaactacaatagttgcagcaaaacgctatgaacagttgtatcgattgatacatcaggacctcctcccagcggaaattcaaatcggtgcccgtgcctggcgtttctgcagggtttccctgccgtcctcctcctcgctccacggccccagctcggacgtcctttgtgcgctttaatttcctgcaagcttctctctcctgcctggggctgtgtgtggtgtggttcgcttgatcgctttcactttgctgtacttgtgtgtttttttggggtctttcagtcgtgcccgttcttttcattcgttttcctggtagtcgtcctgctttcttcattgtattgtataacaccaatctacagtagccggcaaaacttttttgcttttgttggggaaaaaacaaagaaaggaagaagacgtctcgaccaaacaacttatttaaatttgtccagaactctaggtctagatatttccttgaatcgggaacatccgattttaaaaattgtcgtctcgtactccaaaaaccatgacgtaacaccgtcgagaatacgacttggtttttttctctccctctagaatatgttcatccctccacctcgctagaccacagctagatgtgtgcacgtagtactaataccactcactctaacaaatacgggtagatatttgggcagcagagatatctgcaaccgccacttttattttacggccaaagtgtagcagtatatggaatcaaaacaaaaaggcacaagcacaacaacacaacatctgaaccaccaccgcatacgttaaattatctcctctggtttaaatactcaaaagctatgtgcagcgcagcctacatcacttttctcctgcactcgagagccttgcgccacagagaaaaagctggaaaggcattccttgaacagtgagtggcttggtcggggtcaggtcaggtgacggcctccctcggagagcagagcagagcagcggccacgtcactgcattttccgacgccattggtgatcagcgcttcttttaggagtatagtctttaattacaaacgcactcacgacgagtagatctgacgacgcggtctcggtggtcgccgccatcaccattacattacctagtaatgcgctgcttaaaaactcctggtcggggcaggggcccgccgctgatcacactttggcgtcggcgtcggcgaggaggaggcggcggcggcagagcgggcagctggggtgggaccggagccatgcgtcgacgcagtccgggtggaagcagtggccgcagggcgggagcaccttcaccttctccccggccaccagcgcgctgatgcagatggagcacagcgcctcgtcgtccccgccgggaagccgcggcgacgcggacggccggtgcagcgtcacgggcaggccgcggatggcgtcggcgtcgaggccgggcagcgccgccgcgccggctggcgacggcgacgacgacgacgaggcgtccgcctccgggtcgtagcggtggcgctggcgctggcacctccagcagaggtacaggcagagcgcggcgaagacgacgacggcgcacagcagccccgccagcagcggcgccgcgcggccgcgcaccgcgaagttgctgtcgcccacgtccccgtaccgccaccgcgtcaccaccacctgcgggttccctgcggcgctctcctgcgctgccattattggtcgctcctcgccgctgccggtcactgtatgtggcagaggggcatgggacgacgacgggggagaagcggaaggagcgccgtcgtcgtcgtcgtcgtcgcgggggtggcagaggcaactggcaagtgcgacgggggcgtggttataaaatctgaactggaagcgcccggggccgtcccttttgagactaggctgccgcgccagtcgccagtagtagtggctagtgggcgtcagccagtagtaaccagcaagcctccgtacttgagcggacggccaaattgcaaagtggcagcagcgaatgagcgccaaggcaacaaatcaaatggacgggtacgaccagattacactgaggatcttttgggatttgattagagttttggccaaaaccataaagcaaaaaaaaaaaaaaaggaaaagatcgcgtacgtgcgaccactgctgcacgatcatggcaccgttgaagttgaagtagcccgccattccgatgtatgtatgtatgacctgacgggtcgcgtcagtgcgccggggacgacaggatgcatggcatggcatgtcagtggtgtcaacaacggcctaccgtaccgctacagttgtagcgccaccaagctagcttagctgtgccaatgttgttgtagacgacgtacatcatcgtgtgttctgagctattagctgatagcaacctgacacactctattccccgcaggtctcattatattagcacctactagcacgcatattattgggcctaattggtttagctttttctagaggatcttttctatgcaggcccattatttatccatccgaagcacgcgtcggcctacaacgccgagctcagaataagttggcctagctacctgctggcccgtcattttccacacggaaaatttccatttttttcgagccagcagaattatgtatgtaatgcaattcgaaactctgcgatagaattaacatatattagaatggccgaaaggatgtggtgacaagtctgtagttcactgagaaaccacgcaaactaaacggcgactgtagccaacgacagaatttaatttatcttaatcgtcgagaagagggtaaaatggaatttaatttttcgcagctggactctaggaagacagatgccacagcgacacgcaaattattatcgacgcttgagctgtaggtttctggaacgttctcatggccggcgcccccatccggaaagcacgacacgactccacgtccccctcgcctccgggacacgcgtccccggagcgccgccgctgccccccttttatttaaggcaggctctcagttgacacaacacaacaagctcgacggaacaactgactagaactagtacgtagaaatccaacactcgggacgaaattaaaagagacgagacgacgcatcatccggcatggcggcgcaggagggcggcatgaggctggtgtcgcacccgatcgcggcgcacgacgggcggctgccgcggcagtacacggcggaggggcagggcgccaagaaggacatgtcgccgccgctggaatggtacggcgtgcccgagggcgcgcggtcgctggcgctgctggtgcaggacatcgacgccgaccccatcgtgccgtggacgcactgggtggtggccaacatcccgcccgccaccaggggcctccccgaggggttctccggcgccgcgggggcggggccggggcgcgaccagctcggcggactgcaggagggggtcaacgactggaagcagcccggctggcgcgggcccgtgccgccctcccacggccaccgcatccagttcaagctctacgcgctcgacgacgaggtgcacctcggcaacaaggtacgtttgatgctgagatttaatttgttgggagtagttatcgatttgcggtcgaattaattaattgcatgcaggtgaccagggataagctcatggaggcgatcgacgggcacgtgctggaagaagccgagctgatcgccgtgttccagggagtcgtcgccaacaactaacacacacactcagagatatctttgttggcgtgctttgtatttgcttgtgtggctaccatgtaattttgatcgaataaaagggaacttcacatgtgcttagcttattgtgtgacgaagagtacgtcatgtgggcagctttacgtgctttacgtacgttaagagtaggggtgggcacatttttacccgaaccgtaccgaaccgtaccgaaccgaaattttggttttttcggtagttcggttcggtttcggtttttgtatctcaaaagttcggttttcggtatcgtaatcggttttcaccgtataccaaaccgaaataaaaaaacgaattacctaactttatcaattttaaattacctaactttatcaattctaaaatttggctattcgattatgtgaactaaatgtttgaaacaattaaattgttattcacttatttatttgtgatgtatgatgtatctctaaatatttgtacatatataattttgaatttttaaaattatatgtaatctatcatataaactttttgtatgtattgtcttgagtataagtttggtattcggtttttaccgaaaaccgaagtaaaaaaccgaaaccgaacttttcggtttttcattttcaagaaaaccgatcggtttctaatgtctagaaaaccgaagttttttaaaactgaaaaaccgaaccgaagtttcaaaaaaaaaccgaatgcccagccctagttaagagtaacaaaatggtctttcaaatgctagcagttgtgaatttggccatggcagcattatcaatttgcctgcagcagctcctatcatcagttactggtggagcttatttaggccttgttcgtttgtatcggattgcacccggaaccattccacctaatcaaagtttatataaattagagaagcaatccggttaggatttgtttcgacccatcaatccgacagaaacgaataaggccttaagatgaaatagtaaacctggttgatgacacataccctctgtttggttagaggacacgagtgtttggttagaggacacgagggtctgtttggttagaggacacgagggtgcacctccagccgcagagtctcaaagcaggtgacgtttgattggcttcccatcacatacaggctgaatagatacaaaac

SEQ ID NO: 2205 - DNA, 778 bp, Zea mays
cccacgcgtccgcccacgcgtccgcccacgcgtcaacacaagctcgacggaactgtgactagaactagtagatccaatccaacactcgggacgaaattaaaggagacgacgcatcatccggccggcaggcatcgcacggtcaccaccatggcggcgcaggagggcggcatgaggctggtgtcgcacccgatcgcggcgcacgacgggcggctgccgcggcagtacacggcggaggggcagggcgccaagaaggacatgtcgccgccgctggagtggtacggcgtgcccgagggcgcgcggtcgctagcgctgctggtgcaggacatcgacgccgaccccgtcgtgccgtggacgcactgggtggtggccaacatcccgcccgccaccaggggcctccccgaggggttctccggcgccgcgggaccggggccggggcgcgagctcggcggcctgcaggagggggtcaacgactggaagcagcccggctggcgcgggcccgtgccgccctcccacggccaccgcatccagttcaagctctacgcgctcgacgacgaggtgcacctcggcaacaaggtgaccagggataagctcatggaggcgatcgacgggcacgtgctggaagaagccgagctgatcgccgtgttccagggagtcgtcgccaacaactaacacactcggagatatctttgttggcgtgctttgtatttgcttgtgtggctaccatgtaattctgatcgaataaaagggaacttcacatgtgcctaaaaaaaaaaaaaaa

SEQ ID NO: 2206 - DNA, 2119 bp, Zea mays
ctgcccactgacacccaccaagaccaactgatgcctcggccccatgctgccctggcccactcgccggcggtacggccgcggcggcaccaaccggggtggcgtgcctcgtaggtgacttatgttcttgtcggggagtaaaaaatggctgccaacggaggtgctgtgactgctgctgcccccccccccccccccccacacacacacacacacgtctcgcgctttgattggcctgacgtcgcctctaccggctcgatcctgggtgcgccgccacgtagtacgcccttccgcctccactgcggcacgcactgcctacccctccctcccccggacgggccggaccctctgcgacaggggcagcgtggcagtgggtgtgcgggcgcgtgcatcaacgcagacgatccgggcgacttcacgttatcagttagcacgtacacgcacaccgccggcaccggcgtcgggagggacacctgtcgcccgccgcactctgacctccgcccccgccgcgcgagacgacagcgcccgcaccaagacgaggcaactcggcgagcgggacaggtgctgccagcgcgagcctcctcccacccaaccccaacaccaccaccaccagacaccagtccaccactaccactgaggcgagccggaggcgcacacaggcacagcacagtccgggcccgtgccttccaattcggtcgtcgcacacatcgattgagcccgcgcacgagcccatcgctttcgctttggcgtcttcgagaacccgcaagcaacctatatagcccgccgcgaattccgcctggcttcctcgtcgcccgcctcgtcgtcgcgccgcagtgagaggagggggaggcgatggatctcaacgaatgcgagaggagggggccggcggggccggatccgctgtcgaggcaggggtcgatctactcgctcacgttcgacgagttccagaacacgctcggcgggatggggggagggcttggcaaggacttcggctccatgaacatggacgagctgctgcggagcatctggaccgccgaggagagccaggccatggcgtcggcttcggcctcggcctcggcctcggtgtccgcgctgggggcagccgtcgacggcggggcggcgctgcagagacaggggtctctcgcgctgccgcgcactctcagcgtcaagacggtggacgaggtctggcgggacttcgtgcgggaggcgccgcccgggacggctggcggcgaggagccgcagcccaaccgacagccgactctcggggagatgacgctggaggagttcctggtcagggccggggtcgtccgtgacaaccctgccgcggcagctgctgctgtccctgcgcagccggttgctccacggccgattcaggcggtcagtaatggcgcctccatctttttcggcaactttgggggcgccaatgacgccggggctggagcgatggtgtttgcgccggtggggatcggggatcaggccatgggcaacgggttgatgcctggggtggctgggatggcaggtggtgcggtcaccgtgagtccggtggatacgtcggtggcccagctggattctatgggcaagagcgatgaggatctgtcatcgccaatggctccggtgccatacccctttgagggagtgataaggggaaggaggagcggtgcgggtgtggagaaggttgtggagcggcggcagaggaggatgatcaagaacagggagtctgcagctagatcccgtgcccgtaagcaggcttatacaatggagttggaagccgaagttcagaaactgaaggaacaaaatgcagaattgcagaagaagcaggaacaaataatggagatgcagcaaaaccaggtcccggaattggtcagcaatccatatgcacaaaagaagcgatgcctgcggagaacattgacaggtccctggtaactgagttgttgttgatcggactcgacaggatatttaacattatggtacttgtacattcttcaggatttggagaacccaaatttctgttgtatattagcgatcaacagagtcgaatgtaccagtgcataactttcttctcaaaaaaagaaaaaaaaaaaaaaaaaaaaaaaaaaaaaaaaagggcggccgccaccgcggtgga

SEQ ID NO: 2207 - DNA, 3359 bp, Zea mays
cgtccgtctcgcgctctgattggcccggcgtcgcctctaccggctcgagcctcggtgccgccacgtagtactcctacgcccccccgagctccactgcctatcccaccttccccggatcctctgcgacctgcgacaggtacggcgtggcagtggccagtgggtgtccgggcgcgtgcaccggcgcagacgatccgggcgagctcggcacttttttatacgtacgcagcggcgctggtaggggacacctgtccgccgccgcactctgacccccgcccccgccgcagcgagacgagatcgcccgcaccaaagcaagccgaggcggcgagcgggacaggtagcggctgcctaccaccgccagcctccgcccacccaacaacagcaccaccaccaccaccacagtccggtcccgtgccttccaattcggtcgtcccacgcatcgattgcgcccgcgcacgcgcccgtcgctttgccgtcttcgaccacccgcaagcaacctatatagcgcgccgcgaattccgcccggcttcctcgtcgcccgccgcagtgagtgagaggaggaggtcgatggatctcaaggacagcgagaggaggggggcggcggggccggggccgctgtcgaggcaggggtcgatctactcgctcacgttcgacgagttccagaacacgctcggcgggacggggggagggctcggcaaggacttcggctccatgaacatggacgagctgctgcggagcatctggacggcagaggagagccaggccatggcgtcggcctcggcgcccgcggcgggggcggccggcgacggcggggcggcgctgcagaggcaggggtctctcaccctgccgcgcacgctcagcgtcaagacggtggacgaggtctggcgggacttcgcgcgggaggggacggctggcggtccggagccgcagcccaatcgacagccgaccctcggggagatgacgctggaggacttcctggtcagggcgggggtcgtccgtgacaaccctgccgccgctgctgctgctgctgctgctgtcccgcgcagccggttgcgacgcggccgcttcaggcggtcaataatggcgcctccatctttttcggcaactttggaggcgccaatgacgccggggctggagcgatggggtttgcgccggtagggatcggggatcaggccatgggcaacggcctgatgcctggggtggctgggatggcggctggtgcggtcactgttagtccggtggatatgtcggtggcccaactagattctatgggcaaggggaatggggatctgtcatcgccgatggctccagtgccctacccctttgagggagtgataaggggaaggcggagcggtgcgggtgtggagaaggtcgtggagcggcggcagagaaggatgatcaagaacagggagtctgcagctagatcccgtgcccgtaagcaggtcacacacttgtcctgaatccttgcatgtgttgttaagtagtagttgtttcctattgcaagttgctgctctaagattctttattacgattctggtaaatcagcacattggtcttgtttatgccctgtcgaaaacgacgaatatttgataaggtagtaaggtagaggcacatctggcctagcatatcacatttgcaacttcagacacataacctgttgcttatatctgttatgatttgtaggcttatacaatggagttggaagccgaagttcagaaactgaaggaacaaaacgaagaattgcagaagaagcaggtatataccatattgtaccatttatgtacatttaaagagtattttctgtcacttgtcagaaagagattctgattgtatttgctcgtctggctctggcccaatgctaattgcagcaattatttcacagattttgtgaaatgacatgattatttcttgagtaaagtatttgcttggaagtttggtacagaggattgttaattgaatagttctactattaaaaaagctaaattttttggtgaagtaagtttgaacaagtgctgtgtaggatctcactgaatctttttttttgtgattttcgcaattgatatgagcacaactaatttgaagaaaaaacttgagaagataaagtcattttaagaattgatttatatgaagttggattttttattaaaatgatcaaacattttaaaaagaagtagcactctttaaaaaacaattgcagagctgggctttaaatgaagtacttagttaagaagtgagattaaaacatgaaaattctctttaaatgtatatagatcttgaacttcagtatctcttggagttgaggagttcattttaggacttcagccatcatacagttgtgtcatgccaagtgtgtttttatgttgaacttctacatagctttaaattggtagcatgctttgaatgctgcactttcaatagcactttgtttggaatagcatgagattgcacagatgtgtctttgtttctcctcccaccaggtagacctttgccccttgtgttctgtctactggcccatcccaataccaaattgttttttcctgaactcaatccatttgagtgaggcaaaaaatgatgtgcaggccaactttttgccttctttaataccattttagagaaggaaacccattaaggggcctatttggataggatccagggcaaagtccccttatcgaaatagggggtgaagtcctattttgatgggcttatgattcatgattattctttttttttaaaggaaggggcaaaaaggcttgccgctccgttctatattagatgaggaagtaaacaaaggggaacaacagactcgaagcaactgaagtgaagaagaaacaaggaaaatcaagagaacaagaaagaaatcaaaaaaggaaaaaacagggcaaaaacaagaacaaccactaggaaaaaacctaacaaggcctcagctactagcattgcccatgatagccatagtaacttggtctacacccctatgctgaccttgaaagattctgaaatttctttccagacatagattccaccagaattgaattagcagaccgtcgaagttccttcttatctgtctgctgcaaagactacgcaggtccgtccaccaatcgtacaaggaagtgccactagggagcccagtcaggaaaggaaggttggcccgagacaaaactttgttccacacctctctactaaaggggcaatctttgcataagtgcagaattgtttccggggctgagttgcagagacagcagattgggttacaaggccagcctcttttttgaaggttatcagcagtcagtattctcttatggagtagcgtccaagcaaaaaaacggcacttcggttccactttagccttccaaatggggctctaa

SEQ ID NO: 2208 - DNA, 2275 bp, Zea mays
acccccgaggctcgccgggcctcgtttaggcattcccctcccctcccctccccacctccccgtcgtcgtagtcccctgttcatccatcgcaagaactcctgggatcgcgctgggttcgccgcttgcatgcatgcacgcacaagcccgcgagcccggccggggtgccagcatattcgttcgctagctcgtgggctcttctccgtctccgatcccttccgtccgcgctgaagaacatgcgcgcgcgccgggctgtttagatccgatccgatccaggccttcttccgttgcaacctgtgccttgaggcctcctggtgatcgatcttctgcattaattgctggctcaatggtcgccacagccacaggcgtagagtgctgcaagatctttggttttgttgctctataaacactgcatgtgttcagtattgtgaggccattttaaggaatgcagaaagatgtgtttgagtgaaaaagatttctgctctgaagaggagcacatttctccaataaatttcgaatcgctaataattcttgatgagcgaggatttcaagcacacattagacgcatagtagaaaatagctgtgatgcaactgatgtcagaagaaatatcgcaatgctatgtcatataatttctgaagacggctgaagttctctctttaccaagttcctacaatcagttggtagcaggtgtctatatatatatgatggaagcagagaagaatggaaacattcttatgcaaaagtatgaggttggaaaattattggggcaaggaacatttgccaaggtataccatgctaggaacatagagacctctcaaagtgttgctatcaaggttattgacaaggacaaaatttttaaggttgggctaatggagcagatcaaacgagagatatcggtgatgaaactggtgaggcacccaaacatcgtgcaactttatgaggtcatggctactaaatcaaagatatactttgtgcttgaatatgtcaagggtggtgaattgtttaacaaaattgctaaaggaaagttaagagaagatgcttccaggaaatacttccagcaattggttagtgcggttgatttttgtcatagtaggggtgtgtatcatcgtgatttgaagccagaaaacctactcgttgatgagaatgggaatctaaaaatttcagattttggattgagtgctcttgctgaatcaagacgccaagatggtcttctacacacaacttgtggtactccagcatatgtggcgccagaggttattagccgaaaaggatatgatggcgcaaaggttgacacatggtcctgtggtgtgatcctatttgttcttatggctggatatcttcctttccaagattcaaatttgatggagatgtacagaaagattggaaaagcagatttcaaatgcccaccatggtttccatctgatgtacgcaagttagtgtcaagaattcttgatccaaatccaaggactagaatgccaattacaaaaatagtggaatgcttttggttcaaaaagggcattgacaacaagctaatccgaaagaatatcgagatgaaagggaaagtttcagctctcactgatgttaatgtagttttctcatccacgggtattggtagcaacaataacaaattggttgatgtggaacaagatgtagcaaagattaccaacctgaatgcttttgacattatttccctttcagaaggctttaatctttcaggcttatttgaagagtccgagaaaagaaaagaggcacgcttcacatctagtcaatcagcttcaactattatctcaaaactagaagatgctgccacctgttcaaagatgacaataaagaaaaaagaaggtggtgtgctaaaaatggaaggtgcaaatgaaggaaggaaaggtgtactatctattgatgctgagatctttgaagttactcctgctttccatcttgtagagattaagaaaaataatggggatacactagaatatgaaaatttgtttaagcaggacatgaaaccagcgcttaaagacattgtttgggcatggcaaggtgagagtaaggaccaacaggccaaggatcacaatcaatcataaattactcaaccagtttgtttccataataagaaataatgtttgttagtgttcaaaagttgtatctacttcaaactttctcgcatttgacataaacatgtgatttgattcagagtttgttaagaaccatagtattgttatgttacatctatcattaattgtttttctatattgataaaaaaaaaaaaaaaaaaaaaaa

SEQ ID NO: 2209 - DNA, 844 bp, Zea mays
cattgggtaccccgaggccaatctccagtcgtgttgtggccggaagagacagacacgcaaacgagaggactcgagagagattccgccgccaccaccgccggctcagatgccgccgccgcagtcgggcatgaccctctgccgccttcccaaggccacccttggccttcccctttctctcccctctttgctatatcgtcccagcctgtccctcgccgcacgtcgcaccaaggccgtctccgccagggcctcctcctcctctccatcaccggactcttccttcggttcgcggatggaggattccgtcaagaagacggtggccgataaccccgttgtcatctactctaagtcatggtgctcatattccatggaggtgaagtcactcttcaagcggatcggtgtgcagccccacgtcatcgagctcgacaatctcggagctcaaggaccacaactacaaaaggtattagaaaggctgactggacagtctactgttcctaacgttttcatcggtggaaaacacgttggaggctgcacagataccgtgaagctgtatcgcaagggggagctagctagcatgctgtcggacctggatatcaacattgacaactcatgacaagctatgttctgcaaggattgggcgagacttgggcagcactgtattgagtttctttttttaacatgtgcgatgacaaacactggtgtcatttacacattttcgtttggtactccgattaaatcattgaatttgaccaccgtatatatgcaatttgctagaaaaagaagggaacgagctcgcaaatcatgtgtactcggcaattttgtcaaaaaaaaaaaaaaaaaagggtta

SEQ ID NO: 2210 - DNA, 879 bp, Zea mays
cactccggcggccgcttcggggccccgcccccgcccgggagagacgaatcccatcgtgttgtggccggagagacgagaggactccagagagattccgacaccgctgggctcagatgccgccgccgccgccgccgccgcagcagcagcagcagcagtccggcatgactctctgccgcctccccacggccactcttggccttcccctttctctcccctgtttgctacctcgttcccgcccccgcctgtgcttcgccgcacgtcatgccagggccgtcgccgccagggcttcctcatcctctccatcaccggactcttcattcggttcgcggatggaggagtccgtcaagaagacggtggccgacaaccccgttgtcatctactccaagtcatggtgctcatattgcatggaggtgaaggcgctcttcaagcggatcggtgtgcagccccatgttatcgagcttgaccatctcggtgctcaaggaccacaaatacagaaggtattagagaggctgactggacagtctactgttcctaatgttttcatcggtggaaagcatgttggtggctgtacagatactgtgaagctgtatcgcaagggggagctagctagcatgctgtccggcctggatatcaacattaacaactcatgacaagtttgaccatgttttgcaagtatagttttgatgtttgagagacttgggcagtcatgtattgagtttttttaacttatgcagattctttatgtctgcaagaaaaaaaaaagctgtgtcatttacacatttttgtttggtactctgattaaatcattgaatttgaccactgtatgcaaattgctagaaagaaaaacgaacgaactcacaaaaaaaaaaaaattggcct

SEQ ID NO: 2211 - DNA, 2860 bp, Zea mays
  misc_feature (1914)..(1914): n is a, c, g, or t
cattgggcaaccattcatttccccctaacgaccttctccattaggctcacagaggagcacaatatgaatcaaacgctagtctattcactgaatatactggttttcccaaatccaaattatgaaagaattcttcagatgcaattaaagacacctaatacagcaacattagcacaattgaacattgccaggcatcctaactctataaatagctctttaaatttagtggctctctatccttctgtcttcgttgtctattttttgataggctgcttcattctctattcagtcggtaggtttaccaagttagattaggctacactttttctataagatctattttagagagtatctatatcagtaaatttggatactctttttagctaattggctttgacaattttcacttgtcagtaaaaaaataaaaataacagcaaaagttggcctggacatccttgcacaaaccgtaatatctgtgttatttcaccatttgcagcatcatattgaaaaaggccgtaacgtgcttgtacaatacagcattctttttgagttacaacatacaacagcacatgtagaccactggcgtcccggaggaccttcaaaatcagaccaaaatttaaggggcctgccgacaccgacaccgacctaaccaaagcctcaatccacatgatcatctactacgacagcctgattgttcgagaacaatggttcccttttcttggggaaaccagggggctccatacctggccccctgtacttgatctcaggagtacccctaagaccaggctcagccgaagcaggtcggtattggattccagatgtccctgcatatctagtaggggacacgtaccttcttggagcactcctcaacgccccgccccgcagatccacagccctagtagcatcagaatagcctcggtcggtagttcttgtagtggcatccacatagcttctatcactggctcttgatgttccatcaacatagccccggtcactgcttcttgctgtgctgtctgcaaaggctcgatcactagttggatgattcaaaaggctccccgttggtgctgttacagaggtgttaaatgtctcctctggtgtccatcccagagaatccttctttttcacgtatacttgccaaatgccgatcaagaacaggaggaaaagcagcgctggtccactccatacaacagcattgctctctggcttgtacaccgggaagttagacctatagatagcaatgtggccatccccaagacccaagatcaccagcttctcccggtctgccgcgataacaggcttcccagctggctcggtgggcagcacgccaccagaacccgcaaacacagatttgatgtccttgatgcttgtggcaaacagcggccgaggcgcaccgactctcccataatactgtgacgatgtgttgaagacaagaattttatcatggctggccaccaaaaggtaacccttggtcctcgcgtccgcaacggggttgtccatctcagatttcttgacggaacggacccggcatttgaggctggaaacatcaccaagaagcaggacgtgcacgagatcaccagcttcggtgaagccgtaggccttgaatcgctccgaggggtcaaaagagtatgccttgacgctggtgccattgagcatttcagcaaggccctcacagggcgtctcgcggaccgacatggagcggaggtcgagggacgcggctccggcctcggtgaggaagaggaggcgctgcttgacaaaggcgagaggcgtggacgaggcgatagcggtgccgtagagcgtgccgttctcggtgaagacgcggatgcggccgccggcgtcgcaggagagcacgtagcgcgcccggccggcgtggtgggcctcgaggtgcacgacaggggcggcgtcgaggccgcggacgangaggcgggaggaggcggcggcgagggtgagccagtcgtcgccgtgcggggacgactcgatgaggcggtgcgcggcgatggagccgtcggcgtggccggtgaagagcaggcagtcggtgcggcgcggcgaaaggtaggcgaggagcgcggtgacgcggcactcgccgccggaggcggcggcctcgagctcgagcagcgcgtcgcccgcggcggagaagacgaaggcccggccgcgggagtccccgacggcgaagtacttggtgagcccttcggcgtcctcgtacggcagcgcggccgccgccgcaacgtaggcgccctccccaagacgcgcggccgccgtgaagtggaagcgctcggaccagacggggcgacgcttggtgaccgccacaccctgcggggagcgccggtccccgacggccgccgccggggcgacaggctgcgagggatccgggtccgcggatctggcaagcgcggactcgagcgcgtggacggacctcgcaagcgactccgccacctcctctagtttcgcgagctgcgccgcgtgccgctccagcagcgcggcctcggccgccggtcccggcgcctcctccgacgcggcagcgagcgggaggaggaggaggagggcagcgacgcggtggggcatggctgtcagcggtggtgagcgggaggccgtgtagggtttgttcgggtcccggccgcctggaggctggactgaggggatctgggtgactgcgtgggctggggaaagtggcagggaatgcggtgtgcggaagaggcccacctgtcagcgagagaggcttgcgcacaaccggcgccgcgtgctggaacagtggaactagaagaagggccgttgactgtcagctgctgtggacccagatatcagtgaaggcgtggggcaaaaagtatttgcctgaaccacattgtcatgtacaacactacccaaccca

SEQ ID NO: 2212 - DNA, 1227 bp, Zea mays
  misc_feature (1071)..(1071): n is a, c, g, or t
  misc_feature (1082)..(1082): n is a, c, g, or t
  misc_feature (1086)..(1086): n is a, c, g, or t
  misc_feature (1096)..(1096): n is a, c, g, or t
  misc_feature (1103)..(1103): n is a, c, g, or t
  misc_feature (1135)..(1135): n is a, c, g, or t
  misc_feature (1152)..(1152): n is a, c, g, or t
  misc_feature (1154)..(1154): n is a, c, g, or t
  misc_feature (1199)..(1199): n is a, c, g, or t
  misc_feature (1213)..(1213): n is a, c, g, or t
ttcgcgcaccaccatcacgccgctgtggccgcaccagccccacctaccaacctcagtaccatctcagccgtccattcatattgccggctaccccgatccccccggcccactcatcaccgtgctcctcgcccacctaccgcgccacacccgcctcaaatcaccggctcggaaaccaccaccaattacatcggcgtcaccgtcaccgccgctttccgagctctcatggcggcgtccgcgtcctccctccttgccgcccccgcatcctcatcctgtggggccatctccccccagctccctcgtggagctccggccgctgcctccgtcgcttcgccgtcgcgtcactcctgctacctcctccgcgcttccccttcgaggcgccatcggagtcgcttcgtagccaacgccgctcccaccatgcagcctccggcggagtccagggtctccacggtagtcgatgtcgacctcggcgaccgtagctatccgatctacatcggcgcaggcctcctcgacgagccggacctgctgcagaggcatgttcatggtaagagggttctggtggtgaccaacacgaccgtcgcgccgctttacctggacaaggtgacatgggcactcacccacaacaacctgaatgtatcagtggaaagcgtgatcctgcccgacggtgaaaagtacaaaaatatggacacgctgatgaaggtgtttgacaaggcagtcgagtcccgttttgaccgccggtgcacatttgtagcactgggtgggtggtgtcattggggacatgtgtgggttttgcagctgctgcattcctcccggggcgtcaatttcatacagataccaactactctgatggcccaggtggatttcatctggttggtgggaaaaccgggattaaccaccccactaggaaagaacttgattggggcattttaccagccacaatgtgttctaattgacacaaatacactgaacacattgcctgacagggagctagcttccaggcattgccgaggtagtaaagtatggggctcataaaggggatgcaccattctttgaagtgggccaagagaagaaccnggccgaaattngttnagccaagagnaaccaanggcttttggcctatggctatccaagagatccnggtggaaaaccaaagcngnaatggttggccccagatgagaaggaaagtggccttcgagcaacantaaaccgggggtcncacatttgggccag

SEQ ID NO: 2213 - DNA, 1686 bp, Zea mays
cctcgaggccggccgggagcccgcctccgacccccgcgcggccctggccggcgggacaccaccacattgccgtcaccgtcaccgccggcccgccgccaccgcttcccaagctatctcatggcggcctccgcgtcctccctgcttgcagacgccgcatcctcatcctgcggggccatctctccgcgtccccggttgcttcgtggagctccggccgccgcctccgtcccctcgccgtcgcgtcactcctgctgttccctccgcgcttcccccgcgaggcgccatcggagccgctttgtagccagcgccgttcccacgatgcagcctccggcggagtccagggtctccacggtagtcgatgtcgacctcggcgatcgtagctacccgatctacatcggcgcaggcctcctcgacgagccggacctgctgcagaggcatgttcatggtaagagggttctggtggtgaccaacacgaccgtcgcgccgctttacctggagaaggtggcatgggcactcacccacaacaatcccaatgtgtcagtggagagtgtgatcctgcctgacggcgaaaagtacaaagatatggacacgctgatgaaggtgtttgacaaggcagtcgagtcccggtttgaccgccggtgcacatttgtagcactgggtggtggtgtcatcggggacatgtgtggatttgcagctgctgcattcctccggggcgtcaatttcatacagataccaactactctgatggcccaggtggattcatctgttggcgggaaaactgggattaaccacccactagggaagaacttgattggagcattctaccagccacaatgtgttctaattgacacagatacactgaacacattgcctgacagggagctagcctcaggcattgccgaggtagtgaagtatgggctcataagggatgcaccattctttgagtggcaagagaaaaacatgcctgaattgttagcaagagaaccaaatgctttggcctatgctatcaagagatcttgtgaaaacaaagctgaggtggtcgcacaagatgagaaggaaagtggcctacgagcaacactaaacctgggtcacacatttggccatgctatcgagactgggactggatatggagcatggctccatggggaggctgtcgcaactggaatagttatggcagctgatatgtctcatcgcctggggtggatagatgactccataaaagaacgtgtgtttgccatactaaagcaagccaaacttcccattgcacctccagagaccatgaccgtggagaagtttaaaaacatcattgctgttgacaagaaggttgctgatggtctgttgagactcatccttctgaaaggaccactagggcgctgtgtctttaccggggattatgaccggaatgcgctcgatgaaacccttcacgcattctgcaacaactgacccatctcagttttggacttcacttctgtatgctaatactaggccatgtatatccatcaaagaaaagattgcgatgtacattatcttcattgtctcattggtatatttttgtcagaaataatggtataatcgtttatgtgttggtttgagtttgcagagaaccatgtctaatcaactgtgattgttctctactgataaagaagctctgtcaggtgacaaaaaaaaaaaaaagaaaaaaaaaaaata

SEQ ID NO: 2214 - DNA, 1943 bp, Zea mays
agaaagaaacgtctggtagagggcgccgtagcgctcgccgatcccttacagatgaacagttcacggaaaggggcagctgcggatagccttaacctcctggagacgggcgttggagcctgacaccttcgcggcttcgcgcaccaccatcacgccgctgtggccgcaccagccccacctaccaacctcagtaccatctcagccgtccattcatattgccaactgcccagatcgatccgtctcactcatcaccgtgctcctcgcccacctaccgcgccacacccgcctcaaatcaccggctcgttgggcaccccgaggcccgccgggacatcggcgtcaccgtcaccgccgctttccgagctctcatggcggcgtccgcgtcctccctccttgccgcccccgcatcctcatcctgtggggccatctccccccagctccctcgtggagctccggccgctgcctccgtcgcttcgccgtcgcgtcactcctgctacctcctccgcgcttccccttcgaggcgccatcggagtcgcttcgtagccaacgccgctcccaccatgcagcctccggcggagtccagggtctccacggtagtcgatgtcgacctcggcgaccgtagctatccgatctacatcggcgcaggcctcctcgacgagccggacctgctgcagaggcatgttcatggtaagagggttctggtggtgaccaacacgaccgtcgcgccgctttacctggacaaggtgacatgggcactcacccacaacaacctgaatgtatcagtggaaagcgtgatcctgcccgacggtgaaaagtacaaaaatatggacacgctgatgaaggtgtttgacaaggcagtcgagtcccgttttgaccgccggtgcacatttgtagcactgggtggtggtgtcattggggacatgtgtggttttgcagctgctgcattcctccggggcgtcaatttcatacagataccaactactctgatggcccaggtggattcatctgttggtgggaaaaccgggattaaccacccactaggaaagaacttgattggggcattctaccagccacaatgtgttctaattgacacaaatacacttaacacattgcctgacagggagctagcttcaggcattgccgaggtagtaaagtatgggctcataagggatgcaccattctttgagtggcaagagaagaacatgccgaaattgttagcaagagaaccaaatgctttggcatatgctatcaagagatcatgtgaaaacaaagctgaagtggtggcacaagatgagaaggaaagtggccttcgagcaacactaaacctgggtcacacatttggccatgctattgagactgggacaggatatggagcatggctccatggggaggctgtcgcagctggaacagttatggcaactgacatgtctcaccgcctggggtggatagatgactccatcagaaaacgtgtggttgacatactaaagcaagccaaacttcccattgcacctcctgagaccatgaccgtagagaagtttaaaaacatcatggctgttgacaagaaggttgctgatggtctgttgagactcatccttctgaaaggaccgctagggtgctgtgtatttacgggggattatgacgggaatgcactcgatgaaaccctacatgcattctgcgacaactgagacatcccagttttggacatcacttctgtatgctagtactaggctatgtatcaatcagagaaaatattgtggtgtacattatcttcactgcctcattggtatatttttgtcagaaataatggtatattgttttaagtgctggtttgagtttgtagagaaccatggctaatcaactgcggtcagttgttctctagtaataatagtaaagaagcttcactaacaaaaaaaaaaaaaaaaaaaaaaggccgcccgctccgatctaga

SEQ ID NO: 2215 - DNA, 2137 bp, Zea mays
attgggacctcgagccggccatcaccgtgtacctcgccacctaccgcgccacacccgcctcaaatcaccggcccgcgagcccccccccgggacatcggcgtcaccgtcaccgccgctttccgagctctcatggcggcgtccgcgtcctccctccttgccgcccccgcatcctcatcctgtggggccatctccccccagctccctcgtggagctccggccgctgcctccgtcgcttcgccgtcgcgtcactcctgctacctcctccgcgcttccccttcgaggcgccatcggagtcgcttcgtagccaacgccgctcccaccatgcagcctccggcggagtccagggtctccacggtagtcgatgtcgacctcggcgaccgtagctatccgatctacatcggcgcaggcctcctcgacgagccggacctgctgcagaggcagtcaaattatacattttttctttaactgttagactggagtggtcagcctgtgatccttatttatgttttctcaggcatgttcatggtaagagggttctggtggtgaccaacacgaccgtcgcgccgctttacctggacaaggtgacatgggcactcacccacaacaacctgaatgtatcagtggaaagcgtgatcctgcccgacggtgaaaagtacaaaaatatggacacgctgatgaaggtgtttgacaaggcagtcgagtcccgttttgaccgccggtgcacatttgtagcactgggtggtggtgtcattggggacatgtgtggttttgcagctgctgcattcctccggggcgtcaatttcatacagataccaactactctgatggcccaggtggattcatctgttggtgggaaaaccgggattaaccacccactaggaaagaacttgattggggcattctaccagccacaatgtgttctaattgacacaaatacacttaacacattgcctgacagggagctagcttcaggcattgccgaggtagtaaagtatgggctcataagggatgcaccattctttgagtggcaagagaagaacatgccgaaattgttagcaagagaaccaaatgctttggcatatgctatcaagagatcatgtgaaaacaaagctgaagtggtggcacaagatgagaaggaaagtggccttcgagcaacactaaacctgggtcacacatttggccatgctattgagactgggacaggatatggagcatggctccatggggaggctgtcgcagctggaacagttatggcaactgacatgtctcaccgcctggggtggatagatgactccatcagaaaacgtgtggttgacatactaaagcaagccaaacttcccattgcacctcctgagaccatgaccgtagagaagtttaaaaacatcatggctgttgacaagaaggttgctgatggtctgttgagactcatccttctgaaaggaccgctagggtgctgtgtatttacgggggattatgacgggaatgcactcgatgaaaccctacatgcattctgcgacaactgagacatcccagttttggacatcacttctgtatgctagtactaggctatgtatcaatcagagaaaatattgtggtgtacattatcttcactgcctcattggtatattttttgtcagaaataatggtatattgttttaagtgctggtttgagtttgtagagaaccatggctaatcaactgcggtgcggtcagttgttctctagtaataatagtaaagaagcttcactacatccccttctgtctgttactgtcaagtaacaatactcgtagagatttaaacctgtatttgtgtcaattaaatcattacctcgtcacttctaaattttaatacggagtagttcactttgactttgtcaaacttctctggctttgaccaagttttagaaaaatgtggtaagacctgcaaattcaaataaatgcacttctaaaatatgcttcagaggacttaataaaacgcatttgatgttgtagacccttgtgcatttttattaacttttaaccaaagcaaaatacagtataatttagaatgggaaaagtacattgtaccttgatggtgccgcattgtattagaattcagaagtacagtactatgctaaacttgcgcttctcatcagcag

SEQ ID NO: 2216 - DNA, 1969 bp, Zea mays
gcacgagaccattacctagaacatcctaatcgaaaaaccaggctagctcccccacccaaaagccccacctcctccccgtgtcaaaacctccaagtcgatcgcccaggtggccggcgaggcggcaaccgccgccgtagagacgatggaggacgcgttgggctccgcggtgggtccccacttcagcggcctccgtctcgactcgcgccgcctctccctctccccttcctcctccccctcccgctccgccagcggcaacggcacgctcgtcgccgcgccggggctcgcgttccccaaggcggaggacgggaccaggaagcccttcgtcataggcgtgtgtggaggcaccgcgtcgggcaagacgacggtgtgcgacgcgatcattcagcagctccacgaccaccgcgtcgcgctcgtcaaccaggattcattctaccatggtttaactgaggaacagtctgagcatgtgcaagactataattttgatcatcctgatgcattcgatacagatcgacttttggagtgcatgggaaagctaacaagtggacagtccgtgaatattcctatatacgattttaagaatcacaggcgatgctctgaaaattttaggaaggtcaatgaatcagatgtcatcattttggaggggatcttggtttttcatgatcagagggttcgtgatttgatggacatgaaaatttttgttgacgcagacgctgatactagacttgctagacgtgtgaggcgtgatactgttgaaagaggtagagatgttacctcagtgcttgagcagtatgtgagatttgtcaagcctgcatttgatgcttttgtcctgccttcgaagaaatatgctgatgtgatcataccaagagggggagataaccttgttgcaattgatctaattgtgcaacatatcaacacaaaacttggccagcataacttgtgcaaagcctacccaaatgtctttgtagttcacacaactttccagataagaggaatgcatactctaattcgtgacaagaacattactacacctgactttgttttctactcagataggctgattcgtctggtggttgagcatggtcttgggcatttgccatttacagagaagcaggtggttacaccaacaggatctctttacatgggagttgacttctgcaagaagctctgtggagtgtctattattcgaagtggagaaagcatggaaaatgcactgcgtgcttgttgtaaggggataaaaataggcaaaattctatttcatcgcattggagacaatggacaacaactcatataccataagctgcccgtggatattgctgaacgccatgttttgcttttggaccctgtgcttggtacaggtaattcagctaatcaagccattgagcttcttatgagcaaaggagttcctgaggaccgtatcatttttttgactctcgtctcggcccctgaaggcatccattgtgtgtgcaagcgcttccctcatttgaagattgtaacctcagagattgatagtggattgaacgatgaatatcgtgccataccaggacttggagagtatggtgaccgatacttcggcacagactaaccgatgactgatgctgttgtagttagcagtgtgaaaaggtactcaaattagagctgacattaccgtggcagatatactggtgtttggttgctttatggtatactggaaggcaaacgtggataggtttctggtaggtgccgaaaccgtggcagatatactggtgtcttgtccattatcatatgattcgataccacaaaccgttggttgtgaagcaaatttgttttttaaagcattttgaggctcatagctgaagtgcctgctcctcgtcacacatactgttatacagccttgtgaaatgtatgactgaaccctgtttcccggcatctaacagttgccgtggggtctcagctgtggttggaatgaaattcaaaggttgtggcaaggctg

SEQ ID NO: 2217 - DNA, 2436 bp, Zea mays
cgattgtgtcggctaattatcgcgtcgggggcagggcgtgtcttccatcgctccccaaggccccagcccccaggtacccttcgctccccttcctcgtatgctgtgagcgtcgtggggtcgtggggaggaagacgatttcgagggagagaggcaaaggggagctcgcccgctccaggcacccattcctctcgaacccgacatctctcttgttgtttcgaggtgctggagctcccccgctttccacaaaatctgtggagattattcgaaaccatctcgtcgctcacgaacgcgtcagaggttttgcagaaacggagcgcgtgcggcgttcgtcggcaacgttggcgtccatggagagcaccgcgggtccgaggaagaggcagaaggccgcctcggcctctggatccgtggccccgtacttgccccaggagctcgtacggaacatcctcctccgcctgccttccaggtccgtcctccgcttccgcgccgtttgcaaggactggctccggatcgtctccgaccgcgagttcgcggccgaccacaaccgccaccagccggcgatgcccctcgtctccttcctccgcagcgccgccggtagcaagagggggcagacggactgctgcgtcgacgcatttgacctcagcgccgacagtttccggtccgtcgtccggttcgccgacaaggggacgcggtgcagcagcttcgacatccacggctcctgcgacggtctcctccttctcagcttcgatgcccgcttctacgtttgcaacccggcaacgcaccagtggacgcgcctcccggcgcccctccgcgcctcgtggctcgccggcttctaccgccacgagcccaccggagagtaccgggccttgttctaccggggccagtggcccgggacggactactacatcatggtggcggactccaggaaagggaggggaattggcctgccgtcggagaaatatgggtacaagttcaggagacaaccgtatagcctgccggtcctgctccgcggccacctccactggatggcagccattgaaggctacgactacgagatgttggcgttcaacacgacgactgaaaagttcacggttatgtgccctcctgtggttcggtggcacatgtcgctagctgaggtgggcaacgagctcgcgttgttgagctgcggccaccaggtcccgatgctcgagctctggattctgaaggattacgagaacaagagctgggtctgcacgcactggattcggctgccggagttgaagatgagcaccttcgcgttcgatgacttctcgcgaatgattttcgtgtcagaaaagggagttctgatagccaccccggagcagaagctgttgcgctatgacctgaatgggactctgctggaaagcttcccttgcaataatggcagccatctcaagattactccgtacaccttcaaggagagcctcgttcggcatgcattctttgagacaccggattgcaatgccgatggtcatgaagatgaagatgaaccagaaccaccacctttcttcctggggctgtagacccggacccggtggtgatggatctcatgggaacccttggttggagttgatcagcggttcatgcttcagatcggtattacagcctcggtagatgaactgagagtaagctacatttttcttttgtctctcttttatacccatcattccatcaataatgtcactatgtttgtccccttgatgggatgcgggccatgcggcattgtgcaaactgactcccatctctcattagttcgatgttctgaaactatttctgttgcagttttgagtactcctgaacaattgttactgtaaatggctgagttcgtgcttcttgcaataatgcaataccatacatgaaaactgtcatctaagcggccaattgtttttacctcaatcgcaatcaaattagtaaacgatcatggcatttgtttgactcttacctgtactaatcatgtaacctggaccaaagactgcatatagcgctactaatcatatatataatatatagtcccaggttatcaaatagatgatgttctcgctttttcagaaatcaactgttttttatttttgacctaatatatataaactattaatatttatattacataagtagtatcagtgaataaatctttgatttttttttataaaaaacgtatttagaaatacacatattgctaatattttttataaatctagttgaatttaaaaaactttaaccggcacaaataatacaatgttaactattttgaaacacaagaattatttcatgtgttgctacttacataacatagaatctaatgtttttttgaaaaataaaaaggaactttctccttgtgcgtctatgaaacttacgctattactccctccgttcacaattatatggtgtcgttcgatttttaaaaaaaatttgaccgctcca

SEQ ID NO: 2218 - DNA, 797 bp, Zea mays
  misc_feature (534)..(534): n is a, c, g, or t
  misc_feature (588)..(588): n is a, c, g, or t
  misc_feature (742)..(742): n is a, c, g, or t
gagcgccgcagcttagaacctggttctcctgtcgctgtcgcccatcttgcggcatcccaccacggcaccaccgccacagaagagcggccgagcggtgcagagaaccagccagccgagctgagcggccgcgcttccggtgggaggatggagaaggctctcaccaaactgggcagcttcaccatctcccgcaaggccaagcaggagctctccgccatcggcgacgacatctctcgtttctcgagcacggtggaggagaaggcaaaatgggtcttcgaaaagctcaaaggacacaagaagtccctctctgatctactgcgcgagcacaacctccctccaggcctcttccctcgtaacatcatctgctatgagtacgacgaatcgacatcgaagctgatggtgcacctgtcgaagccctgcgaggtgagcttcaaggattcctccgcgatacggtatgctcctcgcgtcaaggcgactctgtcccgaggcaagctttctggggttgaaggcatgaagaccaaggtggtggtgtggggntgaaaggtggctagcgttagcatcgacagctacaagtccgacaagatatgcttncctcgccggtgtgaagaagctgaggcagaaggatgcttatgaggtccctcgtgaagccgtctctgttgatgagttctgacttctgagctcgatttatttcccttatccgtagtatcattcgttcgtagcattttttgggtcccatgtcatcggnaattgatgtgctgcgggccctgccggttttgtagatttgggatcacaatggatct

SEQ ID NO: 2219 - DNA, 978 bp, Zea mays
gccggccgggtcgggtaagcggaggagaagaaacttacgaggattcccctagtaacgagctttgaacctggttctcctgtcgctcttcgtgcgggcgtgcggcacaccaccagaagagcggccgagcggcgcagagaagagagaaccagccgagcggagcggctgcgcttccggagggaggaaggaggatggagaaggctctcaccaagctcggcagcttcacaatctcccgcaaggccaagcaggagctctccgccatcggtgacgacatctcccgtttttcgagcacggtggaggagaaggcaaaatgggtgttcgagaaactcaaagggcacaagaagtcgctccctgatctactgcgcgagcacaacctccctccaggtctcttccctcgtaacatcatctgctacgagtacgacgaatcgacctcgaagctggtggtgcacctgtccaagccctgcgaggtgagcttcaaggattcctccaccgtaaggtatgctcctcgtgtcaaggcgactctgtcccgaggcaagctttccggggttgaaggcatgaagaccaaggtggtggtatgggtgaaggtggccagcgtgagcatcgagagctacaagtctgacaagatatgcttcatcgccggtgtgaagaagctgagaccgaaggatgcttatgaggtccctcgtgaagccatctctgtcgaggagttctgagctcaactcaactccattggtttgcctacgtagtatcattcattcgtagcatttttcgggtcccatgtgatcggcgattgatgtgctgtgatttggtagctttgtactgatattggaagcatgtggatctgttctgcctggcagaagataacccgtgcatgttatctgacgtgacgagtccttcaaaaaaaaaaaaaaaaaggttctgcattggctgctcctagagttcacgtgttcctgttttattttatatatatggtattgcactgcc

SEQ ID NO: 2220 - DNA, 900 bp, Zea mays
agctttgaacctggttctcctgtcgctcttcgtgcggcacaccaccagaagagcggccgagcggcgcagagaagagagaaccagccgagcggagcggctgcgcttccggagggaggaaggaggatggagaaggctctcaccaagctcggcagcttcacaatctcccgcaaggccaagcaggagctctccgccatcggtgacgacatctcccgtttttcgagcacggtggaggagaaggcaaaatgggtgttcgagaaactcaaagggcacaagaagtcgctccctgatctactgcgcgagcacaacctccctccaggtctcttccctcgtaacatcatctgctacgagtacgacgaatcgacctcgaagctggtggtgcacctgtccaagccctgcgaggtgagcttcaaggattcctccaccgtaaggtatgctcctcgtgtcaaggcgactctgtcccgaggcaagctttccggggttgaaggcatgaagaccaaggtggtggtatgggtgaaggtggccagcgtgagcatcgagagctacaagtctgacaagatatgcttcatcgccggtgtgaagaagctgaggccgaaggatgcttatgaggtccctcgtgaagccatctctgtcgaggagttctgagctcaactcaactccattggtttgcctagttgccttatactacgtagtatcattcattcgtagcatttttcgggtcccatgtgatcggcgattgatgtgctgtgatttggtagctttgtactaatattggaagcatgtggatctgttctgcctggcagaagataaccgtgcatgttatctgacgtgacgagtccttcacatgtgtactggtcctggttctgcattggctgctcctagagttcacgtgttcctgtttta

SEQ ID NO: 2221 - DNA, 1135 bp, Zea mays
gccccgaattatattcattcattcatcccagcggaagagcaccaagcttctctagcagcatatacgcatccacccactggaaacagaccaaccctaccctaccctgcagcgcgcgcagagggggaaaggagctccagcaaaaagtttgtccagctcctcctcctactacagcgctagaaggatctgatcatcgagcagcatggcgcggcggccgcagcccatgcccaacctggtgcccacgctcctcctgctcctcgtcgtcgtcgtggccgccgccgcggcggtcgtgagagccgacgacgacgagaagtgcagcaacccgtgcgggaacccctgcggcgagccgtgcgtgtacgccagcccgccgccgccgcccgtgtactcgcccccgcccccgccgccgacgcccgagtactacccgccggcgaccccgaccccgaccacgccctactgcccgccgccgccgtcgggcggcggcggcggctacgagccgtcgcccgggtacacgccgtcgacgccctacacgcccggctacaaccccacgccctccgggtccggctggtacgcgccgccctacacgccgtcgtcctacaactcgccgccgtccccgccggggacgctgtacccgcaggaccccgggttccggcccaacgccgcgcccaccgcgcccctccccctcttctcccttgccgccgcctccgccgcggcggtggcctgcgcctgcttcggcttgttgtgaccgaccgaccgaccggtcggatcggaggccgcgaatcgcgcacgtgcggtacggtaccgacgacctgcgcccgtggtggtggtcgtcgtcaagtcgaccgcagagcacagactgcatgctgggtttagttccgctccgtgttggtgttaataataagattagaggaaggattaagttgggtttgggtaagatttttttttcttcttcgtccactcactgcgtcgtgtcgttttttcttttttgtgtttagtataaattcatcgttcttgtgatgtactacttgttatacatgttcgttgctccaaaaaaaaaaaaaaaatcgtcaaaggaacaaaagttcaaccatctgtttcagctcggatcaaacagaaataacatgtatgcatgttttatgcc

SEQ ID NO: 2222 - DNA, 1585 bp, Zea mays
gcgggacgtgacggcgaggcggcgactagtattaacctaccacaacaccaagtccccccccccacctccgcattgtctccgccgcgatttgtcaacgtgacgtcacgccgcgcctccgagagggagccagtgtggtggaggacacgaggctgccggagccgcaggtgttgctccggtcagcatcggcatggcggggcggatggtgcggagctgcgtgcagacggcgctcaaggcggccaactccgtcgtggggctcgccggcatggccgtcatcctctacgcgctctggatgctccgcgcttggtacagggaggtcgccgacctccaacaacacctcccggtcccctggtgcatctacacatttcttggcctggggatctttctgtgcctactgacttgctctgggcatattgctgccgaaactgcaaacggtcactgcctctcttgtgtatccttttagttgatagatacatggagttagatgttgcttcatataccagcttccggtgcttgtgtttgcttgctcactacctatggttaattgctaaatacatggagctacatattgtctgatataccagctgccatcacttggggtttgcttgttgactacttataatgaatcagtggttagcagcttctgctggtttatccaaggttttcagttaggtgcagaaactacacttcttttttctgggctatataattatttatacatgagatgcaagaaagaactgagttgatattgagagtcctggtctcaaattgcagttacgttctttgagttctgtgatcttttgtgcagtgcgacctgacgttgatattgcgtctctttttccttaacctgacaacgtagtacatgaccatcgtatttgtgcttattatgctggaaggcgcaatcactatggatgtatttctgaatagcaactgggaagaggatttccccgctgacccatcaggcaagtttgaggatttcaagcacttcgtgagatcaaatttcgagatatgtgaatgggtaggcctctcagtggtggctgctcaggtgttatcgatcattcttgggatggtacctcaggaccccttggccctgaccgtgagaccgactatgacagtgatgatgaagtgaccgtgcctgcaaggctacctcttttgataaatcagtcccagcatggttcatactatgctgaacctaacacgtctggaaggagtgattcatggaaactgcggattttagacaaggtcaacaactaagatcttaaggatctcatacaacagaccctccagtaaagactctctctccaaggggttcgggagaatgataagagtatacctttttcttcccctcatggagagatgattagcagcagcagcagtagaatagtttacacacatttgaatgcaatccaacatgcacaagtatttgagtagcatgtgacttgacccccccccccccccctcctacaaaacctacacaatgtaggggaaggatgtttattgtaccaaaatgtttcagaaaagagataaagggccatgaacggtggtggtgcctccactgaccaaagacagaaatatttgttctcccccc

SEQ ID NO: 2223 - DNA, 1065 bp, Zea mays
  misc_feature (921)..(921): n is a, c, g, or t
cattgggtacctcgaggccggccgggtctccctctctttctctgcacggcggggctccactcgtccgccactccaccgcttctacaagatcctacaccacggccccccggccgcggccgcggagaaagctagctgtagctacctacccggtccggtctccgcttctcccgcacgcgcagcctgctgcatcctccttcctgcgaccgcccgcttcgttcgcggaacataaaggtgagccggaccggaccggcgacccagccgagagggagcaagaggtgctgagctatcggcgccgcaggtcttgctccggtcagccacggcggcatcggcatcggcatggcggggcggatggtgcggagctgcgtgcagacggcgctcaaggcggccaactccgtcgtggggctcgccggcatggccgtcatcctctacgcgctctggatgctccgcgcatggtacagggagatcgccggcctcggccaacgccccccggccccctggttcatctacacatttcttggcctggggatctttctctgcatactgacttgctctgggcatattgctgctgaaactgcaaatggtcactgcctctactgttacatgaccatcgtatttatgcttattatactggaaggcgcaatcactttggatgtatttctgaatagcaactgggaagagggtttccctcctgacccatcaggcaagtttggggatttcaagcactttgtgagatccaattccgagatatgtgaatgggtaggcctctcagtggtggctgctcaggtgctatcaatcgttcttgggatggtgctcaggacccttgggcctgaccgtgagaccgactatgacaagtgaagacgacacagcccgtgccccgcagggctgcctctcctgagaaaccagtcccagcatgggtcctgngactacgctgaagctaccacgtctcgtcagggacttccgttattacattctaaatgtgttcagcgttaataaaagccttgcgacgttccattgcaggtgaagaactaagatcttgtgatggtctcatacaacaacagacccttc

SEQ ID NO: 2224 - DNA, 1222 bp, Zea mays
gccggaacggaatcatccaacaagcaaacacacgatcagcccaaacgaaacacgacaacccaagattgaggcgtgcgcgggacgtgacggcgaggcggcgactagtattaacctaccacaacaccaagtccccccacctccgcattttctccgccgcgatttgtcaacgtgacgtcacgccgcgcctccgagagggagccagtgtggtggaggacacgaggctgccggagccgcaggtgttgctccggtcagcatcggcatggcggggcggatggtgcggagctgcgtgcagacggcgctcaaggcggccaactccgtcgtggggctcgccggcatggccgtcatcctctacgcgctctggatgctccgcgcgtggtacagggaggtcgccgacctccaacaacacctcccggtcccctggtgcatctacacatttcttggactggggatctttctgtgcctactgacttgctctgggcatattgctgccgaaactgcaaacggtcactgcctctcttgttacatgaccatcgtatttgtgcttattatgctggaaggcgcaatcactatggatgtatttctgaatagcaactgggaagaggatttccccgctgacccatcaggcaagtttgaggatttcaagcacttcgtgagatcaaatttcgagatatgtgaatgggtaggcctctcagtggtggctgctcaggtgttatcgatcattcttgggatggtactcaggacccttgggcctgaccgtgagaccgactatgacagtgatgatgacgtgaccgtgcctgcaaggctgcctcttttgataaatcagtcccagcatggttcatactatgctgaacctaacacgtctggaaggagtgattcatggaaactgcggattttagacaaggtcaataactaagatcttaaggatctcatacaacagaccctccagtaaagactctctctccaaggggttcgggagaatgataagagtatacctttttcttcctctcatggagagatgattagcagcaccagtagaatagtttacacacatttgaatgcaatccaacatgcacaagtatttgagtagcatgtgacttgaccccccctacaaaacccccacaatgtaggggaaggatgtttattgtaccaaaatgtttcagaaaagagataaagggcatggccggtggggccttcaccccccaaaaacccccggggggggggg

SEQ ID NO: 2225 - DNA, 2260 bp, Zea mays
cccacccccgcattttctccgcgttttgtcaacgtcacgcctcgcccgccgtcctttcctctcccactcccacccccaccccgctatctcccactctttctctgcacggcggggctccactcgtccgccactccaccgcttcctcaagatcctacaccacgtcaaaccagacccggccgcggagaaagctagctgtagctacctacccggtccggtctccgcttctcccgcacgcgcagcctgctgcatcctccttcctgcgaccgcccgcttcgttcgcggaacataaaggtgagccggaccggaccggcgacccagccgagagggagcaagaggtgctgagctatcggcgccgcaggtcttgctccggtcagccacggcggcatcggcatcggcatcggcatggcggggcggatggtgcggagctgcgtgcagacggcgctcaaggcggccaactccgtcgtggggctcgccggcatggccgtcatcctctacgcgctctggatgctccgcgcatggtacagggaggtcgccggcctcggccaacgccccccggccccctggtcagcaaccgcttcccccctcatcctccttccagcctaccagtagtagatctcggccaccgtttctgttcttgatccgcagcgagctacgaggcaagctcctagatttgcacttctctttgctcgccccttcgctgttcttgatttcttttatccccaccacgtccctcgctcggagaaatgcgttcgctttcagcccgaattcgcagccaactgtttcattcatcacacctttttcattagactagactgtagttccgcgaccaattcacgatgccgtggcaggaccgggagattattacacagctctggcgcacaaaacgaagctacccagccaccgccgaaagcgcttttgaattttcccggggcagttaaaggttgctcctttgggatgggggtgatgggcacggcagatttggctacagttagtgacgcatgacagggaagaagccaccatcctatgaatccctctagtggacgctagtgctattcggtgggcacggccggtgatcggcttccgtgttgctgctttggacttgtacaccagaggagatcttggtggcggctgcaatgtggcgtcagatcgggacgcatgatatgatgcaatggtcggcctaactcgaaagtagatccgcggttagttgattggtgggggcaagagcactgatgaaggatatacaaaacaatgacgatgctgatgttaaaccgccaaacagtgagcatgtttagccgtcgctttcctcatcctaacaactgtagtatattaatactgatttcctcatcctaacaactatagttattaatcaaatgggccaagcgtccatgcttttgctgccaccattactaatgatattgctgcgtggaaccgacactttaaacacttcaagaatagttctccctccgttcttttttatttatcgtgttttagtttaaaaataaactagcggactacaaatatttgagaacataagtagcagttaaatatgatttatttttaataaaaatttgaggaccatgtcaaaaaaattacgccttccaatatttcggagtatatactgtcggactggtggtttcactgagaaagcattactggtcgtgcaggttcatctacacatttcttggcctggggatctttctctgcatactgacttgctctgggcatattgctgctgaaactgcaaatggtcactgcctctactgtgtatccttttagttagtaggtacatagtagatttaaatgttgttccatataccagcctccattggttgtgtttgattgctgactacctatgctaaatcacatggagttacatgttatccagctgccatcacctgggttttttgcttgttggctacatatagtgaatgagtggttagcagcttctgctggttcatccaaggttttcagctaggtgcagaaaccacatcttttttctaggttatataattatctgtacatgagatgccaaaaagaactgatctgagagtgagagtgctggcctcgaattgcagttacattctttaagctccgtaatgtttagtgcagtgcgacctcccagtgatattgcccctctttttccttaacccacatgtagtacatggccatcgtatttatgcttattatactggaaggcgcaatcactttggatgtatttctgaatagcaactgggaagaggtaaggagctcagctgtgaac

SEQ ID NO: 2226 - DNA, 964 bp, Zea mays
cttcggtttgatcgggccccgcttccagaacttcaaggaggttgtggtaccatggggctgaccttaacaaactttttaagccggttcttttccaagaaggagataaggtccctaatggtgggtctcgatgcacttgtaaaaaccacaatcctttacaagctcaagctccggaggaaatcgtgaccccccatccctacaatcggggttaaatggggagactgttgaatacaagaacattagcttcactgtctgggatgttggaggtcaggacaagatcaggccattgtggaggcactatttccagaacacccaaggccttatctttgttgttgatagcaatgacagagatcgtgttgttgaagcaaaggatgagctccacaggttgctggacgaggatgaattgagggatgctgtcttgctcgttttcgcaaacaagcaagatctatgaacgctgctgagatcaccgataagcttggtctccattccctgcgccaacgcccctggtatatccagagcacttgtgctaccacagaagaaggtttgtacgagggtcttgattggctctccaacaacattgcaaacaaggcctgaatggacaattctgctgtttcacggagcacatctgcacatggcgaggcatggtcattttgaccctcagacgatcattgtttcattggaaagtatcgtatttctatgctaggcttttcagagagattactctctaagaaactgatccgatattaagacactataattggcattggcactagtagatcgtttactgagtaatgcagtttattttaatgtatcccaattgtgttgtaagatacaactatgcgtcggaattacccattcaatttgaatctagatacgtagtttttgttatatacttatacttggatatatattgtttaatacatggtaaaagtaacatatcaagaaaaatattgtataatttgaagat

SEQ ID NO: 2227 - DNA, 1270 bp, Zea mays
gttgacaaccaaacagatacgcgtgtaggcctatcaatattcatatcatatcgtacgactttcttttctgaaaaaggagcttgcgaacgtcggttgcacgttggagcttcagacgaggagcgcacacccacatctcctggtcccgtcccacctgcaccgcaacctaccggcacgccaccattcccacgggctcacgtagaccgggcccagcctccgccccaccaacccttgcctccccacacctcagcatcaaccactcgtctctttttctccgccccgcccgaagccgaggaggagaggggagcagcgagatcgtgcgcgcctccgagatctccacgaagttgtggtaacatggggctcaccttcacgaagctcttcagccggctcttctccaagaaagagatgaggatccttatggttggtctcgatgcagctggtaagaccaccatcctctacaagctcaagctcggagaaatcgtgaccaccatccctacaatcgggtttaatgtggagactgttgaatacaagaacattagcttcactgtctgggatgttggaggtcaggacaagatcaggccattgtggaggcactatttccagaacacccaaggccttatctttgttgttgatagcaatgacagagatcgtgttgttgaagcaaaggatgagctccacaggatgctgaacgaggatgaattgagggatgctgtcttgctcgttttcgcaaacaagcaagatctaccaaatgcaatgaacgctgctgagatcaccgataagcttggtctccattccctgcgccaacgccactggtatatccagagcacttgtgctaccacaggagaaggtttgtacgagggtcttgattggctctccaacaacattgcaaacaaggcctgaatggacaattctgctgtttcacggagcacatctgcacatggcgaggcatggtcattttgaccctcagacgatcattgtttcattggaaagtatcgtatttctatgctaggcttttcagagagattactctctaagaaactgatccgatattaagacactataattggcattggcactagtagatcgtttactgagtaatgcagtttattttaatgtaaaaaaaaaaaaaaaaaagatacaactatgcgtcggaattacccattcaatttgaatctagatacgtagtttttgttatatacttatacttggatatatattgtttaatacatggtaaaagtaacatatcaagaaaaatattttataatttgaagat

SEQ ID NO: 2228 - DNA, 1083 bp, Zea mays
gcggcacgccaccattcccacgggctcacgtagaccgggcccagcctccgccccaccaacccttgcctccccacacctcagcatgaaccactcgtctctttttctccgccccgcccgaacccgccggggagaggggagcagcgagatcgtgcgcacctccgagatctccacgaagttgtggtaacatggggctcaccttcacgaagctcttcagccggctcttctccaagaaagagatgaggatccttatggttggtctcgatgcagctggtaagaccaccatcctctacaagctcaagctcggagaaatcgtgaccaccatccctacaatcgggtttaatgtggagactgttgaatacaagaacattagcttcactgtctgggatgttggaggtcaggacaagatcaggccattgtggaggcactatttccagaacacccaaggccttatctttgttgttgatagcaatgacagagatcgtgttgttgaagcaaaggatgagctccacaggatgctgaacgaggatgaattgagggatgctgtcttgctcgttttcgcaaacaagcaagatctaccaaatgcaatgaacgctgctgagatcaccgataagcttggtctccattccctgcgccaacgccactggtatatccagagcacttgtgctaccacaggagaaggtttgtacggagggtcttgattggctctccaacaacattgcaaacaaggcctgaatggacaattctgctgtttcacggagcacatctgcacatggcgaggcatggtcattttgaccctcagacgatcattgtttcattggaaagtatcgtatttctatgctaggcttttcagagagattactctctaagaaactgatccgatattaagacactataattggcattggcactagtagatcgtttactgagtaatgcagtttattttaatgtatcccaattgtgttgtaagatacaactatgcgtcggaattacccattcaatttgaatctagatacgtagtttttgttataaaaaaagaaaaaaaggggccgctcgcgatctagaacaaaaaaaaaaaaagcggcc

SEQ ID NO: 2229 - DNA, 1080 bp, Zea mays
agaacaggtccgcgacgcgtgcggacgcgtgggcggcacgcaccattcccacgggctcacgtagaccgggaccagcctccgccccaccaacccttgcctccccacacctcagcatgaaccactcgtctctttttctccgccccgcccgaagccgaggaggagaggggagcagcgagatcgtgcgcacctccgagatctccacgaagttgtggtaacatggggctcaccttcacgaagctcttcagccggctcttctccaagaaagagatgaggatccttatggttggtctcgatgcagctggtaagaccaccatcctctacaagctcaagctcggagaaatcgtgaccaccatccctacaatcgggtttaatgtggagactgttgaatacaagaacattagcttcactgtctgggatgttggaggtcaggacaagatcaggccattgtggaggcactatttccagaacacccaaggccttatctttgttgttgatagcaatgacagagatcgtgttgttgaagcaaaggatgagctccacaggatgctgaacgaggatgaattgagggatgctgtcttgctcgttttcgcaaacaagcaagatctaccaaatgcaatgaacgctgctgagatcaccgataagcttggtctccattccctgcgccaacgccactggtatatccaaagcacttgtgctaccacaggagaaggtttgtacgagggtcttgattggctctccaacaacattgcaaacaaggcctgaatggacaattctgctgtttcacggagcacatctgcacatggcgaggcatggtcattttgattggaaagtatcgtatttctatgctaggcttttcagagagattactctctaagaaactgatcttggcattggtactagtagatcgtttactgagtaatgcagtttattttaatgtatcccagttgtgttgtaagatacaactatgcgtccgaattacccattcaatttgaatctagatacgtagtttttgttatatacttatacttggatatatattggttaatacatggtaaaagtaatatatcaagaaaaatattt

SEQ ID NO: 2230 - DNA, 2496 bp, Zea mays
  misc_feature (4)..(4): n is a, c, g, or t
cggncgcgtgggctcaaaattagtattttagtaatgttcttaacgttgggaccctactaggaaaaacctagacacgaagtccaacccaaatctcaatatcccaaccctccgatccccatttccatccactccgacaccaatcctccgctccgaccaccgccggagaaatggggcggcgccgccggttcgcgcagctggacgatgacgacgacgacgacgaagacgtgcccatcaatttcaagccctcgggtggcgcctcctcctcggacgccaaacccaggaagccccagccgccgccgcagcagcgccgcggagtctccgatgacgacgacgaggacgtggaggaagtggaacttgaggaggaggaggacgacgagaaggatctcgaggcaatgcgacgggccgaggaggaggagcgccgcgagcaggaggccgagacgaagactcgccgccgccggggacggcccaagcgccgccgcgacccggggagcgaggatgaggagcccgaggagctagagctgcaaacggaggatccccgtgaggaggagatcacggaggcggtgcccgtagctgtaggggacccggtcaagatcactggcaaggggaagaagcagaagaagcactatgcttccttcgagtacgagggcaacagcttcgagctggaggaccccgtgcttctcacgcctgaggacagcaatcagaagccctatgtcgccatcctcaaggatataacagaaactgatgggagcctatatgtaactggccaatggttttatagaccagaagaggctgacaaaaaggagggtggattctgggtagcacgagatacacgagagctattttacagttttcatactgatgatgtgcctgcagaatcagttatgcacaaatgtgtggtccatttcattcctcagcaaaaacagattcccagtcgaaagcagcatccgggatttattgtccagaaggtctatgatgcagttgagaagaaactgtggaacctaacagacaaggactatgaggataacaagcagcaagagattgatcttctggttaagaaaacaatagaccgtattgggcagcttcctgatctcgaacctgaagagacacctcttgagaacaattatttgtcaaataaacgaggcctgcgtaagaaacctgttaaccctatagatgtaacaagagaacctccagttggcaaatccgagcagtttgcaaaagcagagacacctggaagtgataagatacggaattatgatacccttgttaagtataaagtacttactggacattctcatcgtgataggtggctcgataaattgatagaaagtattccgcttgcatcaaaggagaatgctggaacatctgctgatgctaattctacagccaaaagttcaatcagtggttcacctgcaaaggatgttggttctgctgaaaatgaaaaatcatatggacttgatgttgttgttgagataatgactgcattagaaagatctgcatatgaagctcttggaacagattttgggaaatataaccagaaactgcgacaactacagttcaacatcaagaatatctctaaacttcgcaggaggctgatggacaaggagcttgatcctccagttcttttaaccatgtcccccgatgaattaaaggctggcttgacttcagcagagaaaacatctgaaccagaagaatcaaggaaattgcagatgactgatacaagatgtcaaagatgcagcgaaaagaaagttggcatatctgatattatccatgcaggtcatggagaccgctatcagttggaatgcacttcctgtggctacacatggttttcgtccagagatgccatcacaacacttacagaggatgccccaagcactgctgggaatgtgggcactgcccccttggcaacagcaaagttcgaggtcgttgagaagaagctcacgagcccacgggaccaatccggcaagcctgcttctgatgctctgcagaagagcactgcagcttacatgccaactatggagaggcagaagtcgtttgctaagaccaagctgttggatgaaccctcccccgcaccaaaacaggggtagagccgtattcatgctgcagattggtctttgcaggatttcgagatacatacttgtacataggggtgatccaccccccgcaccaaaacaggggatgaaccctcccctgcaccaaaacaggggcccttttcttgacatgctaccacctcgtactggttgtcttcgtttcggtagtttgttttgcagtcatgcatagccagttacctctcgttttattatttgcttgtttgttgtagcactcatcagttgacatgaggacgtaggtttgtggcgtttaccagattgattttgctttctatgtgctataaattttgtcttgcaaggatcacttcccagttatgctgggcgacatcatgaccgtctgttgcaaacttaaaacaaattctgagtttttgagttaaaaaaaaaaaaaaaa

SEQ ID NO: 2231 - DNA, 2645 bp, Zea mays
ccacctgaacggagacagtcgaggttgtggcggagagctccacctgaacgccgaagtggaaccgaacagttccagtggttggccgtggcgagctggccacctactagtctccggggagggggctggctccagcgcctccgagcgcggtgccagtgtcgccgtcgcgtgggttccggttccggccgccgccgcttgccggggaatccaaacggcagacggggtcgccgtgaccgtgaatcgtgtttacttgggccttatctaggccacaacgtttgtgactctgtgagcttattgtttgggcccatctctttggcgtgtctgagaacgaattttatcatcaagcccacgaagccaaaccaggatcctacccacctagcacatactagtgaagaaggtaaacaaagtgtattttcatgttaattcacatgcgcgtggtcgacaccacaccacacgacttaaaactcggtgttatgttctacgaccacaagagccatgttaattttaagccgtgtctgcgccatgatccgaagagcgcgtacagtgagagaagaaacgcacggccgccagcagcggccccgggcgcgaggcagcacgtccgttggtcggcccgggcgggagcgaggcacacgtcgcgcatgcacgcgcggcgcccggacacgtgccggcgcgggcacgtccccccccgcgggccatgcgcctcctcgcccccggcccggaggcacaacaagacagagagatacccgatcgccaccgccgaccggactcccctcaaaggcggccacagcacagcgagcatgggagaccggcatcagcatgggcctggcagcggcgtggaggacccggcgacgctgctgcggcgggtgcagacccgcgcgcccaactcgacgcaggtggtggggttcctgacgctgctcgtctctggcgccgtgctgctgctgctgacgggggtgacgctgacgggcgccgtggtggcgctcgtcttcctgggccccatcgcgctgctcaccagccccatctgggtgcccgtcgccgtcgtgatctccgccatcgtcgccgccgcgctctccgcctgcgccttcgccgccgccgcgctccccgtggccacctggatgtaccgctacttcacgggccgccaccccgtgggcgccgaccgggtggactacgcgcgcagccggatcgccgacaccgccagccacgtcaaggactacgcgcgcgagtacggcggatacctgcgcacccgcgccaaggacgccgcgcccggcgcgtaggcgcgcgccgcccggcgtgcatgtgctgcaacccccgtccgtggtgccgctagctataggtcatcattgctgtcgtcgtcgtcgtcttagttcctcttgcattgcgtgtgcgtactctgctccaatcatcccccgcccgtgttgtcaagcaatttctggtcctcttgcttgctttctctaggagatgctgttcatttcgatctcttggcgcaatttgatctttcgcttggtgtaattaggtcattagttaaatcataagagactcgtgttcatggtctttctcacaaccttaaaacaactaattgatgttgaaaagaatatacatgcgtaaccttgctcagttttcgtcgaacagaatgatggcaacctttcttctgcaaacagttgcagataatgcctaggatttttgttctctgtgctgaatcatctatacaatccgacgtatgtactcacctcccgaggttgctccatcccaaaactggagttggcatagcgtggtccccgtacgatgcataacaagtgtcatacagaaggttgtgtcatgtgtgtatctagtgtgccacatgctataatctctgtagtcttttaattaccctttggggtgttaaagggcgatcagagtgacatcagtgatctaaggtacgtagaccgcataaatggtcgtgtctcgtgaacccaagcacgacttattatggacctcagactgacttagtatggttattgtggtgacatgcagtacatgtgctgagctaaaatgctcgaccaatatagtccgacctatttaattagttgtaccctgtcactacatgtaaattttctcatccagtcttccccgtcccgtcgttgctcctgaatagagttagtaatagaataatagatcacaacccgaatatttcctcacaaattgattgagtccttaattaattctagcttaaaacttaattaattctagcttacaagtccgatccttaaattttattactagtcctacttcgagtaatcaccgtatacatgtactcgcgtatttaacagtcattccaggacatcacacatgttctgagtgcgaacatatgcaacagatcatgtttagtcgtttcaaacacgtgaacgcgcccgcaaaaacatacacactcgcgaggcaattaagtcgttgaccattaccggacagacatgttccatttcgctacggcattttactttgaccatccatccgatgatccaatccaagatgctgtcttggacccgaccacgtacacaacaaccctgattccctgaagccttccgcccctctttctgacttgggtttagtttcgcagcagcagtgaaagtgccccgcccaaagaaaccagccgcgcacgtacttgcattgcataagca

SEQ ID NO: 2232 - DNA, 851 bp, Zea mays
  misc_feature (2)..(2): n is a, c, g, or t
cnccccccggcagccacaacaagacagagagatacccgatcgccaccgccgaccggactcccctcaaaggcggccacagcacagcgagcatgggagaccggcatcagcatgggcctggcagcggcgtggaggacccggcgacgctgctgcggcgggtgcagacccgcgcgcccaactcgacgcaggtggtggggttcctgacgctgctcgtctctggcgccgtgctgctgctgctgacgggggtgacgctgacgggcgccgtggtggcgctcgtcttcctgggccccatcgcgctgctcaccagccccatctgggtgcccgtcgccgtcgtgatctccgccatcgtcgccgccgcgctccccgtggccacctggatgtaccgctacttcacgggccgccaccccgtgggcgccgaccgggtggactacgcgcgcagccggatcgccgacaccgccagccacgtcaaggactacgcgcgcgagtacggcggatacctgcgcacccgcgccaaggacgccgcgcccggcgcgtaggcgcgcgccgcccggcgtgcatgtgctgcaacccccgtccgtggtgccgctagctataggtcatcgctgctgtcgtcgtcgtcgtcttagttcctcttgcattgcgtgtgcgtactctgctccaatcatcccccgcccgtgtcgtcaagcaatttctggtcctcttgcttgctttctctaggagatgctgttcatttcgatctcttggcgcaatttgatctttcgcttggtgtaattaggtcattagttaaatcataagagagactcgtgttcgtggtctttctcacaaccttgaaacaaaaaaaaaaaaaaaaaacc

SEQ ID NO: 2233 - DNA, 3624 bp, Zea mays
attagtaatgtatatattttctaataaattgactataaaaataatttaaaatatatctaacaaaactaattatgtatattttttttttttttttgagttaaaaaacatttaatttttcgaaaagtgacagccacaactagcacatatacaggaaccattattgcatctgactcttgatctaacggacacccgacgctgatagtatagtacagttgttgccagaaaccagatacgtatccactgacgtaaatggtattccgtaccttctgacgatactgtgcgatgaagtaacctccttttaccactggatccttggcgcttcctcgtcacgttcccagacctcgaaagactattcccctcaaccctccaaaagaagagaggactgttgaaacttggatgccatggcatacgtccacacgccaccgtaccagtcgagatcaagacggcaataatagacaagaacaaggtgcgtggcagtgcactcgacgatattaatggagctgctttgcacgggcggcagacagccgtagacagagcagtgacggtcgtcgtacacagatcacgatgctgctcccacactcttcgtcagcctctgcaactgctaccactcgtgggctagcactagcagcagcagcagcagcaccgccgcgtccgaccgctcgcccccggcgcgcgcgcctcctgcctccacgcgcgcgggccgagacgcatgcgacgggcgttggcgccgaccgcgcggccgaggcgcttctccaaagcgggctgcgccgtgagtcgctgccgcggcacgtcgcggtggtgatggacgggaactcgcggtgggcgcgcgagcgggggctgacgcccgcggacggccacaaggccggcggccgcaacctggagcgggtcgttgcgctgtcgcgcgcctggggcatccgcgcgctcaccgccttcgtctgctcccgcgagaacttgagccgccccaaggcacggccctcgatccctgcttttcaataaactcgcgtacacatcggacgacgaccctgacacgcactggtgcgttcttgtcttcccgctcatcgtatctgcaggccgaggtcgactacatgatgggcttgtccgagtggctgataggcgacaacatcgacaagctctcgaggtcgtcgtcgtcggctaaaaaaaacctgcagtgatcttgcatagcacagcgccacagtataccgtttgaattttttttacatgttctgcttccgcgttcaggcaggggatccggctgcaggtgatcggcgacgccgcgaagatgccagcctctctgcggagcgcagcggcgcaggccgacgaggccacgaggcacaactcgcagctgcacgtgatgctggccatctgctacagcgggcgatgggacatggtccaggcgtgccgggagctggcccgggaggcgcaggcgaaccggctcagtccggacgacatcgacgagtcggtcatcgccggcaagctcgcgacgagcgccgccggcgagttctcctgtcccgacctggtcatcagaaccagcggcgagatgaggctcagcaacttcttgctgtggcagtcggcgtactcggagttgttcttcaccggcaagatgtggcctgactttggggaggctgagtacctggaagcgttgcgctccttccagggcagagaccgccgcttcggccaatcaaaattactctaacagtctaactcgtttaagagtccctctattttagttttatttagttcctaaattgtcaaacagtaggattaaaacagagactaaactgatttagtctctagtctctcaagatatggttaaaaagactaaatcatattaattctacatttgcccttcatttagttcaattgtactaatagcaggagaatattaaaggctattttagtcttcttatgagtcatttagtatatttttactaattttagtccttagaaacaaacatgttagagactaaattttagtcccctaactaaactttagtccctagactaaagaaaccaaacatggtctaacttgatggagtgttacacctgcatctccagcgtcagcacccaaaagaccgtcccgactcgcgtgcaagggcgtccaatcgtcggatccacaacagcgactatgtcctgtaaccgtggcccatgagccgatatggagtagcgtgtgtgtttgcagccagttgtcacgacgcacaaaagcgcgccactagcttctgtaaggatgaatcatccagagaattgcaaacagaactattccccccgtatctcatcttcttcctctccaagcattctcttcttccttccttcctccccaatctatcgtgttaacaagtggtatcagaggggtctgatcctcgtcactgttccactctggatcccacaacctcccacccctacgacactcgtcttcgtcgccagcgcgccgccatgaacgtcgacttccagcacctgctcgacgaaatgtccaagcgcttcgacggctacgatgcgaagctgacgcagcgcctctccgactacggcgtcaagctgcagcagcgaatgctagatcgcaatctggaactggagcgtcgtatggcggatctcgacacacggatggacgacaagttggcttcgctctccacggccaacgagacgcgcttgtcgcagctcgagtcggtggccatctccttcgacggttggcatccctgcatggagggttccgtcgacgacatccgtcttcacgtctccaagttgaccaatctctacgaacggtcggcagtggagcaccctaccgtcatgactggtgtgcttgttccggctccctctccggccgtgcgcccatctgctgctgcctccacggacgctcaacctgacaggcaccgcctgaatccatcaatccgggatgatggttgcggagttgtcacaattcttgatcatcacccggcaaagggtgcgtcatccccttctcaccccatgtgtttgcttctcctattttccactgttcgagatccgagtttaaggaacccgtgggtggaagtttggctggtttatctgatcattttcctaaaatgttgtttcctacgtccgatggggatcaacccaagttatggatctgtagatgtgaggattactttgatctgtatagtgttgatccagcgcagtgggtgagggtgtcatctatgcatttcagtgctgctgcatctcgcttggtgcaaactgtgcagagccatcttagatcccgttcgtggttagagttctgtggttgggttttggctcgatttggctatgaccatcacgaattgttgatccgccagttgtttaacattcgtcaaacttcatcggtgtctgagtacatcgatcgtttctcatccctttgtcgaccaattgacagcttacggatcgcacacagaccccctttatttcaccatgcgctttattgatgatttgcgtgatgatattaattcttctattttggttcaacgtccatcttcttggaattctgcctgtgtgttggctcaattacaggaggaggtctcggagtacggcaagaggccaccgacccggcaacctgatccattctcgagaactcagtcaacaccaccagcttctcttccacttccaccacccccgtggaaaggagag

SEQ ID NO: 2234 - DNA, 1452 bp, Zea mays
gcacgagaccattacctagaacatcctaatcgaaaagaaagactattcccctcaaccctccaaaagaagagaggactgttgaaacttggatgccatggcatacgtccacacgccaccgtaccagtcgagatcaagacggcaataatagacaagaacaaggtgcgtggcagtgcactcgacgatattaatggagctgctttgcacgggcggcagacagccgtagacagagcagtgacggtcgtcgtacacagatcacgatgctgctcccacactcttcgtcagcctctgcaactgctaccactcgtgggctagcactagcagcagcagcagcagcaccgccgcgtccgaccgctcgcccccggcgcgcgcgcctcctgcctccacgcgcgcgggccgagacgcatgcgacgggcgttggcgccgaccgcgcggccgaggcgcttctccaaagcgggctgcgccgtgagtcgctgccgcggcacgtcgcggtggtgatggacgggaactcgcggtgggcgcgcgagcgggggctgacgcccgcggacggccacaaggccggcggccgcaacctggagcgggtcgttgcgctgtcgcgcgcctggggcatccgcgcgctcaccgccttcgtctgctcccgcgagaacttgagccgccccaaggccgaggtcgactacatgatgggcttgtccgagtggctgataggcgacaacatcgacaagctctcgaggcaggggatccggctgcaggtgatcggcgacgccgcgaagatgccagcctctctgcggagcgcagcggcgcaggccgacgaggccacgaggcacaactcgcagctgcacgtgatgctggccatctgctacagcgggcgatgggacatggtccaggcgtgccgggagctggcccgggaggcgcaggcgaaccggctcagtccggacgacatcgacgagtcggtcatcgccggcaagctcgcgacgagcgccgccggcgagttctcctgtcccgacctggtcatcagaaccagcggcgagatgaggctcagcaacttcttgctgtggcagtcggcgtactcggagttgttcttcaccggcaagatgtggcctgactttggggaggctgagtacctggaagcgttgcgctccttccagggcagagaccgccgcttcggccaatcaaaattactctaacagtctaactcgatggagccacgaagtggagcgccagtatatgtgaagagttatggattgttcggttagctttcattccatttagattaaataagattgaatgaatttaaatcttaagtaagttaaactttttttaaaatttttttaatcccatcaaataaatgagtaacaggattaatggaacaaagtcttaattggaatttgtcctgttttttaaacaccaaaaaaaaaaaaaaaagaggcctgtgccatcaaaagattgtgatccacc

SEQ ID NO: 2235 - DNA, 716 bp, Zea mays
  misc_feature (5)..(5): n is a, c, g, or t
  misc_feature (54)..(54): n is a, c, g, or t
cgggnccgacccactgcttccgcgttcaggcccggccgccgactgcaggtgatncggcgacgtccgcgaagatgcctagcctctctgcggagcgcagcggcgcgggccgacgaggccacgaggcaaagctcgcagctgcacgtgatgctggccatctgctacagcgggcgatgggacatggtccaggcgtgccgggagctggcccgggaggcgcaggcgaaccggctcagtccggacgacatcgacgagtcgatcatcgccggcaagctcgcgacgagcgccgccggcgagttctcctgtcccgacctggtcatcagaaccagcggcgagatgaggctcagcaacttcttgctatggcagtcggcgtactcggagttgttcttcaccgccaagatgtggcctgactttggggaggctgagtacctggaagcgttgcgctccttccagggcagagaccgccgcttcggccaatcaaaattactctaaggcctcgtttggtttaagagtccctctattttagttttatttagttcctaaattgtcaaacagtaggattaaaacagagactaaactgatttagtctctagtctctcaagatatggttaaaaagactaaatcatattaattctacatttgcccttcatttagttcaattgtactaatagcaggagaatattaaaggctattttagtcttcgtataaaaaaaaaaaaaaaa

SEQ ID NO: 2236 - DNA, 4582 bp, Zea mays
caattaaaatattatagattattggacttaactcatttatttggcaataaattttagaataaatctcataggcccacttacggtaggagtagaaccgacgaacttttaatcccactagttaggtgcacataagttgcagggtttctatttatatttaagtgtaaatataagaatatatatattttttgttggctaggtagatatggatatggttttaaagctatcaactaatgtttgaatccgtgtgtttgtacctaattttagtttttttatcattttaatatgccgcatgaaaccgtggaaaatggtgagagatatggagtaaaagagaatgaagtcaatttaaacaacttgtctcttgttatttctaaaataaaagcatgagagagatgaagctatagctccacaactgctgatgcctagttccagcagcagctttgaatccaatcgaggacaagtatactcctagaactacatagtcgaagagtggccgttattttaaggttgtatgtatgcatattggcttttattttatcctagagctatgattcattatgctgtagcctatagtgggccatatgtttgagtgaaaaatggaacatgtatatagaatgtgtatatgtttttttttcagtattttgtagagtggagtttaaaataacaggtgtgacagccccccgtttaaaacataggaaacttgcgcgctccccgcgagatggcgacaaagcgccgaggggtttggtgctgctgctggctgccgttgcctcggaggctcagagcacgcacgggcacggcgtagcgcatggtagaggtgatagcggagggccgcgaggtgagggcgacggcgtgtctgtcagcgtgtggttgcctgccgttcttgcaatctgccatcgccaagcccaagcagctgcaggcctgcatctgtcgttgagacgtcggccgcctggcctcagctcagctcagaagcaaataatcttgtgcagggctgcagccgtgccgccaaggcatccttgcgagctggggaaagaaaaagaactcaagtggcgacgggtgctctgctcacctgtcggccgacgttatgttattttattctcgcacgcgccgtccagggtctctcaggcgctattacatgagatgagatcagcaggagcgaatgaatcgaagagagtgttcgcgtgccgctgaagacgaggagagactgctggtgccttgccgatcggcggtcgatttccccggtcgctgccgtgtcgccgtcgccgccgatatcttccaccgctctgcggatcctaatgcataggactgtcggtgggatccgtctccgcccagttgcatcaatgcatgcacgatgaccatgttcgtctctctctctctctcttctcccctgtttagctaaggcgtgatcaggagacaaatcggcgtaagagcttgtcgcgttgttcataggcggctgcataattcagcacatatacagatcacattgcattgcagcaggtagaacatcgctctctggcaagctggcgagcctgactcgccgccaaatacggcagcctgtaagcactactacgtacttgtacatgtgcgcatacgatacgagtacagtgcaaacatacgtgtctgcaagcttccaaactccgctgtcatccacagcaagcccctcaggtttcacttcagacgataaatagatagaggggtctttatttccatgtgttcctgctagctgctgcagtgctgctacagctacatggatctgatatttgttattcctttttttaaaattaaactgctactaaagatgcctaattttctagtgatatgctcacaagatttttctgttcaaacgcaagcatggatcgtcgacggaagctagtaggggtatgatggcgtgttagcgtgtatccgagattccgggtacttgtaagtagaagaagctcattggtgggcgtggttcgtggatcagatcgcgccgggcgcatgtaatagaagaaagataagaggacacctgccttgccacggtcgcaaaaggcctacaagggccaggcccgtccagctcaaacgtgccggagcgccaacacgcacgcacactctggacgcgcgctggctgactgggcgtcggcgtcgccaccaaccgccgctataataaacacacgcacggcaggcaggcaggcaggctccatcagtacagatccaccgccaccaccaccaccaagcactccagtcccgcagcagcatggccggcagcgcgtcccgcctcgccatcctcttggtgctcctggcggcgtcaccgctgcttggcgcgacgcagaaggccgcgccagggccggcgtcgtcgtcgggctcgggcgcgggcgcggcggacgcggcgccgccgacggacgtgaacaaggcgctgaaggacgagcagttcagcgagttccggcagctgctgcacgacacgcgcgtggacacgcagatcaacgcgcagctgacggacagctacaacgggctgaccatcatggcgcccaccaacgccgccttcgacaagatgaaggcgggcgtgctgaacgggctgtcgccgcaggagcagatccagatggtgctctactgcgtgctgccccggttctacagcctgtccatgctcggcaccctcagcggcaaggtcaacacgcaggggtccggccacgacgggccctacaggtacgacatcaagcggtcggggaacaacgtcaacgtgtccacgggggtgaactggatgctgctgggcagccccgtcagcaaggacttcccgctcgccatctaccccgtcgacaaggtgccgctcccctacgagctgttcgggcccaagccgcccacgccggcgcccgcgccggcacccgcgcccgggccggccaaggccaagaccaagaagaagaagaagtccgccgccatcgccgagccgcccacggccgacgacgacgacaccggctccacctccgacgaccagaaggctgccgccgcgccgccacgcgccagcagggcggccgccgcgctctccgtgctcggcgccgctgttctcgtcggcggcctcttctgatgggaagaggatcggatcggaggaggatagaatgaatgcaccgtcattcagaccaagatcacacggcgtgtgtgcgtttggccatcggctttattctttcttctctcttctcttgggggattttctctctctctctctctctctcggtgatttgtatttgtaacttaatgtgatatacattagcagtggttgttcttctttcaaaaaaaaaaaaaaaaaaagatctcacctgcttctgtttggacgaagcgtagctggttgctgtcgcttgtgttttaagcattttctttgcagtggaaaggaaacagggaagcgcagacagtgtccaaggcatggcatcagatcacagacatgcatgtgtggtagcagtccgtcgggcttgcggttgctgtgtcctgtcctgtgcatggcttcactcgttccctccttagagatcagctgatcagggcagggtgaccatcacgagaggcgcattatatcaatggtgggcgcgccgttgggtttaaagcatttttagccagggtacgcaccgacagccgagcccagggagaggtggcatcgtgatcctgatcccttttgcgctgcctcaccacggtcacgtggagcctacctactctggatctggtctggtggcctcccgttgctctcgcgggtggcttcaaaccggccggtgacgagcatagtaggggcatgtgatcctccttactcatggagcagattatatattcctcgagcatttgagcgtcctattcaatttgtgcaatcgaggtcatgtcccttattcgctctgcatttccttagaggtgactctacttgtacaccacttttaggtcctgtttgggaacaaagtttttataaaccacggtttttaaaatactacagtataatttagtcataataataccatagtttaaaatactacagttttaaaataccacagtattagatacatagaggtgtttggaagcaaagtatttttttgcacgcggtagagatgcgcgcgctgcgttttacagagaaaactgaggtatagagtatagacctaagtttagaatacttcaaaagaactgcagtatttgtaatactctagttttgaaaacagagattttaactggcttgtcaaacacctttttggtatataatactacagtttttaaaaatattgcagtattcttccgaaaatttgaaaaaaaactcactcccaaacacccccttacttgttgtggtgcagtgcactagtatatgtttcgagcaaccacaaccttttaacaggcttcttgtgcgcacgcacggctcccatccgaaccaaacccaactgagatcaaaccagttttcggcctactgctattacaaatttcgtttctatttttcttggcccatttccttaatggatcacggtcataaggcccactaactaaaatgctggtagcaagtgcgaagtacactttgaaaatgcaagacggatttttaaggcctctttggaaccgcccctccctatatattgaagatctggtttacattttttttttctag

SEQ ID NO: 2237 - DNA, 1752 bp, Zea mays
  misc_feature (1731)..(1731): n is a, c, g, or t
aagtgatgttccatcatgtttgcttaaaaagacacgcactgcctctgcctgtgcctgcctgttcatggtcctcatcctcacagagctggttaccgaaaaattggtatactttttcttggcgcaggaccttgggtgacgccggggcgcagaggagggcaggcagtgtaggctccatcagatccaacgccaccagctagcagcagcagcagcagcatggccaccaccagcacgcctcgcctcgccaccctcctggtgctcctggcggcggcgtcaccgctgctgagcgcagctcaaaaggccgcccccaaggctccggcggcggcgaaggcggcgccagggccggcggcgtcgtcgtcgtccggcgcgggcgcggcggacgcggcccctcccacagacgtgaacaaggcgctcaaggacgaccagttcagcgagttcaagcagctgctgcacgacacgcgcgtggacacgcagatcaacgcgcagctgacggacagctacaacgggctgaccatcatggcgcccaccaacgccgccttcgacaagatgaaggccggcgtgctcaacgggctgtcgccgcaggaccagatccagctcgtcctctactgcgtgctgccccgcttctacagcctctccatgctcggcaccctcgacggcaaggtcaacacgcagggctccggccacgacgggccctacaggtacgacatcaagcggtcgggcaacaacgtcaacgtgtccacgggcgtcaactggatgctgctgggcagccccgtcagcaaggacttcccgctcgccatctaccccgtcgacaaggtgccgctcccctacgagctgttcgggcccaagccgcccaccccggcgcccgcgccggccccggcacccgccaagtccaagaccaagaagaagaagaaggccgccggcatcgccgagccgcccacggccgacgacgacacctccgcctccgacgaccagaaggcggccgccgcgcccggcaccgccggcagctggaccgccaccgcgctctcggcgctcgccgccgctgccctcggcgccggcctcttctgatggggagagggaggatagagtcagtcaccatcgttcagatttgagatcacatggcgcggcgctactgcggtggcgatcgatcgctcctgcgccgcgcgccgtgcattgccatacaatgtcgcacggtcgatacgatcagagttggtgtgccccatccatccatgtacccatccatgcatttgtggctttattaattctttcttccccttgctttctctctccttttcctttcggcggatttctattggtgatttgtatttgtaacctaatgtgatgtacacaagtagtgcttcctctttcactggatggatctttggcctccgagatctggacctgcttttgtttgtttaatccgagcgtactatacgcttaacatactagctggttgcttgctctagccggggcgcccgcgcccctgttccaagcattttcttgcagtgaaaagagaacagggaagtgcagacagtgcaagagatcggacagacatgtgtggtagcagtgcgttggacaccacacatcttcccttttgctgcatcatgtcttttgcctgaaacacgcacatagcaatagcagcagttccctcctttgagatggctggctgggtctgtcagccagcgaggtaaaccgtgctcatcagcagagacgcattatattattggtggttgcaangtgatcctggacccttttgcg

SEQ ID NO: 2238 - DNA, 4770 bp, Zea mays
  misc_feature (817)..(817): n is a, c, g, or t
  misc_feature (1848)..(1848): n is a, c, g, or t
tagatttagtcttgtacaatatttccttctcttgtgaaagaagttaatgtttcatgattttcaagttatgatcattagcatcagcaggatctaacagttgaaacttgtaatttgcagcttcgcggagtcatttgttccttttggaggtcttttgtgcgatacctatgaagcaaatagtctcacaacaaatttctgccctcaggctctacgatgtcaacattgcaacgatagatatgagcaagaagttgcctctatcattagaggaagtggcgttacagctgatgctcaccaagaaggtctaccttctctgttgcagaatggcggcatgatgggttctaacaatgagtttgatgcagtcaaggtgtgaagctacttatatattcttaaattttgaagtttaatagtgaatataatgcaacttttacagcttgctgataaatgaatacttttggatttgattggtataaaagatgtacagtttttcttcagtgcaggttagagatgatcaaatggtattgagtacaaaaatattgaatctagagaagaagtggaatgagtactgtgtacgtctccatcaaggttgcaatagaatcaacagagatccttgccagttatttccacatcacattggtgttcgagttgacagggaaagatgtgcaaatccaaaccaaagcgcacagacaattgcacttcagagggatattattaaaccttgtgcattgtcttctccatacaccaatataactgcaaagagtatttcagcaccagaccaaataaatgcagaccttgtactaaaccttcaagtgaggcagtcgangagtaatgaaccccttcaaagtggggttgtgccattccaacatatcaactcatcaaattataacaaacccgaagaatcatctgctgcacctgtgacaactgatttagtgttggccacccctcgtggatcttccttcaaggattcaagtagtgccctgtgtaaacgtgtagaggacattgaagagacaatccagctgatgcctaacaaggttgacgatctgaatcttaaacctcctcacttgtctatacaaccttacacttgctccaagagttcctcatcaaattgggagcaaacatcacctagtgctctgcattcaacatctttaggaggcacttctgcctttggccaatggcagaggccttcaccgctcgcaacacaaagttttgatttgagcaattacaagctacttatggaacacctgtttaaggttgttgggaggcaggaggaagcattgagtgctatttgtgcatccattgtgcggtgcaggtcgatggagaggcgtcgtggtgcaaacaaaaagaacgacatatggtttagtttttatggccctgacagcattgccaagcggagagttggtgtggcacttgctgagctaatgcatggtagctcagggaacttgatatatctggacctaagcctcaatgattggggtaaccctagtttcagaggaaagcgtgccaccgactgtatctttgaagagctgagaaagaagcggcgatcggttatcttccttgacaatattgacaaacccgcgcgcccggttcaggagagcctgattcatgcaatggagactggtaggtacaaggacttgcatgggggacgagtgactgatcttaatgactcgattgtggtgttgtctacaagaatgatccaaggatgccaggatgcttctcttggggtggaagagggcaatgctttttcagaagaaaaggctgtggcagctcgggggcatcaactgaagatcatagttgagccgggcacaaccaacatcggtgggggcaacgttgtagtttcgtcaaggcattccttgngaagcagtgaagcctcaagttattccagtaagcggaagctccacatctctgatgggcaagaaaagacagaagaatcggcaagcacgtcccacccgcccccccacgcgtccggcatcccattcgacttgaacctcccaggcgacgatgaggaagcccatgatgatggtgatgatgacaagagcagtggcagccacgaaaactatctagagggatctgtcggaaacctcttgcgttgggtggatggttcaatcaatttcaagccatttgactttggcaagctttgtgaggacatcctgcaggagttcagcaatactaccagcaaaattctgggcaccagggggtgcaggctggagatcgacgctggggctatggagcaggtagtggcagcggcatgggcatccgattcgcatgagaatgagaagaggcctgtgcggacgtgggtggagcaggtgtttggcaggagccttgagcaggtcaagatgaggtgtgagaatctgagcagctgtaccctgagactggtttcctgtgaggtgaaagaagatggttttggagctttgcttccctcgagaataattctggattggtgatggtgatatgtgtcgtttgcattattgctgctagctatctagctgtaagtattggttagttagctgacaccacccaccgtactgtagcatatataggttcatatcattatttggtggcttcaaaataatgtaattaagctggagtatgtacgtacggtagtctagcaattaaactactcgttcaagtccatgacctggggagggatggctgtatttattgttgctcctgcgtgtatatatatatatatttgtaagaccgacgtgatggccttttcatgtggaattccatatactgatgtcatttaactgtctgtgcaagacaattgcataaattcacaagtatggaaagcaaaactgcctgacgaccctctcccctgtgtgcatgtgtgctaaaatggtctttactgtcccagttgataccataaggcttatactgaagcatggaaccagttcatggactgtagattgctctcagaaaagcatagccaaaagattcgtatgtacacatatgtcgcagcatttatttaattatcttgttgaatacagcggtactacacttgtagtataacaattaagtaggggttcaattcaaacactgtattaactaaacaaagaactaagccccaaaaattaagtagagttcccatgttcctgtcaaagcagttcatgcccgaaaaattgaccttcaaatcaacaagggcccctccaatcccagcctaaccaggttactaaggacagaacgacctcaagtaagcctgattggtttaaaccaactaatcgagcctgttctagactgactggaagacagatttcagagacggaagctcatgcagtcctgctcatttgctctagatgaccatattcaaaactcaataaaatagtaaacagctcatgcatacggattgcattaaacagtagcaagcaagccccaatttgcaggcacgagttatactgctcggagaatttggggccgatggacatgcatcgcaccgcacacggatgtagacgcaggcatgctcacgcaaacatagtcgtatagagtcgcttctcctcttgtcgtgcccttgctggaagccttgctcgcagtcgtagagacgcagccgccgtcgtggccctccgctcctcttgccgtgcaccgacggtccgctgccgtggccctccgttcctccgccgaccagcagtgccgccgccttcgggttggggactggtgtggggactatcggggaaaggattacggttgggagagcaaataggagtggtggattttgtatttttatgaggtgatcatgtccgtgtctgcatggcttggacgcagagctgtttttgttcggtgaatcagtatatcggttctatgcgactccgataccgatcaccgaagttcgctgaaattagaactgaacccgacaccaaaccccgaaaaccgaaacttcgggtcggtttttgaaactacggatcagtttttcggttttagtttaaaagtgcacaggcctacgcataagaaaagaacaacaagagataaaatatgttactcatctttatgtctcagcacttatcattccatcttttttacaatataacatacaaacataccaagagataaaatatgttactcatctttatgtctcagcacttatcattccatcttttttataatataacatacaaacatagctcgagggtacttcgaaggctgagctaaacgaagctaaaggccctcgaaaggtgaatttatgcatgacattattcatctatttatatgggagatatacaacttcgtatgaaattacaagcgtgcccaccaaatttacacatatggttcacaaatattacaagggcaatatgtctttcctcctccttccttgcagcacaaggcttccgattcttctccctttctgcttcgtgtgtgaagccctttgacaccaaagctggtggcctgtgcacacatcttcgtcacacacgtactcggacaaagctctctcatgaccacttcgtccgaaggatggcttcgtttgtttctaatgatgtgcttaaaacacactttctcaacttgaaaacagagttttgaggatcttcgtactataggcctccaacaatcgttagtttttcacttttcaaataataacgatgtgtttttattctattgaaggaacacgtagagtgcaaaatatcatcatagtgaaacatatatattagttcccaaccaatatagagcaaaaaataaatcataattcatatttatatatggaattagcatgtaaaaaagtatgaactgtgggccaaggaacgagcaacagagccaaattaaacaagcagcaggggattcacaacgagtgca

SEQ ID NO: 2239 - DNA, 1294 bp, Zea mays
cttgaaattgacaatgtaggaggatggcggtacatgtttggttttagtgctccgcttgcagctattatggctattggtatgtggactttaccatcttcaccaagatggctacttctcagggcagttcaaggaaaggcttctttggaggataataaaaagaaggcaattcaagcccttagaacattgaggggccgcacagcaagtgaaaaggttttggcagatgatgttgacgatacaattgtctctattaaggctgcctacgcaggacaggaagctgaaggaaacgtttgggatgtatttgaaggagctagcttgaaggccttcactattggcggaggtctggttctgtttcagcagataacaggtcaaccgagtgttctatattatgctgcttcaatacttcaggtgttgcggtatttaaagttgacgatgttggaaggcgcccattattgataggaggtgttggtggaattgctttgtcactcttcctactggcagcttactacaggttcctgaacaacttcccctttgttgctgtcggcgcgttacttctatatgtcggtgcttaccaggtctcatttggtccaattagttggctaatggtatctgagatctttccactccggacaagagggcgtgggatcagcctcgcagtactaacaaatttcggctcgaacgctctggtgacatttgcgttttcacccttgaaggagctcctcgggccagccaatatatttttcctgttcggcgtcatagcagtgctctccctcgtgtttgtgatcctcgtcgttccagaaaccaaaggactgagcctggaggagatcgagtcgaagatcctgaagtaattaaaaaccgttcgtgcgatcataagccccatttggagatattgtaagtagcgatgccattttcaaaacgggcgctcgctcactcgtaggatcggagccaaagctttcagacatgggagtacatatgcaaagggcacgtctcggtgtaaagcttggacatctttctcttttattagcgtagtgaatatttccgaacatacttggtaaattacatttcagttgagtcataatcacgcctctgtagactgtagtccactgtgacctactgtagtagtatgcatgtcactagtaaaagctggtaagctgtgtgatggactgatggtgtagacttgtgcagttgtgctcgcataaggctggccatcagatcgtgtatatagcgacataaaacactattttgcactatagataatactgttataatttacagaatggagttggaaacatgagat

SEQ ID NO: 2240 - DNA, 2049 bp, Zea mays
ccacgcgtccggagccttaaatttcatggagacatagtcaatattgcagaaagcagtgctatcaaaaagaaagaaggcacatcaaccaacactactgctgaagccgaaaatgatgttttggcagatgatgatgtcaataagtctattagacatgcacattccatccttcgtgatatccacaagtccatatttgaggagcaggtatttgatatggtgatccgggagacgtttaaccagtctcaaggcatcaatgttactgggatgtgcgaagattttctccaattagctattggccaggagtgttcgttgtgcctttcgcttgagctctctggacagaacaataatgcaggaacagtaggacagcaagatcatatggatacaaattatcctggaaatcttgcagtagccactgtaaatgggaaggagtcctcaaataaggatgtgagagggtttcctaaccccaaaagcttagaaatctacctgctccatatgttccatgaaattcttaggaaactcagggagaaatctcgtcatgtggttcgctaccagagttctgctcaagctgcacctgacgattgtggcctgctaagccatttttgcatgacagtagctcacaggatattttctaacaaagtacatttggagctggaaagcgtggtatgactactcgacatttgtcaattagtataattttatattagtagattggcattgtgaattcctttcactaatgcaggttagtagggttccttatctccatctgcgttcccttcctacatggcattctcgaacttcttcctggtctctctgcttgaaagttcctcagcctatcctggccaccggtcgagtcacaaagccttcagactatcacgagctgaagtacaaatccaggtcgcagtttagtacaaaggtgatcttgaaagatggccaaattagtttaatgggtgagggctccccaagcattgttgggtccttgactgggaagccatctgattcacgtctgataaatagttacaattgtgacttggaagacctcccaatgatgcttctgcagcaggtcgccagtcaagtaatccactggctccatgatgaagcgatgattcttgggatgaacgtgactagagattttctgtgcctgtactttgaccttggccaaggcgaaacacttggtctattggcacatgtcgacccggatgacacctatggctgcatctcatggtacctcactgttgatcacccaatggaggaggggaagatgtcagctggcagtccagagtcagagaagcgaaggtttttggggtacctttccctggaagtgctttactctaccctgatggacctgataaaattgtgcagcacaagtgatcaaattcgtgcctcttgatcgacataagtggatgaaatgatgtatgtccgtgcagtgtttaagagtatgtaaattgaggcattatgtgcacctgttgtttgctaataggatgtttggcttgaaaaacggagtccatcctctcactcttcagtatgtttgtttggttcatgaatgaaataagttgatacatcaccatcttatttcactaagttaataattagtattagcatgtggaataaagttgtctcgctactctattaagaaattggttgattctccaaaccaaatactccatgagtatatgctaatgcatcgccagccttattgggggatgtgagagggtctgaatttttaattggctagaattgagaattagaattttagatcacttcgcttgtgtcctctaaagtttctgaggtttaaattttagacaacattttatatcttctgtttgaagtatcaagagagtggttttaaatttagtggctaaacttaagaccgcggcatggtcgaaatatgtatcttgacccttaacaggaaagaagaattcatgtcttaaacgatgatctttttagaatttttgtttctcttcattttctatttctgaccaaattagccaggtcgtgatagcatgtgcctccgcctccgggactttttggctgctttgtgattttttacagggg

SEQ ID NO: 2241 - DNA, 1313 bp, Zea mays
tgcagtttccaaatcgatgcaaggtcaacatccatgcaacggtttactcctggtttcaacaaagagacgttgctgcatctggagattacagtcagttttttttttttttttatgcataacggcattatactacattacacagctgagcaagtacatcacatgactgaatggatttgtcttgtccggcttcgctattgctactactaacttgcccaaaaaaactaaaagagagagagagagagagagagagagagatagaggatggattaatttttcaagatagagagatagattgactgatgagtcaagcgatagattgattgatgagagtctagctagacctatcactacagtactactgatggatgacctaggaggaagaggaagatagggataggaagcagggggatgatgaatggaagggaaggcggatctatatctccatctgcaacggaacagttggaatcaggagagcggacttctcatgatgcatatatgacgcccgatgagagcgccataagaagaacagcggccctctcctcctcgctcatgcacttattgtggcgcatccggcggcgctgcttgaacgtcgcctccttgccgaaccccaccacgtggagatccacggtgacttgctgatccttcttgtccgtgtctttcttggtgatgctggtgtgctgtggatcggtggcagcggcagcggcagctgctctctttctcggctgatgccgatcctgctgtggattagcgaccgctgttgtcttctttctcagctgatgctggtcctgctgctgcggatcgacggcggccttcttctttggctgctgcagatcttgctgtgagttggcggcggcggccgctcctgcgtcgagaccgatcgcctgcctcctcttgcggtagcggatgccgcaggcgttgcagagggacttggggccctccggtcctccgcgccagagcgacgtcttggtggtgtggcagttggcgcaggccttggcgtcgcctgaggcagtggcggccgagggggaagtattaagattgggatacgtctccatgtctatctccatccccatttccgtgagcagggaaaacaaacccaagcagcaggcgcgacggatgacgatcctgcagcaacaagctagtcaggagttgcgatccgacgacgatggatcgccgccgatccaattcgccggagaagcagtggagcgaatgccaaggggaaaggaaaatgggcgggcagggagagcaagggttttagctcgatacgacagtcagaggtgggtgatgggcgagtgcgaaaccaaaggtaggataat

SEQ ID NO: 2242 - DNA, 1495 bp, Zea mays
  misc_feature (9)..(9): n is a, c, g, or t
ccaaaaaanctaaaaagagagagatagaggatggattaatttttcaagagagagagatagaggatggattaatttttcaagagagagagagagagattgactgacgagtgacgagtcaagcgatggattgattgatgagagtctagctagacctattactacagtactactgatggatgacctaggaggaagaggaagatagggataggaaccagggcggtgatgaatgggagggaaggcggatctatatttccatctgcaacggaacagttggaatcaggagaggcggacttctcatgatgcatatacgacgcccgatgagagcgccataagaagaacagcggccctctcctcctcgctcatgcaacttattgtggcgcatccggcggcgctgcttgaacgtcgcctccttgccgaaccccaccacgtggagatccacggtgacttgctgatccttcttgtccgtgtctttcttggtgatgctggtgtgctgtggatcggtggcagcggcagcggcagctgctctctttctcggctgatgccgatcctgctgtggattagcgaccgctgttgtcttctttctcagctgatgctggtcctgctgctgcggatcgacggcggccttcttctttggctgctgcagatcttgctgtgagttggcggcggcggccgctcctgcgtcgagaccgatcgcctgcctcctcttgcggtagcggatgccgcaggcgttgcagagggactgcagaggatacagacatataagatgatgagcccgggactattgactatgatgataaataagtaaaacaaaacgaaagagcgattcggcgaccggccggaacgaaatgcattggaatatgactgactggtggtgtatgaaagaaaaaaaaactagaccttggggccctccggtcctccgcgccagagcgacgtcttggtggtgtggcagttggcgcaggccttggcgtcgcctgaggcagtggcggccgagggggaagtattaagattgggatacgtctccatgtctatctccatccccatttccgtgggcagggaaaacaaacccaagcagcaggcgcggcggataacgatcctgcagcaacaagctagtcaggagttgcgatccgacgacgatggatcgccgatccaattcgccggagaagcagtggagccgaatgccaaggggaaaggaaaatgggcgggcagggagagcaagggttttagctcgatacgacagtcagaggtgggtgatgggcgagtgcgaaaccaaaggtaggataatgccagtgacggcgttgccgatggaaccctaacgccgcctcgggcttcccttcccgcttcctcttctgtgtgaatggacgagaatgcccccctccctctcagcatttggcccatttggcttggcactacggcccagctgttgttccagcaaggccagcacccgggcaaggggcaaatccaatgcaatgcacgttcaccatcctattgcaaaaca

SEQ ID NO: 2243 - DNA, 6155 bp, Zea mays
aacaaacagagaaacacttcgtcgctaacctatcttcctcccgcagccgccactttctgtctactctcctcctcctccatccctagcgctaacaatctggtatcaaaggtcaggcaaactggatcccgtcggcaattgccctcggcgtcctcgcaccgctgctatggagtacaacgaatcgaaccgccaggtgctcgaggaattgcggctcatggaagcaaggctgtctgagaagttcgctggtcgttgcgacagcatagagcggcgcgtggaggagcggtgcgatgaactcaattcccacttcacgacgcgctgcgacaagatccaagatcaagtcgatgttgctgcactccgtggcgaggaacgtcttatcgccttggaggaaatgcgcaccgacatcgagcagtggcgccccgatctaatcaagcggatcgaggacgtggcgttggaggtggtgcgcgccaacaagttcttcgagcgggaacgtcgagcggagcccgtcgacaagcccggcatcttcggcagctacacggcgccgcccctgcgtccacccgcaggcgcacctcccgctgctgggccgtacggccacctcttcgagacattccaccgggagcgtgaatcggggtatgaatttaccccgactcatggcccggtcaagggtacgcgtccaccccatccttctcgcctctctggttttatgcccgagcaatactatccatatgagtcggcacgcgatactgggcgattggggagcgggcgttttccaccgatgagtttccctcgctttgatggatctcgtccacaactatggcgcacacagagtgaaaactattttgagatgtatgacacagagtaccatatgtgggtcaagatagcgtccatgcatttcgagggcaaagctcaccgatgactgcaatcggttgagcgcaaattgcgttacatgtcttgggaggaattttgtgggctcattcatgatcgctttgggaaggagcaacacgagtcgttgattaggcagttgtttcacattaggcaaagtgggtctgtcgcagattatgttgaacagtttgcttcactggtagatgagttagctgcctacgagtctcgcacagatcctttatattatacaatgcgttttatagatgggctcaaacatgaaatcaaaacagttattatggttcaacgacctcccaatctcgatgctgcctgcgctctggctcttgtgcaggaagaggcgctggagtcctcgcgtcgccggcgtgtggagcctatatccaaccggatggcttggccacacgcggccacttcaactgaagcaggtcgagctgatggtgtatctatgggacctgagaagcctaatactgacaacagacgcgggtgggctccccctgaaagaatagcatcattgaagagctatcgtcgtgcacgcggtctgtgcgatcgatgtgctgaaaaatggtttccaggtcacaaatgccccactactgtacaactgcaagtcatagaggaagtctgggatttactcaatgaggatgaggtctctgcaacagtggaaacgacgtctgagcaattgctgatggctatatccaatgcagcatggtcagggatcggttccattacgactcttcgtctccaaggttccatacagcagcatgagttgatgattctcatcgattctggatcttctcacactttcattaatgacaagtggctgtcagaattaaaaggggttcggccattacacaatcagctcaatgtcagagtagctaatggacaaatcctcacatgctcccatcatttaccccaggctgtatggcacatgtccggtcaccagtttgtcaatgatctcatttttctgcctttaccatcagtcgatttggtagtgggcatggattggctgcaattgcatagtcctatgagagttgactggtccaacaaatggatgattataccttatcgtggcactttggtttgcttacaaggtgtttgtccatcatttccttcaggtgccatggtggaattgcgtctgttaccagaaccacacgagagcggtaattcggacagcaatgaagacaccgtgattgatcctcgagttaagaaagtgttagcgcagttctcggaggtttttgctgaaccggcggggccgccacccagcagacagtgtgatcatgcaattccactggtctcgggggctcatccttttaatgtgcgaccatataggtatccaccagccctcaaagacgaaatagagacacaagtgcagcagatgctggaacaaggcgtgattcagaagagttatagtccttttgcatcacctgtattgctggtcaagaagaaggatcagacatggcgcttttgcgtggattaccgatatctgaatgccataacaatcaaaagcaagtacccagttccggttttcgattagctaatggatgaacttgctcacgcacaatggtttagcagcgctcacttgtccccccccccccccccccttcgtttgctaccgggtgaggaacacaaaacagcatttcagacacatattggtcatttcgagtttcgggtgatggcgttcgggctcactggtgcacctaacacatttttggaggccatgaacgacactttagccccagtcttaaggaagtgcgccttggttttctttgacgatattttaatctacagttcgtcttttgaagcacacctgacccatctgactacagttctcgaactcttacacaaagataattggaaagtgaaattatccaagtgtgcctttgcccagtccagcattgcctatttgggccatatcatcagtgctagtggtgtctccacagatccggctaaaatcatggtagtacagcagtggcctaccccttcctctgccaaggagttgcgcagcttcttaggtctggcgggtttttacagaaaatttgttcgccatttcggtatgatcagtcggcctttaatggatctgctcaagaagaatactctatttgtttggacaacggagcaccaacaagcatttgaattattgaaaacagcactaagctcagctccggtgttagcactcccagacttctctcttcctttttgcatttacactgatgcatgcaaaactggagttggtgctgttcttatgcaacgaggacatcccctggcatttttaagcaaggcattgggaccgaagaatcaaggattgtcgacctatgaaaaggaatacttggctatactcattgctgttaaccagtggaggtcgtacttacagttagcagagttccacatttatacggatcatcaaagcttagtgccattgaatgaacaacgcttgaatacagtctggcaacagaaactgtacactaagttggctgggttacaataccgtattatatacaaaaaaggctgcgataatgtggctgccgatgcattgtctcgatatcccacttcggaacagctgctgcatatttctcagtgtacacctacctggattgatgaggtggtacagggataccagcatgattctcaggcccaagaattattaacacatctgactatatcatccaacaacgacaactctccgtttactctagtccagggtgtcatccgacataaggggcgtgtgtggctaggcaacaatacaacgttacaactcaaaattatagcggcgccccacgcttccgctctcggaggtcattctggatttctggtaacctacagaaggattaaacagctattttagtggaaagggatgaagaaagatatccatgcctatgtccagacatgcaatatctgccaacaggccaaaccggacaggaccagctatcccgggctgctcgcgcctctacctgttcccccgcatgcatggcattctatatcaatggacttcattgaagggttaccgaagtccggaacaatggattgcattctggtggtggtagatcgattctcaaaatatggtcatttcttggcgctggcccaccctttttctgcagcaaaggtagcaaaacttttcttggataatatctataagcttcatggtatgccggacaatatagtatctgatcgggatagagtgttcacaagtctgttctggcagcaattattcactctcagtggcacccaattatgcatgagttcggcttatcacccacaatccgatggccagacggagcgcgtaaactagtgcattgaaacttatttgcgatgctttgtgcacgcctgtcccagcaaatggtaccaatggttagctgttgcagagttctggtataataccaactttcattcagctctgaattgttctccatttgaggtgttatatggacagccccctcggcacttcggcttgcaaccagggagtgcagtgactgtttcagatctgtctacttggcttcacgatcgtgaggtggtatccaagttggttcagcaacatctgttacgtgcccaggaccgcatgaaacgtcaggcggataaacgacgttctgaacggatttttagcgtcggcgatcaggtgtacctgaagttacaaccgtacgtacaatcatcagtcacaactcgggccaatcaaaagcttgcttttcggttcttcggcccctacaaaattttacagcgcatcggcccagttgcttacaagcttcagttgcccgcttcctctcagattcaccccatttttcatgtatctcaactcaagtcggctgtcaaccgtccacaacacatcattccattactacctgagactaatgattcacttcaggtgcccatacaggttcttcaacgtcgattaatccggcgtggtggttctatggtgactcaagtcaaagttgcatggtctggaatggacaccgcaatggctacgtgggaagatgttgatgcactgaaggcgcgttttccttatgcgccggcttgggggcaagccgcgtttcaagactgggggaatgtcagctctgctgtaccggaagacacaagaaccatggccgagaaggatctgacggcgaagacagaaggaggcgatgtctcagctcggcctcgacgtatcaagcgcggcagcgtccgagtaactgggccggaatgggccaattgatggctggctgggccggtctgtaatatgggatataggcatacgctggaaccgtgaacaggcatcgaaaatctgagaacaaacagagaaacacttcgtcgctaacctatcttcctcccgcagccgccactttctgtctactctcctcctcctacatccctagcgttaacaatctggtatcagaggtcaggcaaactggatcccgtcggcaattgccctcggcgtcctcacaccgctgctatggagtacaacgaatcgaaccgccaggtgctcgaggaattgcggctcatggaagcaaggctgtctgagaagttcgctggtcgttgcgacagcgtagagcggcgcgtggaggagcggtgcgaggaactcaactcccacttcacgacgcgctgcgacaagatccaagatcaagtcgatgttgctgcactccgtggcgaggagcgtcttatcgccttggaggaaatgcgcaccgacatcgagcagtggcgccccgatctaatcaagcggatcgaggacgtggcgttggaggtggtgcgcgtcaacaagttcttcgagcgggaacgtcgagcggagcccgtcgacaagcccggcatcttcggcagctacacggcgccgcccctgcgtccacccgcaggcgcacctcccgctgctgggccgtacggccacctcttcgagacattccaccgggagcgtgaatcggggtatgaatttaccccgactcatggcccggtcaagggtacgcgtccaccccatccttctcgcctctctggttttatgcccgagcaatactatccatatgagtcggcacgcgatactgggcgattggggagcgggcgttttccaccgatgagtttccctcgctttgatggatctcgtccacaactatggcgcacacagagtgaaaactattttgagatgtatgacacagagtaccatatgtgggtcaagatagcgtccatgcatttcgagggcaaagctcaccgatgactgcaatcggttgagcgcaaattgcgttacatgtcttgggaggaattttgtgggctcattcatgatcgctttgggaaggagcaacacgagtcgttgattaggc

SEQ ID NO: 2244 - DNA, 1922 bp, Zea mays
gagagacagtcagatagctcgaacctcgaaaagcaggagagtccaaagccgaatggacaactggatattcaacaaatcaacagagccacagaggaaatgaatccgatagccaccgccgccaccacgccatcctcatttttcgcctcaaaccgccgcttcgcccctcgcctccgctccctcctccccgccgctggcatgtcttccgccgccgtatccgcctctgccccaagccccagctccggcactggggaacaggcgaaggcggccccgctcccgcactcgaccctcgagatcgcgggcgcccgccggggcctcctctccggcttcgccagcctccgcgccccgtaccgtgccttccccgtactcgcgtcgaaccgacacgtcgaaaccatcttcgctgcgctcacgcgatcgctccccgccgttaagctgcggcgcgagtgcctccgcgcccctgacgacggagccgtcgcgctcgactgggtctctggcgacgaccgcgtgcttccgaatgatgctccggtgcttatactcttgcctggtcttacaggtggaagtgatgatacatatgtaaggcatatgcttatgagagctagaagcaagggatggcgtgttgtggtgtttaatagccgtggatgtgcagatagtcctgtgactacacccaagttctattctgcttcatttacaggggatctccgccaagttattggtcatattttaggacgttatcctcagtccaatgtctatgctgccggttggtctcttggagcgaatattcttgtgcgctaccttggcgaggaaactgataaatgccctttatctggcgcggtctccttgtgcaatccttttaatttggtaattgcagatgaagatttccacaaaggatttaacaacgtttatgataaagcattggctagggctttgacgactatatttaagaaggatttgaacaaaatttaggcatgctctccttttcgaagggctggagggtgaatatgatatacccaaggcagcgaatgcaagaactgttagagattttgatgaggggttaacccgagtttcatttggtttcaagtcagtggatgattattactccaattcaagcagctcggattctatcaaggatgtttgcatacccttactctgcatacaggctgataatgacccaattgcaccatccaggggaattcctagagatgatatcaaggcaaataagaactgtctacttatagtaacaccacagggtggccatcttggatgggtagcaggcgacgaagctccattcggatgtccttggacagacccaatagtgatggaatatctagaacatctcgagaatgggaaggactctagtaccaaaaataacacatcctatgagggtgtttcagaggcatcagtatcccatctaactgtgcatggccaaagataataatatctctcttctcatatttctcattcgccacatatgttttatatggaaatagtttagtagagttcatttagccgtgttgtctgctggtgcctgctggtttgggtacatggctcttcgtctacaggtctacacatgtgcgagaagatttctgtgtcaaataagatgtctggttctgagatcaaaatagaacatgcgttgtccaattgttcgttcttaggggtttcactttcatccggtgtttgaaagggattctctgtaaatgcatgagctgttacggaattggcctttgtatccctcttcggcaacgtgtgaagttgatggcgatgagaacagcagtgcatcatgtaaatttgacaatgtcattcagggctaacaaacatctcgtgctaaacatcatcttggattaacatatgacaatgtgatgaaatagtaacagttgttgaaattttaaaaaaaaaaaaaaaaaaaaaaaacccgggggggggcccgg

SEQ ID NO: 2245 - DNA, 1208 bp, Zea mays
ctcctactcgcttgcttttctcagtctcacggccggcccagcccaaaatccttttcaccgctacgacctccgtgctccggcgatgcagcggatttcgctacgacttctgcgctcctcctacaccgccgcctccgcctccctctccaccacctcctcctccctccgcggcctggcagtatcccatggcggttggaccacccgaccgtcgctgcagcctccggtgcgaaccgcggcgccggtcgaactcaccaggtggccgccgcggaggggttactcccagttcgcgagcgggttcaccccgctgaagccgaagccgctgggatccatcctcgacatcgaacgcgccaagggcctctcccccgaccacctcgtcgccgcatgggatgactatcatttaggaaggggtcatataggtgcatctatgaaagcaaaactttaccatctcttggaacaaagatcagcttcatgccgtcactttgttattccgttgtggaagggaagtggatacactactatgttcatgcaagtccagatgccatacatggtatttacaggacttgaagactataaagcacgaggcacacaagcaagtccttactacacagtcactcattacacagagtttgctgagaccaaggacactgtgcttattcgaggagatgttgtttttaccagcaaactaaccgattcagaggcaaagactcttctagagactgctcactcgttctacctgaatgatgtgagatacagactcgtggagcgcttcaacaaagagactcatgattttgagttcggggacgtccttaaagtgcttgacatgccaaccatgtgacccagtttaattcccaaccaatagcaaatattcctagagcacattgattttctgtcacctcaaatcctcaatttagcacgggagattgctttcttgcatcatcagaggcagtaagatggagccactggatatcatcctgccttcgctcattgagcattccgtgtggattttgttgcactgattacaccatagacaattttgctgtttttttaagcagttgatgattttcagggatttgagacataagttatattttttgctatatcattgtacccattaggtccataatgacattttgtaccatcttgatgtatttcccctgaatatttttgtggaaaccataaaccaatttgtttgttaaaaaaaaaaaaaaaaa

SEQ ID NO: 2246 - DNA, 3325 bp, Zea mays
  misc_feature (1939)..(1939): n is a, c, g, or t
cctaactcttactcgggttgggggcatcaagtgcaaccagtggcggttagcccataagcccgattatcataataaacaacacatatttcagtatactaacaaaattacggtgcataaatctatatttcaatacacaacgctcagattacaatgcacaaatatagaatctataatctagggttgtgagcatttgtgatatagtcttgaaaagcatcagattctccaaagcaaagagccagatataatctagcaattaaacgacaaagttcaattcttgcaactgcagcagagtactcccaacttccaacactaccatatgtgttatatttagcaatcgactcaacaatgccagatctttccttttcctttttagcacgacaatgatcaagatgcataagcaaatgcacaacaccagagctagatttagcagataaagtctccctacagtgatggcaaatggcagagattcttacctccttatcttgctctatcacagtgacctcttcaaagtcaacctagacctcataagtaggtcccctcctcatatgcttgccaccgccacagacagcgtttgccacagcggtcggactcgaggatccagtgggtgtgtaagtaccagttccaacatctgccgcacgcggcggcatcaacatcaggtggagtgccacggatgatgaagcacacggtatccttcgcctcgttatgatcttcaagtcttcgctcctcctcctcggcgctcggatctaaatccatggccaactcctacttagctcgcctggctcttgactacgcgcaaccagcaaaagaactataccaaaaacaacaacaaatgcttactatcagggtaaccaacagagaacttgagagggagacaagatgtagatggcagtggtactatcacatgcgctgcgtagccggagcaccagattcgctgagaaggggaaaatagagcggatatcttgaaagatcgaggattagggtttccaaatagagaaggtaggagataatggagggcaggaggggtagctaaaaggtagtagaagacaataatagaggagaacacaacactggaagctgatacctataggctagagcagatataaaacttggaagtggagcaagcgagtggcgatggagattggagaccaaacctgaaaccagagcaccagatactcaatgagggggcaccaatcggagtcggagacgacgacgcgagcgagtgcaccgatctaaacgtcgagcaccgatcgaagtcggagacgacgacgcgagcgagtgcgtttgcgcgaggcggcaagggaggcgaatgggaaatagacaagattagggtttctcgaacgagcggacgtgtgggaatggtgggaagtgtgctagtgtgcaactgaccgatgtgtatacatgtgcatgcatggaggcggaccagtgcaaggtcgtgcactttagtcgggttgggtcgtgcttaccccacgagccgtacatgtagcccaagcacgacacacacatcgtgccaaggtggccaccgtctatcgggtcgggtcgtgctgtgcggggttaatagcgggttgggtcgtggtgtgcgaggtttctagagggtcgggtcacgggttgcccaacggaccggtccgtatggacatgtatacaatatacacaccgcacaccgaagcgctccagtcgctctcgactccgtactatctttatttttcagcccctttggcagggctctcacgacggttccttctctggctcttcgtgaagccgtatcaaacgatcttaaaaacgacttctcgtcgagagccatcaaggagtaagggacgttttgctattaggagccgaatcactagaaaataatcttctatcggtttaatctatcccacatacaataatatttcataatattatagtctctaccatcgttaccatcgtctctatgtgacaaacngttttaccaaataaattacaaacggaagcctgagctagaggatgagcgagtcttgagaacggtcctcagtgtcaggctggccgccagagtgaccgcccgcccccacacaccccacgtgacaaccgttccctagtcccgctggcaagcgggccccgacagcccggtccacctgtccggcgccggtgtcaccgcccaggtccggtcaggtccagttcaaatgagcagtcgtagccggccgggctccggctcgccccccttcccctccgttgttatcttgtcaagttgcggttgtctccctcctccggcgctcccttccgcccctcccttcccgcctcctccgcgcagatcgccaggcgaggaaccagaccgcagggcaggatgcagtacaagaacctggggcggtcgggcctccgcgtcagccagctctcgtacggcgcgtgggtcaccttcgggaaccagctggacgtgaaggaggccaaggtgctactgcaggcgtgccgggacgctggcgtcaacttcttcgacaacgccgaggtgtacgccaacgggcgcgccgaggagatcatgggccaggccatccgggacctgggctggcgccgctccgacgtcgtcatctccaccaagctcttctggggcggccagggccccaacgacaagggcctctcccggaagcacgtcgtcgagggcctccgcggctcgctccgccgcctcgccctggactacgtcgacgtcgtctactgccaccgccccgacgcgtccacgcccgtcgaggagacggtgcgcgccatgaactgggtcatcgaccagggctgggccttctactggggcacctccgagtggtccgcgcagcagatcaccgaggcctgggccgtcgccaaccgactcgacctcgtcggacccatcgtcgagcagcccgagtacaacctcttctccagacacaaggttgagtctgagttcttgccactttacagcacctatggcattggtttgactacatggagtcctctggcttcaggagtactatctggaaaatatggcaaaggggacatacctgctgatagcagggtttgccctagacaattacaagaacctggcgaacaggtccctgggtgacgacacgcttcgaaaagtgacttgcggcgaaacctgttcaccggcacttgcggatcccagatggcttatttcctgctcctaattaaattgtcagtactgctggtaacctggtattgtatatagcatactatagtagtattattcagtcagccgtactctccggatctttgactctggagcggtggcggcagtttttcatgtccgggagcaaaggactgttgaaatgcacgcggaactgcgcaaggcaggtttggttggttttaattctcgttc

SEQ ID NO: 2247 - DNA, 1565 bp, Zea mays
gtctgaatccggtgttgccgtccccggccggggccgcacatatgtgagcagccgcatccggccttcctcttcctcctcccctctcccccgttggcttgttcagttgctcttcgtctcctcccctcccctccgccggctctccggcccctcttcgtcccccctcatcctccgcgcacatttccagacgaggaaccagggaggctaagtgcaggaaggcaggatgcagtacaagaacctgggccggtcggggctccgcgtcagccagctctcgtacggcgcgtgggtgaccttcgggaaccagctggacgtgaaggaggccaaggcgctgctgcaggcgtgccgggacgcgggcgtcaacttcttcgacaacgccgaggtgtacgccaacggccgcgccgaggagatcatgggccaggccatccgggacctgggctggcgccgctccgacgtcgtcatctccaccaagctcttctggggcggccagggccccaacgacaagggcctctcccgcaagcacgtcgtcgagggcctccgcgcctcgctccgccgcctcgacatggactacgtcgacgtcgtctactgccaccgccccgacgcctccacgcccgtcgaggagacggtgcgcgccatcaactgggtcatcgaccagggctgggccttctactggggcacctccgagtggtccgcgcagcagatcaccgaggcctgggccgtcgccaaccgcctcgacctcgtgggacccatcgtcgagcagccggagtacaaccttttctccagacacaaggttgagtctgagttcttgccactttacagcacctatggcatcggattgactacatggagtcctctagcttcaggagtactaactggaaaatataccaaagggaacatacctgctgatagcaggtttgctctagacaattacaagaacctggcaaataggtccctggttgacgacacgcttcggaaagtgaatgggctaaaacctatcgccgctgaactcggcgtttcgttagctcaactctccattgcttggtgcgcgtcaaaccccaacgtctcatccgtgatcactggagccaccaaagaaagccagatcgtggagaacatgaaggctctagatgtcatcccactgctgacgccggaggtcgttgacaggattgaggcggtcgtccagagcaagcccaaacgcactgaatcatacaggtgaaggcggtacgtacgggcctacgtgaccgtgcagattgtgagtggcgcggagggattctcggcattcgtccgaatggagtttaggcctctccagtaccttgatttcacgaaattatatccatggaacattggtcccatgtattctttctgggcgtccccagtcgtggtgctgtgttccaaacatctgtccgtcctgtgtgtattctgcctgcgtttcagattcagattttttttttattttggacccaatcaaccctgcactgccttgtcgaggaccgtggtccgtggatggcaatggttcttacttcttactggttatattatatatgctgcaagattgctaaaaaaaaaaaaaaaaa

SEQ ID NO: 2248 - DNA, 1517 bp, Zea mays
cgcccctcccttcccgcctcctccgcgcagatcgccaggcgaggaaccagaccgcagggcaggatgcagtacaagaacctggggcggtcgggcctccgcgtcagccagctctcgtacggcgcgtgggtcaccttcgggaaccagctggacgtgaaggaggccaaggtgctactgcaggcgtcccgggacgctggcgtcaacttcttcgacaacgccgaggtgtacgccaacgggcgcgccgaggagatcatgggccaggccatccgggactctgggctggcgccgctccgacgtcgtcatctccaccaagctcttctggggcggccagggccccaacgacaagggcctctcccggaagcacgtcgtcgagggcctccgcggctcgctccgccgcctcgccctggactacgtcgacgtcgtctactgccaccgccccgacgcgtccacgcccgtcgaggagacggtgcgcgccatgaactgggtcatcgaccagggctgggccttctactggggcacctccgagtggtccgcgcagcagatcaccgaggcctgggccgtcgccaaccgactcgacctcgtcggacccatcgtcgagcagcccgagtacaacctcttctccagacacaaggttgagtctgagttcttgccactttacagcacctatggcattggtttgactacatggagtcctctggcttcaggagtactatctggaaaatatggcaaaggggacatacctgctgatagcaggtttgccctagacaattacaagaacctggcgaacaggtccctggttgacgacacgcttcgaaaagtgaatgggctaaaacctatcgccgctgaacttggcgtttcgttagctcagctctcgattgcttggtgcgcgtcgaaccccaatgtctcgtctgtgatcactggagccaccaaagaaagccagattgtggagaacatgaaggccctagatgtcatcccactgctgacgccggaggtcgtcgacaggatcgaggcggtggtccaaagcaagcccaaacgcaacgtcgagtcatacaggtgaaaattcggtgttcatccgacggagttcaggcctcctccacgaaacttcatccatgatccgtgtgtattctgggcgtggtgctgtgttcacaaacacaagtctgtcagtcctgtgttgtgtattctgctttccgatacagattttggaccaattcaatcctgcattgtgttgcttgcgagcagaaagatttgttggatgaccatgatcctttctggtcgtgctgcaagatttctggagcgtgagatcctctgctgtatcactgtatcagcagctcatgctgttggctgttgcttgcagaaatattcgagtccgttttagcagaatcctgccccatgattctctagctcggagacccgagttatcatcggtagagtgatttcgagtgtttctctagcagaagtcaatttatctgataaaaaccatttgacaagccgtatgtaaagtggtaaagtgagataggtta

SEQ ID NO: 2249 - DNA, 2875 bp, Zea mays
tttttttgattatttcttttttccaggtctataactaaaattacttcggcacctcgcttttctaaaacatggaaccgaatctattaatggttaatttagtttaatttaatttaaattttggtttcaattaatttagttcgattccttgtcactgtcgagcagcggccgcccatctccaacaccaccaaacttcctccggtccggtcctcccaaaccgtgtgaagaccatctcaccaccatgtggatcccacgcacgtttggactggacccactcgacatcgggccaacgcggcaaacaacagcgtagtcctagcagttcccgcaaaacttctccctcccaagttccaaacatcgcgcctcccgctcgccctagcccccttcaaaaccccactgctctccccgcctccaccacaaaacacgaaatcggcaaatccattccgcccgcctattcatccctcaccaatatccggggcccacatggcagccacccgcaagctccacgcctcgtccgccgccaccagcggcgaccacctccgcttcctccgcccaggggccctcgcccgcctccgcgacgccaggctccgccgtgggagtcgcgccgcccgcctgccccctccctcatcgccggctccggcgccggcgtccccctcatcgcctcctcctgcggctggagacggcgagggcatcgtggccgtgccgtacttcacgcccgcctcgaggctgctcgcgccccggtgcccgcagcggaagaagctcgcggcggccaagtctgtggtgctcttcgctccgccgcctcccagcaccgatctgcccatcgaggcggttattgagttcctcagcgcgcctgacatggtggttgccgcccactagagtgtctcgccgtacttttgtgttagccttgtagatctattcgtcgcttatcttgttagcttagtgccttagggtggtatgaaattttcgtcgtttgtttgtactgatctggatgtgaaaatagagacatatacaaggaagcgcatgcttgatatgtagtaatacagaatactacaaaattgggtaaccaaaaaaaaaaaaaaaatagccgcggcctgttatgaatttgtggactgagatcatttagcttatggtccttacatgggcacatatgttcataaaactaggctcattcaattgcttgttacgtgagaatgcgatcatgtgatcggatgtcggcgattttttattattcctacactctgaatttgttatgttttctcggatggcacttcaaaaattatggcgaccaagtggcattagtgattagtctgagttgcctttggttgaccgttgctcatcctctcttttatatttgtccacatgatttgttgatatgccaattcaatgtctcttttgtatgaactctttaattaacagttccttcacatcttattatctctacttaaggtgtttttttcctcctacctcaagatgctattctagtgcttgccacctgtcaggtgtttgacatatgctcaacattttagttgccttgtttgttcgatgataacttctggtataattcttgatgttaccatttctgtagcttcattatgatatgttccatgaagtgtcaacaaggcttactcattgacttttatctcaactgcaatcaccttccccatctatagttaacaaggccatttgcccactacctggaaggaagactcactattatgttcacttcgtattatgatatgttggatgatctaaggatatagaactagtcaactaggctcattcaagtgctggttactcgtgaatttgatctcgttgatcgaatttagtttgtctaccagattgtacttcagaaattatgttaagtggcatcagtgattagtcagagtggcctttagttgaacattgtacatctattttatatttgaccattccatttgttgatatgcacgaactatttaattagcacttccttcacatctatcgctacttaaggtggctttttgcctacgtcaagatgctattctagttcttgccacctgtcaggcgatttgatgtatgatcaccattttagtttcctttttttcgttgatatgataatttatggtataattctggatattaccgtttcttgttttattatgatcgtgtaacctagggtcctaggcttagtggcttactcaattacttttaccttattcaattgtaaccatcatcctcatctgaagctaacatgtccactcctgagcagaggtgaatgtatatctcatattattagtgttgaattatacaattaatggctcatatcgatatcattaacattctttcaccactgttttaatttcatactagctgctttcagtttctgatggactgcgtcattgttggcaacgaacattatgaaaccacacagagttaaggaaactttacaacgctacaaagaacttcaggacattatcacaattcttggattggatgaattatcggaggaggatcgtttaactgtagcaagagcacgaaaaatcgagcggttcttgtcacaaccgttctttgtggcgaagtttttaccagttctccaggagagtatgttgggaaagaagccaaatgtgagtgttaccactttccctgtcttgcacatcttgtttattttataaaaaacaattgcatagcgaactgtggggtctgaatatcctaccaactaacatattatttgatttttaaggctagtttagcaactttatttttccatgagattttcattatctcaagggaaaataaactaattttttttgggaaaatggaaaccccttgaaaaagtggggttgccaaactagcccttattgtccgaaaaaaccctcacatgttactccaggggtacgagcag

SEQ ID NO: 2250 - DNA, 1610 bp, Zea mays
ttccaggcaagcaattcctgggcacctcctcccagtgatcccgttcctattctgctgttactttgtctccgcaggccccacattctccgtctcgccacggtcgcggtcgtggtctcgctccggcaaacccaatggccgccgccgtccccaacggccacaccgccgccgccggagacgacgacgcaccacccgccgcttcgtcgtcgttggtgttcctgggcacggggtgctcgagcgcggtcccgaacgcgcggtgcctgatccagccccccgacccaccctgccccgtctgctcccagtccctttccgtcccgcccgagttaaaccctaactacaggtgcaacacttctcttttgattgactattgccaagatgaacgtgcacataagtatattataatagatgttgggaagacattcagagaacaagttctgagatggtttgttcgccacaaaatcccttgcgttgattctattcttctgactcatgagcatgcagatgcgatcttgggccttgatgatgttcgggtcgtacagccatttagtcccacaaatgatattgatccaaccccaatttatctctctcaattcgctatggacagcatctgccaaaagttcccctatttggtcaaaaagaaattaaaggaaggggaggaggttagacgagttgctcaacttgaatggaagataattgagagtgatattcagaaaccattcacaacttcagggctagagtttgttcccttgccggtgatccatggtgaagactacatttgtttgggtttccttttcggaaggaaatcaaaagttgcttacatatcagatgtttcacggtttcccccaagcacagaatatgcaatttcaaaatctggaggagggcaacttgatttgctcatcttggattgcctatacaggacgggttctcacaatgtgcacttgtgttgggaccagacactagatgctgttaggaggatttgccccaaaagagcactgcttattgggatgacccacgagatggatcatcacaaggacaaccaaacattggaagaatggtccaggagggaggggattgacgtgcagttagctcgtgatggcttgcgtgtctacattgatctgtagccgtgaaaggaaaatatgccatactcagcgaaccgcgccaggctttctggctgatgtaacatccattcccacttgtgaagaaagtgcaaactgactaaaaaggcgagcctatttggtgcatcattttacgtttcgctagtttatacgtgaatctctgaataaaaaagagaaaaagaaaagaaaagagagagagtagccacttgctagtagctggttcagtgccccggcaaattaatggccatctccctggtaaaggtagtcgaatgttcttgtaatcttgtcaattggaagctacactgcactggatgcatgcccaccagtcgaactgagcatgcgatttttttccctcggtcgcgcccgggtcatgtattgtagtatatcgtaagaggaaaatcgattgagcatgttcgtggcgccagaccgagccacacgacaaaaaaaaaaaaaaaaaaaaaaaaaaaaaaaaaaaaaaaaataaaaaaaaaaaaaaaa

SEQ ID NO: 2251 - DNA, 1702 bp, Zea mays
tatatatatatatatatatatatatatatatatatatatatatatatatatatatatatatatatatatatatatattagtttggcttaatacgttgtctagagtattaaaatgaataaaggagatgagagataatatctctctatatataaagaggaaaatcctatctaaatataagaaaagtgacaatttagggtcgctgcatgagtgtgtcagggaataatgatcgaggcaagctagagcagagagagaataaaaaagaagtcggccctggcccattgaagatatgtacagtatacgtgtagtagtgaacatggtgggggttgtagttgtagtgcacttgtcctcgttagatgagcagtagaagcctatatactctttctgaattttacaatctttaactttaataattctgcctctttgattttttgcaatgacccatcccaagctttgtggggggtgactggtgacatacctgcaaccatggcactatataacagagatggtctccccgccccgcggccggacgccgggccggtctaagaagaccgacgactcactcacaaccaattagctcaagatcgagctatagagagaaaagctaagatcgaaacatataccaatgggcaacagccttaggtgctgcctggcctgcgtcctcccctgcggcgcgctggacctgatcaggatcgtccacctcaacggccgcatcgaggagtacggccggccggtggccgccggcgagatcctggccgccaacccgaaccacgtcctcagcaagccgtgctcccagggcgtcgccgtgcggaggatcctcatcgtgtcgccggactccgagctagagcgcggcgagatatacttcctcatcccggcctcgtcggtgccgccggagaagaagccgcagccgcagcgacagcagaagagcgtcgtcctggccggctcgcacggcaaccaggcggtggtcaacaagaaggcatcgtcgtcgcaccggagacgacgcaccgccggctgcagaaccaccgtatggaagccacacctcgagtgcattgttgagggggacacttaggcagaggtggacgatgatccattcttttgctctcttttttttttttttggtttttgtggatcaagcgggggggctaatggctaatgcaatgtaacaccactagcagcatggtgttttgcccacttaatttgtgtggttagtcagcatttttaatcttttttcttgggtaaatgtatatccatgtaatgttttcccccttcctacatatgatgggaatgcagaggaagggttgttgccagttctttcttcttcgtcaaagtgttccgcagttgcctatatattcttctcctgtttttcagggtctgtgcagtggttgagaaaaagatgaaatgttgaagggctcaaatacatttcatcaaataaacaatactcctgcaatgcaagctgttctgtttgaatatagatttcaagttacccaatgtttagtgttaatcccactggctactgcaccaataatcccctgctaacaaaacaagcacttgatccaccaagggcaagctagggtcgatgatgctagtaggagtagaaacgaagactcaatcaatagtttcttaggataattttgcttcctaacagtgggagggacatgcatcattagaccatgaatgattagaagcttgctttgctagattttat

SEQ ID NO: 2252 - DNA, 2171 bp, Zea mays
cccacgcgagccgactcctgctcctattatccgcgtcgctcctcagggcggagaggaggcaagaggaaggaagcgccgcgggagcgccagacagacagacgaaccgagcaccaccgccactagaaaaagccagcccaaaaccctagctccggcgcgccaccgcgcagatccggtgctcccgcgcgatgtcggaggcggaagcggcggggtcgttgtcgaggcggcgaatggaggacgaggagggggcggcggcgatggaggcggatgcggcgcacagcgggaggggcgaggcggaggatgaggaggtcgagagcagcgactacacgtcggaggacgagggcaccgaggactaccgtcgtggtggataccatgccgtccgcgtgggagactccttcaagcagggcgcctacgttgtgcagtacaagctcggatggggccacttctccaccgtatggcttgcctgggacacagcccactccagatatgtggcgctgaaggtgcagaagagcgctcaacactacacagaagcagccatggatgaggtcaagatcttgaagcagattgctgatggtgatcctgacgactcaaaatgtgttgttaagcttcttgatcacttcaagcactcggggcctaatggtaaccatgtgtgcatggtttttgagtttctcggtgataacctgttgaccctgataaagtacacggactatcgtggaattccccttccgatggttaaggagatatgccgccatgtgctcattggccttgattacctccaccgtacactttctattattcacactgaccttaaaccagagaacatattgcttgtgtctaccattgatcccacaaaggaccctcggaaatcaggcgtacccctagttccgccttcaacgaggacagacgagccacctcctaaggtgcctgcacaatcaggaaatggtggcctcaccaagaaccagaagaagaagatccggaagaaagctaaacgtgcagttgctgcaacttcagaaggaagtagtgctgtggcatctgcggacacagatgggtcagatgaccgaggagatctgggtacaacaaatgagggtagtcctagacaggatggagctaagaagcgggtgacacgagataggcgcggtagcaaaggggccaagaagatgatggcaatgaaggctgatctaaaatgcaagctggttgactttggaaacgcatgttggacatacaagcagttcacaaacgacattcaaacaaggcagtacagatgtcctgaggttatacttggttccaagtattctacatctgctgacatgtggtcctttgcatgcatttgctttgagcttgccactggggatgtgctattcgatccacatagtggcgataattttgacagagatgaggatcacctcgcgctgatgatggagctgctaggaatgatgcctcgaaagattgcgttgggtggtcggtattcacgtgatttcttcaatcggtatggggatttgcggcacatccgacgcttgcggttctggcctctcaacaaggtgctgatggagaagtacgagttcactgaaataaatgctaatgggatggcagattttcttgtcccaatacttgattttgttcctgagaagcgccctacagctgctcaattgcttcagcatccatggcttgatgttggtcccctccgacagcaacctaaaacacggccagagtcagcacagagtccaggtgatggtgtttcagagaagcaaaagaaagagaaagaagaaagagaggcaatggccgtagagttagggaacattgccatagatggtgcttcttcttccaggatggcaaatgacccccaatcaagcacaaataaaacaaccgctacctcttctaagaagtgagctgcatttgatttcatgagttaagctgtaaaacttgttttcattcgagaattgctccatgagtgggaaacatatgtttttttttaggtttgagatatgttaggatagctaccgagggaaaagaacagtaggctaaatatttgttgtatggggttgggtggacaaggttagatttgtcggggttgcagtaaccctagcccttttctttgagaacatattcttttgtacaattagaatccgcgatttgtttaatggtagcattgagcaactggaaaaaaaaaaaaaaaa

SEQ ID NO: 2253 - DNA, 4438 bp, Zea mays
  misc_feature (4388)..(4389): n is a, c, g, or t
gagggcatgactgctatgcaagcaatccttctttgtaagcgtgcaagcaaactatctgatctattagattacgatccaaccccagatacaaccatggtttgttaggggttttttataaagattattgagctggtggtggaagggtttaagtgttaaatgtgacctacggttggatcgtaatctaatggatcagatggtttgcttgcacgcttgcaaagaaggactgcttgcatagcagtcattgccgacaatgagtttagccagttagagaagatacagctttagtggttgatctttacttttccataccttgtgtgcacaaatctaaaatgccaaataaagtagactggagatcctttttgaaaaaaagaaaagaaaagtacagtaactatttagtttgtcgatattgggatggcacacacaaccacataaagtattacccacttttacataatattttctacaatttgaactgctggtgtttaccttataccttcagcattttttttaccataactaccttttgctgtagctcccatttatagaagttagtaaatattagactacacatgctctgttgttttcagcttagccatctattagttatggtttatctagttatgatgctaggattctaatcatgaactactttggcctacttattacttattatttcgaaggatgcatttgtgatagatagttttgacttttgaggaagcgtcaattccatatctaaattgctttcatgtaagaaaaagcaaagttggtgtctaaaaaaagattacagaagaacacgaagtataaattagatactaatgaagtggtagagctagaaactttttttgttgttgcaatttctgcctacattgctgcgccttgttactcccttttaactcgtgttattgctgcaccctgtttgggcagaatgagtttttgtttgctcttttctgtatcctggtagcaagaaacgatgttgatagtaaatcatttttgactttcatatggtatatgcctatatggttttgaaccacatggaaaattttatttgcgtggattgagcaagtttgaattatttatcatttgggttttctagttaattggcgtctgcattttttggggggcatcaaatgctggttacactacaaattagcccttgaaccatgtaaaatttctacatcaaggtttcctcattttaatagattttttgcatgtatcaagtctgtacctctagactgcggttttgcgtttttttgggtgggaaatgtgacttctcccttcccaagatgaagttatattctgagaaattcttcacaatgcaggatcacctcgcgctgatgatggagctgctaggaatgatgcctcgaaaggtaagcagggtttcaatttacttggcatagttctttagcaaaggttgatagtgttcttaattttggtatacccccccggccgcccagatcgcgttgggtggtcggtactcacgtgatttcttcaatcggtacggggatttgcggcacatccgacgcttgcggttctggcctctcaacaaggtgctgatggagaagtacgagttcactgaaataaatgctcatgggatggcggattttcttgttccaatacttgattttgttcctgagaagcgccctacagctgctcagttgcttcagcatccatggcttgatgttggtcccctccgacagcaacctaaaacactgcctgactcagcacagaattcagatgacggtgtttcagagaagcagaagaaagagagtgaagaaagagaggcaatggctctagagttggggaacattgccatagatggtgctggtggcaaatgaccctcaagcaaaaaagcgcaactaaaacaactgctacctcttttaagtgaggtgcatttggtttcacgagttaagctgtaaaagttgttttcagtcgagaattgtcgcacgagtgggtaacagatgtttttttaggtttaaaatatgttaggatagctgccgagggaaaagtagagtaggccaattatttgctttatggggttggatggacaagactagattcgtttgggttgcagtaaccctagttttttttcctttgagaacatattcttttgtacaattagaatctggaaaaaaattaaggttagcagtgaacaactgggaacccgaaatgtgttgcgttaaggcctgcctaaaattttctgctggaatcatctggaaacatgatgtgccaccttttatcactgtaaagtttttactgtacattttttgcctggtatatgaattccagcatagatttaaacatgtcctgtttatgcacacggcaacgcaggtgtactttatgtttggtttatcacgttacctacatgtgctgatacaagggaagaagggcagtgagccagtggcgttgacgacactgcagacgaggcaaccatagttgattagttgcaatcagttgaaagagttgagttgtggcatttgggtcgggcacttgggtgatgggtccgaggcccgagctgcacccggtgcatggcgtgggtttgggtcgcggttcctgaatccgcaatccagtggtcgccccgcgcgcagcacaccacccaaaagggaagtcaagtcaaccaaaggccgcacggggtacagccctacccctcccgtcacaaatcccagcggcgccaagcccaagtcagcgcgcgcggcgatggagcggcgggggcaacagcctggcgacgcgcagcagccaggcaaggacggcgccggcgactcccctcctccaccgccaccggtacgactcgctctgcagaaatcccaacgaaccttgtgcatcttcacgccgcggaaaattcagaaccgcaaatctccgaccgagcagctgaaaagcgtcgagctgacgcgcttgttgcctgctcgccgcatggcagttcctggaggtgagctgcaggagctccggcaaggttcggcggttcgcggcggggacgacggcccgctacgcgctgcacgccatcaaccgcaagctcggccccggggccccgccggcgctgcacgtcgaggccgtcagggacggcgaggagcccgtcagcttcggccccagcgcggccctcgccgactacggccgccgcgcgtgcctgcagaccgtcaccgcgcacgacgcgcccgggatccatcacgcgccgcacgcggacacggcggtatgccacgacttctgatctcacctgcctgcattagtcttgattcttgaatgtaaaaagttggatttacttgcaaaaggaaaaagaataaaagttcgttttttcttcaaggatcaagagctaggcattaattttgtgcggactgtttttttttttgttagtaaaaactaattcttctctcggtcgtttttttagacgcctctgacacgcgaattagtcgccgtcagatgttttgtttcggttgacggtgtcagcacaatgcctcccgtgacggcttacctgatcgccctgtcgaagcgtcagaggaacgtatttttaggagcaattgcatgcctctaagttacaacatttatataccgtaaattaatagcacttagaggtacacattttttttccagattacatctttctaagcatttagggggcgtaggttaggattttgcccactgtatattatattacattgtatggtcttcaaatttccacatttctactccctcagtttggaaattgtgtctactaggtaatcttttttttttttttgagggatcattttgcgtggatcgttaattgcagaaacagggcgacaggcagccgtccaaagaagatgccgatggtacggagacagtcaggggcacttgcatctacgtcgccaagatcgtgctcgcgtttgcgtttctcttcctgctaggtggatcgctcacgtacctgctggaggtgatccctgacatgctgcagactgcatcggcgcttgagttacctgattttttctacgacccgctgactgaaaatgtatgacgcatgttatcatttcattagcattatttatatggcattgtgtgcggctttgtaacttggtcaattttaattcgtgtcgctgcagctcatgataattcatcgtctttgttattaggtctactttctaggcattgtgcaaggtttgcttgagtgcttggtaggacttttttttttttgacgtagacaaacgcacactcacctatataaacatacacatcacacatatgctgatatgcacacattacctctgtaagcacatctgaaagaataatgacgcctttggtttgagggactaaaattagtccatctattttagtctcatttagtctctaaattttcaatagtaggactaaaatagactaaattgtttgtctctagtatctcaatggatgactaaaatggactaaannatattaatttcacttcttatacttactttattttagttacactaatgca

SEQ ID NO: 2254 - DNA, 1823 bp, Zea mays
gcacgagggagaccgagagagcagaggcgctcagcacggagcgaggcgccgcgccgtttccttttctgctccactgcaaccggagtccggagcatagcaacctcgctgggctcccatatagcgggcccgcggagccgggatatactccagggaagtcgagcaaggagagcgtggattgtggactacaggggtaaagatcgagtgagcatcgcttcaccatgcgcccttctctctgctgcgcacctctttttcttctgctactattacatttggcatttgctagacctctctttcctctaccgagtaagacaaagaatgaagagaagaagcccatacagacgtttcggccatataacattgctcatcgtggatcaaatggggaaattcccgaggaaacagctgctgcatacatgagagctattgaagaaggggcggattttatagagtctgacatccttgctagcaaagatggggccttgatttgttttcatgatgtaacacttgatgatacaactgatgttgccaagcgtaaggaatttgccaatcgaagaagaacctatgaagtggagtggtttaatgttactggatggtttgtagtggacttcacactggaggaacttaaaacacttagagtgaagcagagatactcgtttagagatcaacaatacaatggtatgttttcaatcatcacgtttgaagaattcatttcaattgccctagatgcagacagaactgtcggcatatatcccgagattaaagatccagtttttatcaacaagcatgtcaagtgggctgatgggaagaagtttgaggacaaatttgtggataccttgcttaaatatggatacaaaggtcaatatatgtcagagaattggctgaagcagccattgtttatacaatcctttgctcccacctccattgtacatgtatcagattttattgactctcccaaggtatttttgattgatgatatcagtgtgagaacacaagacacgaaccagtcatactgggaaattacttcagatgactaccttgcatacattagtaaatatgtcgttggccttggtccatggaaggacactattgttccagcttcaggaaactacttgatgccacctagtgatcttgtcgcacgggcacatgctcataatctccaggtacatccatacacgtacaggaacgagaaccagttcctgcacttcaacttttttcaagatccctacaatgaatacgacttctggataaacactgtgggggttgatggactgtttacagatttcaccggaacccttcacaggtaccaagaattgacatccccacaccggaaggatgagactgcaaatagcctcctagtaaaaattagccaaatgatctcagcatatgaaggtctctgatcagcacgacgttgctgaaaattgtttgtgcttttgttaatcgatctgcaagagcacacgatccattcatcacggacggtgcaacgtgacactgtgactttgcaaggttaaataaacgagttgtttctggttgggacttgttagcacgagccgtactctccattaaagctcttaaaccctgtgagaaatttctagtgtgggaataattgttttcacgatagaaaccgtatcatggtttagcgtgccaggatggacgagttggtctcgggtctttgcacagttggcctacaattgtacttgccggagtgttgaaatttctagtgtgggaataattgttttcacgatagataaacgctcttgtcactcttatcctcttttatgctgcttaagtaaccccctgtttgttggtcccaaaaaaaaaaaaaaaaa

SEQ ID NO: 2255 - DNA, 1756 bp, Zea mays
gcacgagaccattacccgagagagcagaggcgctcaaagttgcaaccggagtccggagcatagcaacctcgctgggctcgggcccgcggcgccgggatatactccagggaagtcgagcaaggagagtgtggactgtggacgacaggggtaaagatcgagtgagcatcgctgcaccatgcgcccttctctctgctgtgcacctctttttcttctgctactattacatttggcatttgctagacctctctttcctctaccgagtaagacaaagaatgaagagaagaagcccatacagacgtttcggccatataacattgctcatcgtggatcaaatggggaaattcccgaggaaacagctgctgcatacatgagagctattgaagaaggggccgattttatagagtctgacatccttgctagcaaagatggggccttgatttgttttcatgatgtaacacttgatgatacaactgatgttgccaagcgtaaggaatttgccaatcgaagaagaacctatgaagtggagtggtttaatgttactggatggtttgtagtggacttcacactggaggaacttaaaacacttagagtgaagcagagatactcgtttagagatcaacaatacaatggtatgttttcaatcatcacgtttgaagaattcatttcaattgccctagatgcagacagaactgtcggcatatatcccgagattaaagatccagtttttatcaacaagcatgtcaagtgggctgatgggaagaagtttgaggacaaatttgtggataccttgcttaaatatggatacaaaggtcaatatatgtcagagaattggctgaagcagccattgtttatacaatcctttgctcccacctccattgtacatgtatcagattttattgactctcccaaggtatttttgattgatgatatcagtgtgagaacacaagacacgaaccagtcatactgggaaattacttcagatgaataccttgcatacattagtaaatatgtcgttggccttggtccatggaaggacactattgttccagcttcaggaaactacttgatgccacctagtgatcttgtcgcacgggcacatgctcataatctccaggtacatccatacacgtacaggaacgagaaccagttcctgcacttcaacttttttcaagatccctacaatgaatacgacttctggataaacactgtgggggttgatggactgtttacagatttcaccggaacccttcacaggtaccaagaattgacatccccacaccggaaggatgagactgcaaatagcctcctagtaaaaattagccaaatgatctcagcatatgaaggtctctgatcagcacgacgttgctgaaaattgtttgtgcttttgttaatcgatctgcaagagcacacgatccattcatcacggacggactgcgactttgcaaggtgaaataaacgagttgtttctggttgggacttgttagcacgagccgtactctccattaaagctcttaaaccctgtgagaaatttctagtgtgggaatacttgttttcgggaaggtactgtaatgactagttcacgatagaaaccgtatcatggtttagcgtgccaggatggacgagttggtctcgggtctttgcacagttggcctacaattgtacttgccggagtgttgaaatttctagtgtgggaataatcgttttcacgaaaaaaaaaaaaaaaagtcactcttatcctcttttatgctgcttaagt

SEQ ID NO: 2256 - DNA, 1440 bp, Zea mays
cctgcttctgccgcccggcacagtctacacccaccaccaccagacccctgtcgcactcgtgtgccggccggcgacggcgatgatggcgactggcccatcgctcgccggggtatactccgccagagccacccgcctcgtgcctctacgcgccggcgcacgggcgccctgcgccggtgccgccgcggccgagcctgcggccgagcacgtgcggaggctcgtggcggagttcgacccggcggtcccgctggactccgcggtcacgccgccgagcgggtggtacaccgacccggattttctccagctcgagatcgacagcgtcttcttccgcgggtggcaggctgtcggtcacatatggcaagtgaagaacccaaatgatttcttcacaggaaggctgggaaatgtggaatttgtcgtatgtcgggatgcaaatgggaaacttcatgctttccacaatgtgtgccgacatcatgcttcactccttgcatgtggaagtggtcataagatttgcttccagtgcccttaccatggatggacatatggattggatggcacccttctgaaggctacaagaatatcaggaattaaaaacttcaataagaatgattttggtctcataccaatcaaggtggctacttggggaccttttgtgttgatcagatttgatgatgagtccactggagataatgtttatgacacagttggaaatgaatggttgggtagtgcttcagatctgttgggtacaaatggcattgacacttcactgccgcatatttgcaggcgagaatatattatcaactgtaactggaaggtcttctgtgacaattacctagatggtggatatcatgttccatatgcacatggggctcttgcatcgggtctgcagcttcaatcctatgaaacacttacatatgaaagagttagtgttcaaagatgtgaaagtgcaccagcagaaccagatgacttcgatcgcttagggacaaaagctctatatgcctttgtttatccaaactttatgatcaacagatatggtccatggatggacactaatctagctgtcccattagattcaaccagatgcaaggtggtatttgattattttcttgacaagtctctgctggatgaccagtgctttatcaagaaaagcctcgaagacagtgagcaagtacagatagaagacattgcactgtgtgagggggttcagcgtggcctggaatcgccggcctacagtgttggaagatacgctccgtctgtggagatggccatgcaccacttccaccgcctcatgcatgctaaccttagtgagtactgagtaattattctcatggacgcatcttgcaaagttgtacagaaccaaacgctttttttttggcaggacactgcatgaacactgttctctattgcaatcttgtgaattcagccacatttcagttacacaaaaaa

SEQ ID NO: 2257 - DNA, 1300 bp, Zea mays
aaaacaccgattcgtttccccttggcacctggcgccctgtcgccttcgaaaaacagccgccgccgtcgcccgtcccggatccgacggcccccgctccttcgtctagtatttatactagtgccttgccggcgctgcccctgttgcctctcgcatttgcccacgcccgcagcgcctcgcctcggctgctctacctctatcccgcgacccgcgagatcggaatcgcggcgccccgccgccctcctccaaaatggcaccgtctctgctcggggggttcaccaagtcgttggccatgacggtgctctccgagatcggggacaagaccttcttcgccgccgcgattctggctatgcgccatcccaggaaactcgtattggcaggctgtttaactgcactaatagtcatgacagctctatcggcttctctaggttgggttgcaccaaatctgatttcacgtaaatggactcatcatttgaccactctattgttctttctatttggcatttggtcattgtgggaaggcttcaaggaagatggagattcggaagaattggctgaagttgaagcagagctggatgctgcctttaagagtaataaaggtgaatctaaaaataaatttaaggcgaatgatgatatgaagaaacagcaaagaccatttctcatgcagttcttctcaccaatttttctgaaggcattttctattacattctttggtgagtggggtgacaagagccagattgctacaattggcttggctgctgatgaaaacccgttcggtgttgtcctgggtggaatcatagcgcaagcactctgcactactgctgccgttcttggtggaaagagcctagcgtcccagatatctgagaagatggttgaactgtcaagcggagtgctcttcctgctcttcggtatcatgtccttactctctggaccagaaggagaattgtaatccctgcttgagcctttttcagctagctgattaacatggctttctcttcttagacctatcttatttcagtacatgaatgatggcaacgaaagccatccatccatggcgaacaggatggtgatttaacagtttagccgacacgctgtaaacatttcagtcgcccttcaaaaattactacatgttacagaagtctgtagcgattgtatatttgtattctgtcgtgcccagcacgtgaaattttgttatcgcaattacatgcgttaacaaagctttgttcgtgaaccaagtattcaggcaattaatatggggcttatagcaggcctttgtctttaaaaaaaaaaaaaaaaagcggcc

SEQ ID NO: 2258 - DNA, 1341 bp, Zea mays
cactccatagggcaattgggtacctcgaggccggccgggcccgtcccggatccgacggccccgcgcgcgcgttctcacccgaccctgctcttcgcctcggctgctctaccagtctacctctaccccgcgccccctccgagatcggaatcgcggcgccccgccgccctcctccgccatggcgccgtctctgctcgggggcttcaccaagtcgctggccatgacggtgctctccgaggtcggggacaagaccttcttcgccgccgcgatattggctatgcgccatcccaggaaactggtcctggcaggctgtttgactgcactaatagtgatgacagctctatcagcttctctaggttgggttgcaccaaatctgatttcacgtaaatggactcatcatgtgaccactctattgttctttgtatttggtatttggtcattgtgggaaggcttcaaggaagatggagattcagaagaattggctgaagttgaagcagagctggatgatgtctttaagagtaataaaggcgaatctaaaaataaaactaaggcaaacgatgatacgaagaaacagcaaagaccatttctcatgcaattcttctcaccaattttcataaaggcattttctattacattctttggtgagtggggtgacaagagccagattgctactattggcttggctgctgatgaaaacccatttggtgttgtcctgggtggaatcatagcgcaagcactctgcactactgctgctgttcttggtggaaagagcctagcctcccagatatccgagaagatggtcgaactgtcaagcggagtgctcttcctgctgttcggtatcatgtcattgctctctggaccaggagaattgtaatccctgcttgaacccttttcagctggctgattgacatctctctctccttagacctatcttatttcagtagatgaatgatggcgacaaaagccatccatccatatggcgaaccggatggtgattcgatagtttagccgacacatcggaaacatttcactcgtccttcataaataactacatgttacagaagtctagcgatttcattctgttgtgctcagcatgtgaaagtcagtctactccctccgtttttttatatttgtcgcgttttagttaaaaataaactagaagacgacaaatattcgagaacggaggtagtagaagctgtctacagtatcatgaatatgatgtaagattcttgttactaaatttttgttgtcgcaattacatgcgttaacaaagcttagtttgtgaatcaactacgcaggcaaataatacggggctttgtctaaaaaaaaaaaaaaaaaaaaaaa

SEQ ID NO: 2259 - DNA, 1258 bp, Zea mays
  misc_feature (1247)..(1247): n is a, c, g, or t
tcgaggccggccgggacgtctggctgcgcgtcattctcttcctcttccggtgctcgtgctcgtgctcgtgctctccgccctccccctccgccacctcgcgcggaacggaacccaggccgccgccgacccagccaccgctaggcgaccgcgcggcatggtggcgcttttacactacctatgctagtttgcctgatgctacatttccacgatggttaagctgactatgatagcgcgtgtcactgatggccttccattgtcggagggattagatgatagtcgggatctgaaagatgctgacttctacaagcagcaagcaaaactgttgttcaagaacttgtccagagggcagcatgaggcgtcaaggatgtcaattgagacaggaccataccttttccactacatcatagaaggccgtgtttgctatttgactttgtgtgaccgttcttatcccaagaaacttgcattccagtatctcgaagatctcaaaaatgaatttgagaaagtcaatggcagccaaattgaaacagctgcaaggccatatgcatttattaaatttgatgcattcatacagaagaccaagaaactgtatttggataccagaacacagaggaaccttgctaagctgaatgatgagctctatgaggtgcaccagatcatgactcgcaatgttcaagaagttctcggtgttggtgaaaaactagaccaggtgagtgagatgtcaagtaggttgacttcggatactagaatctatgcagagaaggcgaaagatctcaatcgccaggcattgattcgtaaatatgcccccgttgctattgtgattgggatagtggtgatgctcttctgggtgaagaacaagatatggtgactggtgccatcttgcgatttcacagttatcatgctggaaccagctgagttgtcttgtcttccctcgtgcaaccatatgtttgatcgtggtcccaaaaagaaaagaaagatggctcgatggtttatcccgcatctgccgattcaagcgactactttagctatcaaaagcaaaaccacggtagtagagatagccttggaactgcacatttctattaactggacatgtataaatagttctcgtgagcgcacaccatgtaatcgtcgaaattcatccatgtgttgtgacattttttgagcacagttgaacatgtggtggagcctggaggcaggtcattctcacccccttgaaaaacccacgcgtccgcccacgcgtccgctagttnctagatcgcga

SEQ ID NO: 2260 - DNA, 1318 bp, Zea mays
ccggccggggtagcgtatccctctgccctcccggccccctcaagcgctaatacggctggctgcgcgtcattctcttcctcttccggtgctcgtgctcgtgctcgtgctctccgccctccccctccgccacttcgcgcggaacggaacccaggccgccgccgacccagccaccgctaggcgtctaggcgaccgcgcggcatggtggcgcttttacactacctatgctagtttgcctgatgctacatttccacgatggttaagctgactatgatagcgcgtgtcactgatggccttccattgtcggagggattagatgatagtcgggatctcaaagatgctgacttctacaagcagcaagcaaaactgttgttcaagaacttgtccagagggcagcatgaggcgtcaaggatgtcaattgagacaggaccgtaccttttccactacatcattgaaggccgtgtttgctatttgactttgtgtgaccgttcttatcccaagaaacttgcattccagtatctcgaagatctcaaaaatgaatttgagaaagtcaatggcagccaaattgaaactgctgcaaggccatatgcatttattaaatttgatgcattcatacagaagaccaagaaactgtatttggataccagaacacagaggaaccttgctaagctgaacgatgagctctatgaggtgcaccagatcatgactcgcaatgttcaagaagttctcggtgttggtgaaaaactagaccaggtgagtgagatgtcaagtaggttgacttcggatactagaatctatgcagagaaggcgaaagatctcaatcgccaggcattgattcgtaaatatgcccccgttgctattgtgattgggatagtagtgatgctcttctgggtgaagaacaagatatggtgactggtgccatcttgcgttcacagtatcatgctggaaccagctgagttgtcttgtcttccctcctgcaaccaaatgtttgatcgtggttccaaaaagaaaaagaaaagaaaagatggctcgatggtttatcccgcatctgccgattcaagtcgactactttagctatcaaaagcaaagccgcggtagtagagatagccttggaactgcacatttctattaactggacatgtataaatagttctcgtgagcgcacaccatgtaatcgtcgaaattcatccatgtgttgtgacaaattgaaaatatatgaaaagaaattatatgataatttattaaatactatcttgtatacaaatcaaatgaaatcataattccatttctaatttaaaattggacatttctcattatatta

SEQ ID NO: 2261 - DNA, 548 bp, Zea mays
  misc_feature (17)..(17): n is a, c, g, or t
gagagagagagagaganagagctcacctacctccccccccgggctggtggcgcgcttgcgttcctctcttcacaggcccctcggtgcgcagtggtggatttgtccttctgatttgcagctctgacgacagtgggaccactgactgagaaggcagcaattcgttgggagcagatatggatcactttgatgagcatgacagtgatgacatgaaagtaggggcagcttctgatggcccctccagactcagaaaaaagaggtccaaggtttgggacgaatacgagcacatcattgtagatggagcaattcagagcgcggaatgccgctactgccatatgcacatgagttgcagaggtgctgatggtcagtccaatgggacaagccatttgtggcgacaccagaaaatttgccgagcaaaagatgagttttgtccaagccaactgcaacaggatgcagacttttcatctgattcacttgatgagataaagttggtgactcatagtgagaatagcaaattcaggtcaaaggtctggaaggattttataccattc

SEQ ID NO: 2262 - DNA, 3470 bp, Zea mays
agcagaactgtgccttgctaacaaatttactgcaaaagcaatatccggccgggtattattagcaagatacattaatgcaccaatagcactgagatatgggaactctggtcccaatacatgttcttcatcatcccgtggtctgaatggaactttctttaaatccaaagatctgaccaccataggagtctttgaaggataagacatgtgcatattgaatttttccaataccttttgggtatatgtactttgatgtacaaggattccagaaggtaaatgctcaagttgtagacctaagcaaaatttggttttacccaaatccttcatctcaaattccgtcgttaaatgatgacgtgcttcatcaatatcaagtttatttcctatgatgttaaggtcatcaacataaactgatatgatacagaatcccactttggatcttttgatgaagacgcacgggcaatcatcatttttcgtgtatcccttacgtaaaaggaattcactcaatcggttgtaccacattcggcccgattgttttaagccatataatgacttctgcaactttacgcaatacatgttgcgctttgcctttggattcggtacatctattccatcaggaactttcatgtatatatcagaatccagtgacccatagagatatgcggtcactacgtccatcaactgcaaagatagacgattttgcactgccaatgatattaaatgtcggaatgttattgcactcatgactggtgaataagtttcgttgaaatcaacgccgggtctttgcgtttacccttgtgctactagccttgctttgtatctcactacctcaccattttcatttcgtttccgaatgaaaacccacttatatcccacaggggaagatatcacgtggggtaggtattacagcagagaaaacttctcttttgtaaagcgaggctaactccgcttcgattgctgccttccatttgatccaatccgagcgcttactgcactctgccatggtctttggatctagatcattttgaaggtcctcagcaatctgctcggagaaatatatgtcgacattggtagcttttctatcatatgtttcaccagtctcaacatagttgatggcaatttcatcattccttagagactcatcagaatttcccaaattgatgtgtccaggattttccgatgtcccagcctcggttatgtgcacatccgagctgggttgtggatcatcacaatccacatgatacattgtatcatattggtgtccttttgcattcactattgttctttgcttcttagcaacagaacagcgcttattcaccatacttctcctctctaggagttgagtggccttattcggtacttccactctttctggtgcattcctagcaggaatgaatgatttagtgacacctttgtaattagtgaatgcatctggcagttcatttgcaagtctttgcaaatgtataattttctgaacttgcagttcagtttctgaagtacgtggatcagaacctggaacactttgagtattccaatttatttcctggcattctttttggtacttaaattctccccctaatgccgggaaatgttcctcatcaaaaatagagtcagcaaaacgggctgtaaatagatcccctgtcaagggttctaaatacttaatgatcgacggagattgaaatcccacatagatccccactttcctgtgtgggcccatagctgttctctgaggtggtgagattggaatgtatacacaacatccaaatttacgcaaatgggaaatacttggaggatttccacgtaccatttgtattggggatgttgaatggtatgcagttggtcgtaattgtataaggtcagcagcgtgcagaactgcatgaccccaacacgacgaaggcaatttgcaattcatcaataatggccttgctatgagtttaatcctcttgattagtgactcagccaaaccattctgggtgtggacatacggtaccgagtgctgtacttgaatccccagcgccatacaataatcattgaatgcctgagatttgaattcagcagcattgtccattcggattgaactaatccgatgttcaggaaaatttgcctttaacttgataatttgagacattatcttggcaaatgcatggttgcgtgttgatagtaaacacacatgtgaccatctagtagatgcgtcgattaaaaccataaaatatctgaacggtccagaagatggctcaattgggccacaaatatcgccttgaattctttcaagaaatctaagtggttccgctcggattttaagaggtgaaggtcttaaaatcattttccctgtagcacatgcagtgcatatataatctgaagatttgggaaattttgcttcagtcaaatcatgaccaatagaattggtgataatttttctcatcatcccgatacctaggtgccctagtcgatcatgccaaatttgaaatgcatcgacattctgaaaaattaccttgtatgcaacatgttcaatgggcttgatgtatgtataatataatccggattctagagttggaattttttcacatatctgtttgccatattcagtaggtttggtaagaagtagatattcttctttattttcttcatatgtttccacatggatcccattcttacgaatatctctataacttaataaggtacgagttgaatcgggatataataaagcattctcgatcacaatttgagtacccattggaagagtgataatggctctaccagaaccaactatcaatgcatctcttcctgcaattgttaaaacatttccttcccttttctttaaagtctggaaatattttatctcagttaatatagagtttgtggtacagctatccacaaggcataattcctcctccaatgaaccatttccggtagacatctatattaataacaagaattaggtgattaattctttattttattaaatatttatttatacatacatatggtatctgatgtcaatattacaataataatattatggtatatatgagtttttgtactatcaatagtacaactcttattgtaataactatcttcaaatcctaagcaaactctatataatatgacttttaactatgaattatattacaacacttaaatgatttgggtatcaaattctagaagtagatatctaaactagatctccacatatgtcgcccgagttgtattcaatcatcatgttgtccatctgctgagcggatgccttgttgttggaacaaccaatctccttatctttctcagtagcttgattgaagtgggcttcatatcttcatcttttgttgccatctcggattgactttaaataaaggtcgaccaaatgcctgggagtacaagtggctgtgaaatgtgtgttgcaaccacatttgtgacagagacgtggtttatcattcacaattttttcatttccacgagccctcatgttttctttgtgccta

SEQ ID NO: 2263 - DNA, 2065 bp, Zea mays
gtacccctcatatacccccgtcccatcgtatacgaatcacagacaaagcacgagcggtggtagctggccagccaccatggctccaccacctctgttcccgctcccgcctctcctcatcctcctcgtcatcgtgcctctgttccccaccgccgcgccgacggccacgacgctgccgctgtaccgccacctaccgcacgtagccgaggccgtggcatcgcaccaccacccgctgtcccgcctggccgccgcgtcgctggcccgcgcgttgcacctcaagcgccgggaccccaaccaccacagccagaaaggatcaggcggccacccgtcagtaccagccaccgccgcgctgtacccgcactcctacggcggctacgccttcacggcgtcgctcggcacgccgccgcagccgctccccgtgctgctcgacaccggcagccacctcacgtgggtgccatgcacctcgagctacgagtgccgcaactgctcctccccatccgcctccgccgtcccggtcttccaccccaagaactcctcctcctcccgcctcgtgggctgccgcaacccctcctgccagtgggtccactctgccgcgaacctcgccaccaagtgccgccgcgccccctgctcccccggcgccgccaactgccccgccgccgccagcaacgtctgcccgccctacgccgtggtctacggctccggctccacagccggtctgctcatcgccgacaccctgcgcgcgccgggccgcgccgtccccggcttcgtcctcggatgcagcctcgtgtccgtgcaccagccgccgtcgggcctcgcgggcttcggccgcggcgcgccgtccgtgcccgcgcagctcggcctcccgaagttctcctactgcctcctgtcccgccgcttcgacgacaacgccgccgtgagcggctcgctagtcctcggtggcaccggaggcggcgagggcatgcagtacgtgcccttggtgaagagcgcggcgggcgacaagctgccgtacggcgtgtactactacctggcgctgaggggcgtgacggtgggcgggaaggcggtgcggctcccggcgcgggcgttcgcgggcaacgcggcggggtccggcggcaccatcgtggactccggcaccacgttcacgtacctggacccgaccgtgttccagcccgtggcggacgcggtggtggctgcggtgggcgggcggtacaagcggtccaaggacgcggaggacgggctggggctgcacccctgcttcgcgctgccgcagggcgccaggtccatggcgctgccggagctgtcgttccacttcgagggcggggcggtgatgcagctcccggtcgagaactacttcgtggtcgcggggcgcggcgccgtggaggccatctgcctcgccgtcgtcaccgacttcggcggaggctccggggctgggaacgagggcagcggcccggccatcatcctcggcagcttccagcagcagaactacctggtggagtacgacctggagaaggagaggctggggttccgccggcagtcatgcacgtcgtcgccgtcgtgaggtctcacgacgtcggcatggcggggatcggagtggaggccagtaattactccagagtccagtccacgtaacactccaaattccaattccaaaagctggctgcttgatcttttgttagtgctcgtgtactgctaataaaaaactaaatttactgtcatctactactactattaagttattgaaagacgtggcttgctttgggtttcattggtagttttacttttaacccctttaatttggtagtggactatcatgggcttgtgtggaatgtttgtgggcctatctctcttgtcgcatgccttgattgcgtgtggttgtggtgggtacctaatttactgacatgtcagtggcaattgtaggagggagggcatgtgccattgctcggcatacgtacgtactccatagcaagagggagctggtacgcgaacgggcctaaataaaagcatgggccctttgaagtcgtgtcagaaaaacaaacttgtcttgtggccaccagggcgcacgagcgttatt

SEQ ID NO: 2264 - DNA, 2456 bp, Zea mays
gttaaattggagcatggcccttttttaaataggtcgctcgtccactttagctagcaagttggtattatatacgtgggtttggatggtttctcatgtctcatttgttaggcagggaggaaaaacaaatccacgtgacccatgatgcacaaaactagtgctttaatattatgtgagaatttttagctcttccatattctttattagtcattgattgacatattaggtaggagtaaagacaaagaacataagccaaaaccgtttttttaatagttcatttgtcagtgtctgcgtgcaacgacgtcacaagagcgcagctagccctacacaagcgtccactggcgcatcaagcctttacgcgcggcgaagcgcaccaacctacatggatttttttttttattttggtgggtacctacctagtactttcacgtgttcttggtaggatacgtggacaatgtgagaccacgtcgcattcagaaaaactcccggcgtccggacgctctattatacattcattataaaaagcattgggtggcccccgggcgccggcgaaaagtaattcataaactcacaatggcggcaacggcataccccactgtggtgctcatcccactatgcgtcccaggccacctcgcgtccatgatcgaagccggcaagcggctgctcggcagaagccgctgccccatgtccctcaccgtgctcatcacgcagatgaccatgtccgccaacctgatgtccgacgtcgacgacatcatgcggcgggaagccgactccggcctggacatccgcttcgtccacctccccgccgtggagctccccaccgtccaccacggcctcgaggacttcatgatgcgcttcatacagctccacgcgacgcacgtcaaggaggccgtctccggcatgtcgtccccggtcgccgcggtcgtggtggactacttctgcaccaccctattcgacgtcgcgcgcgagctcgcgctgccggcgtacgcctacatgccgtccggcgcgtcgatggtcgcgctcatgctgcggttaccggcgctggacggggaggtgtccggggacttcgaggcgatggaaggaacggtcgacctgcccgggatgccgccggtgccggctcgtctcatgccgtctccgctgatgaggaaggacccgaacttcgcgtggctggtgtaccacggcaaacgcttcatggaggccgacggggtcatcgtgaacacggtggccgagctggagccgtccatcctcgcggccatcgccgacggcctctgcgtgccaagacgccgcgctccggccgtctacccgatcggcccggtcctgcctctcaagccgccgtccgcgcccggcgacggcgagcaggtagtagcacagcggcacgagtgcgtgaggtggctcgacgcgcagcccccagcgtccgtcgtgctgctctgctttgggagcatgggcggcagcttcccgtcgccccaggtccgcgagatcgccgacggcctcgagcgcagcgggcaccgcttcctgtgggtgctccgtggcccgccaccgccggacggttccaagtacccgacggacgccaacgtccacgagctgctcccggaagggttcctggagaggacgaagggccgaggcctcgtgtggcccacgtgggcgccgcagaaggacatcctcgccaaccccgccgtcggcggcttcgtcacccactgcggctggaactccatcctcgagagcctgtggcacggcgtgccgatggtgccctggccgcagttcgcggagcagcacctgaacgcgttcgagctcgtgtccgtcatgggcgtcgccgttgccatgcaggtggacaggaagcgcggcaacttcgtcgaggcggcggagctggagcgcgcggtccggtgcctgatgggcgggtcggaggaggaggggaggaaggcgcgggagaaggcgacggaggcgaaggccctgagccagaacggcgtggccagcggcgggtcgtcggacgcgtcggtgcagaaactggcgcgagagattttgcacaagcacgacgacaaggggtgtgccaccgcaagcggggagagcatgggcagcgtcgtcgttcccgcatctccggccggaataatatgatcccccgaacacggagaaatcgccgtcgtccacgaataaatcggaggccgccatgcgatccgtctggcactgctcacgttgtttgacattgttcagaatcgccgtgtgcactgtagtttcttatccgcagtagcttttactattcgaaataatgtagcatagcaagcgctgcttcttcctaagtccgtgcagcgtagcccgcgtgttcgagctagtttgtgttaagttgaatgagttaatggatgctagttgtagtcaaaaaaaaaaaaaaaatttgttagctgctgatgcaaacttatttgttagctgctgatgcaaacttttagtaagatgactttgttaggttctcc

SEQ ID NO: 2265 - DNA, 3634 bp, Zea mays
  misc_feature (566)..(566): n is a, c, g, or t
  misc_feature (1997)..(1997): n is a, c, g, or t
  misc_feature (2034)..(2034): n is a, c, g, or t
  misc_feature (3396)..(3396): n is a, c, g, or t
gaaatacattttcctttttttaaaaaaaaatggcgacaaaaaggactcaaggacactttagggaatcaataaattcaaccaacctattacctaaggttccaaagccctcgcaatggctccaaacgagcccttagagtgtgtgtgcttgtgtcaggtagggatttaggcaatcgttatccataggaatgctaatggtcatttgcggtaaaagctcattagcaagaggctatatatacaaagaggctaacgtgcttgaacggatcatctaagccgatgcctccttgtgtctcactgtctctctagggttgcagcgtccaagacgtcgttgacgtttctctcactccatgctatgcacatcggtatcacgatgttttattcatacacgtgtggataccctgttgttgtggtgttaatcatcaacgaactcgacgagtatggatgaacatgttgttgttgctggtgataccctgagtatgtacaactactacttccactacatcgacaaattcttccatgcattggacgtttaatgattatggtatattatcatctactcacatgatatnttacttagggggtgtttggtttctagggactaatgtttagtccctccattttattccattttagtccctaaattactaaatatagaaactaaaactctattttagtttccctatttaacaatttataaactaaaatgaaataaagtgaagggactaaagtttagtccctataaaccaaacacccccttaaacatattagctatgctaacgtgtagcgtccatgaccaaacgcccccaagtgggctcatcaatgatgacacatttttcacttgtccagtctagaccaaacaaaaggcctagcccaattagcaaaagaactcttaatgcagtaggttctttccggccatcattcctagcagccccaccatcatcacttgtctcctgattctcttgtcatcaccctgcagattcctgctcacctgctgcatcaccatattccatagatggcacgctgatatgcatcgctcggagaccatcagagtgctggagtttacgccatacacacaaaggttctgatgacgcctgatgaccgcatcactcggagaccatctttgcactacgagacacatgtgccctgacgacaacctaactggcatctgctccttatctaatcgagccacggcatcctgcatataacacaaagtcaccacgttttgtcagcgatcgaaagcccaagctgaatccgtggccatgtcggctggccacatggtgtgcggagtggcattggcactaggcaccgtccttctgggctcctcttgcattaccgtggtcaccgcctcgccggaaggtaattaagctgcgaatgccggtggtgagcgagggttgctgcaataggttttgtcgcccattcgattcacctcgcacggacacgggcagcggttcgtctccgaggacggcgtcgtgaacgcccgcgcgcgcgtgctcggcggcggcagctgcctcaacgccggcttctacacccgtgccagcggtggctacgtgcgcgccgccgggtgggaccaccgcctcgtcaacgcgtcctaccgctgggtggagcgcgcgctggtgttccgcccggccgtgccgcagtggcagcgcgcgctgcgcgagggcctcctccaggccttcatttgacagtcggtcgatcgaggtgattgcggggggcgacgtgcatgcagccttcatttgacagtcggcatgcatatcatactagatcaataggcgcgcgttgcgcgccctacaataatacgttgaaactacaaagaaatgaagaatagggggtttaaacttacatggcatgtatcaactataaaagaaccatttcgagctagattgttgctcaaaaaaaaaaaaaaaaaatgaaaaaaacaaccaaaattgcatcctttgcttcttcttacagtttacatctaacctcgttaaggtcttcatggagaccgtccaataaaaagncgagaagctcctgtgaatcatgctgattaaagccacngaactgaggagcataacacacaattttttccttgaaatgataaggtggaacgagtttcctgccagtgatccatcagctcaacagttctccaaacgccaaagcaggttcaccctagcttagtaaagtcagtaaacaactgtctgcacattagcccaatgcacaatagagggtaataggatatttttaaatatctattttggtggtaaaacctttgcaaatttctattgcctaaacccattggcagaatgcagtcagcagttgacattattggaggatggtatagcttcctctagaacatgtattatgatgtttgggcatcaacattttgagcttataaagattagtctgattaaaaattgaaacgacaagtaggtatacaaggttcctcttatggatttcaaaagcaaatgttagctagtttgcactggtattagtattcattattcagccttcaccttgtgattagctcctgctaaggaataacacaaaggctaacccaccttgcacaagctccaggtgcaaccagtctctaattggcatattaccacgttcaaggtaaagaaagatgcagtctaatgtatcagataagctataaagcctattttcttgttccccttatctgaaggtcaacttttcttgttcgtagctagtgctattcaatcaatttaaaaactatatcaaaggcattcatggtgtcaccaatatcttctacgctacaaaactatatgctgcacttgaaaagacaggtgacagccaatgagttgcgtatgtgctcctgaaaaggaagtgtatatcaacctataaaagaggtgtgagcactctgtatttgtacaggtcaccttccaagtcattttttgcttcagaaactacgaagttttcttgaaaagagacattaaagcactctcagaacatacgatacctgaaaactacgaagttttcttgaaaagagacatcaaagcactctcagaacacatgatacctgatagaaatacaactgacctgcatgtgctctataacatggaaacctcaaaaggaaaacagtacctgaaagttgtacgttgtgatatacaatggcacagattattatgcataataatctaggttgctgcataataatctaggttgctgcacaatggcactctaggttgtttttcgcacaagtagcagcggcagcacaagctagtgcatctgttgtacagatatttgtgggccaattgcgggtaaattcatgaagccatctttcaccatgaccctgtgctaaaaccataatgtttttataaccacaaactacacaggtttggggcaaggaatcactctagtgacccagagatagatgaagctttgaagaagggagaagatacngggctttcgttggttatcttcagtccttttgtatttgttagttatttttgcatgattatattaatacttactatatacaagacatttgaagaatcaaatgcctggaaacaggagctgcaagcctgcctgccaccataatgacttatagtagttctgtgcttgctgctgactatgaagctaaaaaccaaataaatagatttgaagttcttgtattcaactgtcagcaagtatttttgcg

SEQ ID NO: 2266 - DNA, 1975 bp, Zea mays
cgccgggacgagcatcgagacgatgatcgccgtgcccaacgacatgctcgcggccgtcgccgactacgaccgggcccggcggtgggttagggacaatgtcaccaagtacaccttcgacggcggcgtcaacatcaagtgcgtagccctaggccctagcgcgcgcgtatatatatatgcagtgcaccgccattggcatggaccagttcgtttctccgctggcgctgagacgttctcgatcgtacgtgtacgtacgtccaggttcgtggccgtcggcaacgagccgttcctcagggcgtacaacggctcgttcgaccacgtgacggtgccggcgctcaggaacatccagcgcgcgctggacgaggccgggcacggcgcggcggtcaaggcaacggtccccgtcaacgcggacgtgtacgattcgccggcgagcaacccggtgccgtcggcagggaggttccgcagcgacgtggcgcgggtcatggcggacatggtccgcgtcctcaaccgcagcggcgcgccgctcaccgtcaacatctacccgttcctcagcctgtacgggaacgacgacttcccgctggactacgccttcttcgatggcggcgccggtgcgccggtggtcgacggccgggccgtctacaccaacgtgttcgacgccaacttcgacacgctggtgtcggcgctcaagagggtcgggctcggccacctgccggtcatcatcggcgaggtcggctggccgacggacggcgacaggcacgccacggcggccctcgcggagcgcttctacgcggggctcctccagcggctcgcggccaggagaggcacgccgctccggcccggcgcgcgcatcgaggcctacctgttcgggctcgtggacgaggacgccaagagcgtggcgccgggcaacttcgagcgccactggggaatcttcaccttcgacgggcggcccaagttcccgctggacctgcgcggcgacgggcggccggcgatgcccgtcccggcccggggcgtggagtacctgccccggcggtggtgcgtcctgaaccccatcagcatggccggggacggacggctcccggacaacgtcgcgtacgcgtgctcccgcgccgactgcacggcgctaggctacgggtgcagctgcggcgcgctggacgcgcgcgggaacgcgtcgtacgccttcaacgcctattaccaggcacaggggcaggtggagtcggcgtgcgacttccaggggctcgccgtcgtcgtcgacgaggacgcctctcagggcgcctgcaacttcagcgtgcagctcgttgggtcaggggctccggtggccaccgcggtcaccacgatggcggccgtactggtccctctgtttcttgtgttgctttgagctcgcgcaaggtgtggtgcttgcctgcctgactggaatcctgatgactgtactgtacagtgttggtccactacagtgacgtactaagtactaccatgttttgatggttcatcatgtgcgatgagcgtgtctcttccctgtatcttcaacctctacgacggttcctcctaaattattctcttacttggtgagtgtccgtgcgttgcaacgggaacatataataccatgataacttatatacaaaatgtgtcttatattgttataagaaaatgtttcataatccatttttgatcctggccatacataattttttgttattttaatttagttgtttcactactacattgcaaccatcagtatcatgcagacttcgatatatgtcacgattgcatggtctcatcattggagagcacgtgtgtcacacccggttttagaaggtaaaccgaatgcgaaccatgtacgtgccagtatcagttattcacgtacacagcgattacataaatgactcatcatagcacaatgcttcgaattacaataaagagtaagtaataatattacagactagatccatttacataatataaatcaaagtacacagaatcg

SEQ ID NO: 2267 - DNA, 1508 bp, Zea mays
atccaccagcagctagcgtagcgagcgatggccaccgaactccggtcgccgctcctcccgccgccgccgcagcgacgactaagcccgcgggcagccgcgtgggcggcgctcgccgtctcggcgacggtcctgctcctccccttcctgatcggcagcagaagcaccaccaccagcaccagcagcacgagacacccccggccccgatcctccccaccatccaaccccgtggagctgaccctcctgaccgccgccagcgacaagggcgcggtgtgcctggacgggagccccccgggctaccacctgcaggcggggtccggcgccgggtccggcagctggctcatccatctcatggggggcggctggtgcgacaccgtccgcagctgctccgaccgcaggacgacctacctcggctcgtccctcttcatgcagaaagtcatggacttcactggcattctcagcaacgacccggcacagaatcctgatttctacagctggaacagagtgttcgttaggtactgcgacggggcatcgttttcgggggattcccagcgcgaggctgggcctgggaacggcacgctcttcttcagaggcctgcgcatctgggaggcagtcctcgacgagctcatgcacaagggcctcgcgcattccaaacaggccttgctcacaggttgttccgctggtggtctggccacgctgctgcactgcgacgattttcgcgcacggtttccccctgaggttcctgtgaaatgcctctccgatgccgggttctttgttgacgcgaaggatttgtcagggcagcgctccatgcgttctgtgtacagcggagttgttcatcttcagaacgttactaaagttttgcccaaggactgcctcctcgcaaacaaggacgatcccacgcagtgtttcttcccggcggagcttgttaagagcatcagcacgcccacgttgatcgtaaactctgcttacgactcttggcaggtacggtttgttgttgcgccagacagctcgtctcccgacgagtcatggcgcggctgcagagacgacgttcgcagatgcaattcctcccagatccaagtcctcaatgcatttaggaagacgatggtagatgacctcgtcgaggctgccgacggcaccaacagcagctggttcatcgactcttgcttcacacattgtcagactatcttcgacacctcaggatggaactcagcggccgcgccgaggatcgggaacaagacactgacggaggtgatcggggactggtactttggtaggagcccgagcccggtggtgaggcaggttggctgcgagtatccatgcaaccccacatgcaataggcagccaccagttgccggcttctacaacaaagctcttccgccgcgtgaacaagcgaacattcttgtattgggatgaaacatacaagtaaacggatgaaacatacaagtaaatgttgggtgtgtcctctacagctggtcatcagtgaccggattgggccaaaaaaaaaaaaaaaa

SEQ ID NO: 2268 - DNA, 1118 bp, Zea mays
gggtaccgcgagctcgcccgcggaagctcttgaggagatgctgcaatgaaacatggctcctctgtctcctagactggtagtgcccgtagacgtgaagaagctgccgcgggagcaaaaggtccctctccacaaccgctggcacccggatatccctcctgtcgctgatgtaaccgaaggggaattgttccgcgttgagatggtcgattggagtggagggcgggttagggatgataactctgcagatgatctgaaattcatggatttcacaattgctcattatcttagtgggcccctaagaatagttgattctgaaggggttccagcttcaccaggtgatcttctcgcggtagaaatctgcaaccttggcccacttcctggcgacgagtggggttacaccgcaatacttgaaagggagaatggaggtggattcttaactgaccacttccctagcgcaagaaaagccatctggtatttcgaaggaatctacgcatgctccccgcagataccaggtgttcgttttccaggattgactcatcctggtgttgtgggaactgcaccgtcacttgagctcctaaatatatggaatgaaagagagaaaagtttgtctgagacaagcccggagactattaaactgtgtgaagttctacaccagaggccccttgctcatttaccgacccctgaaaattgcttacttgggaaggtccaagaagggactgctgaatggcacataattgcaaacgaagcggccagaactattgctggaagggaaaatggcgggaattgcgacataaagaacctaagcagaggctccagaatttatctaccagtgtttgtcgaaggagcaaacctcagcactggtgacatgcacttctcccagggggacggcgagatttcgctgtgtggagcaattgaaatgagcgggttccttgagctcaagtaattctgttcttatttacacttcagcactacatgatagtatgacatctcgcattcatcgagcagacctaagtgcttggttcgaggaatgagctagtccatcatcttatcacatctcacttttttgtttcgtttgtggagtgaaatgagatcataaccttatttcaaaaaaaaaaaaaaaa

SEQ ID NO: 2269 - DNA, 1525 bp, Zea mays
ctctgcggcgcccgcggggccggcggaagcaagcaagagactgagagaggcaggtaatacatacctgcgactgcgacgagtgagtaaagcttcatcttcttcctccttcctccggcctcttcctgagtgctgcacgcagtgcgtaggaaggaactcgcgtacgtacgtgtgctagctagctagctcgaccacgcgcagcacgcaggcgcgtagtagctcgatcgatcgaccgccggccggaaatgtcgaccaactcgaggtccaactccagggccaacttcaacaacgagatccatgacatcggcacggcgcagaactccagcatgccccccacgtactacgaccggtcgctggcggacatcttccctccgcacctcctcaagaaggtggtctcggaggtggtgtccacgttcctgctggtgttcgtcacgtgcggggcggcggggatctacggcagcgacaaggaccgcatctcgcagctggggcagtcggtcgccggcgggctcatcgtcaccgtcatgatctacgccgtcggacacatctcgggcgcgcacatgaaccccgccgtcacgctcgcgttcgccgtgttccgccatttcccctggatccaggtcccgttctactgggcggcgcagttcaccggcagcatctgcgcgtcgttcgtgctcaaggccgtgctgcaccccatcgccgtgctgggcaccaccacgccgacggggccgcactggcactcgctcgtcatcgagatcatcgtcaccttcaacatgatgttcgtcaccctcgccgtcgccacggacacgagagcggtgggtgagttggcggggttggcagttggttccgcggtttgcattacgtccatcttcgcaggggcagtgtcgggcggatcgatgaacccggcgaggacgctggggccggcgctggcgagcaacctctacaccggcctctggatctacttcctgggccccgtcctcggcacgctctccggggcctggacctacacctacatccgcttcgaggaggcgcccagccacaaggacatgtcgcagaagctctcctccttcaagctccgccgcctgcagagccagtccgtcgcggtcgacgacgacgagctcgaccacatccaagtgtgattcatgctccatcgatcagagagtgcgcacttgtttactcctcagtcctctcactctatgtatcggcaacactccctaggatatactagtggtccgtagtcatggtctatgtctatgtgtcgctcttctctcgatccatgcacgtccgtggcgcggtgtggatgggctcgctctgtcaaatgtgccaatgagctggagcttaattttgggacgaacactgtgccgtgtgctgtgtgcagccagtcgtactcgtacctctcctgctatcacttgttccaaaagctcttggtgcttacataaagatcatctgtgccttgcacgataaaaatctctattcttgcactccaaaaaaaaaaaaaagaaaaaaaaaaataaaaaaaaaagacaaaaacccc

SEQ ID NO: 2270 - DNA, 896 bp, Zea mays
  misc_feature (818)..(818): n is a, c, g, or t
  misc_feature (844)..(844): n is a, c, g, or t
  misc_feature (872)..(872): n is a, c, g, or t
ttgggtacctcgaggccggccgcgagcaagaagcacacagcgagcacgcaccagcatccttggcagcgatctgcttaattgcttctcccagcgcgcgcggccaagctaggggatccatcagatatccacgcgccatggccgccgcctccaccacgtcgaggaccaactcgcgggtgaactactcgaacgagatccacgacctctccaccgtgcagagcggctccgccgtccccaccttgttctacccggacaagtccatcgccgacatcttcccgccgcaccttgggaagaaggtgatctcggaggtggtggcgacgttcctgctggtgttcgtcacctgcggggcggcgtccatctacggcgaggacaacaagcgcatctcgcagctggggcagtcggtggccggcgggctcatcgtcaccgtcatgatctacgccaccggccacatctccggcgcgcacatgaaccccgccgtcacgctctccttcgcatgcttccggcatttcccctggattcaggtgcccttctactgggcggcgcagttcacgggggcgatgtgcgcggcgttcgtgctcaaggcggtgctccaccccatcgccgtgatcggcaccaccacgccgtcggggccgcactggcacgcgctcctcatcgagatcgtcgtcaccttcaacatgatgttcgtcacctgcgccgtcgccaccgactccagggcggtgggtgagttggccgggttagcagtcgggtccgcggtttgcattacttccatcttcgcagggccggtggtcgggcggatcgatgaacccggcgcggacgctggncgccggcggtggccagcaacgtcttncacgggcctctggatctacttcctcggncccgtcatcggcacgctctccggg

SEQ ID NO: 2271 - DNA, 1936 bp, Zea mays
gaaaaatacatgtctcatttttcattaatcatgtcaagtcaggcagaattgcaacactagtgctagctgaaataaaaacatgagtattcttttttttttttttttgtaaaacaataaattgttaagagggactttacattcatttttgtacttgaaagatcagcttacaacttttacattttcagttacatgaccacgttctgaacttttgatacacacatatccatatgttcggatatgagaatggttagggcttggatcaatgaccgtgcatcaaatatgacgccaactttagggtcatgaatagacttcacggttaccttttacgtacaacattaatgttgtttatctgtaaaccaaaattttaaaactaagcttccgactagattttctgaaacttcaaggcaatctcagtgtgtgccttttttgattcagcatcaaatattattatccaggcaagcaatgatcacatgaaaaattccctgagctgccaaattttcaatatctaaaggaacttggcctccttctggaaccaatatagcatttacatagtcattggtatgattctttaagcttttgtgaggatcgccataagtccgatttagagaatcggtaattgcagtgacaaagccagaggcagacagcccagcagtctctctgtcatgtgacccattcagaagaagtatcttggggatggatcttgatgctatagtctcaccaatgccacgtaataccagtgatggacagactgatgtaaagagtgatcccatagcatagacaatgcagtccaccttacttagctgctccaaaactgtatggttaacttcagggaaaacctcatgcaataggttgctcccttcacttgacatgtaaaacacacgcttgatccttgaaggaagtgtgctacatgaattacaatccttgttgacaatttctcggcgtccattgcttggatgtgatatttcattttggccacgaatgatagtcccatcccatagttcacatcccagagtaagtctgtcatttgtggatataacaggaagcacaagactttctgctgggatctgtgatacgcgtgaaaacaaaaaaattgcagcatccaacgactggaagaatatgcgtgccccagcaaaaaagaaatttccaatgctgccattggtgaagcaaaacatttcagctgaccgtcgaagtatctcactgtgaaagtagaccaaaaaggcacgaattgtttccctgtatggacgagagactccctcccataaagtgtggtctccttctacaatctggtaccattccagctttgcctccgaaggatcaataggcaaacgatgcccaagcaattttcgaacagaaagagcttctgcagtactttcatcagacaacctcaaacatcttgatcttatgtctcccacagcaggcccgccaagcacacgcacaatctcagcagtgcttccaccatcatcagaaacagggagcacgtgcgcgactcgagtagtgactttcttcaattcttcaacaacaccgttaaatgctgtcccgcctgagaaaacgagcagcgacgggggcacgtgaggagctggagcgcctccatcggtgtctgcgcctgcggcagcagagtgccagcctccgtagacggccatggcgcggctgcggcggagacgccacggcgggggcctggacgctgcagatctcggcgcgcggagtaggcagcggcttccgcaagcggaggcttggggcggggttatgttgcagcgcgggcacgcgacgagtgccattcccgacctctctcgggtagggtggaagtagaagggggggcgggcggacggactgtcccggccgaagcagcgcggcggtacccgctgccaaggaaacgaccggcgcgcgtccgcggcggtaatcttttttgattaggatgttctaggtaatggtctcgtgc

SEQ ID NO: 2272 - DNA, 1992 bp, Zea mays
acctcgatgacgcagaagagaggcagacacacatagctgcgagtagagcttcttcttcttcttcttcctccgcttcctcttgccgagcgcagtgctacgtaggaaagagctaacgcacgcgtcgtagctcgtcggtcgatcgccggaaatgtcgaccaactcgagggccaactccagggccaacttcaacaacgagatccacgacatcggcacggcggtgcacaactccagcagcctgccccccgcgtactacgaccggtcgctagcggacatgttccctccccacctcctcaagaaggtggtctcggaggtggtgtccacgttcctgctggtgttcgtgacgtgcggggcggcggggatctacggcagcgacaaggaccgcatctcgcagctggggcagtcggtcgccggcggcctcatcgtcaccgtgatgatctacgccgtcggccacatctccggcgcgcacatgaaccccgccgtcacgctcgccttcgccgtgttccgccatttcccctggatccaggtcccgttctactgggcggcgcagttcaccggcgccatctgcgcgtcgttcgtgctcaaggccgtgctgcaccccatcgccgtgctgggcaccaccacgccggcgggcccgcactggcactcgctcatcatcgaggtcatcgtcaccttcaacatgatgttcgtcaccctcgccgtcgccacggacacgagagcggtgggtgagttggccgggttggcggttggttctgcggtttgcatcacgtccatcttcgcaggggcggtgtcgggcggatcgatgaacccggcgaggacgctggggccggcgctggcgagcaacctctacaccggcctctggatctacttcctgggccccgtcctcggcacgctctccggcgcctggacctacaccttcatccgcttcgacgaggcgcccagcaaggacgcgtcgtcgtcgcactcgcagaagctctcctccttcaagctccgccgcctgcagagccagtccgtcgccgccgacgccgacgacgacgaggacctcgaccacatccaggtgtgaagtgtgatgtcatgtccggccgctccgccgtacgtcccgtcgatcagagagtgcacacgtacgtgctactcctaacactatgtgcctagcaggatagttagttatggtcgatggtgatgtctgctggtctgtgcgccgatcggttctcatgatccgatccatgcgcgcacgcactcgcattgtgtgtccggttggtggcgcactggcgcgctgtggatacatgggctcgctctgtcaatgtgccaatgagctctggcgcttctttttgggacggatgaacactgtgccgtgtgcgtacgtgtgtgcagtcagtcgtacgcgcgtgccaagcaagcgttcgtacgtctcctgctgtcactcttgttccgaaatcagttgatggtgcatatatacaaagatcatctgtaaggagggttttcaaatgctggaaggcaaatgtgtttcatccctaaataaacatggccatcgtcaaatatatcacatgcagcaaagttcaaaaacttaagggaggacttcgaaaaggccgacggtaaatgtgtcatcccactagacatgaccaactaatttgcctcccactgcaatgaacaagaaggtctcacctttacttcaccgctcacggacaaaaggtttgcactaacctgggactccttcaaatcaagaattgggtgctatgtatgaatccgggactatgccttttgaccttgagaaactgctagaccgacctttgcaagacctaaaaggtagcttcgccaaggaagaaaaagacaatgtaattatagaattgccttcagataagtctccaggtccatgtggcttctataatgagtcatcaagaaacatgggtcatcattaccagatatttatatgagaacttatgggaagcatctctaaatatatattcattaattacctataaaatatagtttgtatgt

SEQ ID NO: 2273 - DNA, 714 bp, Zea mays
cggcggccgccctttttttttttttttacagaaattgaaaaatacatgtctcatttttcattaatcatgtcaagtcaggcagaattgcaacactagtgctagctgaaataaaaacatgagtattcgcactatggatcgattagtaaaacaataaattgttaagagggactttacattcatttttgtacttgaaagatcagcttacaacttttacattttcagttacatgaccacgttctgaacttttgatacacacatatccatatgttcagatatgagaatggttagggcttggatcaatgaccgtgcatcaaatatgacgccaactttagggtcatgaatagacttcacggttaccacatgaaaaattccctgagctgccaaattttcaatatctaaaggaacttggcctccttctggaaccaatatagcatttacatagtcattggtatgattctttaagcttttgtgaggatcgccataagtccgatttagagaatcggtaattgcagtgacaaagccagaggcagacagcccagcagtctctctggcgggtggcccattcagaagaagtatcttggggatggatcttgatgctatagtctcaccaatgccacgtaataccagtgatggacagactgatgtaaagagtgatcccatagcatagacaatgcagtccaccttacttagctgcttcaaaactgtatggttaac

SEQ ID NO: 2274 - DNA, 1346 bp, Zea mays
tgggaccctcgaggccggccgggcggacgcctcagcgagcacgcaccagcatccttggcagcgatctgcttgcttctcccagctagcgcgcgcggccaagctaggggatccatcagatatccacgccggccatggccgccgccgcctccaccacgtcgaggaccaactcgcgggtgaactactcgaacgagatccacgacctctccaccgtgcagagcggctccgccgtccccaccttgttctacccggacaagtccatcgccgacatcttcccgccgcaccttgggaagaaggtgatctcggaggtggtggcgacgttccttctggtgttcgtcacctgcggggcggcgtccatctacggcgaagacaacaggcgcatctcgcagctggggcagtcggtggccggcgggctcatcgtcaccgtcatgatctacgccaccggccacatctccggcgcgcacatgaaccccgccgtcacgctctccttcgcatgcttccggcatttcccctggattcaggtgcccttctactgggcggcgcagttcacgggggcgatgtgcgcggcgttcgtgctcaaggcggtgctccaccccatcgccgtgatcggcaccaccacgccgtcggggccgcactggcacgcgctcctcatcgagatcgtcgtcaccttcaacatgatgttcgtcacctgcgccgtcgccaccgactccagggcggtgggtgagttggccgggttagcagtcgggtccgcggtttgcattacttccatcttcgcagggccggtgtcgggcggatcgatgaacccggcgcggacgctggcgccggcggtggccagcaacgtcttcacgggcctctggatctacttcctcggccccgtcatcggcacgctctccggggcgtgggtctacacctacatccgcttcgaggaggcccccgccgccaaggacacgcagaggctctcctccttcaagctccgccgcatgcagagccagctcgccgccgacgagttcgacaccgtctaaattaaaacgcccacacgcgcatccacaacactgtcagcctgcaggtcaactcttcgcgcgtacgtacgctggacgctggctgagagagtgagtgagagagagagagagtactgtactactgtgtgctcgctcgctcgctctgttcaaagacctcatcatatcaggtgggagctagagagatagagctgcgtgtatgtatgtgtgtgtgtgtacgtgcttggtgtaccctacctagcgggtgagagcagctagcgtgatgtttatgtatcttcgtcagtgttgcaaaagttaattgatatgcagctgatgtgtctggctttgctggtt

SEQ ID NO: 2275 - DNA, 1425 bp, Zea mays
ttgggtacctcggggccctcggggccgcccggaaagacacagcgagcacgcaccagcatccttggcacttggcagcgatctgcttgcttctcccagcgcgcgcggccaagctagtaggggtctaggggatcgatcagatatccacgccatggccgccgcctccaccacgtcgaggaccaactcgcgggtgaactactcgaacgagatccacgacctctccaccgtgcagagcggctccgtcgtccccaccttgttctacccggacaagtccatcgccgacatcttcccgccgcaccttgggaagaaggtgatctcggaggtggtggcgacgttccttctggtgttcgtcacctgcggggcggcgtccatctacggcgaagacaacaggcgcatctcgcagctggggcagtcggtggccggcgggctcatcgtcaccgtcatgatctacgccaccggccacatctccggcgcgcacatgaaccccgccgtcacgctctccttcgcatgcttccggcatttcccatggattcaggtgcccttctactgggcggcgcagttcacgggggcgatgtgcgcggcgttcgtgctcaaggcggtgctccaccccatcgccgtgatcggcaccaccacgccgtcggggccgcactggcacgcgctcctcatcgagatcgtcgtcaccttcaacatgatgttcgtcacctgcgccgtcgccaccgactccagggcggtgggtgagttggcagggttagcagtcggttccgcggtttgcattacttccatcttcgcagggccggtgtcgggcggatcgatgaacccggcgcggacgctggcgccggcggtggccagcaacgtcttcacgggcctctggatctacttcctcggccccgtcatcggcacgctctccggggcgtgggtctacacctacatccgcttcgaggaggcccccgccgccaaggacacgcagaggctctcctccttcaagctccgccgcatgcagagccagctcgccgccgacgagttcgacaccgtctaaattaaaacgcccacacgcgcatccacaacactgtcagcctgcaggtcaactcttcgcgcgtacgtacgctggacgctggctgagagagtgagtgagagagagagagagtactgtactactgtgtgctcgctcgctcgctctgttcaaagacctcatcatatcaggtgggagctagagagatagagctgcgtgtatgtatgtgtgtgtgtgtacgtgcttggtgtaccctacctagcgggtgagagcagctagcgtgatgtttatgtatcttcgtcagtgttgcaaaagttaattgatatgcagctgatgtgtctggctttgctggtttgcaaaagatgcatgcatgtgttggaactcggaacacaaatatatatatgggtttttttttgtct

SEQ ID NO: 2276 - DNA, 6126 bp, Zea mays
  misc_feature (4815)..(4815): n is a, c, g, or t
  misc_feature (5886)..(5886): n is a, c, g, or t
ggctaacctccttttttctctctctatctttctctccatctgtggacttctccggttttgtttgacgagatgcctgcgctcgccgtcgacgccgcgacacccgtggcgcacgccttcgcgtcctgcgacgcggcgcgcttccccgccccgcccgtggtgggccccgccgccgcggccgaggccgccccctggtcggccgacctctccgcggcgctctacaacgtggacggctggggcgcgccctacttcttcgtcaacgacgacggcgacgtggccgtgcgcccgcacggcgccgcgactctcccgggccaggagatcgacctggccaaggtcgtggccaaggccgcgggcccgcgcgccggaggcgggctcggcctgccgctgccgctgctcgtgcgcttccccgacgtcctgcgccaccgcgtcgagacgctcaacgccgccttcggctacgccgtccgctccaccggctacggctcaaggtaccagggcgtgtacccggtctggggcccccggggccggcccggccgcggggccattgtggagttcggcgcgccctttgggttcggcctcgaggccggctccaagcccgagctgctgctcgccatgagctgcctcgccgcgcgcggcggcctggacgccctgctcatctgcaacgggtacaaggacgacggctacgtctcgctcgcgctcatggcgcgctccatgggcctcaacaccgtcatcgtgctcgagcaggaggaggagctcgacattgtcgtcgaggccagccgccgcctcggcgtgcgccccgtcgtcggcatgcgcgccaagctgcgcaccaagcacgccggccacttcggctccacgtccggggagaagggcaagttcggcctcagcgccgcgcagatactgtccgtggtcaccaagctcaaggccatcggtatgctcgactgcctccagctgctgcacttccacatcggctcccagatcccgaccaccgccctgctctccgacggcgtcggcgaggccgcgcagatctactgcgagctcgcccgcctcggcgcggacatgcgcgtcatcgacgtcggcggcggcctcggcattgactacgacgggacccactcggcgcagaccgacatgtcggtggcgtacagcctggaggagtacgcgggcgccgtggtggccgccgtgggccgcgtgtgtgaccgcaagggggtgcagcaccccatcatctgcagcgagagcggccgcgcgctggtgtcgcaccactcggtcctggtgttcgaggccttctcggctacggcgccgggacgcctggacgcggccacggcctacctcctcgacgagctcacggacgactgccgcgccgactaccgcaacgtgatggccgccgccgtgcgcggcgactacgacacgtgcggcctgtacgccgaccagctgaagcggcggtccgcggagcagttcaaggagggggtccttggcctggagcacctcgccgcggtggacgccttctgcgagctcgtcgcccgcggcatgggcgcgcccgagccgccgcgcacctaccacatcaacctgtccgtgttcacctccctgccggacatgtgggccatcgggcagcagttccccatcatcccgatccagcggctgcaggagcggcccgccgtcgacggcgtgctctcggacctcacctgcgacagcgacggcaaggtgagcgagttcatcggcgggaggcacagcctgccgctgcacgagctgcccacccacgccactcgcggctactacctgggcatgttcctcgggggcgcctaccaggaggccctcggcgggctgcacaaccttttcggcgggcccagcgtggtgcgcgtgtcccagtgcgacgggccccactgcttcgccgtgacgcgcgccgccgcgggcccgtcctgcgccgacgtgctccgcgcgatgcagcacgagcccgaggtgatgtacgaggtgctgaagcagaggaccgacggcgccacggccgccgccctcgcccgggccttcggcgcaatgccgtacctggtgttcgaccccgaggccgccgtgatgtccggcggcgagagcagcgactcggagcggtcggccgccggcgccgccgaggaggaagacgatgaggagtgggagttcatgcgcgggctcaccgtctgatgacgtgcccgcccgcccgccccgggtgaaacaaggcgagtccgtcgccaggaagttgtcagtggccggccggcgttggtttacataataacccccaccgcccggtgttgtatcgtgtcgtggtcgtagtcgtcgggtgtctcgtcgtcgccggagttgtttggcgccacctttttattccgaacgcgtcagtgtccactgttcgcctttccttttttttctctctctttcatgggaataatctgaaggaaactaatagcaagtttctctttaactggaaatttcgttttttcaagaattcattctgtctgttgctgtgtcggttccgcgcccccgttgcgtggtgcgctgccaccggagaacaccttcctctcgtctcgacgtcgtcgctttctcttttcttctccatcgtcgcgtcgtgggcagggggcaggtgtcacggccccgagcgccggaatctctctggataaaccccgagatattcggacgtcacgcgggtgggccgcggcggatttgaaacgcagctctgggacgctacctgacgcgcgtgtcagcgtcatcggagcggtaggtgtggggacgctggcgggctgggctttgcttccttccttgctgtgcgtgctcgactgcgtctgcctttgccgcatgtgttgcgagatgacgaggacgaaaaggtcttccagaatttatgagcagtttttggatttggtacagatgctgtgagctcgagctggagcaccgagaccggggctgcctgcgacgcggtaggtgagcgccgcccgggagtcggttatactacgactttcgccgcatacattcagccgccggccgccgcatacggcatggattagattattagataaagatcggatgagtaataagcagtgcaaagttcatgaacctgaaatatgcatgcatacacctgctggcgatctcggccgttgacggagcatgcatgtggtgtgtccccgttccggatggctcgcacagatctactgtctactactagctcccagagcagagcaggcagagatggttggcggttggcacaggtagagaggcagccacgcagtgcagagccgtggtagcgatgcgcgaggcggatggacaggatagggaggggatagcgtaggggccaagtgaccactcgtcggctctggcctttcggcgcccatctcctcctcatctcatctccctccacggtccacttgtttcgttcgctgtgtgacagtagtgtgagagattccagatccaacacctgccgaccccgtcgtgatcctgtccagcggctccagagacagagaggcacgaacacatgccaagctcccagctcctcccctcccccctcacctcacctcaggccctcactcccccaggtactcaatgctctttctctctttcagccgccgctgctgcgttgcgtcgtgtgggagctgagctagtggcactgggtgctctcgaccgcactaggcagaccagacgttgcgtcgtgccccatattcgccgtcgccgtgcctttcagcatctatctgggagtgaatgacttgggctgggtgacggatagctgaccatctcagctctctcgaagaacaagatcgtaggagaacctcctagtcctttgcccctgtcgacactttatatgctggtgtggtgtccatcctgtcgctgctgggggtgccaattgccatgcccattgtttgttcggtcccgttcaccggggatcggatcggatcgtctgtccagcagcactaccagttcggttcagatgcaatggaatggaatggaatgcaccaccgcgcgttgacgctggtcgaataaggaggctaatgctgcctcgtctaattcagcggttacggcagaaggtaccagttgccaaaggtcggtagaataagtacccaccatctggatccacccctccaaacttcagtgctcttataagagacctaaaacactttatcttcgtctacactctagagctctcaacgatttcaaacactttatatcaattttaagctataaatccaacatgagatgggctaactttagactatttatgtaaagctttagctgtatagtttagagctaaaatgtagagggggaaaacataaacaagctagccttaaaaattaaacttgaacgattattgaatctgggagatgtgtatatctcgattccaatagaagaaaaggatcagaaaaaaaatgcaccgactagacctggttaaagtgatctcgtgttcaaattaaaacaagtacgtgtatatttctagcagtacaagtgctcgtgtaaggctgcttgccaccaactctactaccatcgtgttgcagagatggtggttcgttcgtccttaaagaagaagaagattggcttcattcggacgtaaccacaaatcttttcattctttcttttcactgtatcttttctcatcccaacgccatctttcccggccacggcgaacctcgagttcttgcatggtctctaggttgatggtatagggcagggcacgcacgtgtgtgcttaacctgctgtcatttttgtttagcaaaaaactagtagcacagcatgtcagcatcgttatccggggacctctcatgcttataggagaacaatgtcgtgcttctttcctccacaaataaagaggagaactctacttcgcagttncggcgtcagacatctcaactcttgcaacgtacgtttccttgccgcccgggcaagtccgagtccgtacaaggaaccggtcgtcgagtcgagtggggcatctgaaaaagctcagcatccggtccggtccggtccagtccaagtgtcccactccccgcctgcagctcgacgaacggaggtgacacgaacccaacctgggatggggggggggggggggggggggtagagagatcagtacgtttccggacagagctggaacggttggtgcgccgtgcgcagttcttgctgacgatagtttagaaacgtttcggttggtgcgcgcagttcttgcggcgcctgccatgtctgaacctggacaccgctacgtctagctccgggacaggagacgagcgctttgaccggttctgattgtacacgagtccggagaagtgatcgggattcggggacagttgtgaagcttcgcaggctttgactaccgccacacacgtgtgtgtgtgtgcttgtttactagaaagatggcttggtttggtagcaatagcgacggcgaatttgagataatgacatctgctgctgtctgctaagaaagactggtcagtgactctgaataaaagaacctgcatacatgcagctagatataaaagaaaagaaacgttgaagcgtcgcatacctacttgtgcttgcgttacctacctttacccctgttggctgttggaaggctgaaacgggagatcgagctatattattattagtgccgtctcttgcgctgatgcactcctcctccgtcaggcaggagctgatctagccgcgtatttgtatttggacgaagtgcttgtctagatacgtaagtagctctaaacgaatgatcttgtttcagaacgtacgggacgagcagtgtagtattctctaacctggaaggaggagtgcaagcggatggaaaagaatagtttaacctggaaggagtgtattctctaaccaaaccaacggaaggacggcttgagtgaatgaattctgatcactctgtactatctgcttccctttccagtcagaaagaaggcaacatgggtgggccaaacnggccaccgtccaccctaagatttggcccaaagtttaagaacactacatatctttggcgtggaacctcagcaattagccgtacatcttcgacaacccgccgcgctgtttctccaacccgtcatcgaggcccatcgctaagcccagcacccagcctgcaattctctccaccttttaacacggtgtttggtccgggcctattttggtctataaccattcccgccacacttcaacaccatgttt

SEQ ID NO: 2277 - DNA, 924 bp, Zea mays
attgggacctcgagccggcgcgttgcggccattcggcccccgccgcctgccagcagccctcgctgccggccgggacttctcccgtcctcccctctcctcccatcaacctctgctgacctccccgacccccgaggccgttcgctcggtgcctgcgcagcagcgccggctgctggagctggtcggcgcgcgcaacaatggccaaggccgtgccctcgccgctcgcgctcgcgctcgcggccgtggccgtggcggcgctgctcctcctgtgcggcggcgccgaggcccgcgtcctcctcacgctcgacgacttcggcgccgtcggcgacggcattgccaacgacacccaggctctcctggacgcgtggggcgccgcgtgcagctccaaccagaaggccgtcctcgccgtgccggccgggaaggtctaccagatctggccagtgcagctctccgggccctgcaagaagaagatcaagctgctgatttccggcgcgatcgtggcgccgtcgagccccgacgagtgggccgggcgggaccccatgaagtggctctacgtctacggcgtcgacggcctgtccgtcagcggcggcggcaccatcgacggcatggggcagcagtggtgggccagcacctgcaagcgcaagaagacccagccgtgctactcggggcctcgtccaaaggcggtgcacttcgaggagtgccgggaggtgagcgtgcagggcgtgacgctgcagaacgcgcagcagttccagctgacgttcacgcgctgctcctgcgtgaaggccagcttccctccgggtggtggcgccggcggacagccccaacaccgacggcatccacctcaacgacacctcccacgtccgcatcacggacaacctcatctccacagggggacgattgcgtctccatggtcggcaattgctctga

SEQ ID NO: 2278 - DNA, 837 bp, Zea mays
  misc_feature (758)..(759): n is a, c, g, or t
ggtccctcgagacggcgggagagcacacgctgacgcctagtacttctcccgtcctcccctctcctctcatcaacctctgctgacctccccgacccccgaggccgttcgttcggtgcctgcactgcgcagcagcgccggctgctggagctggtcggcagcgcaacaatggccaaggccgtgccctcgcagctcgcgctcgcgctcgcggccatggccgtggcggcgctgctcctcctgtgccgcggcgccgaggcccgcgtcctcctcacgctcgacgacttcggcggcgtcggcgacggcattgccaacgacacccaggctctcctggacgcgtgggccgccgcgtgcagctccacccaggaggccgtcctcgccgtgccggccgggaaggtctaccagatctggccggtgcagctctccgggccctgcaagaagaggctcaagctgctgatttccggcgcgatcgtggcgccgtcgagccccgacgagtgggccgggcgggaccccatgaagtggctctacgtctacggcgtccacggcctgtccgtcagcggcggcggcaccatcgacggcatggggcagcagtggtgggccagcacctgcaagcgcaagaagacccagccgtgctactcggggcctcgtccaaaggcggtgcacttcgaggagtgcccggaggtgagcgtgcagggcgtgaccctgcaaaacgcgcagcagttccagctgacgttcacgcgctgcttcctgcgtcaaggcgcttnncttcgcgtggtgggcgccggcggacagccccaacaccgacggcatccacctcaacgacacctcccacgtccgcatcac

SEQ ID NO: 2279 - DNA, 818 bp, Zea mays
atgcgctacggcagtttgtagtttagtctaatcaagccatggtgttgaaacttgaccatacttgtcttaatgagactgtattcggctcgagatgagcttatgttcctatatgactactagctagaagttagagcctagatgatggctgcttctgttggcgtgaaagctcgagtgctcctaaatggtcgtcgtattagctgatacgacatcgacccgatgcaatagataatattgtttacacgcgcgagtccaaaattgttggctttgggtcggagcagttaacgcgagaagtgtattttatcacttctgagtgcaaccttttttttattatttttccgagcttctgcctcttgcatatgttgtagattctcgccgagaagggagtagtagtattacctgatatctatgctaattcaggtggtgtggtcgttagctactttaattgagtgggttcagaacattcaaggtttcatgtgggccgaggagaaagtggacgatgaactagaaaaggacatgagcagtgcttttcaacacatgaaggccatgtgcaaatctttggtgctgccgaagtgtgccgtgacattggaattgcgggtctagaaaaacaagctcattagatttctgaaaaaacattaggagttattagattggtagcatttttttaagatttaaaattttatagaagtcatcattttcgtttattggaagaaatatttttggaagttgaaaagatgctctaacatccaaccacgcaaactatcttgcaaccactctaacacgatttcggtaatatgtttttatgaaaaaaaaaaaaaaaa

SEQ ID NO: 2280 - DNA, 2302 bp, Zea mays
gaggcatgcgctacggtggtttgtagtttagtctactcaagccatggtgttgaaacttgaccatacttgtctcaatgagactttggagtgaaccaaatgagcttatgttcctatatgactactagctagaagttagagcctagatgatggctgcttctgttggcgtgaaagctcgagtgctcctaaatggtcgtcgtattagctgatacgacatcgacccgatgcaatagataatattgtttacacgcgcgagtccaaaattgttggctttgggtcggagcagttaacgcgagaagtgtattttatcacttctgagtgcaaccttttttttattatttttccgagcttctgcctcttgcatatgttgtagattctcgccgagaagggagtagtagtattacctgatatctatgctaattcaggtggtgtggtcgttagctactttaattgagtgggttcaggtaaaatgcctgttcgtcgctgcttcattgctcgattggttccttgctctaatctgctttcttgtgccatgttgattgatcgtgcagaacattcaaggtttcatgtgggccgaggagaaagtggacgatgaactagaaaaggacatgagcagtgcttttcaacacatgaaggccatgtgcaaatctttggtgctgccgaagtgtgtcgtgacattggaattgcgggtctagaaaaacaagctcattagatttctgaaaaaacattaggagttattagattggtagcatttttttaagatttaaaattttatagaagtcatcattttcgtttattggaagaaatatttttggaagttgaaaagatgctctaacatccaaccacgcaaactatcttgcaaccaccctaacacgatttcggtaatatgtttttatgatacgagtatatgtttttatgatacgagtgtgctaccaaatgcatgattaaacgaaatgggcttcctgtgaccggagcgcatcaggctaggctgttggggattcgcatggccagctggtgaagccgaacacaaattgttctggcttcatgcataaacagtgctggtcaaaatatgtttcatgaataggagaaagcaaaaatggatgaactctcgtgtgagtctttttagtatatataagtaaatgatgaagcagctagagagacatgcgctacggcggtttgtagtttagtctactcaagccatggtgttgaaacttgaccatacttgtctcaatgagactttggagtgaaccaaatgagcttatattcctatatgactactagctagaagttgagagcgctaatactatattaattgtgtaacatattcattatttgctcattcgaggagaaatttaaagtcttactagtgtcactactgatattttatttatcctaaaataataataataataataataataataatagtattaaaggtgtgtcatataaaacacactatactatctatttttagatgtgtgttattagagtggtctactgtgtgttgttattgccgttaaatcctgaccatattgactcctcatgctacaatggttgaacgtcagcgatgtagtgaaagggcaacgtcatcccctccggcgtgctcggctagcagcttatctactcgtgtagtagacatccggaaaagtgttgcagcgggtcaaattgctgtgtgatgtgccgggtaaccgccaagggctactctaatattttactcgtggtggatgtgtcatacaaatcctgacttctcatatatactaaatatttaaaaaatggaaacgctgtgttgttcgctcacgtacttataatgactatttttatgtagaatgattgacacactaaaataattgaggctaaaagatgaaatgaccaagtttgtttacttcctttccaataatgcctgttttttagaacgactaactcactaaatggcttctatatcaattgttctaattaatgactaagactaaaaatatagaatgactgattttgttcacttcttttcttgcagtacctatttattttagaatgaccgactcatcaaacgactcatatctcagttattctcatgaacgatcgaggctaaaacacatttattgttcttttttataaatcaagcgtgtggatgtggatagttgaccgacacgatatgcggatagatggccaggcgcgcgcgaggtcgaagaggcctaacactaccatatatatatatagtttgtatatttggagccttgggcttccaataattagagaaagccctagcccaatggtgccatccggtccagccgcaccagggaagacggat

SEQ ID NO: 2281 - DNA, 1672 bp, Zea mays
ctgtaattcatgttcaacagtgttggaggaccagtgttttgatacaataaaattcatcagaaagggacggcttggaaggagtccggttgaaataacattctgagtggtgcgtttgttgatcctaggttaccaatggttggttatacagttcttggtggtgattattaaaattgtatttagccattttataatatttagaaagtttatttggtttcgacagagttcatgtatcttttcgttcttaatgagattctggtccggggtttgatgtttgaagattccagatgtaaattatccgcaaaagttgcagttgtgtttcttttttgccagttatcatccacagtttaaatcgatgttgtgactgagtttctcgtaagcgctaagccacctaataattcagtagaagaggacacactaaagtcaattacggtcaccactagccaccaccgctgatttgcggcccttgccggcttgccgccagagttgagtgttggagcagtgccggccttgtgatgctgatgaacatccttgtaggttgcagagatggagcctccgtaaggccatccttcttgtcagcaatcaaaaaccattagcagcaggcacgagtgccagcttgcaagcccagctgccaggctctggcgaagtgggcgctgtgcaaatgctgtcattcgattgaagaagcatcggcatcggcaccgtccttgtccatggcgggcgttgccgcaggttcaggcacaggcacctctgtggtggtcgccagagccaggtcgataggctggccaccgtccacaggcggcgtggttggagggaccaaggttgtgcatggcttgtccatgatcggtgcggcagagctatcaccgaggatcaccagtgccagctcacgcggaggctcatgctccttgtccctgtggtccgcccctgcctgcctgcgaggccggccacggcgcttgggcttcaaggacggtgcatggatttcgtccttgccggcaacagcaaccgatgacattgcagcaacggccagtgtcgaaggagagccatccttccgcggcctgcctcggccacgcttgggcttggcctctaccagtaccaccgaagacccaacggacgccggcttgcacgagccggcctgatcagcctgctccaccgggagctcctcctcatcagcgttctcctgggggctgcgctcgaaccgccccgtggcagttcgcacgaagaagccctcggcgacgtgcttgccgaggtagtgccggaggagcctgtcgtgcgcggggggcacgccggggtgcctggcgcggataaaggcagagatggagtcctcctccgagccgccgtcctcggccagcgcgtcggttgcctcgccgatcatccagcagtagggtgggtgatccggcgtggcttggcggcgcttccgcgcgaccaccatcggctgcggcgttcgctgcccctcctcatccatcggcccccgcttcgcctcttgcaccgcgtccacctagacaagggccaccattgctgggtaggaatgcggaatatcgggttcgggctcgggctcctgctgttgttcggatggagggcgaggagcaagatactacggccgatgggctgccgtttgatggtgtttgtatgtatgactggcctaggagacccgactttattttaccatactgcccttttt

SEQ ID NO: 2282 - DNA, 8659 bp, Zea mays
  misc_feature (3192)..(3192): n is a, c, g, or t
tatatgtaaaaaatcaataggattgcaacattctgaaacaaatccgcctgaacccagtaattaggtaaagtcacttggaaaattagcgagaaatgattgttttttacaaataaatgcaaacctaaaacgtgtttacaggtactgtttaggggaacacaccagcttagtgactacaagaaggaacgctgtattcaagcctgatgtagctagaggctgcggctatatgacttttcttcttcttcttctctctctctttcccatgtatggtcttttatgtttgggattaaagattaattttgtggccgagactgtgaatgtgagtttgggtttacttgcttgggagtgtagagaagcttggcttggactgattcctctcctaggagagactgtgaaaaagaggcatgtcaggcgttagacgatcgagacatcgggagtattattagaaactgctctgaaagtgagtagtaaacgtattctctgatccaaccggcccttatcggcttcgttcctttcttccaagggaacctcgacgagcttttccgagaacgcgatctctgtagaaagataacatacgaggatagcaccaatgatctgacggcttgaaagagaggccaggcgacgtcctgaatagtcaaagattcagagagcataaaatgattagcctggagctctgaaaagatatactccatacagacgaactagctagtactgcatgaaagcatcaagagcgtactgctacaagaaacagctttgcgcgcgcaacgacgcaacatacaatactccagaaaaaaaagagatcggctgttaaaaggttgcaggaacaaggagcagcagatatcgatcgatccgcctgatcccgaccgtatgcagcgccggccggcacagggacaattcgttcgccttggatgcctcgtagcatagcatctgctggcactataaggggtttttggagaaagaagagcacgcacgcacgcatatgcgtactgcgtacataggctgccactaatgatggcctcgaaagaaagatgaggcgactctgcaattgttaatccttctgttcgttgtaggggttgcacggatcggagatggaatcatcttactaatcaaaggtgaggcctaggttattagatgctacaggtgtgtaggcattcttgatggtccctattagcctgccttttggaataggggtacgtatacaatgcacactatatcgtatactatatattgtagccaaattaactgggcatatgggcatgccactttcacaaacaggtccatatgggcatgccactttcacaaacaggtgtagatgtaattaagatcaagatgcatgttgcatattgtaatgtgttgagatttatttaggctctaggtcagagatgttgtggattctgtattgcaatgcagtgcttataagtagacgtgtgagggatatgtatgtagaaagtgggcaagagtggcacttagttgatagatagatgttcattctctgtctttctttatgtgttttttactagatgagtttcactcatttctgaaaatcacaatagtattacatgataagggatttgcagcaacttatttctctaactaaaagatatagtatcgcttaagcaatggagaatagataagttaccaacaatgcctttactcgacgggggaaaaaatccttccacattttccagtgacccatttgttcgggcctttccgttatttctatgtcatatatatagattggaagggttgaaaaaattagaagacattttgacttgctatggatttaaacatctaatccccctccaatctatattgattgagataaaaaacgaacagcttctcgggttgaaaacacctgttgtcatttgtcaactgggaacgattatatatgttcttgcataaggaaaaaatgctcacagaagaaaacccgaattgttgtagcacaataaaaatagtctgagacggcgacctcgctgttgccagtcgcatagacagggaaatatttccggaccatgagctcatcaccagccaattctggtctgggctggttttaattcaatttttactattttgggttgaaaccaaaacttgagaccagattaacataagtgcgttcctatgccttggcccatgagcctgataggcccggctctggggtacggcgaggggaggtgtccgcttcaggcctccgacggcaaagggccctagcggctatgtgctgtcgatacgtgtattggactggacctagagctttaagcagacagcttttgtcttgggctagcccaaaagtacatgagcaaatagttagtagaacgctgaagattttctaaaaaaaaggtacgtagaacgctgatgctttgctaaaaaacagaagtagaaagcttatgcagtcttcgaatcttgcacgcactcacatcctcttcataattctgaacccaacggccatcgctgaatggctagattctcttactatgataaatggatgatcaacttctcataaatgagtgctaaagttcaacaagcgttttattattagatcgctgatcaagtttacataaattaatactcaagtttcaagtgtttattattagaccgctgatcgcctttgcgtaaatgaatgttgaatggaaccttgaggtgatttaatatgtaactcctgttgcaatgtaaagtgtacatccattttattcctggaacacattaatttcaattgaaattgtgcatggaatacgtttactcactttgagatcagtttctactcccaatatctcaatccccatctagtaaaacaaatgcaatccgacttcgtccctcctagctagagggaagcaggaagagagggtaagaacggctcaggtcccgagtgaggttgttattttttttatttaactgaattggttagtagttagtactcctccggtcctatgtggaagcgaattttaggccacaaacaggggcgacgccagtagtacttgtctggtgcacgggcaccagggtgtatcaagaatttctttgtaaattgagtaatatttattatatatcacaagaaaatttacaagttccttgagtagtgtaccacctttatttttgtgctagcttcgcctctgcccacaggcaggtcgagttttcggtgagttggactgaaagaacaaccccctttcatcatttcagatgttgaaacttggaagccaagangggaagcagacagcagtgtatttaatctcacgctctgttgattgcgctttgagtcttgcagtccacaaatctgcctatccctttggtggtctgggtacacgtgagatggcatgcctgcagtcgaccagctggttcttagatacaccctctacagagaaagctactgtctgtatgctaagccatgctacttgtatatgtaggcactagaagatggggtcaatggtataagtctctctctatttgctcctccttcagtttcatctgggccagcacctttcctcgatttgctcgaggcacgcacagctgctccttgccaccaaaaggctggagtgtcagttgttctgttcaggccgtcagcaatgcaagacctggtgcaaacaaacacagtcgcctctttcagctcacggatgttaagcgttggcgttgctgcttgaacaacagactagaagtacagaaaaatccaaccataactggcagtgggaaagtattcttttgcaattctttcaaactttaccttggctgttgaccaacaatctgtagcatttatttgttagcagcacagcgccctcagcgtttccttatggtggggagctggggaataatgtagtttctagacagccttttactcttgcatgactgtacctgatcttcgacagggcgacatcactcactctctacctgccaaatttaacacgggaattcccttgagattggtggtgttccgattcggatgggtcaaccttgacgcaaaggctagctgttggctcttgacgcaaaggctagctgttagtactaaaagaattctcttaaagccgacgtgtaggtcgtgtgcgatacggtggacctgatttgggttcgtgcgtgggcacacacgccttgcgatgaactggcgagtagtggcgatgacttgagtagaataggattatccttccacccattgacacgagggcttggctgagagaattcgagatgaggatgtgagcagcactagatgacgccgacgcggcgaggcggacgcgcttatccgagtcagcgcggacgcggcggccggccggtgcgatacgccgctcctgagtcctagcgggtagcggatgtacggatctgacccatcttttttaatggataccatccgttatgttatgtgccaatggcaaatggcatggcgagacgccagtacgctgtacgccaccggccaccgcccaccgggctcctcccatgcccaagggccaagcgcaaccgtgaagcatttgggcagccgttttcctggggaggcgcctccgtgaacgaggaagttgttgcctgcctcagccctcagatcagatgccactacggcacagcgccgagtgcgctccttcgcctttatggcggtcggcgccaacgccaacgatcatccggacgtctggcaatcaagatgcctacgtacctcaagcgtccgcaaggagtacggttgaaacagagcctgaaaagacaacgtggatatgacaggacgatgcaaagctcaggtttggacattacctgccttgtcagggcgatgcttggctgcacgggcaaaggctgcagagaatccagcgacgcaacgacgacaagaaataaaaataaaagcactcacacttgacgttttcagttctgttcggtgagatcacccgaacgaaaaagagcaccaaaaagttcgaacacggcattcgacacgcacagacgcaccggcagccagccggtccggcccggcccggcccagccctgaaataatatcttcactgtcaaacgggacccacacgcaaaaggcgattttttttttggtaagtggacggaaaaggaggcaggagagacaagccagccatgggatgggcgggcgactcggcgcgtaggaggaagaactctccctcggcgcggtggcggcctctcccacaacttttcctaattgaattcgatctcccttccctatccggcatcagcgcgcaccaccactagcgaatcccgtttggtcatcaagaagacgtaccgctgtctccaatcgaagttccagtcccactccaacatcggagagagagcacatgtcagtctgacttgcgaactccttccctctcctccttcccccaggtcaggagtcccagatcgtgaagccagctattttactctactcccccctcaccacgagtcggaattcagccccgcgccgcgcgtcgatcttatcctccagtctgattccagctccgcccccgcctccacctccacctcccctctcgatccctcgctattaatacatcccggcggttcactcccgatctccatccctcccggccaggcctgcctcctcgatcctcggacgaaacgcgccgccttctttcttcgtcccagtctcgcctcctgccctttttaggtcgcccggatctcgctctcgtcgtcgtcgtcgcgcgcgcgcgcgcgcttcttgtttctgtcggcgccgccgcggtgctgggaaggcggctccttttcgcggccacaacccacaacacgccctcgtgatcctataccttcttcttggaaaaagttgccgccgcgatgaacgcgctcgccgccaccacccgcaacttccggcgggcatcgaagctgctcggcctcgactccaagctcgagcagagcctgctcatcccgttccgggagatcaaggtggaatgcaccatccccaaagacgacggcagcttggcgacgttcgtggggttccgcgtgcagcatgacaacgcccgcgggccgatgaaaggcggcatccgctatcacaatgaggttgatccagatgaagtaaatgcccttgctcaactcatgacatggaagacagctgttgctgcagtcccatatggtggagcaaagggagggatcgggtgctctcctggtgaactaagtagaagtgagttggagcggttgacacgagtatttacccagaaaattcatgatcttatcggaacgcatacagatgtccctgctcctgacatggggaccaatgcacaaaccatggcatggatgctggatgagtactcgaaatttcatggtcactccccagcagtcgtcactgggaagccaatagatcttggcggatcactgggcagggatgcagcaacagggcgaggcgtaatgtatgctaccgaggccctactcgctgaatatggaaaatgcatttctggatcaacttttgtgatccaaggttttggcaatgttggttcatgggctgctcgacttattcacgagaaaggtggtaagattattgcaattggggatgtgacaggttcaattagaaacacggctggtatagacatacctgctttggtgaagcataggaatgaaggtcatgcgatgaaagacttcgatggtgcggaagttttgggttcgaccgagttgctagtgcatgactgtgatgttcttgtcccctgcgccttaggtggagttcttaacaaggataatgcaccagacgtgaaggccaaatttataatcgaagctgctaaccatccaactgatccagaggcagatgagattctcgccaagaaaggagtagtagtattacctgatatctatgccaattcaggtggcgtggtcgttagctactttgaatgggttcagaacattcaaggtttcatgtgggccgaggaaaaagtaaacgatgaactagaaaagtacatgagcagtgcttttcaacacatgaaggccatgtgcaagtctctggattgcgaccttaggatgggggccttcaccttaggagttaacagggttgctcgtgccaccctcttgagaggctgggaggcatgagaccattgaccgcgcattacagattcgacaggtgcattcaataattcgtgtccaacaacgttggagcattagtgtctgatacgggaaaattcatcagaaacgaccggcttggaatgagcccgttgaaataacagtctgggtgttgtgcttgttgatcctgagttaccaatggttggttcaccagttcttggtgatgattagttaaaaaaaaaaaaaaaacgttttattgtattttagaaagcttatttggcctcgacagagttactgtaccttttcatttttaatgaaattctggtctggggtttgaagttcccagatgtaaatgatttgcaaaaaattgcagaagggtttcaaataaaccagttatcatccacacagtttaaagcattgctacgactgagtttctcataagccgctaagcaacctaataattcagtaaaagcgaacgcactaaagttatcatcctgcgctttgcgtttaacaatcgtgatagaaatgcttcaggtcaggtagccaagttttggagatacgggtttgacgccgctagtgtctggagaaggcaacgcgagcaaagcaatctctggatcatctgaaatctcgtcagcgctaactgggtacagtttgcgaggccggccgtgccgcttcagcgtcgctgatgctttcctgccgccctggtcagcaactgaagccggagtacgacagccagcggcaaccatcggtgccaacttgggcgatgcagatgagaccttacagcctagcttcttgccaggtgtaagagcagagcggccaccagtagccaccgcgactgatttgcgttgccggcgacggcccttgggtgtagctgacagatccttcgcctctgtgttggtcaccagggccaggtcgagaggctgcccaccatcgaggatcaccagtgccagctcacgcggtggctcatgctcctcactgttatcattcttgcctgcgacgagtgcttcgctggagatgtcagcggtcgtggccatcccctgcgcgcgaagccggcgacggcgcttgggcttcaaggatggtgctcggctttcgtcctcgtctgcaacagcaaccggtgacattagaacagaacccttggcagcagcggctcgtgtggaagaagagcctgcatgtggtgttatccactgagcccccgcgctgccatccttcctgccttcaggcggtgtcgaaggatagccatccttcggcggcctgccccggccatgcttggcatctaccaccaaagacccaacggaagccgggttgcacgagccggcctcagtctgctccaccgggagctcctcggcagcgttctcctctgggttgcgctcgaaccgccccgcagcgtttcgcaggaagaatccctcggcgacgtgcttgccgaggtagtgccggaggaacctatcgtgcgcggggggcacgccagggtgcctggcgcggatgaaggccgagatggagtcctcctccgagccgccgtcctcagccagctcgtcaattgcctcgccgatcatccagcaatagggtgggtgatccggcgtgtgttggcgaggcgtccgcgcggccgccgacggctgccccttctcatccgtggccttcccccgcttcgccgcttgccccgcgtccaccattgctgggtagggatgcggaataccggtctcctgctgttgttcgggtgggagaa

SEQ ID NO: 2283 - DNA, 1116 bp, Zea mays
aagttattaaagtggtagcattttttaggatttaaatttgtatggatgttctaattttcatgtattggagaaatgtttttgagagttgttaaagatgctctaacatcgaaccacacacgtaaactatcttgcaaccatcctgacacaatttcagcaatatgtttttatgaaaaagtgtggctaccaaatgcatgtttaacgaaatgggcttcctgtgaccggagcgcatcaggctaggctgctggggattcgcatgaccagctgttgaagccgaacacaaattgttccggcttcacgcataaacaatgctggtcaaaatatgtttcatgaataggagaaagcaaaaatggatgaactctcgtgtgagtctttttagtatatataagtaaatgatgaagcagctagagaaaaatgcgctacgacggtttgtagtttagtctactcaagccatggtgttgaaacttgatacttgtctcaatgagactttggagtgaaccaaatgagcttatattcctatatgactactagctagaaattaagagcgctaatactatattaaatgtgtaccatattcatcatttgctcgttcgaggagaaatttaaagtcttactagtgtcactactgatattttatttattctaaaatattaagaataatagtaaaagtgtgtcttgtagaacacattataatatctatttttagatgtgtgttattagagtggtctaccgtgtgttgttattgccgttaaatcctgaccatattgaatcctaaagctaaaaaggtcgaacatcagcgatggagtggaagagcaacgacatcccctccggcgttgttagccccgtgacgtcggaaggtgcaagggagtcttcgacgtcgagcaagaagatgagcagcgaggagcaacaacaagagagcgaaggccgtcatcgcacggaaggcatgccaacgttcgtttgaatgggctcaagtgggccgtgtaatacttaagtgggccgctgggtcccgatgctgatataggtcagtctgtgagaacattaaggccatcgaataacaaaatagcaaatccatttttgccgctactgctatcttcttatttcccacgacatctcttctcc

SEQ ID NO: 2284 - DNA, 837 bp, Zea mays
  misc_feature (673)..(673): n is a, c, g, or t
  misc_feature (698)..(698): n is a, c, g, or t
  misc_feature (720)..(720): n is a, c, g, or t
  misc_feature (743)..(744): n is a, c, g, or t
  misc_feature (761)..(762): n is a, c, g, or t
  misc_feature (768)..(768): n is a, c, g, or t
  misc_feature (785)..(785): n is a, c, g, or t
  misc_feature (806)..(806): n is a, c, g, or t
  misc_feature (826)..(826): n is a, c, g, or t
gaggcatgcgctacggcagtttgtagtttagtctaatcaagccatggtgttgaaacttgaccatacttgtctcaatgagactttggagtgaaccaaatgagcttatgttcttatatgactactagctagaagttagagcctagatgatggctgcttctgttggcgtgaaagctcgagtgctcctaaatggtcgtcgtattagctgatacgacatcgacccgatgcaatagataatattgtttacacgcgtgagtccaaaattgttggctttgggtcggagcagttaacgcgagaagtgtattttatcacttctgagtgcaaccttttttttattatttttccgagcttctgcctcttgcatatgttgtagattctcgccgagaagggagtagtagtattacctgatatctatgctaattcaggtggtgtggtcgttagctactttaattgagtgggttcagaacattcaaggtttcatgtgggccgaggagaaagtggacgatgaactagaaaaggacatgagcagtgcttttcaacacatgaaggccatgtgcaaatctttggtgctgccgaagtgtgtcgtgacattggaattgcaggtctagaaaaacaagctcattagatttctgaaaaaacattagaagttattagattggtagcatttttttaagantttaaaattttatagaagtcatcanttttcggtttattggaagaaantatttttggaagttgaaaagatnngctctaacatccaaccnnacgcanaactatcttgcaaccanctctaacacgatttcggtaantatgtttttatgatacgagntatatgttttt

SEQ ID NO: 2285 - DNA, 1871 bp, Zea mays
cccacgcgtccgcccactcgtccgcccacgtttccgccaatctttaccccaggacaatgtttttatcatatcaaacccaaagtcaaaataccctgtgctgcagctggaccttagattgatatcagatcttgttgttgttatcgtgtctgctacatgtggtggaatcgcttttgcttgccttgggcaacctgtgattacaggttatctacttgcaggatctataattgggcctggaggttttagctttgtcaatgaaatggtgcaagttgaaacggtagctcagtttggtgtgatatttctcctgtttgcattgggacttgagttttctactgcaaaacttcgagttgttcgtgctgttgctgttctcggaggaatgctccaaattatgctgttcatgtttctttgtggtattttggctacactatgtggaggcaaaacaaaagaaggtgtttttgttggtgtgcttctctccatgtcttcaacagctgtggttttaaagtttctgatggaaagaaatagtatcaatgctcttcatggccaagttacagttgggacgcttatattgcaggattgtgctgttggtctgctgtttgcgcttcttccaattttgagtggtacatctggccttcttcacggagttgcatcaatgacgaagtcgttggtggtattgataacgttcctgaccattctctctatcctctcccgcacgggcgttccttggtttcttaaactgatgataagtctgtcatcacagacaaatgaactataccagctggcagcggttgcgttctgcttgttatttgcttggtgtagtgataagctgggcctgagtctcgagttgggttcatttgcagctggagtaatgatatcaacaacagaccttgcgcaacatactcttgaacaaatcgaacctatccgcaacttattcgctgctcttttccttgccagcattgggatgctaattaatgtccatttcttgtggaaccatgtggatatactccttgcagcggtaattttggtgatcaccgtaaagacatttattgttgctattgtcgtaaaagggtttgggtatagcaacaaaacatctcttcttgtcggcatgtctcttgcacaaataggagagtttgcttttgttctcctaagccgtgcttcaagtatccatctcatcgagggcaagctatacctgcttcttcttggaaccactgcactcagtttggtgacaacccctctgctattcaaaatgatcccagcagtggtccacctcggggttcttttgagatggttttctgtcgataccaatcaggtggagctgggcctaaaaaatgatgtcctccgcattgatagcggcaagcgcataaatctgatagtccaaggctcacatgactcatgacacatggcacactgcaagctactttttttgtatggcttgagtttacaagctctgtaaagtgttttcacctgtattgaagagtttgtagcagatatacaagggtggaggcaagagaactcaactcagatcttgctcatagggtgagatcaatcctcccccatcatggagactgcatgggcagttgggtttgccgtttttgagagcagtgtgtctaggatgattggtggagtgagtggctgtcgactccaaatgagggtctcgtgtaacataagaatgtatgatggttaattgattggatcagcatgataggatctaggcgtgatcgttatgccattgtatcctttcggcaaaactgtgtatcctcgcaacacgaaagtgtgtacaacagtatccatcagatcacgaatttcgttatgtaaccgaaaaaaaaaaaaaaaacatgattttttttcacgcgaggcttccaaaaaaaaaaaaaaaa

SEQ ID NO: 2286 - DNA, 1600 bp, Zea mays
gcacgagaccattacctagaacatcctaatcaaaagaccaaaaacaaaacaaaacggaaatagctcgcggtcgcggtttcttgcgccactccggctcagccgccgcccgccacccgccacagccgccgcagacgagatgggcatcaagggtttgacgaaactgctggcggacaatgcgcccaaggcgatgaaggagcagaagttcgagagctacttcggccgcaaaatcgccgtcgacgccagcatgagcatctaccagttcctgatagtagttggaaggacaggcatggaaactctcacaaatgaagctggtgaagtcactagtcatttgcaaggaatgttcaaccggacaataagattactggaagcgggaatcaagccagtttatgtttttgatggcaagcctcctgatatgaagaaacaagaacttgctaaaagatactcaaaaagagatgatgcaaccaaagatctgactgaggcagtagaggtaggagataaagatgcgattgaaaaattgagcaagaggactgtaaaggtcacaaggcaacacaacgaagattgtaaacgactattaagacttatgggggttcctgttgtagaggcaccttctgaagcagaagcagaatgtgcagccctttgcataaacgataaggtgttcgctgttgcttcagaagatatggactcccttacttttggggctccacggttccttcgtcatttaatggatccaagttccaagaaaatacctgtgatggaatttgatgttgccaaggttttggaggagcttgaactcaccatggaccagttcattgatttgtgcatcctgtgtggatgtgactattgtgatagcatcaaaggtatcggggggcaaacagctctgaaacttattcgtcaacatgggtccatagaaagcatcttggagaatcttaataaagacagatatcaaattcctgaggactggccttaccaagaagctcgacgcttgttcaaggagcctaatgtcacattggatattcctgagctaaaatggactgcacctgatgaggagggtctcataagtttcctggtaaaagataatggtttcaatgaagatcgggtgacaaaggccatagagaagatcaaatctgccaagaataaatcgtcgcaaggaagactcgagtcctttttcaagccaactgccaccacatcagcaccgctaaaacggaaggagacttcggataaaacaagcaaggcagctgcgaacaagaaaacaaaggctggtggaaagaagaaataatcttggatgcttgatgtacaactacgactacgaaagcagcggtggcgtgatcacttcgcctagattatttaactccctgttttaactcagacctttggtgaaagtttgcccatgtttcaagctggggtaagttagttgtgtttgaagagattggtgtaccaagtaacaaaacttatcgctgtttttttacttcttgtcctttgaagtatgtatgccagtcctcgtccttttaagtatctgtgttgcaacaaaaatttaaggccttgtttagatgcatagaaaaaaaaaaaaatttagtttaaatttcaaaaaaaaaaaaaaaaa

SEQ ID NO: 2287 - DNA, 876 bp, Zea mays
ttttttttttttttttttttttatatcaagatcgataaaatcatattatacaacgaacatgtcaaactctctaatacaacgaatatgtcaaatactctacatgtcagatgagaggggagtaattacaaataggtaaatagagcattctgaagaaaaggcaatgaccattatttggatgaagtgactttcccctattgcttgcaatctatgaatgacgatcagctgtcgccttcagtgaatacccctaaagaaaccacgtggcagttggtctcaaacttgtcgaggagatctgacgcctgcgcgggagagacaacacaaggccagtcccgtccgcgagcaggaaggcagatcgagatcaaaagggaggcgaagaggggaggattgggggaactgatttcctggtagaagaggtggcggtggaagttgagcgccgtgtggtaaagcaggtgcacccacttcttctgcgccgcccgccgagccaggccaggtacgctgccatcgatgccatagacctcgtcgccactgctcctttctctctctcctctcgctacagcggtcgagctggagaataggaatcagattcggacgggatccctccaccaagttggtctacgcggcggtggcgtggcagatctgctccaagccgtgaaaaccggcggagctgcgtgctgcggcgacgggaggagggagggggaggcagagggagctggcgaggtcccggcggccccgggcggctggtggaggaggcgagcgaagcaatcacaaagaagaaagcgcagtgcagcacgggacggagggagagggcaccagacacgacatctcccacaactccagtggataaattttttagatccgatcccgccactcgtccgcagg

SEQ ID NO: 2288 - DNA, 2992 bp, Zea mays
cgtgctggcctactctaagatccgcgggcgcgtcgtggcggctcctccgcgtcccgcctccgaggccgcgggcggcgtcaggctgatcggggtggcgcgcggcgccggggagcgccccatcgtattcgtgcctctcaaggtcacaccgcctcgcgctcgtctcctctccttgtcgcttcgattcgttcccctcccgctcccgctcgccctcgccatgaatgatgtcgcctgaatctggttctgggggtttcggtagctactacttggccggcttgccgcctcttcttctttgcgttgctgctctgccattttcctattgtagtagcggcgccatgctgcttggatgaagcaggctgcccaagtcctccactgctgggaatagaatcggaatgtgtgttgcacttgcctgctgtgcagcctcctaaactgactggccacgaatttcagctcttctgcacatagggcaaacgcctcaacctcggtgagtgcctggacagtcctgctcgaaactggaaaattagcagctgacttgggatccaatgcccaagtgagcaactcatcgccacagaacgacccttcctttagctgaaccttgttaaagaacccactccttccaccatcagtggttacactctccaaacaaccatgaagaataaagtgcatctcatccaccgggtcaccttccctcaaaatgaactcattttctgtgtagagtgcaggtcttaaccgctcacatattgcatccaacaatcgttcatccatattttcaaacaaaggcacccttttcactaagcccaaacaaagatgccgcttgatatccctcctaagatcttttggaagagtttgaaccaaagtttcttcgtctactcccctggtttccaaccaccgataacgttcatacttcctcaccctatgtctgatgtccggtggcagtgaacggtgatgcatccactgctcagcatcgcgtttcttaactctcatctcttcaaggcgtatagcaacagattgtaggtagctctgcatgttaccaatgaggagagcaaaaagaattagtccaaggacacatattgctatagagaacaggacttctccagggtatgtgcttgtcaaaagcccttgaccaagtgtacttagattttgcaatccccaccagaagcaataacataattttgagatgaaatttcctggactaagtattttagagaccagtgcttgctcataaatgccaaagttgaaaggattgtcttgaccgccattgcacatgttgaatacttgggcactattattcgtaagccaactatcatagctgccatgatgatgattattgcaatacaagtagctgctattacatcccaagccaaagttgggatcgtcacagtatagatgccagcaatcatcttcacgttctatggttaaaaagtaccataaagtaccaacattctgcccagccagcataataccatagaagataaccagcagcacaagtcatgggtgatatgaaaacactaaatgaaaattacaagaggctgtttcaatgaacaaatggaaactaatgaattttcctgtgccatagatatcatgtataaaaggtacagcataagccatgtgaaacataatttctgatataaacttatggaaaacaaccatgatgtatagtgctgaaagcgagtatttcttttgcataagtcaacaaaggaaaatctttgaagatcaattaaacaaagatgatgctgtttaaaatatatacaaaacatctcattttacatctaagaactaacttaatggctgaaggattcaaagtttcaaacagtttcaactggactatgtatcacattttttaacaaagagtttaaagtcatcagtaatttagaatatcagagaacctcaggtacatatcactgatattgacatattgtagtcaaaagatcgacctcgttactgctgcctgcttctgatgagtaaagaaaaggacagacccagtgctagcggctcccacatgagtggggtctagaaaaagaatagccgaggcaagtcttaccccgtgcgttttgcaaagaggctgtgccgacctaggacctttgtggctcagtggaaaggcttctcaccactgtgccaggcctgtccttcactaatgagtaaagaatgtggaaaatataattgatagtacatagcttatggaagcacttacatgcccagccagcataaaccatagaagataataagcagcaccagcccaagcagtttcaataaaaacaccagctgtccttttcaaatctgtgatcacagggaatattcgaagcaaccttggaatgtattggatcaaaacaacccaaaccagtgcagttttcgtagtcagtacatctgggccatctggaatatggaggtatctccatacaacaatctgtcaaccaccaacagatagtttaaggtaagctgggaaattattagaaccaagaaagcttctgaatgtgaacaagaatataataagttcagctagcaattgggatagtcttatgcatacatataacagtgtcaaggcttaatcaagtaacactgcacaaggacgcaaggtagtgaagcaataatttacctttcagatatgaactaaatgcatattgcatagaaatgtaaatattctttgttgatgaagaggaaggagattaaaggtgactgtaacttaatgtagtaatacctccattctaaattgtaatatgttttggcttttctaggtacatagattttattatgcatttagatatacactatgtctaaatacatagtaaaagcaatgtatctagaaaactcaaaacatctgacactttggaacggaggtactccctccgtttcgttttagttgtcgctggatagtgcaaaattgaactatccagcgacaactaaaaagaaacggagggagtagtaaattacagtgaggtatacattcagtgcgcacatgaacaattagattgtgggaattcaaaatttggagaacaaa

SEQ ID NO: 2289 - DNA, 3096 bp, Zea mays
  misc_feature (40)..(40): n is a, c, g, or t
gtgaaataaaaaagagtctagtgaaataaagacttgctcnaaatccagacacacacgcatcaattagatttttattcagcttttccctccccctctctatctctgtgtatgtgtgtgtctcagacaattttttgcttggcttttgtatattacagaagcagcactcacgctcatctctctcgggtatgactcagcagtaagcaccacatcccttaatgcgatgtgaagccgcatcccctatctctctctcctccgtcggacacagagccataacctccaattcaccatacgagttagccattgcctcatctgtttcggtactcggtaggggcggaacgtggcagggcttgggcgctcgacctaggcaggggacagggcacatctcagcgtggcagagccggccgctcggcagacctcgggacgtggcgtcggggaggagctcaatggtgttgtgcggcgcgaaagcagaacagacggagctcagctaacttgggcagcgctggtgactcgggaggctagagatggatgtgacgacaccacaacggtgctgagtcttggcgtctcaacggaggcattttaacaattaaacatgatagaaaaaacttgttctagctcacaatcacggcaccacatagagaccatcatcaccaaatgtaactcatgaattcactccccactaacagacaaatgggaagaggaggtgtgcgaaaagggatcagcaggaggaggccttaccacgtggcagttggtctcaaacttgtcgaggagatctgacgcctgcgcgggagagacaacacaaggccagtcccgtccgcgagcaggaaggcagatcgagatcaaaagggaggcgaagaggggaggattgggggaactgatttcctggtagaagaggtggcggtggaagttgagcgccgtgtggtaaagcaggtgcacccacttcttctgcgccgcccgccgagccaggccaggtacgctgccatcgatgccatagacctcgtcgccactgctcctttctctctctcctctcgctacagcggtcgagctggagaataggaatcagattcggacgggatccctccaccaagttggtctacgcggcggtggcgtggcagatctgctccaagccgtgaaaaccggcggagctgcgtgctgcggcgacgggaggagggagggggaggcagagggagctggcgaggtagtttgggctggtgtctggtggtggaggaggcgagcgaagcaatcacaaagaagaaagcgcagtgcagcacgggacggagggagagggcaccagacacgacatctcccacaactccagtggataaattttttagatccgatcccgccactcgtccgcaggtgacactgatgccgtacgcccgtaccccgccgccgcgccgctttttttttttctattcaggcaaaaatttaatacatttgcatttccatagacgtcaagcaggatatacctccgttatggtctgtctgtgcgtggttacaaacctttacaaacactatcttcttcagctgtcgttgaatcttgtacagaatctacagatgaggtaaagtacaattacaagcgagtacagtgtgattgtctcgttagtcagcatcatcgacaccaaaatctggttctgggggtttcggtagcctgacaatggtagggacagccttgcttcttagcctgtgaacccctcgcatggcgttggcagcgaaacgagatgcatagatagtcgccccaaggctagggtggctactacttggccggcttgccgcctcttcttctttgcgccgctgctccgccatcttcctcttgtagtagcggcgccatgctgcttggatgaagcaggctgcccaggtcctccactgctgggaatagaatcggaatgtgtgctgcacttgcctgctgtgcagcctcctgaactgactggccacgaatttcagctcttctgcacatagggcaaacgcctcaacctcggtgagtgcctggacagtcctgctcgaaactggaaaattagcagctgacttgggatccaatgcccaagtgagcaactcatcgccacagaacgacccttcctttagctgaaccttgttaaagaacccactccgtccaccatcagtggttacactctccaaacaaccatgaagaataaagtgcatctcatccaccgggtcaccttccctcaaaatgaactcattttctgtgtagagtgcaggtcttaaccgctcacatattgcatccaacaatcgttcatccatattttcaaacaaaggcacctatcagtagcaaaaacaaaatgaggatattaaataactggaaatcactaaacaaagcacaaaacaatagtttgagcaaccagaacgtacccttttcactaagcccaaacaaagatgccgcttgatatccctcctaagatcttttggaagagtttgaaccaaagtttcttcgtctactcccctggtttccaaccaccgataacgttcatacttcctcaccctatgtctgatgtccagtggcagtgaacggtgatgcatccactgctcagcatcgcgtttcttaactctcatctcttcaaggcgtatagcaacagattgtaggtagctctatataaatccaacttggaatcaagcaaagaaagaggaaaaggcttaaaagaacaaaagggaaacaatatatcactctacctgcatgttaccaatgaggagagcaaaaagaattagtccaaggacacatattgctatagagaacaggacttctccagggtatgtgcttgtcaaaagcccttgaccaagtgtactgtcgaatggaaatggaaattaagatggcaggcataacacgctctgaagtagaacatataatgatgacagccaatcttgtgaacctacaacagctagaatgcatatttcaacagccaagtgcaggaacccaattcacagaacaacctaaatgtgaagtcctgaacctaagaagtggagctgcaaacccatcagtttctggttctaacccaagattgaccactcatctgtggttcactcttgtgtcagcattgatgataccattctgttagacataaacaacatataaccaccactttccag

SEQ ID NO: 2290 - DNA, 2691 bp, Zea mays
tagcgtggtcgcggccgaggtacttatcattcatgttcctgtgcgactaaggaatttcgatataaaggattcatcctactttggtaagaagtcagataggggagtcagtcttattgcttctctttgtgaaaaacatcatacctcagaagatgagttgagcaaagcactggagaagacaaatactctcgtaatggatattctgaaaaagaagccatgcccagctacttcagcatgccaacaggataatttgtctttcatcgatccagaaggcttgacagtttttaaggatttgcttcagggagactcattgaaaccaagtctgataatcctggaaaaggaatatgaaaatgcaattaacacaaaaggtgagctagatgagcgcatgtttgctaatgatgaggacagtttacttggtagtggaagcctttcaggtggagccattaatttaccaggcacaaagagaaagtatgatgttatggcctcacctgcaaaatcaatatcaagcccaaatccaatgtctcctccacgcttttgtctatctcctaaaggaaacggcttttgcaactcaaagatggctcctagcactccagtgagcacagccatgacaactgccaagtggcttcggagtacagtatctccccttccatcaagaccttctggggaactgttgcgcttcttctcggcctgtgacaaggatctaacagatgacattgcacacagagctgggattatacttggagccatattcacgagcagttcttttggtgaacgaatctgtactagtatgcgaagcgcaagtaggatggatgctatctggacagagcaaagaaaaatggaagctcttaagctatattatagggtcctcgaatctatgtgtagggctggggcaccgcgcggccggccgggcgaccgtccgtcacttttgatctaatgaacgtttccatcggtgtatgattgcatgttctgcggagttagttcttgcaactcacaagactgtcactatgatgttcccagctgtgctggagaagactggcattacagcatttgacttgagtaaagtcatagagggttttgttcggcatgaagatacactcccaagagagttaaagcgccatctgaattctcttgaggaacggcttctggaaagcatggcatgggagaaagggtcatcaatgtacaattccttaatcgttgcgaggccggcactgtctgtagaaataagccggttaggtttactggctgaaccaatgccatcgcttgatgcaattgcagcacatcataacatctcattgggtggcctgccacctcttcccttccagaaacaggagcgtttgcaagacaaagatgaagtcaggtctcccaaaagggcatgcactgagaggagaaacgtgctggtggacagcaattcattgcggtcaccagtgaaggatattattaaaccaaagttaccacctctccaatcagcttttgcaagtccaacaaggccgaatcctgcagcgggaggcgaaacgtgtgcagagacaggaataggcgtgttctttagcaagatatcgaagctcgcagccattagaatcagaagtctctgtgaaagactgcagcttccccagcaagttctggaacgggtgtattcccttgtgcagcaaatccttagccaacagactggccttttcttcaacaggcacattgaccagatcatactatgcagcatatatggagttgccaagatctctcaactggaactttcattcaaggagattattttcggctacaggaaacaacctcagtgcaagccacaagttttccgaagcgtctatgttcattggcccccaagaagccgtaacgggaaaacaggagaagaccacgtcgacatcatcactttctacaacgaagtattcattcctgccgtcaagtccttgttggtggaggtagggcctggcgccagcgccagtccaaagaagaaagaagaggaaaaaggtcctgctgatgtaggtccattcccagaatctccccggctggctcggttcccgaacctccccgacatgtctccaaagaaggtttctgctacccataacgtgtacgtctcaccgctacggtcatcgaagatggacactcttctgtccccgagctccaagagctactacgcgtgcgtcggcgagagcacctacgcgttccagagcccctccaaggacctgaaggctatcaacaaccgcctaaacagtgtgtccggcgggaagaaagtcagcggccggctgaacttcgacgtcgtcagcgatctggtcgtggccagtagcctcggcagtgaccgtgacgccaagcctgcggccgatcctgccaagacgacgccggtgaagtgcgagccatctgactcgtgatcgtcgtcgactctgacgaggcccttgttatagattgttatgtttcagatactcgtgagttagtagatggtaactagacgaggaggcccttgtttctgtttgcgtcttttctttttttgacgtgggaaacatctctgcgagcagctctacgttgtgtaaaatatatataaagaaagctgccccgatggctccccttaacccgactcgcgttgtagggagatgacaagcaccatggccatgtaacttcatagaggttttgagagagttgtgtaaaaatgcaagatggtcgttgaggcaacacaacagcggatcttttgtt

SEQ ID NO: 2291 - DNA, 2738 bp, Zea mays
caaatactctcatactggatattttgaaaaagaagccatggacagctacttcagcatgccaacaggataatttgactttcattgatccagggaggctcattgaaatcaagtcttctaatcctggaaaaagaatatgaaaatgcaattaacacaagaggcgagctagatgagcgcatgtttgctaatgatgaggacagtttacttggcagtggaagcctttcaggtggagccattaatttaccaggcacaaagagaaagtatgatgttatggcctcacctgcaaaatcaatatcaagcccaaatccaatgtctcctccacgtttttgtctatctcctaaaggaaacagcttttgcaactcaaagatggctcctatcactccagtgagcacagccatgacaactgccaagtggcttcggagtacagtatctccgcttccatcaaaaccttctggggaactattgcgcttcttctcagcatgtgataaggatgtaacagatgacattgtacacagagctgggattatacttggagccatattcacgagcagttcttttggtgaacgaatctgtactagtatgcgaagcgcaagtaggatggatgctatctggacagagcaaagaaaaatggaagctcttaagctatattatagggtcctcgaatctatgtgtagggcagagtcacagatcttgagtgggaacaatcttacatcacttttgtctaatgaacgtttccatcggtgtatgattgcatgttctgcggagttagttcttgcaactcacaagactgtcactttgatgttcccagctgtgttggagaagactggcattacagcctttgacttgagtaaagtcatagagggttttgttcggcatgaagatacactccccagagagttaaagcgccatctgttttctcttgaggaacggcttctggaaagcatggcatgggagaaagggtcatcaatgtacaattctttgattgttgctaggccagtactatctatcgaaataaatcggttaggtttactggctgaaccgatgccatcacttgatgcaattgcagcacatcataatatctcaatgggtggcctgccgcctcttcccttccagaaacaggagcgtttgcaaagtatcactttatcagccactatcagcataatgcctattacatgttcctgaagtgttaaaagcagtatttctttgtttcttttacacttttcaatcacgcgaataagtgattgaaccccctttttggtaattgtgtttcctgtagataaagatgaaatcaggtctcccaaaagggcgtgcactgagaggagacatgtgccggtggacagcaattcatttcgatcgccagtgaaggacagtattaaattgaagctaccacctcctcttcaatcagcttttgcaagtccaacaagaccgaatcctgcagcaggaggtgaaacatgcgcagagacaggaatagctgtgttctttagcaagatatcaaaacttgcagccattagaatcagaagtctctgtgaaagactgcaactttctcagcaagttctggagcgagtatattcccttgtccagcaaatccttagccaacagactggtctcttcttccgcaggcacattgatcagatcatactatgcagcatatatggagttgccaagatctctcaactgcaactttcattcaaggagattgtttttgcgtataggaaacaacctcaatgcaagccacaagtttttcgaagtgtttatgttcattggcccccaacaagccataatgggaaaacaggagaagatcatgttgatattatcactttctacaatgaagtatttattcctgctgtcaagcctttgttagtggaggttggacctggtgctagtccaaagaggaaagaagagggaaaagtaggtccatacccagaatcccctcggctagctcggtttccgaaccttcctgacatgtctccaaagaaggtttctgctactcataatgtatatgtctcgccactacgatcatcaaagatggatactttactctcaccaagcccaaagagctattatgcatgtgtaggcgagagtacctatgcgttccaaagcccctccaaggacctgaaggctatcaacaaccgcctaaatagtgggaagaaagttagcggacgattgaacttcgacattgtcagcgatctggtcgtcgccagtagcctcaacggcgttcaaaatgccaagcccgcagccacggaagtggttcccaccaagacacctgtgaagtgcgagccatctgaatcgtgatctactctgatgctgcatcaccaatccagtgtaacttattataaatggttaggtgtcagatgctctgatttaggagtgtttgaatgcactagagataatagttagttagctaaaaaatgttagtggaattagctagctaactattacctaatttgctaaaagtagttgatagctaaaatattagctagactgtttagatgtctcaattttagcagctaactattagttctagtgtattcaaacattcccttagatattaggtggccttatttctgtttgtatttttgacatgtaaacatctttgtgagcagctctaccatctgtaaaatataagaaagctgctctaagagctcccataacccaactctctttgtaagagatagataagtacgatagtcatgtaactttataagttttgaaaaggtctgtaaatacaaatgatcattgtc

SEQ ID NO: 2292 - DNA, 1964 bp, Zea mays
ctgtgcggcgctcaggcggcccgcggcgcatttcctcatccattccaatcaatcggaccgacaccggctaaccctagcttctgtttggctgttgccttgcgggtggcggctgctttggtgcgctgcgcagtgcgctccgtccgtccgtcgaccggaaggccgtcccctggcccctgctcgtcgtcttcctcgggcgctcgtcttcctccgaacgcgcgcgggccgccgacctgcttgttctcctggaggagcgcgcccggcgggcaggcgacgcagtccagcggcgggttgaggaagaaggcgagcgaccggtggatccccgtccagccgtcccctgctcctcttcctcgggtcgggcgctcgtcatccactcttcctccagccctccatctgatccccgtacgaccgtcccctgctcgtcttcctggtgctcggctgctccagtgctcggcccctgctgcagtgctgctcggtcgcgtcggcacctgctgcagatctgctcgacctcggctgctcggcttcctgttccttctgctacaaattcatagtcactgatggggaaggcaaagcgtgcctcgatcttcatcaggctggtttctgcagccggcactggattcttctacgtgaagcgcaagaatcctcgtcgcatcaccgagaagcttgagtttagaaagtatgatccccgtgtgaacaagcatgttctgtttaccgaagcgaagatgaagtgagatcttgtttctccacaatgcagaactgtaataagttgtcaaccttttgcgaccagaaacctttatgccgttattagacagatgattaacgatcctatgtgtttttcctgctccaatgagctgcaagcagcagatggctagtgttttgtcaaaaaaaaaaaaaaaaagccgcctgaaatctggactcccatctttttctttcacaccgccatgttttgtgaaacgatgccatgttttcctctgagccggcggcgaaccgtcgagatgctcaactaaaaaccaaacgaagctgttggctctgaactgagtgctggattacttattctgttctggaaattacagaaacctggttttattggagtcgcacaacggttgtggcaaacacaatgtccaattagcaattttagattgtgattgcaagaagtcgaatgaaagtattgatcaatccctcacataatattcgaatttaataacaggggatgaggtaagttaaccagtctactaactgtcagtgtcctcaaacaaatggaattgccccatcattctgagcactccattcctgcaagcactgcctagaggtaggatcgtagtcccacagcccagataccatttgccggtggaccttttttctcctcttgtttatccagttgttgtgaatgatgaaacagccaagctctttgcaggttgctcgtacatcacgcttctcccatagacccttgtaggcaccattggggaacaagtcccgatccaagaacacaacggtcaggttcgtgttgggctccaagcatctgtcttcaccgatccggtttgttccgttctccccacacaagacatcgtagaaactcggctgctcagataggcctgaactggctgcgtggtttactatcatctccattgcaatgatggtggcgttgtctgagcgagcaaagtagaatcctgagttcagtcggcgtggcaagtttattggtcctgtaaacagacagcaataaatgtatttgcaggttgaagtttgtgtcacatggacatttgctaggaacttcttgtcatgtacattgaaatttactctgggttcagatgttggtgtgagttgtgaagagaagaaaataggaagaaacataagaaaatgggatccaaacttttacctgtctcattgtattcatcagattgtgctccgaatgtagcaagaccaagagagtacaggagtggcatcggattgccaaaccaataaacatcaac

SEQ ID NO: 2293 - DNA, 986 bp, Zea mays
  misc_feature (948)..(948): n is a, c, g, or t
gccggccgttccggggaccgactctcggcaacgatttcctcatccattccaatcaatcggatcgacaccggctaaccctagcttctgtttggctgttgcctggcgggtggcggctgctttggtgcgctgcgcagtgcgctccgtccgtcgaccggccggccgtcccctggcccctgctcgtcgtcttcctcgggcgctcgtcttcctccgaacgcgcgcgggccgccgacctgcttgttctcctggagaagcgcgcccggcgggcaggcgacgcagtccagcggcgggttgaggaagaaggcgagcgaccggcggatccccgtccagccgtcccctgctcgtcttcctcgggccgagcgctcgtcatccactcttcctccagccctccatcggatccccgtccgaccgtccccggctcgtcttcctggtgctcggctgctccagtgctcctggctgctccagtgctcggcccctgctgcagtgctgctcggtcgcgtcggcacctgctgcagatctgctcgacctcggctgcttggcttcctgttccttctgctacaaattcatagtcactgatggggaaggcaaagcgtgcctcgatcttcatcaggctggtttctgcagccggcactggattcttctacgtgaagcgcaagaatcctcgtcgcatcaccgagaagcttgagtttagaaagtatgatccccgtgtgaacaagcatgttctgtttaccgaagcgaagatgaagtgaggtcttgtttctccacaatgcagaactgtaataagttgtcaaccttttgcaaccagaaacctctatgccgttattagacaaatgattaacgatcctatgtgtttttcctgctccaatgagctgcaagcagcagatggctagtgtttttatcattttgtgtgggaaactaccaatgaaatctggactccaccctttcctttcntttcacaccgccatgttttagtgaaacgatgccatgtt

SEQ ID NO: 2294 - DNA, 1032 bp, Zea mays
cattgggtacctcgaggccggccggggtcacagccggccgggcggacaggcacaaaccctaatccccacctgaccccgcagcctcattccacctaggcgcatcggcgacggcggcgttgcacgccctggtccatctaccgacctcgcctacccgcggtcctcgtcgttcacaggcggcgcgccctcgtccaggtccagtcgtcctcgttcacgaaggcggcctcgtccagcctactgttccttctgctacaaattcatagtcactgatggggaaggcaaagcgtgcctcgatcttcatcaggctggtttctgcagccggcactggattcttctacgtgaagcgcaagaatcctcgtcgcatcaccgagaagcttgagtttagaaagtatgatccccgtgtgaacaagcatgttctgtttaccgaagcgaagatgaagtgagatcttgtttctccacaatgcagaactggaataagttgtcaaccttttgcaaccagaaacctctatgccgttattagacaaatgattaacgatcctatgtgtttttcttgctccaatgagctgcaagcagcagatggctagtctttttctttcacgccgccatgttttgtgaaacgatgccatattttcctctgagccggcggcgaaccgtcgagatgctcaactaaaaaccaaacgaagctgttgactctgaactgagtgctggattacttatgctgttctggaaattacagaaacctggttttattggagtcgcacaacggttgtggcaaacacaatgtccaattagcaattttagattgtgattgcaggaagtcgaatgaaagcattgatcaatccctcacataatattcgaatttaataacaggggatgaggtaagttaaccagtctactaactgtcagtgtcctcaaacaaatggaattgccccatcattctgagcactccattcctgcaagcactgcctagagctaggatcgtagtcccacagcccagataccatttgccggtggaccttttttctcctcttgtta

SEQ ID NO: 2295 - DNA, 1086 bp, Zea mays
ttgggctccgcggggcccggccgggatttcctcatccatttccatcaatcggaccgacaccggctaaccctagcttctgtttggctgttgccttgcgggtggcggctgctttggtgcgctgcgcagtgcgctccgtccgtccgtcgaccggaaggccgtcccctggcccctgctcgtcgtcttcctcgggcgctcgtcttcctccgaacgcgcgcgggccgccgacctgcttgttctcctggaggagcgcgcccggcgggcaggcgacgcagtccagcggcgggttgaggaagaaggcgagcgaccggtggatccccgtccagccgtcccctgctcctcttcctcgggtcgggcgctcgtcatccactcttcctccagccctccatctgatccccgtacgaccgtcccctgctcgtcttcctggtgctcggctgctccagtgctcggcccctgctgcagtgctgctcggtcgcgtcggcacctgctgcagatctgctcgacctcggctgctcggcttcctggtaacctggttcctgctgaagtgctgattctagagtctgctgcgtacgtttagtagtatcagttccttctgctacaaattcatagtcactgatggggaaggcaaagcgtgcctcgatcttcatcaggctggtttctgcagccggcactggattcttctacgtgaagcgcaagaatcctcgtcgcatcaccgagaagcttgagtttagaaagtatgatccccgtgtgaacaagcatgttctgtttaccgaagcgaagatgaagtgagatcttgtttctccacaatgcagaactgtaataagttgtcaaccttttgcgaccagaaacctttatgccgttattagacagatgattaacgatcctatgtgtttttcctgctccaaaaaaaaaaaaaaaaaagaccccaagtgttttgtcattttgtgtgggaaactacaaatgaaatctggactcccatctttttctttcacaccgccatgttttgtgaaacgatgccatgttttcctctgagccggcggcgaaccgtcgagatgctcaactaaaaaccaaacgaagctgttggctctg

SEQ ID NO: 2296 - DNA, 3397 bp, Zea mays
ctcggtacccctgctgcatagcactaaaaaatattgtgtgcaaccaattaaatgaagaaagagtaataaattaggttttgcataagatttggtttcattacgatatccaagatataatgaaagaagatgagtattaaattcaattaagtaatattaatgttggcattggagagatgggtaatttatggatgatgcggtgggttgggactgctactagaacacggccgacgataaagagactgaggtaggagtataccagcacactgtacatactgaattcagagataaagagactgacgcgaagatgcgccgaacgtgttgggtacttgggtcattgggtgtcgactggtcgctggaggaccgaagcacaagcgaagcggtgaggaagctgtcaaaggccaccaaaaccacgccggacgccggaagtcgcagggcagaagcggtgaacgcgtcgaccgaatccactagcatccctccctcttccgcgtctccgctcctataatatgcctgcgcccctcaattccacaccaaccaaactgctagcagcgccagcggcggtcagcgtcagcgtcagcgcccgaccaaatttcccccctcacctccccctctcccgtcgtcggcatggccaccgacgtgctgcgcgcgcgcaacgtcctcttgccggcgccgccgcagaggatccgggcggcggcggcggcgcgccggagggcagctggtagcgacagccaccaccccggcgccaccgccaccaggaggaggtcgccgccggccgggacatcgtcccccgcggcggggcgaagacaccccggcggcaggagggcgaggcctgcggcggaggtgtacgccggcccatcgttctcgacgtcccccgacccgagcttgctgccgctaccgcagttccctgccaggaaggccgtggccgtggccatgacgaccgccgtcgacgccgccgccgccgcgacgcgcgacctcaggcttatcctgcggctggagtagccatcaggacacatagctcgtctgctggctctaacgctggcttcgatttctcttcttaattcttccttctttattagctcctactcctagtccttgtcgacgcatcatcgatcgagctgcacgttggttctggctgctctcctggtatgggtcccacgctgccgcggcgaggcttccggctcagttttattgtgtggtcggcggcgaggcacgcggcggccatgggatcccaccgcgacggcggtgtagaatgatagcagtagcagctgtaatacactactctgtactgtgacgtgcaagtagatagtactagttactagttagccagtgtagggttcctccgtgtaacaagtcatcagcgtgtgatcctcttcgtctgttcatcaatatacacatttctatatgtttcaacaattactgatttgaattagcaaaagtcaaattgtctgccgcccctctaaaagactccttgaatcaataatttaggtagctaaactaaaaactcctctccaacaactctataaatgaacttcctaaatttagctacttctcatctaaccttattttctaattggataatggattcattataagcaaataagggataatggattcgaaccgttaattagcccttgttagctcttactattagtctagaaatagcccatttctaattggtatctaaaaaatatataggctacttaatcattagcccattaatccaaacatcctcgtgagcatctgttgtaacaacaactctaccgataatccgatatcatcagtttcatattcgtaaactaagagctgaagtttcatatttacagagaaaaaaccagcatgtgaataatgtgataagctgaaatttcatttcgtttgcaccaaaaaaaaaaaaacttaaggtataagctgaatggtgtagccaaaagaattagcttagaatacatgcaacagaagatagtgttcgttttcccttgctcctccttacttagcccaaggctttaagatcgaaagcacgactatggcggcaattaccagcagaatgataatcgcaatcaacatgcactttctcgacttcttctgcaggctcttcgcggtgcgtagcgcctcggtaccagacaccacatggtttacagcattttgaacctgacggtggcaatggatcagctttcgaacttgattgagttttccagtagcactgataaaattcagccttttttttaaccagttgcatgtactaatcagaggaacaggtaaagttacgaaccaggttctctatgttgtctagatcctctctttgtgcatcaacgagtgccgccatgtctgcaaaaatctgaaaaataaatagaacacacgccatggtttagtggccatgatcggtctggaaattgatgtgaccaatgatgtacatggtataggtttattagattacaaataacagtaaaggttcttatatcctgtaacaagatatctaagtcgatgtttcgaacaaaacaacgtctaagctgcaattcttgtaccatctgcagttcaaggagccttttctctatctccatgactgcatcatgccgttcctgaatttcttcaaccgtgtcaaggatctatatcaacatagatggaatttcatgaaacgaaaagcaagagtggttaggcgtagccgcgtagcacattgagatgggcaataaaagtatgaggtgaaattaaataaacgacaatgtaggagtgctattcaccgacctgtcctctacctgtcccttggattgctctctcaaagatctgctcgctgcttccggtctcgatgagacgatcaatcacctaggcattgtgccaaaacttggtcagaagaggtaagcgttcgctgtgccttgtgtagcgtggtagaagtagaaccaccatctcacctcctcagaaggctttgttcccgtgactgttccggttcaagattaaggcttgtaaatattcagccaacaggataactcaaactgaaatgacggataaaaaaaagttttacatacctgtgaagatcctcctctctacaacttctcggtactcctcttgtatagtttgtcttagattctgcaatgaatggtgaacaatgtgattccaagtctttaattttcttggacaaagaaggtggagagagcaaggtcatttgcacctggaaatcgttcatcctttctttcagcttcttcttcaatgcactgcaatcgaagttgacgttttgttggattacttttgcattggcataataaatgcaagaggatcttacatggtcatggacatccttgatcggtctacgctggtgcccttcccacaccccggcttctgtctgttctcgagattctgcaaaccgaagaggagaataatgagctctggcgagcatcgggtgaagtgaatcacacgc

SEQ ID NO: 2297 - DNA, 2127 bp, Zea mays
  misc_feature (2111)..(2112): n is a, c, g, or t
  misc_feature (2119)..(2119): n is a, c, g, or t
  misc_feature (2122)..(2122): n is a, c, g, or t
  misc_feature (2124)..(2126): n is a, c, g, or t
gcacgagaccattacctagaacatcctaatcgaaaagagaaacgccgccgcccgctcgccccgtgcactgctcctccgccttagcccgtagccaccagatccttggcgcaccagccctccatcgcagtcctggttaggctaggggatgtcaaatctcgattccgcgacgccggcggctgcagtggcggagatagggacggcggagcgggactctaccaccgcttctgtttcagctttaaatgggacacatagatgcaagaagaagaagataaagaagaatacgactcgggagcagcaagagttacaacttgatttggattcaacattgacagcagaggcggagggacaagtagaggcaaagggaaacgaggtggaggagcaggatgccactgatgctgttgcttctggtattttgatggaggggacaccaaaatattatgaggaggactccaaggtgaaggtcagtctgatgcccgagaaggaagccaacaccactgttgtttcagtttctgagagtacaccaaaacacaagaagaggaggaaaaagaagaacaagattcaggggcaactagattctgcaaaggcatcatctagtgttgtttccatggatataattgcagctgataaatctgaaaatggttgcacagatgtggtaggggcatcaggacatgctgatatcaatatggatcccataaatggtgatgatctaagtagtgctcagtcaaaggcaaatgatgctgatgttttactgaagaataaggatggaaacaagggggataagaattgcgctgagaacagcgtcttgttgcaggagagctctgcaagaagaaaaagacggaggggaaaaagaaagtggggttcagccggtggaggaccaggcttctcttctgataatggaggcgtggttgctgagcatagcctgcattcttcagcaaaccatggtcttagctgcatatgtgctccatgtttagttgaggcacatgaaaagaagatccaaaatatctactcaccaagaggatcactggtaaggtttcaaaggaagaaactcctgatcttggaccttaatggtctgctagcagatataaatcaagattaccataatgcacacttggcacatgcaaaggttcgaaccaaattagttttcagaagaccatactgtgacgattttctgagattctgcttccagaattttgagctaggaatatggtcatcaaggaaaagggaaaatgttgaatcggttgttgatatccttatgaggggtcttaagcaatgcctactattttgttgggacatgtcttactgcactgttacagggtgcaaaacaattgacaacaaggacaaaccattagtgctgaaggaactaaaaagggtttggaataaggatgagccagacctcccatgggggcagggagagttttcaccttcaaatacattactggtggatgattcgccctacaaggctctgtgcaacccgccaaacactgcaatcttccccgaaccctacaattacatgaaccagagggatgattattccttgggacctggtggagatcttcgggtttatctgcagagaattgctgctgcagacaatgttcaaaattttgttcgggataacccatttggtcagaagtccatcacagagagtgatccaaactggaatttctatgtgaaaatagtcgataagatggagaagcaaatagttgatcaagtggaaacgaaaatagttgatgaagtggagaggtccttaggttaataggaacaaaggttcaatcaagagaaagttctgtatttgtttgtgttgattagcaggtgttttgcattgcgccagtgctatcatgtgtaatctaatttagtaattgttgtttcatagacaaaacatgatttgaagaatcttgataggttttgttgttccaaccgagggatgaatcattgtttgtcctgtatcgagtgttacaggctttctggtttgctaacttagctatttctggaagtttggttgactatgctggaggatgattcagttcgatggaactgttatatactcgaattgttgtaaatcatctcagtttcatggaaaaaaaaaaaaaaaatttaaaaaaaaaaaaaaaaannaaaaaanaanannna

SEQ ID NO: 2298 - DNA, 1297 bp, Zea mays
  misc_feature (9)..(9): n is a, c, g, or t
ggtaccctncgaggcccccccgtcatatcttcctccctcgcctattccccttccccgcgtgccgcgtcaaacaaatctaggcttccaagcgagcgaaagccttcctccgccagccgatctaccaacatcctctccgccgattggaggcacctgcgaagatgccgcagcggcactcaaagaacaacaacgacctcgccttcttcacgtacgaggagaagcggaagctcgggtacggcacgcagcgggagcgcctggggaaggactccatcaagcccttcgacgcctgctgcctctgcctcaagccgctcatcgacccgctctgctgccccaagggccataccttctgcaaggagtgcatccttgagtgcctcctcgcccagaagaaggacatcaagcgtaagctagcagctcacgaggcccagaagaagcaagagaaggaagaggaggaggaaaagctaattctgcagaaggctaaggagttggatgcctttgatcagcagaatcatggggctgttccccagtaccatgatcgcagtggttcccaaggcaagaatgggtttcatggagcgaacagtgtgaaggtcacttcttttgaagaggaagccctccgtaacatgaaggcattctggcttccttcagctactcctgaagctacggtcaaggtagatgcaccctccgccgacactgtctgccctgaggggcaggagaagctcaagttgaaatcgctcttccctatctcatttatggaggaaactgctgatccgaagaggaagaaggcaatggaaaagagctatatgtgccctagttgcaaatccactctcacaaatacaatgtccctcgtggcggtcagcgcctgtggccacgtcttctgcaagaagtgctctgacaagtttctagtaaaggataaagtttgcttagagtgcagcaaatcattcaaggagaggaatctggttccattagagaaaggaggaactgggtttgcggcacatgatgaacgcttggaggcaagggatttcaagcatttgggcagcggttctgggttaggactagtgaagcctgcaccaaaagcttactagccttgaatacttgtagccgcttttatatatcgtttatcatggtgtcatgaaattatgtataacctggaaattttgttttgtggcatcaaaatcgctctattcaggacagttctccagtctttaacgatctatctgatatgcatgtttcttttcatctcgcgcatttgttaagctggagctgttgtactatgaccgcttgctcttggtgttggcataatctt

SEQ ID NO: 2299 - DNA, 1430 bp, Zea mays
aacaaatagaacgcatatttttatgttttattaaaccaaagtctatacatcaaataatagaaatcgtagcaatacagaatttgttcttctggtattttatccattactccgaaaacatcatcagcctacggtcaatcccgctcggcccaacccacttgtgtgcaggaacgcacgcggcccgccccgccctcccgtcactatattaatccaggatcatcttcccgcgtcgccgctttgccttccccgcgtcaaacaaatctagggttccaagcgagcgaataccttcctccgcctgccgatctccccgcatctctcgggctaagacgattcgaggcacgagcgaagatgccgcagcggcattcgaaaaacaacaacgacctcgccttcttcacgtacgaggagaagcggaagctcgggtacggcacgcagcgggagcgcctgggaaaggactccatcaagcccttcgacgcctgctgcctctgcctcaagccgctcatcggcccgctctgctgccccaagggccacacattctgtaaggagtgcatcctcgagtgcctcctctcccagaagaaggacatcaagcgcaagctagcagcacatgaggcccagaaaaagcaggagaaagaagaggaggaagagaagctaattctgcagaaggctaaggagttggatgcctttgatcagcagaatcatggagctgttccccagtaccatgatcgcagtggttcccaatacaagaatgggtttcatggagcaaatagtgtgaaggtcacttcttttgaagaggaagcccttcgcaatatgaaggcattctggctcccttcagctactcctgaagctacggtcaaggtagacttgccctccaccgacactgtttgcccggaggggcaggagaagcttaagttgaaatcgctcttccctatctcgttcacagaggaaactgctgatcagaagagcagcaaggcaggaaactcctgtagctacatgtgccctagttgcaagtccactctcacaaataccatgtcccttgtggcggtgagcacctgtggccatgtcttctgcaagaaatgttccgacaagtttctagtgaaggataaagcttgcttggagtgcagcaaaccattcagggagaggaatctggttccattggagaaaggaggaactgggtttgctgcacatgatgaacgcctggaggcaagagatttcaagtatttgggtagtggctctgggttagggctagtgaagcctgcaccaaaaacttactaaccttgaataattatagctgatgttgtgtattgtttaccatggtgtcatgaaattatgtaacctggagaattttgttttatggcatcaaaatcgttgtattcagaacagttcatcttcagtcttttaatctatctgatatgcggccatcttgcagctttccttcc

SEQ ID NO: 2300 - DNA, 2140 bp, Zea mays
  misc_feature (1438)..(1438): n is a, c, g, or t
ttaaagttgtttaaaaaaactatggtgttgaagctttatatatataacccatttttttaataaaatcaatgcttcaaaaaatagaggtttattttttttagaaactctaaagatttactgtgtctaaaactgtaaataaccagcattttacaaagcagtaatacgagtatttgtctaatactcctaaaacatgttcggcccattgtcgatcccgctcggcccagctcaccaccgctgcacgcacggccagaatcaccccgagcccgacccagacgggttcctctcctcaccagcatcatatcttcctccctcgcctattccccttccccgcgtgccgcgtcaaacaaatctaggcttccaagcgagcgaaagccttcctccgccagccgatctaccaacatcctctccgccgattggaggcacctgcgaagatgccgcagcggcactcaaagaacaacaacgacctcgccttcttcacgtacgaggagaagcggaagctcgggtacggcacgcagcgggagcgcctggggaaggactccatcaagcccttcgacgcctgctgcctctgcctcaagccgctcatcgacccgctctgctgccccaagggccataccttctgcaaggagtgcatccttgagtgcctcctcgcccagaagaaggacatcaagcgtaagctagcagctcacgaggcccagaagaagcaagagaaggaagaggaggaggaaaagctaattctgcagaaggctaaggagttggatgcctttgatcagcagaatcatggggctgttccccagtaccatgatcgcagtggttcccaaggcaagaatgggtttcatggtgcgatacttaggtggctgatgattttcgtgtggatattaagctaagcacgaccatgaattttaggccaacattatctcacctggagttagatttagtttttgcaaggtcgcacttgtacttgggataaaattatcttttagggctagtttggaaactcaaatcgaggatcaaagaggatttagggtttgttcggttagtttggattgtagacaggaaccattctagctatcaaggtaatacaaatttgttaaccattccaatcctgatccattccgggcactggttccggaggaaccgaacggggcctcaggtgaaatgaactaatttttcactcaatcccctctaaccttggaggagatttgagtttccaaactagccctacccctaccgtgtctttgattcgaactcttgtatgtagtatagtttcggcatccaacatttgaccctagccatttctcattgtacttgcaagtagaactgagcatgggccacccgatccgaccctagcaatgcaatggatgggtacgagccatagtttttgactcgtaataatccatgagccgggtatggggcgtgccaaacaacccacgacctgatncgacctgatgtttgaacatgtctagctacaagtatatgttttttttgctaaagttcattttgcgagcattcatattcatcagtcactggtcattagactaaggaggtgttaggtttctttagtcaccatactaaacttcagttcctaaaatttctatttgggaggtcttatttagtcatattgtttggcagtttaggacctaaagtttaggaggtgggaaccaaacacccccctaattcccctcttgtagtttccttacctagaattcctgttgttcatgatgagcctcaaaatttttgtagttggccttgaactatctgctttgtaattcagtctactgaacagagtactaagggtttactcttattcttccagtaagctagcagctcacgaggcccagaagaagcaagagaaggaagaggaggaggaaaagctaattctgcagaaggctaaggagttggatgcctttgatcagcagaatcatggggctgttccccagtaccatgatcgcagtggttcccaaggcaagaatgggtttcatggagcgaacagtgtgaaggtcacttcttttgaagaggaagccctccgtaacatgaaggcattctggcttccttcagctactcctgaagctacggtcaaggtagatgcaccctccgccgacactgtctgccctgaggggcaggagaagctcaagtgaaatcg

SEQ ID NO: 2301 - DNA, 1062 bp, Zea mays
tctgcaactacgtgcccgcacggagctcgcagcttttgccctttcccaccgcgcgctcctcatttattatttcacacgtcctgcgccacgtacacattaaacaggtcaagcccattaatataatgatcaccaaagaagtaattagtataaaatactcataacgtctggtgatgaagcgtatgcattgcatgcatcgagtatatatttgtgtctggtcggaagcaagggcctagctcgagccactatatatataccaataatcgacttcatatctcgtggccggccgggccgggatcagagataggagagacgaacaagaaaagacgagatcatatataccgtacgttatagagtaggaaaatagaaatacgaatgatgatcacgggacggcagcgaaaccctgcaaggctgcaggtgtcgtcgtccttcctgcttgcccttgttttcgcatcatcggtgctcgtcggcatcgtggccggcggcagcttctacgaggagtgcgacgcgacttgggagccccagaactgctgggcctacgacgatggcaacaggctctccctcgcgctcgtcagcagttcctcaggttccatgatccggtcgaagcggcagttcgtgtacgggaccgtgtccaccatgatccagcttgtccccggcgactccgccggcaccgtcaccacctactatacgtcgtcgctgggcgacaaccacgacgagatcgacttcgagttcctgggcaacgtgagcgggcagccctacaccatccacaccaacgtgtacgctgccggcgtgggcaacaaggagatgcagttcaagccatggttcgaccccaccgccgactaccacaactacaccatctcctggactccctgcatgatcgcgtggtacgtcgacggcgtccccatccgcgtgttccgcaactacgcggcgagccacggcgtggcgttcccgacgagccagcccatgtacgcctactctagcatctgggcggcggaggactgggccacgcagggcggccgcgtcaagggcgactggtccaggcgcccttcgtcggcagctacccgg

SEQ ID NO: 2302 - DNA, 1452 bp, Zea mays
acatcacatccgcgcgccattgcaatttgcgttcgttccttcctccttgctagggtttcttggattctgaattagcagagcagccagccgccaagccgctgcattttatgctgcttgctcgctcgtactctaattaacacctgcctgccttttgtcctctatcccgcgctgcgcagaagcagctggagagcatggtgaaggaggcgtcggtggacgacgtgatgaaggtgctgatggcgtcgcgcaagttcgagatgcaggagctgtgggccacctgctcccacctggtggcgcgctcgggcctctccgccgacctgctcgccaagcacctccccatcgacgtggtggccaagatctaggagatccgcgccaagtcccccgtccccgccggcgcgccgcgctcgccgttcctcacccaccactacctccccatcaacgcggcgtcgtcggccgccgaccgcgaccacaagatccggcgcatgcggcgcgcgctcgacgccgccgacatcgagctcgtcaagctcatggttggcgaggggctggacctcgacgacgcgctcgccgtgcactacgccgtccagcactgcggccgcgacgtcgtcaaggcgctgctggagctcggcgccgccgacgtcaactcccgcgccggccccacggggaagaccgcgctgcacctggccgccgagatggtctcccccgatatggtgtccgtgctgcttgaccaccacgccgaccccagcgccaggacgctcgacggcgtcaccccgctcgacgtgctccgaggcctcacatcagagttcctgttcaagggcgccgtgccggggctcacgcacatcgagcccaacaagctcaggctctgccttgagctcgtgcagtccgcggtgatggtgaccacgcgcgacgtcgacgccgccggcgacgacgccgggggaagcgacggcggcggcggcggcaacttccccaggagcgacgccgacgacagcttggtgagcctgacgatgaactccacgctcatgtaccagggccaggagatggcggctgccgcggtggccgccggtgaggcgaggaaagggaacggcggcggccgagggagcccgtccaacttgtacttccccaatggcggcttcccataagtattatattgtgcccttcccttctataatccatcgtcaagatgatctttcttcttcttcttctgttggattggatctttgtgagaccatggtgtagctagctactagtactatttattttgagtaggagacatgcatgcgcgagagcaagaatttcatggtatttgatgtggattgttcgatcgacgactgtgggagacaaagcaactgttgctttgttcaaatgcttcactgtgatgaatctttgtaatgtggcttcaacaatagtagtccaataacactaccaatttagagctagcttgcaaaaaaaaaaaaaaaa

SEQ ID NO: 2303 - DNA, 681 bp, Zea mays
gtcccccgacatggtgtccgtgctcctcgaccaccacgccgaccccagcgcccggacgctggacggcgtcaccccgctcgacgtgctccgcggcctcacctccgagttcctcttcaggggcgccgtgccggggctcacgcacatcgagcccaacaagctgaggctctgccttgagctcgtgcagtccgcggtgatggtgaccacgcgcgacgacgacgccggggcagggggaggaggaagcgatgccgccgacgacagcttggtgagcctcaccatgaactccacgctcatgtaccagggccaggagatagcgggggcgatggccggcgaggccaggaaagggagcggcggcggcggccgagggagcccgtccaacttgtacttccccactgccttcccataataagtatttagtttccttcatcaagcaagcaatgccttttgttttcatacatatatgcatccatccatccaaagatgatggatcttcaatttctctatgttgtattagatttttaatctgcattgtgaaaaaaaaaaaaaaaatggtggtgtggctagctagatactaatgcaagaatttcatggtatttgatgtggattaattgttccatgcatcttagtacatgtaaatgatccgtctattggtctgggcagcaactgttttactttactttgttc

SEQ ID NO: 2304 - DNA, 894 bp, Zea mays
ctgggtcggaaaaggccaaaaactcatcggcaacctccatctgaaaattctctcgcctgaacgtccaagcacaatcccgaaccctaaccagcgccccagctcgccgtcggcatgtccgccaggttgctccggcgagtcctccaggagcgtgaggccactccgcaggacaccgacgtcgccgacgacgaccagtcggtggaggaggaggcttctcctccgcgcacctccgcgcggaatctcttcgatctcctcgacgacggaaacggcgacggcgacgaagaagatgaaaaggaagatgaaacagaaataattcaagctgtgagctatacagaacagagacattctgtgcaaaagaaagcgaacgctgttcccgaaacaaacaaaaaatccaagaaaaagaaaaaaaagagcaaggcggagccgtcatcaacaaaggcaaaggatgcacagtcgttggagtcaattctggaagacttatgtattgaaaagaatccaatacaacaaagagctcatcagagtgacagggcagctggaaaggaatttgagacaaatgaagctactcatgtggcatcctctgttcttgcaatagacccaaaacatctaaagggtgaaaatgagatgaggcgcatttttggatcaaaggtagtggattcatttgaaaatcaacggagtatgccaagcagttcaaggcaagtacgtggtgctaggcgtgttgcccataatccaagaaaaactcttcttgtgtctccacctagctactggccaccatgggataagtcaataacaatggatcttcttgagatgaagaatgggttgaattacttcaggtacacatatgacccttcagtcagccatgtgcaggaattatttgaaaagcgccaagcagcaaatgat

SEQ ID NO: 2305 - DNA, 2009 bp, Zea mays
gctcactagtccccccccccccggacgcgtggggtcggcactcggcagcaaactgaatggcgcttcgcgctgtggagctccggagattccttctccggcgcatcggcggcggcgaggcggccctgcctcctctcgcgtggcgcggccggccagcgagcacatccgccccggcggacgacgagctcgcggggaagagcgcctacgaggtcctcggggttggggagaccagttccagcgccgagatcaaggcttccttccatcgcctagccaaagagacccacccagacgtcgccgcggctgctggttcccgacggttccttcagatcctcgccgcctacgagatcctatcagattcacagagaagggctcactatgatagctacctgcgatcgcagaggcgagttgtggggaaacatcccaggccatctcagttcgtgtacccaagtggttcaggctcaggcattgtggtacctcgagagagcaatgttgttgaatggctgaaatggtacaggcttaccattgacgacatagttaccaagaagagggttgccactggctctggttattttgaaaggctcgaaagcgagctgtacacggctatccatgctgcatactatggccctgatgtcgactccatggatgtccttcctgattgctttgaagccgaggagagatctgcatatgaaacctctgagctattacaccttgtttcaggccgtgatctttttggtattgttactgtaactgatagtgtcaaagagctgtcagatgtttgtcgtgaaaaactggtaccctctggttgtagatcttcggaatttactcatgttgtttcaagaaatgcgaataagaattcaatatctatgaatcctgttgatatgaacaagcaagaaatgcgatatgaaaatgatgttccttcatcagattccttcaaggacattgagttgcaaatatgtgggaaattagttgctactgcgactaggagccccaactgcgattgcattgacaaatcggatttggaagaagatcacattcatgtgtatcttgttccaaatgcaaatatatctgatttaacacatgggaaacttctcctcggcacaattactgggttagccaccactggtgaggaaggatcttgctgtgtctacgatggtcacaacataaagacacacattattatgaagcacaggacattgatggtattggctttttgagcctcgttgttacatgcatgacactggtggatggtatatcgaaacttatgggagagacaagaaagggaggacgattccgtctcaaagacagtgggatggttccaatgaacattctgaaaagagattgcatcctgcaatgtatcttgctgctctggcttacagatctttggatcttgaagatgctggaagaagacgatggaatgtgactagcttgctgcaatggtccttatctcatcttcgtcagctgttcaaaaaaagttgctaatggagagaaaggggattgacacgagaacaccatgaaaatagttgtttggggtctcgctttaacaattagactgaacctgtggtgtcacaccctttgctggttctgttcagctgctttttagtatgctactgtatagttagaaactaatgtgctttcttgatatgatagctgataaggacatctttctgaggctgttgactaccctgcccgtttgatatacaacatgatagtaaaggtttgcagagcgtgcgataaatgatctgacactgatggtaagatagccagaatcctacatgacaatgtcttctacatcgttttatgcatatttcttagctacaagtgacatgtaacttaaaaggatggtgccatggtggtatccaccattttgcacatctgctgtatttttataagaatttaaatccaaagccgactgattgagaaaaaaaaaaaaaagaaaaagacaacaaaaacctatcggatcttagaaatgaaaaaaaaaggcttgatgggcttggcaaactgaaaaagaatat

SEQ ID NO: 2306 - DNA, 1134 bp, Zea mays
ttgcgcgccgccggcccggccgggcttgcccctccctttctcttctccccttgtgtcgcgctcgcgcatctgaagcaagggggggaagggccaagggggatcggtcttgttctcggagagggttgagctgcttgacggttttgactcggatcatggtgtgcagctctatcagatagagagctgacgtgaggtgtgagacgcggatcgtggagtactactcagtaggagaggtggggagggggaagaaggcgatagccggggaggatggtgcttgtgcttgcgctgggggatctgcacatcccgcaccgggcgcccgacctccccgccaaattcaagtccatgctcgtgcccggcaagatccaacacatcatctgcactggcaatctctgcatcaaggaagtccatgactacctgaaaagcctttgccctgatctccatattaccagaggtgaacatgatgaggatgctcgatacccagagactaagacacttacaattggtcagtttaagcttgggctgtgccatggccatcaggttgttccatggggcgacctggactccctggcgatgctccagcggcagctggacgtggacatcctggtgaccgggcacacgcaccagttcaaggcatataagcacgagggaggcgtggtgatcaaccctggctctgccacgggcgcctacagcagcatcacttacgacgtgaacccaagctttgtgctgatggacatcgacgggctccgtgtggtggtgtacgtctacgagctgattgacggcgaggtgaaggtggacaaaatcgacttcaagaagactgcgacgatgcacggctagccctatccttccactccgtgattgagtgcaagacatgtctagcttctgtttcttttctttcagcttcttgattcagagcctcctgaacacgctttctacctgttcatgcgcaaagaactttttaggtctggttgttaacaatgtttctcggagccatgaatttaaatactatacttttaaaaaaaaaaaaaaaaaaaaaaactttggctagcttggaacaccggctattgtttagataaagtattgtaaatgatgacatttgggcataagttaatcatactatgaaaaatttgggttggagtg

SEQ ID NO: 2307 - DNA, 1192 bp, Zea mays
acctcgaggccggccgggaaattctcgcctttctgtcgcgcgggggatcgatcttgttcgcggagaggggtgacgtgattgacgattttgactcgaatcatggtgtgcatctctaccagatagagagctgacctgaggtggagacgcggatcgtggctcctggggtggaggtacaagcgtacagctcaataggagatcaagagtaaagagtgtggggaggggaaggacgcgatatcgggggaggatggtgcttgtgcttgcgctgggggatctgcacatcccgcaccgggtgcccgacctgcccgccaaattcaagtccatgctcgtgcccggcaagatccaacacatcatctgcgctggcaacctctgcatcaaggaagttcatgactacctgaaaagcctttgccctgatctccacattactggaggtgaatatgatgagtatgctcgatacccagagactaagacacttacaattggtcagtttaagcttgggctgtgccatggtcatcaggttgttccatggggcgacctggactccctggcgatgctccagcggcagctggacgtggacatcctggtgaccgggcacagccatcagttcaaggcatataagcacgagggaggcgtggtgatcaaccctggctctgccacgggcgcctacagcagcatcacttacgacgtgaacccaagctttgtgctgatggacatcgaaggactccgtgtggtggtgtacgtctacgagctgattgacggcgaggtgaaggtggacaagatcgacttcaagaaagcagcgacgatgcaagcctagcactactatccttccacggtgtgattggtttcaagacacgtctaggttctgtttttttttctcttcttgattcagagctccctcaacactctctttctaccacttgtgctaacctgttcatgtgcaaataactagtttaatacacattagctgatcatattacgacggcgtgatgttaaatgtcaagtaacttaaggcctgtttggcatggctctagagcaaaactccaaggaggagctgcatgtcaaacatccagactccaaagttgtaaattctatggagtttttggagctgcggagtagctcttttgctgatctgaaaactctaaaaaagcaatcatggagttttgagttatttacccgccaaaaaaaaaaaaaaaaa

SEQ ID NO: 2308 - DNA, 1126 bp, Zea mays
ccacccccccgcccgcgcctcccctccccttgtgtcgcgctcgcgcatctgaagcaagggggggaagggccaagggggatcggtcttgttctcggagagggttgagctgcttgacggttttgactcggatcatggtgtgcagctctatcagatagagagctgacgtgaggtgtgagacgcggatcgtggagtactactcagtaggagatcaagaggaaggaggtggggagggggaagaaggcgatagccggggaggatggtgcttgtgcttgcgctgggggatctgcacatcccgcaccgggcgcccgacctccccgccaaattcaagtccatgctcgtgcccggcaagatccaacacatcatctgcactggcaatctctgcatcaaggaagtccatgactacctgaaaagcctttgccctgatctccatattaccagaggtgaacatgatgaggatgctcgatacccagagactaagacacttacaattggtcagtttaagcttgggctgtgccatggccatcaggttgttccatggggcgacctggactccctggcgatgctccagcggcagctggacgtggacatcctggtgaccgggcacacgcaccagttcaaggcatataagcacgagggaggcgtggtgatcaaccctggctctgccacgggcgcctacagcagcatcacttacgacgtgaacccaagctttgtgctgatggacatcgacgggctccgtgtggtggtgtacgtctacgagctgattgacggcgaggtgaaggtggacaaaatcgacttcaagaagactgcgacgatgcacggctagccctatccttccactccgtgattgagtgcaagacatgtctagcttctgtttcttttctttcagcttcttgattcagagcctcctgaacacgctttctacctgttcatgcgcaaagaactttttaggtctggttgttaacaatgtttctcggagccatgaatttaaatactatactttttaattgtcatgataataacataactttggctagcttaaaacaccggctattgtttagataaagtattgtaaatgatgacatttgggcataagttaatcatactatgaagaaattgggttggagtg

SEQ ID NO: 2309 - DNA, 594 bp, Zea mays
ccggcccggcccgcgcaccaacaaacaaaacaagcctaccataaaaagagaatctttcaaagatggcgtccaagaagatggtcctcgccgtggcggcactgctgctagtcacgctcgcactgcaggtcgcccctcctgcgatcgccatggactgcaaggccgggtgtgccgagatcaagaactccccactcggcataagcatcgaggagtgtctgaagaggtgcgaggggatcgccaccgagcagggacctagggacccttacaaggataacaaacttgacatcccataaacacttatgccttgctgatatatttgtgcctatccaatcatttgcgatagatcaatgcatctttgtgttaaaaatggatagatcaatacatgtgtatatatgctccctccgttctttttcatttatcatcgtttagttcaaaaatgaactagcgtgcgacaaatattcgagaacagaggtagtactatgcaggtctacccatgaaatctggttcccctattggcgtctgacagtttatttgtattccacgatataagaaatacaaagacatgcacgcaaaaaaaaaaaaaaaaaagcggccgcc

SEQ ID NO: 2310 - DNA, 4480 bp, Zea mays
  misc_feature (1703)..(1703): n is a, c, g, or t
gctgatttttagaattcaaaacaccttttacttagcattagtcttttttctcatgttcaaagtggacaatttcagtgggagtcttaggaagcaacattatcttaatgtttagggttagggtttatggtttagggtttagagctacacctttgaaaaataatattgcattatatagtgaattaatagtctataaatgtgaaataaataatcataatgcgacattacaaataatttaaattataattgtcatatatgcatcattaaaggctaagaaacgagtcatatatctataaaattatccaatatttatcattattgtgtaggttgattagttttatgcagctcgcgagccagagcggctcggctcagctcgttgccccaacgagctcaaaaacctggttcggctcgaggctcgcgagccgctctaagctcaagccggctcgtgagcttcgagttttttttccagccctagtcacctagacgatttatgttttagagatttattcaatgatcatgttatctgttccagttcgtcttgaaattataccctatacagaggcatggcgtgttaatgtaaaatttcaagactaacgtgccaattaaaagttgcaactaaatagccgatagaaatcagtaaaatatgtaaagatgaaacaaatcactctcaatgaaagtttcacacgatttccttaaccttgaaaacaggttgacatggtttcatcccatgaaaccaatttcacccacgaaactcatttatcttaaataatatgtcatatcatctaaaatattgaagtgacacacttataattatatctggcacaatcatgaaactgccattgtgaatagctatagtctcgtatgcaaacgggtcatgcatgagtccatagcaagtacgagtacatgttatcctaaatcccgtaacaaactcctactattgctggcggatgccctaacaacacgacgggttgtattagagcacgacgggtccggagctgaagtttcggttactcccgtcaaacgtgtccagtcgaaaatctcatcgccagagccttgggtttacgcatttacacgtaatccagtaggatccgccagttttacgccgcctgctccgatccatcgatctcataactgcatgcatgctatccccccggccctccaactccaacgaaccccgtcaactcgccagccttatccgtcggtctctccctccctcctctatataagccgcctacgtccccctcgacccctaccaatcgtcctcgcattatccatccatcatcgactaatccagtgtacgtcgttagttgttactcaagagatcaataccgcaacaatggccgggggttttgccgtctccaagtccggcgccgacggccgggagttcaagggcaggatcacctggtacgtctggatgtgcggcatcgtcgcggccaccagtggcctcatgttcggctacgacgtcggcatctctggtacgtagatcgacgacctccatcgcgtcctgatgatgcaacggatccggatccggatccgatctgatcaatgtgtaaacgccatgcctccgtatagggtataatactaatgatctgatctgatggcctgcaggtggggtgacggccatggacgacttcctggagctcttcttcccgtcggtgtacgcgcgcaagcaccgcgccagggagaacaactactgcaagttcgancgaccagcggctgcagctcttcacgtcgtcgctgtacctggcggcgctggtggccagcttcgtggcgtcgcgcgcgtgctcgcggttcgggcgcaagcgcacgatgcaggcggcgtcggtcttcttcctggccggcacggcgctgtgcgcgtccgccaccaacatcgccatgctcatcgtgggccgcgtctgcctcggcgtcggcgtcggcttcggcaaccaggcggcgccgctgttcctgtccgagatcgcgccggcgcacgtccgtggcgcgctcaacatcctcttccagctcaacgtcaccgtcggcatcctcatcgccagcgtcgtcaactacttcgcgtcgcgcgcgcacccgctcggctggcgctacgcgctgggcggcgcggcggcgcccgccgccgtgctgttcctcggctcgctcgccatcaccgagacgcccacgagcctggtggagcgcggccgcaccgacgccggccgccggacgctggagaagatccgcggcaccgccgacgtgggcgccgagttcgacgagatccgggccgcgtgcgaccttgcccgcgcgctcggcgaggaggagaagccataccgccggctgatgcgccccgagagccgcccgccgctggtgatcgcgatcgccatgcaggtgttccagcagttcacgggcatcaacgcgctcatgttctacgcgccggtgctgttccagaccatgggcttcgagaccgacggctccctgctgtcggccgtggtcacgggcagcgtcaacgtcgtgtctaccgtcgtgtccatcgtcctcgtcgacagagtcggccgccgcaagctcctgctggaggcgtgcgcgcagatgctggtggcgcagacggccgtgggcgcgatcatgctggtgcatgtgcgggccaacaacaaccccagccagtcgtgggcggtggccatcgtcgtgctcatctgcgtctacgtgtcaagcttcgcctggtcctggggcccgctcgggtggctcatcccgtcggagacgttcccgctggagacgcgcacggccggcttctcgttcgccgtcagctccaacatgctcttcaccttcctcatcgcgcaggcgttcctgtccatgatgtgctccatgcgcgccttcatcttcttcttcttcgccgcctggatcgtggtcatggccatcttcgtcctcacgctgctgccggagaccaagggcgtgtccatcgacgagatggtggaccgggtctggcgccgccattggttctggaagaggtgcttcgccgacgactacgacgcggccagggtctacgacaactgctagtgctaggcacgcgcgccgccggggattagtttttttgtcattgtaattagaaatcggcctgattaattgatttcgttgctatgacatttaaattgatgtcgtggcaatcaacaggcaaaactatatagtatatgagaaatatgctcgagttctcgtgtgattcgtatcgtcctcgtatatatatcttatacgaggaaaacatgacggcagaattgattctacgtacattatctgggcctatttggttcacaacctaggaaaactgtctatcaatcctagctaggtgtctaattttgattgtctgctgcgcgcttgaccttctcaagcctacaaccaaacagaccacacgacgctacatacaaagctccctcaaaattcacaagtagatcattagatgccatttttcgtcatgacaaattaaaggtcacgtcatgaccacctaaatttctgaaagattattaaaataagttccaatcattttcttaagagcatctccattagttacataaatttagcatccttaaattataggtttaggaagttgctaaaaatgtttgtgctccaacaattttttatttaatggttgctaattttaaagttgtccatgttaaaaaataaataggtctactttctattttgaaattcatagcaacaacctttcctgacctcttgagagtttaaagttacgtcgtccacgtgagagttacgtcgtccacagagatcctcgtggcgacggcttggaggcaacacagaggttgtctggcggtggcgaagtaaaagcatctaggacaatggagatggatttgtggtaggttgtctggcggtggcggtggcggtgtaaagacatctttgctgtagtatgcttttcttgtgttaggttgcctagcggtggctgcctaaagacatctgtgttggagtatgtttttcattatgtacttagtgtcaacgttgatttcgagagtcccaacaaggttgataaatgtagggataaaattcaattttgtatggagtttgtaaatttaggaacctaatttatataactataggagaagagttttttcctgaaagctttttaaaattatatttaaggagtagtttatataactactgcggatgacaatatgagatgactggtgatgcacaaagccatcaagccatgcacgcgtgtaggatctcggatcgagttgcttcctcttgctcttgtggtgacatgtgcagggttgtttctgactttttgggggcctagggcgaaatctaatatggaggtcccatccaccgtgtatgtacactatatatataattataaacacaaattattgaacattcaatggaaaaaacttctatgacatgccttaaagtttataagatggcaaatataaattagagccataacacttacttgtcacatgtcacatgatatcatgctaaaaatttcttctaacattttgtgatacaaagtcgtcgatttacc

SEQ ID NO: 2311 - DNA, 1009 bp, Zea mays
  misc_feature (15)..(15): n is a, c, g, or t
  misc_feature (39)..(39): n is a, c, g, or t
gtggatgttgtgggnatattttgcttcttaaatcttggnaacaaagtatcaaccgccaccacaactgtcacagtggcttcaacaggggcccaagccaatatacattggttttggtagcatgcctcttgatgatgagaaaaagtcactgctatcattttagatgcacttagagaaacaggacaaaggggaatcattagccgtggttggggagctcttggaagtttttcagaagttccagttgatgtcttcatcttggaggattgccctcacgattggctcttccctcggtgtgctgcagtggtgcatcatggtggagcaggtactacagcagcagggctgatagctgggtgtcctactactgtagtgccgttttttggagaccagttcttctggggcgagagagttcatgcacgaggagtgggtcctgcacctatatctatcgcagaacttactgtagaagcactatcaaatgcaataatattcatgcttgatccagaggtaaaatcacgaacaatggaactggcgatagcaataggcaatgaggatggtgtggcagcagctgtagatgcatttcatcgtcacctgccttcagaattgccgctgtcgccgcccgcacatgtggaggaagaacgcacagacttcttccaatggttttctcgaggcctggagaagtgttgtttcccattcagtttttaggtacggcagtccgtacgctaggtatatgtatgatttattcatttatgagttgaaaaggtatatcacagtaattttctaaaattggaataaatgctggtataagccaatggtgaggatgcaataaaaaagatcgacgcaattgtaaatgtttgggcagctacaattgtattcagaatttgccggtaggcctgaaatttgtgccccgatgtgccttccagtaaaaaaaaaaaaaaaaaaaaaaaaaaaaaaaacgactgcaaaaatgtgtttaatttgctcgttttttccaaagaactatagaatatacaaagtg

SEQ ID NO: 2312 - DNA, 8644 bp, Zea mays
  misc_feature (5434)..(5434): n is a, c, g, or t
  misc_feature (8481)..(8481): n is a, c, g, or t
cataataagttctttacgaaaacagaaaacgtgtctaaaatgttccctaaagtgcgccattttttcgtagccttaaaactctctcatttgtagctagagaagaaaaaaaaaattgggctccctagaaatacaaacgtgcacaaatcgaaatggttttttttaacttttcgcatgccattttgctccttctctattcgtgtagtgctccaattcctcctcgtttgccacaaatgtcgagctgtcagtcgacacccacgcaaccttgttgtccgcgcattcgcgctatctgccaacaatggtgctccccacccacaattcgacatctaacatcgcacaactcactattagacctctatcatcgatcaagcctacgttgtcgctcatcccacccacacccaccgttggtccttcctcgtcgaccacgaccatccgcgtactgccaacaatctttaatggtggcgcaagtttggtcactgaatagacgccaaagccgcagaaaaagaaaatacacctgtgaaacatatcaatgttgggcctaccctaatctagtttaaaatatttttggtccacttttaaggaaacggttggagaaaatattaaaatatacccctaatatttttttagatgtttctaaagatcagttttagaagtccttttatgggaaagttttggatattttctaaggttgatcgcaaaaagatgatgtatatggtcgtgtatattttgccatgtataccgtactgtgtatgacgtgtattttaaaataagagatgagattaaagagtctggtgcctaacagaatggcaaacttatttttaaatttattttaaatctacatgtcctgaagataggccgttctaataatcttttatagaataaaacaattttttttacgtggagctgttgaatgttaaacctatcgatggtatgttggtttgacttttgtctttgattttatcatctaaaaatcgaaagccaagttaaaggattgaatataggaagcaatatctttttctttctaaaaccgagtttttcacagtgtaaaattgaaagtacatgtgaacatacttttagttgttttcagatgaaccataaaaatatatatagaatttttttagtgattttattggttttcataaaaaaaagttttaactgctcgtaacctacaacagtttttttaccgctcacatttaaaaacatttttttatagctaaccaaacaagcaaacagactctccgggtgccctcgaacggctgtcgccgtcgtcttgactccacctctgtcagtcgctctcccaagtccacacaaccgcccactacaacggcagccaagagcatttattattttcagcacaactccgtttgatccgcgcctgcccacccatttcctcctccactggtttgcctggcgcttattaattgcagccgaatcaaacgcacaaagggcactggtgcgcctaccatgtccgtcaatgtctggatgactggatgagagagagagagagggcacgagaaagtacgagagagatagagagagagagagagatgcacagcaagcggagggaaagataaacaaatccgatccgcactgctgagcgcatcggagtcaaaaccaaccgtccctgtctttcttctgactttccccaccctcgtcctctttcggcgactctgcaatccagcgcggcccaaggatgacgaggtcgacgagatcttcctccatgcagcgctgcttgctcttcctctgaggcctgcccctggccctgtcccggtcttgtccgtctggatttcgctcaggcggggcctttcctctccttgggagtttctgcgacgactgctgctgctgctgcctctgctagctctcgtcgtaacgtaaccgccgctcctgctcctggtgctcggtcgatgcacgcagcgtagcaaccggcggcgagaagaattgcctgcttccctccctcgcggcgctcgcggccgtgcatgccctgcaggaaaagagccgcctccttcccggatcccgccgcctctcgccggagatgggaggctcccgctggctgctccacttcctgctcgtctccgtgctgctgcacgtcgtccggtccctggagtcccaggcgtgccaccccgccgacctgagggcgctcctcgacttctccggcggctgggacagcaaggccgccgggctcgtcgggtggggtcccggcgccgccgcctgctgctcctggacgggcgtcgcctgcgatctcgggcgggtcgtcgcgctggatctctccaacaggagcctccacggcgtcatctcccccgcgctcgcctccctcgacggcctcgccgcgctcaacctctcccggaacgcgctccgcggcgccgcgccggaggcgctggcccgcctcccgaggctgcgggcgctcgacctcagcgccaacgcgctctccggcccgttccccgccgccggcttcccggcgatcgaggacctcaacatctccttcaacagcttcgacgggccgcaccccgcgttccccgccgcggccaacctcacggcgcttgacgtctccgccaacaacttctccggcggcatcaactcgtccgcgctctgcctctcgccgctccaggtcctgcgcttctcggggaacgccctctccggcgagatacccagcgggttgagccagtgcagggcgctcactgacctctccctcgacggcaactgtttcaccgggaacgtccccggcgacctgtacacgctgcccaacctgaggaggctgagcttacaggaaaatcagctcactggcaacctcggcagtgaccttggcaacctctctcagatcgtgcagcttgacttgtcctataacaagttcacaggctccatccctgatgtctttggaaacatgaggtggctagagtccgtaaacctagccaccaacaggttggatggagagttgcctgcttccctgtcaagttgtccactgcttagggtaatcagcctgaggaacaactctctgtctggcgagattgctatcgacttcagccggctgccgaacctgaatactttcgatattggaaccaactatctgagtggcgctatacctcctggcatcgctgtgtgcaccgagctcaggacgctgaatcttgcaaggaacaagctcgtgggggagataccagagagcttcaaggagttgacatccctgtcgtacctctcgctgacagggaatagcttcaccaacctggcatcggcactgcaggtattgcaacacctgcccaacctgacaagcttggtgctgaccaggaatttccggggtggcgagacgataccagtggacggcatcagcgggttcaagagcatgcaggtgctcgtcctggcgaactgtttactcaccggcgtcatcccgccgtggctgcagagcttgggaagcctcaatgtgctggacatttcatggaacaagttgaatgggaatatcccgccatggctggggaagctggacaacctcttctacattgacctgtcaaacaactctttcagtggtgagctccctatcagcttcacacagatgaggagcttgacttcaactaatggctcgagcgagcggtcgccgacagaggacctcccattgttcatcaagaggaactcaactggcaaaggtctgcagtacaaccaagtcagcagcttcccaccgtcgctcatactctcgaacaatctgctcgtggggccggtcttgtcgagctttggttaccttgcgaagctccatgtcctggatctgagctggaacaacttctcagggccgatccctgacgaactgtcaaacatgtcgagcttggaagtgctgaatttagcccacaacgatctcgacgggacgataccttcgtctctaacgaggctgaattttctctccatgttcgacgtgtcgtacaacaatctgaccggagatatacctaccggcggggcagttctccacgtttgcacctgaggattttgacggcaaccctgccctgtgccttcggaactcttcgtgtgcagagaaggactcgtctgtgggacctgcgggcctcgggccggcgggaaggaaagctgccaccgtcgccctcggactgggaactgcggtcggggttctcctcctcgtgctctgtgcttatgtgatcgtgtcaaggatcgtccattcaaggatgcaggagcgcaatccgaaggccgtagcgaacgccgaggactcggaggggtgttccaactcctgcctggtgctgctattccaaaacaacaaagagttgagcatcgaggacatcctcaagtccaccaacaacttcgaccaggcctacatagtcgggtgcggcggtttcggcctcgtctaccggtcgacgctgccggacgggaggagggtggcgatcaaaagactgtcgggagactactcgcagatcgagcgggagttccaggccgaggtggagacgctgtcgcgggcacagcacgagaacctcgtcttgctgcagggctactgcaaggtcggcagcgacaggctgctcatctactcgtacatggagaacggcagcctggactactggctccacgagagggccgacgacagcggggtgctgctggactggcggaagaggctacggatcgcgcagggctccgcgagggggctggcgtacctgcacatgtcctgcgacccccacatactgcaccgcgacatcaagtccagcaacatcctcctggacgacaacttcgaggctcacctggccgacttcggcttggccaggctcatctgcgcgtacgagacgcacgtcaccaccgacgtcgtcgggaccctgggctacatccctcccgagtacggccagtcgccagtggcgacctacaagggcgacgtatacagcttcggcatcgtcctgctcgagctgctcaccggccggaggcccgtcgacatgtgccggcccaaggggaccagggacgtcgtgtcgtgggtgcttcggatgaaggaggagggcagggaggctgaggtcttccatccgagcatacaccacgaggacaaccaaggccagctggtgaggatcctcgacattgcgtgcctttgtgtcaccgctgctcctaaatcgagaccgacgtcgcagcagctagtcgcgtggctggacgacatcgcggagggctgaggcttcattctttgctgcagtcctagtttcttcccagtgccttcagtttgatagtttcttaagaatgattattagctgtgtacataatatttacagagtgatatgccgagagttctcttcttgtctttctctttatctgtctagtgatgctgatgacatcaacatcttcatttacttggtaaggtggttgccagatcaccggagagtgtaaaagtgctttgtaggcttaccctcagtacaataatctagccttgacatgagcagctttcctacagacctgtggctcccctccttccctcagttactcgtacganagacattttgcaggccttattttcttgcatggcccatttaccctgcatctcttcatggacgtcttctttcaatcttttgctgatgcagggcaccaggtggggtttttttttgtgtgactacagcattgtatttctcttgcagtttgaaggcctgacatctagcagaataacattcatactgaaggcgccagcaaacatgctcattaacccccttttttacaaagaaaactaaaggttgcttgatcatgatggcattgaccggtactagtatcatcatcaccattggtcgaatctgtaggcccaaaggctggccatttcttttcgaaggagtccagttttcccttttctacttgctactttgtgtcactttcttgtatgacccaacaaacaaatcggtttatttggttatcagctaactgtgtcacactttgtctaagcttaatagtttaaattgaactaggctctttttggtttcctatccaagtcacaacaacatacttaagctcagtcgtctgaattgaagaaaactaaccttagtcacaaaagttaggcaagttaaaacatctcagatcaagtataataagagtacagtcatagcgaggaggaggaaacagcgctggtggttacatggttggctacacaaacaagcagtggtggatccagaaatagatcaaaggaggggcgagtaggttgaccaactataacgtcagacacacaactggtatcttataatgggcaacctggctgattaggacgcagattgggacggtgtcatggtgcgtgtgtgtcggatgggaacgtttaatctttttgtcatctttatggatggcactaaattaccagttaatgctagttggatcattattatagcattttgtgtgatattcatctcgtaaagatgacaaaacattagattgtcctgttatacacggatgtagttaatgcgtgatagcttgcagaatgaaacatttgggctacattaaagacctggtactgctctttcaacccacaacagggcagggctacagccccgtcagcccacccccttttgcatatgccactgcattcatacaagaggtaaggcttaccttatatgtgttaggtgagacctagggagaaaatagatctatgtgttttgccgtgggacgtacgaaactcgtgatttaaagagtagaaataacttatggaagtgttattttatgagtagtcttttagttggctatatataatatgacaacaacataaaagctcgttataagctatattattaaatttgctcttaggcagaaaaccaaacaagcctctaacttaagactgttgccagtagatagtgtaaaataggggacgtagaactgtagacaaaattgtttgtagagtggagtttgaaataaaggataagataagagatgtgacagggatttgctggagatagttttgggtataaaaaagctaagcaggcatggacctggccaatatgtgcttgcggactagcttatggaccaggccgaaaccggcggacaggccgcggtcatatacagtgccaactctgaggcccagggaaggttcaaaaagacacctccctacttgcggtgagagatgggccaaaaggcgcacggcccacggagtaagcatgtagatccgtcgcgtgctgctctgcagaatgggagtatgggactaaaaagtgagtttcggcccaataccagccccaagtgaatataaccacccaagcctccctgtgtatctgttgttttgggtcgacgccatgcagttgcagccccgtacgtcagtgatgcggatgaaagtacagcggcatgccctcgtttcgtgttcttctctaccagtttcagtagcacacgcgtgctcttgactctggtggtgcacgcagttgcaaggtgatgctgtgctgagcatatctatctatctatctatctatctcactagctctctaatcaaagcagagggctaaacaataacctttcgccccgtggtctgggtccatgcatgcatccactgacgaaggggatcaggctgtagatctcgatccagtacggtgcaccctgttgcctagacacgcccatctcctgttccagtagcaagtgtcagagtgccccctaccacgcaacgcaactcttttcgccgtcacctctgccctgccacgcccccccacagccgtattagactttagtaataatgaccaacctgattcatcgtcatctctagtaccacaaaacttaacacgtgagtctccgacaccgtaccatgcaacatgcatggcacgctcgaccagctgcagcgcccgtcgagaccagcgtgttcctcgccgtcgtcggctcgtcgcggccttcttgctgcaaaatgatgttcatagacttgtgcgtaacagcagtgtaggcgtcgtcacacactctaggacgagcgatttcatgccatcgattcggctgacaagagcagcgacgacccctgccctcctgatgccatcgattctgaaactcataaaaaaagctaaaatatactcgtttttttaaaaaatataaaatatgctccgtaaaaaatttgaaaaagaaataatctctgctgccagtaccagaaggcagcaggcaggtcaggaacacacacgctgcagaggcggtcggggtgtggcagcagtactttgcgcgttgtcatctcatatcagctcacagtcacagtcacacacgcaccgtcgtctcctcgtccgttccggccgccattattaccagagaggacttggcgagccttccaaaagatgtcgccacaccacgccactggcactgtgcggggtcactcgcggagcgtccccgcgcgcccactacagccagccaaaggaaacatcgctcacacccttaattatttagcaactttttaaatatgtgatttaaagaactaaaagttacataaatattggagctgctcttaggagactaaagtttaattctatcttgtttggttctatggactaaaagtattcaaaaaatattaatcgaatcataagaggaccaaaatactcattaatattctctcaccattantgtaactaaaataaaggagtgtaaataaaagttacataattattggagctgctcttaagagactagagtttaatccgtaccttgtttggttctataaactaaaagtattcaaaaaaacattaaccgaatcataagaggacaaaaatacttattaatatctccc

SEQ ID NO: 2313 - DNA, 1662 bp, Zea mays
  misc_feature (382)..(382): n is a, c, g, or t
atttaccatttatttggtctgtacaattttagtgaatcagaataataagttcatttacagcttttaagagtccaccacatgtttaatattgcaggttcaccctgttcttatgcttatcggttatgttattatcggcggtgaaggtaaatgatgtaaatgctttcaggcttctcttttctgttacatgacaaattttagtttagtgatatcttgtccgtgttgtcagctataatggtgtacagggtacttccaacatcgaatcatgacacaactaagctgatccatctaattctccacgggattgcactcgtccttggtgcggttggaatatactttgctttcaaaaatcacaatgagagtgggattgccaatctttacagcntgcactcttggattgggataggaacaattactttgtatggtattcaggtaaggccatgcatgtgatggcaaagttaggtgtcttctttgactatgattttgacacactaacaacactactgcatttattttgaatgatttgtttttttattgaacaaaccagagatatactgtgttttttttccttcaaaatataatccggcccgaggttgccggtagctggtgagctttatacttgctcttcttagacagtttctgaaatgagaaactgcattctagtgtgaagtgaacactcgtatagttatgcagtgatagaatgaccttatatttgccttattgatcacagtggataattggattcgtcacgttcttcttccctggtgctgcgccaaacgtgaagaagggtgttcttccttggcacgtactctttgggctctttgtctacatcttagcactggctaatgcagaactcggctttcttgagaagctcactttcctcgagagctcaggtctcgacaaatatggcacagaggcattcttagtgaacttcacagcattggttgtcgtgttatttggtgcctctgttgtggtggctgctatagctccagttcgccttgaagaaccacagggttatgatccaattccagaaaactagcgcaaatgaaatgtacagcgtatgcagttgccaagattggctgttaccacatggagataagatattcatgtctctttattgacggagaagaaggtgatggaattatcacaataaagatgtagacataaatgtgtgtgtatatacattctgtgacacttcaaaatttcagtatatgcaaaactgaatatcctgcttcataaaaaaaaaaaaaaactttcatgaatatcctgcttcataatgtgctatctctattctctagtaccttttttctgatatttattgcaaattgagctgagtttgaatcgtcctggttcagaatcaaccactaaaactgtctaacataaagtgacaaatctacatgcaagttaactatcataaatagagttatcttttcttagttttgatttatttgcgctggtttgctgtaatccatggtaaaagcataatggagttacttttatcaaatagtaacccgattagatgggtgtgtcgtgtgtgtagggggaggggctatatttgtcaattggcattgtatttgatataacgcttactcgtatttaaagcccactagtcggttacacgtgcgttgggacgactcacaacaatacccacgtaaattatccacc

SEQ ID NO: 2314 - DNA, 1136 bp, Zea mays
actcctatgggcgatccggccccgcccggacgctccccgcactctctctctctccctccctccaactcattggcagcagcagcagcagccgcagccgcgagggccaagcagtggggggacaaggaaaagggccgacgaagaggaaaaaggaagaacgcgtcgcggagccatggggcttggccttggcgtgcgggcggcgcccttcacgtacgcggcgcacgcactggccgtcgcggcggcggccatggttctcgtctggtccatccagttccgcggtgggctcgccatcgagtccaccaacaagaacctcatcttcaacgttcaccctgttcttatgcttatcggttatgttattatcggcggtgaagctataatggtgtacagggtacttccaacatcgaatcatgacacaactaagctgatccatctaattctccacgggattgcactcgtccttggtgcggttggaatatactttgctttcaaaaatcacaatgagagtgggattgccaatctttacagcctgcactcttggattgggataggaacaattactttgtatggtattcagtggataattggattcgtcacgttcttcttccctggtgctgcgccaaacgtgaagaagggtgttcttccttggcacgtactctttgggctctttgtctacatcttagcactggctaatgcagaactcggctttcttgagaagctcactttcctcgagagctcaggtctcgacaaatatggcacagaggcattcttagtgaacttcacagcattggttgtcgtgttatttggtgcctctgttgtggtggctgctatagctccagttcgccttgaagaaccacagggttatgatccaattccagaaaactagcgcaaatgaaatgtacagcgtatgcagttgccaagattggctgttaccacatggagataagatattcatgtctctttattgacgaaagaaggtgatggaattatcacaataaagatgtagacataaatgtgtgtatatacattctgtgacacttcaaagtttcagtatatgcaaaactgaatatgctgcttcataaatgtgtgtatttgctttcatgaaaatcctgcttcataaaggaaaagccctcgccgccagt

SEQ ID NO: 2315 - DNA, 514 bp, Zea mays
  misc_feature (488)..(488): n is a, c, g, or t
  misc_feature (490)..(490): n is a, c, g, or t
  misc_feature (508)..(508): n is a, c, g, or t
  misc_feature (511)..(511): n is a, c, g, or t
ggctttctttcccctttgacgtcgcgtcgacgtgagcgcgtgtaggctgcttcacgagctagaaaagtgaggaaatttaaatctagtagaattatagaattatcaagaagtgttattgtgcagttctgtcggcgagcgtgtggattctagctttctttgcttcagtcagagattgtggattctatcttttataccccgtagtagctttctactaaattacacataggctgctgcacgagctggattgtggagtactaaattacacaatccagctcgcccagattctacgatccacgaatcctctcaaactagagagagagagagagagagagagagagagagagagagagagagagagagagagaggccatgagctagaattcacaaagagccatcagcttttggaccttcagttctctgcaatccaggacttcaattatgccgctattcagaatctctagctaaaactagcagagcacttgatacgngnttatttgggtgagggtgnggncta

SEQ ID NO: 2316 - DNA, 1119 bp, Zea mays
aatctacagatatgaaccaagttagataaggtactcgtacaccgaacatgttcgatagaatgctctagtgacagcgaaaaaaccaaacaacaaaaaccaacgaaatccctgccatttttataggagacgacggtgcggggaggcaagggaagggggcgacgaagaggaaagcgaagaaagcgtcatggggcttggccttggcgtgcgggcggcgcccttcacgtacgcggcgcacgcgctggccgtcgcggcggcggccatggtgttggtctgggccatctacttccgcggtgggctcgccatcgaggccaccaacaagaacctcatcttcaacgttcaccctgttcttatgcttatcggttatattatcatcggcggcgaagctataatggtatacagggtacttccaacatcgaaccacgggacaaataagctgatccatctagttctccacgggattgcacttgtccttggtgcggttggaatatatttcgccttcaaaaatcataatgagagtgggattgccaatctttacagtctgcactcttggattgggatagggacgattactttgtatggtattcagtggatagttggattcgttacattcttcttccctggtgctgcgccaaacgtgaagaagggtgttcttccttggcacatactctttgggctctttgtctacatcttagcactggctaatgcggaactcggctttcttgagaagctcactttcctcgagagctcgggtctcgacaaatacggcacagaggcattcttggtgaacttcacagcgttggttgtcgtgttgtttggtgcctctgttgtggtggctgctatagctccagttcgccttgaagaaccacagggttatgttccaattccagaaaactagtacaaatgaaatgtacatcatatgcagttgccaggattggctgttaccatatggagctaagctattcatctctctttattaaggagaagaagatgatggagttatcacgataagaagatagtgcatcgtcattgtgtgtgtatatgtatatacattccgtgatacttcaaaatttcagtatatgcgaaattgaatatactgcttcacaaaaaaaaaaaaaaaaa

SEQ ID NO: 2317 - DNA, 1170 bp, Zea mays
ccacgcgtccgctaaaaacaacaacaaatcgacgaaataaactgtcatctataggagacggtacggggacaccactcgcgccccgcccgctctctctctccctccctccaactcattggcagcagcagcagcagccgcagccgcgagggccaagcagtggggggacaaggaaaagggccgacgaagaggaaaaaggaagaacgcgtcgcggagccatggggcttggccttggcgtgcgggcggcgcccttcacgtacgcggcgcacgcactggccgtcgcggcggcggccatggttctcgtctggtccatccagttccgcggcgggctcgccatcgagtccaccaacaagaacctcatcttcaacgttcaccctgttcttatgcttatcggttatgttattatcggcggtgaagctataatggtgtacagggtacttccaacatcgaatcatgacacaactaagctgatccatctaattctccacgggattgcacttgtccttggtgcggttggaatatactttgctttcaaaaatcacaatgagagtgggattgccaatctttacagcctgcactcttggattgggataggaacaattactttgtatggtattcagtggataattggattcgtcacgttcttcttccctggtgctgcgccaaacgtgaagaagggtgttcttccttggcacgtactctttgggctctttgtctacatcttagcactggctaatgcagaactcggctttcttgagaagctcactttcctcgagagctcaggtctcgacaaatatggcacagaggcattcttagtgaacttcacagcattggttgtcgtgttatttggtgcctctgttgtggtggctgctatagctccagttcgccttgaagaaccacagggttatgatccaattccagaaaactagtgcaaatgaaatgtacagcgtatgcagttgccaagattggctgttaccacatggagataagatattcatgtctctttattgacggagaagaaggtgatggaattatcacaataaagatgtagacataaatgtgtgtgtatatacattctgtgacacttcaaaatttcagtatatgcaaaactgaatatcctgcttcataaaaaaaagaaaaagctttcatgaacaacaaaattcaaaagcggcc

SEQ ID NO: 2318 - DNA, 2550 bp, Zea mays
gtgtgttgataatgtgttgaataactatgttatcacagattaccagatccgcttccttctctcccgtcagcagattaggcacgagaagttgtataagaaccgtctcccttctcataaacacgtcagagaaaacatacgagacacatgatatagagttggacctctgacctctttatcatatgtattctatataaggggtacatgttctatatatatagatacgtgataccctcaaaggcatattgggtatttggccatataacactttgttagtttctgaacactaacaactatacattagtttatgagatcaaataggccgtaacgatggacgccagcccatgggccaacgatcctccgtgggccgacttcctaaccgcacgaacctccgagacggagcgtgacgcccgcctcggcgcctccgccctccgtcggcggcgcacggggagcatagaaggtgtcgtactcgtacctctcgcacacgcccccatcgccacgcgtgcaacgaagctggctccgtcgccatggccctgctgccgttgcccccctgttccccgtgccaccgccgggccgcgcctttgccggcgcccacggtcgcctcggcgcgccaccgcagggggagcctgcgcctcgctgcagccggtgcctgctccggacctaccgccgcgcggaagccccgtcccaccgccgccgacaggaggaggtaggcgcacgtggatcccttgcgttagcgtcgctcacttctgtgtgccatgtcaaatgctccattgggtgctgcaatggatgcttgcttctgatatagcagtagcgtacaattcagcgaaccacagatttagagattcgtagttaatttctactaattgaccacccccaaaaggaaccctcaaaaaagtccaattggacaagtgtatgtagttgctcgttcacgagttgagtcatccactcttggatatttagatgtctagaaacagtccctgctgctgtttcaataccatcattcttctgctacgcccaagtaaaatcctcagaacacaatgttcagcgcaacctgctcctaaattccgctgcttcggtcatgtctgtctcggtgatggcgctagctgtttagtgcaggtgcgaatgctttgacctccatcggcggttagttccttacgcggaggcttactgctggcagaagtccattgtcgagaggaggaaaaggttgatagacagcggcgaagaccactccgacaccttgattgctttgcaacatccaccggtctacacattgggcaccgacagcaaggaggaatacctccattttgacaaggaagatgctcctttcgaggttcatcgtattaatcgcggcggtgaagtgacgtaccatggccctggacaggtatttatcagctacttttgttgtagttgctcctttcgaggttcgtcgtattaattcttgttggtgtttagttatagctcccagtgactagtaatagaccctagtatcggccatgtttgaagtcaggatacgaccgatcttgactctgcatactcttgttcagtctttggttcaaaaaatatataccacgagtgaatatttcacatgcgcttctcacagtcatttgatttgtttctcctagcttgttatgtacccgattatgaatctgcggtaccacaaagaggatcttcactggtacttcaggtcactcgaagaagtgatcatccgcgcacttaaatccgccttctctataacggcagcaagagtagaaggtctcactggtgtttgggttggtaagtgcaatcaacccttcaagcatttcaccaagtgtccagttctcccttttattgggattttcctaatgcttataaaaccaagggatgccatggtgttgctaacgatccatccccgtttcctctgtaggggaccgtaaagttgcggcgatagggatccacggttctcggatgatagtttatcacgggctcgcactaaacataacaactgaccttgctccattcagaatgattgatccttgcggcataaaggaccgcggtgtggggagcattaaggagatactacaaagggtgtctgatgcggaagagatcgatgacgcgtcactgatggatatagtgtatgattccatgatcaaggagtttgcggaactcttccagctcagtctagacttcagccctggttgcagtttccagtgagaacaacgcttttagcagaccgtatgatgctgccgttgtattctggacggaatgttagctcacggcctttcgtgctcggtatctccgtgtctgctgcactccaccatgtataccacatccacctttcagtcgcaggatatctctggaatctgtagcagtagagtcgggttcttcggtgtcctctcttcatgggctctggtgtttatagagcatcactgctctctctctctctctctctctctctctctctctctctcttgtatgtaacagtgtatacttacacattcttccatctgagcagataataatatcccagccaggcagtcagcgattttaaaaaaaaaaagaaaaaaaaaaaaaaaa

SEQ ID NO: 2319 - DNA, 1339 bp, Zea mays
  misc_feature (1185)..(1185): n is a, c, g, or t
accaaagtccaagcaccttcccaaaaaatcccccattttcttcgaggcgaggagagcgtgaaagacagggcaccggcagcgacgatgtcggggcgcggcaagggcggcaaaggtctgggcaagggcggagcaaagcgccaccggaaggtgctccgtgacaacatccagggcatcacccttgccggcgcccacggccgcctcggcgcgccaccgcagggggagcctgcgcctcgctgcagccggtgcctgctccggacctaccgccgcgcggaagccccgtcccaccgccgccgacaggaggaggtgcgaatgctttgacctccatcggcggttagttccttacgcggaggcttactgctggcagaagtccattgtcgagaggaggaaaaggttgatagacagcggcgaagaccactccgacaccttgattgctttgcaacatccaccggtctacacattgggcaccgacaacaaggaggaatacctccatttcaacaaggaagatgctcctttcgaggttcatcgtattaatcgcggcggtgaagtgacgtaccatggccctggacagcttgttatgtacccgattatgaatctgcggtaccacaaagaggatcttcactggtacttcaggtcactcgaagaagtgatcatccgcgcacttaaatccgccttctctataacggcagcaagagtagaaggtctcactggtgtttgggttggggaccgtaaagttgcggcgatagggatccacggttctcggatgatagtttatcacgggctcgcactaaacataacaactgaccttgctccattcagaatgattgatccttgcggcataaaggaccgcggtgtggggagcattaaggagatactacaaagggtgtctgatgcggaagagatcgatgacgcgtcactgatggatatagtgtatgattccatgatcaaggagtttgcggaactcttccagctcagtctagacttcagccctggttgcagtttccagtgagaacaacgcttttagcagaccgtatgatgctgccgttgtattctggacggaatgttagctcacggcctttcgtgctcggtatctccgtgtctgctgcactccaccatgtataccacatccacctttcagtcgcaggatatctctggaatctgtagcagtacagtcgggttcttcgcggngtcctctcttcatgggctctggtgtttatagagcatcactgctctctctctctctctctctctctctctctctctctcttatgtaacagtgtatacttacacattcttccatctgagcagataataatatcccagccaggcagtcagcgatttt

SEQ ID NO: 2320 - DNA, 1345 bp, Zea mays
aacgatggacgccagcccatgggccaacgatcctccgtggaccgacttcctaaccgcacgaacctccgagacggagcgtggcgcccgcctcggcgcctccgccctccgtcggcggcgcacggggagcatagaaggtgtcgtactcgtacctctcgcacacgcccccatcgccacgcgtgcaacgaagctggctccgtcgccatggccctgctgccgttgcccccctgctccccgtgccaccgccgggccgcgcccttgccggcgcccacggccgcctcggcgcgccaccgcagggggagcctgcgcctcgctgcagccggtgcctgctccggacctaccgccgcgcggaagccccgtcccaccgccgccgacaggaggaggtgcgaatgctttgacctccatcggcggttagttccttacgcggaggcttactgctggcagaagtccattgtcgagaggaggaaaaggttgatagacagcggcgaagaccactccgacaccttgattgctttgcaacatccaccggtctacacattgggcaccgacaacaaggaggaatacctccatttcaacaaggaagatgctcctttcgaggttcatcgtattaatcgcggcggtgaagtgacgtaccatggccctggacagcttgttatgtacccgattatgaatctgcggtaccacaaagaggatcttcactggtacttcaggtcactcgaagaagtgatcatccgcgcacttaaatccgtcttctctatcacggcagcaagaatagaaggtctcactggtgtttgggttggggaccgtaaagttgcggcgatagggatccacggttctcggatgatagtttatcacgggctcgcactaaacataacaactgaccttgctccattcggaatgattgatccttgcggcataaaggaccgcagtgtggggagcattaaggagatactacaaagggtgtctgatgcggaagagatcgatgacgcgtcactgatggatatagcgtatgattccatgatcaaggagtttgcggaactcttccagctcagtctagacttcagccctggttgcagtttccagtgagaacaacgattttagcagaccgtatgatgctgccgttgtattctggacggaatgttagctcacggcctttcgtgctcggtatctccgtgtctgctgcactccaccatgtataccacatccacctttcagtcgcaggatatctctggaatctgtagcagtacagtcgggttcttcggtgtcctctcttcatgggctctggtgtttatagagcatttccatctgagcagataataatatcccagccagcgattttaaaccgtgt

SEQ ID NO: 2321 - DNA, 1252 bp, Zea mays
ggacaagtgacaaatgaatctgtttgaggcttgcttgaatccagattcattggatggacaagtgacaaatgacctgaagaaagctggcagccttagattttacaaaccaaaattcaaatatattttttgtgatatggatggtacgctgctcaacagtaaaagtcaagtttcagcaaggaatgcagaagctctaagggaagctaggtcaagaggagtaaacatagttattgccactggaaaggcacgtcctgctgtaatcgacgctcttagtatggtggacttatctggaaggactggtattgtttcagaatcatcacctggtgtattccttcaggggctgttggtttatggtttggaagggagacggatttataaaagaaatttggaccaagaagtatgtagagaggcactctcatattctatagagaacaagataccattagtagcatttagtcaggatcattgttattcgatgtttgaccaccctttggtcgattctctccattacatataccatgaacctaaggctaaaatagtgccatctattggtcagcttttagaaacagctgagatacagaaagtattgttccttgaaactcctgagaggatttcgtctgcactgagaccgtactgggcaaaggcgatagagggaagggcccatgttgttcaggcacagcctgatatgcttgaacttgtaccacctgcaacttcgaaaggcaatggtgtgaaggttctgttgaaccacctttccattagtccagatgaggtaatggcaattggtgacggagaaaatgacattgaaatgttgcaactagcttcgtttggggttgctcttgcaaatggatctgacaagacaaaagcagcggcaaatgtaattggcgccacgaatgatgaagatggagttgcacaggctatttatgaatatgccttctaagagcaacgaatcattttggactgggttaatttcttctgatttcccatttttcgtggactcaacacagaacaattgtagtggttccaacttgcaagtacacaccgctccaccggagcgcaatctcgctctggtgttacagtttctgaactgttagcaactgtaagacattttttagttggcatgaaccgaaatccagctaccagctcgacatactcttggctggatatgtaaccgctaaccgaattactatttttttctcatttttttatgcaaaagcgttccttttttttaacaaaaaaaaaaaaaaaaaaaaaaaaa

SEQ ID NO: 2322 - DNA, 1122 bp, Zea mays
gggaccctcgggctgccggattccggccggtgcccgccggtgttagcttgccaacaatctctgcggagtaggtcgcctgacgaactcacaaatcacaaggatacgccgagacgtgcgtctcgcttctcccttcctcagctgctggcccgctgcctgcagccattgcccgctcctcgaggtcaaatggcccctgcccccgctctcaccgccacatccgtcctgaagcgttcccacctacccggcgtccactcgttggcctgtcgccggcagccgggggcggaccgcgtctcggtgctttctccagcgatcccgccgccccgcgtttcatggcagcaaggatctggagtggttgctaagaggctcctctgggcgagtgcgagtggttccttcgagaaagataacatcggggaggacgcggtgttgccttctcagatagcggtggagaataaagtagattttttgaagattttaaagagtgccaactccattattccccatatagtgctggggagtacaattctcgccctggtgtacccgccttcgtttacatggttcactaccaggtattatgcaccagctttggggttcttgatgtttgctgttggtgtaaactcaagtgccaaggattttattgaagcaataaagaggccagatgctattgctgcgggctatatcggacagtttgtcatcaagcctttgtttggattcctttttggcactcttgcggttgcagttcttaacctcccagctgctctaggcgctggcataatgttggtttcatgcgtgagcggagcacaactttcaaactatgcaactttcttgacggatccacatatggctcctctcagcattgttatgacatcattgtcaacagctactgcagtttttgtcaccccaacattatcttactttcttattggccagaaattacctgtagatgtcaaagggatgatgtccagcatcgttcaaatagttgttgctccaattgctgccggattgcttctgaatagattccttccaaggctctgtgcagctattcagccatttctcccttcgatgtcggtgtttgtcactgccctgtgtgttggctcaccattggcaataaatatcggggctgttttg

SEQ ID NO: 2323 - DNA, 1110 bp, Zea mays
gcacgaacaaagtacaggtccatttctagcctatcgagctcctcaggtagtaaaaccctacctacacctcgtgccgcctccgtcgccggctcgcctccccatcgacgcgcaggcagccctgcgtttgctccccgtcggtcgggaaaggggcgcgccggcgctgcctccagcaatcaactcgccgcatccaatcacggcgcctccctcctcgattggctcctcggtggttggttgttataggcaggcgggaaggatgttctcgctgagccagatcgagcacgacctcccgatgccgccgcacctgctgagccgcccccttcccgacgccatcaaggccgagctcgagaggctcttcttggacaaggtaatcacaaaacttgggctgtgcgtgtctgtctatgatatccgatccattgaaggcggttccatccatccaggggagggctgctcgacttataaagtttcatttcgtttgctgatgttcaagccttttaatggggagattcttgttgggaggattactggatatgacgataagggattgcaggtttcacttgaattcttcagtgacatttgcatacctggacacttgatgcagtttggcacagtaaggggaccagatggtaggtggatgctgaagactgaattaggcgatgagctttatctagatctagatgacgagataaggttcttggtttctagcacaaaatacccgcctataccaattgatcaaaatgaggatgacccaccatttgctccaatgcagattgttggaagtattaaaggggatggccttggtcttcttgtttggtgggcagctgatgaagaggagggggaggaggcggcagaggaagagcaatagcatcgtgttgcttgagggctcacttcgtgtaatttacagaatcagcctggtagcatgtgtagtgtaggggtcaggttcctaggagaattatgtatgtatgcaatcccctgaaattttctaaatatctgtgagctatatataattttatagcgcagagatctctccctgtaagagcatctccaaaagctccccagaagtctcctctaaatctattttttggggaaaaaaaaaaaaaaaaaaaaaaaaaa

SEQ ID NO: 2324 - DNA, 2478 bp, Zea mays
ccggctttcaattcgcctgcaatcttggggtgatcgattacaccagcattatgggtcgcgtgaagctacagatcaagagaatagagaacaacaccaatcggcaggtgaccttctccaagcggcggaatggcctcatcaagaaggcctatgagctctccgttctctgcgacattgacatcgcgctcatcatgttctcgccctccaatcgcctcagccacttctccggcaggcgcaggatcgaggacgtgatcacgaggtacatcaatctcccggagcacgacagaggaggagttgttcggaatagagagtatctgatgaagatgcttgctaaactcaaatgtgagggtaacatagccgaacaactcacacctaataaagagccaataaattccaacgtagaggagcttcagcaggagattaagacgtaccaacaccagatggaagtcttaaaggagcaacttaggatgttcgaaccagatctgacaacattgatgtcgatgaacgatttcgagacgtgtgagaaattcctcatggacaccctcacttgcgtggaggagcgaaagaaatatttgctgtgcaaccacgtggccccgttcgatccgtcggcctccaacatgcaacaacacgtagacatgttcgccctgccgccggcgccgcctcaccaacaggagcaacaaggggacgacctaggaggcgccgccagcgcgttcggtggcgatgtctcgtggttcgccgatgggatgccgacgtcgtcgatctttgctgcgtcggacccaatcttgtactttagggatcaggtgatgttcgactcgacgtcgacgatgcggcgtgactcgatggtggctggggtggacgacccaggaatgacctcggtgtgccagatggagcagcaagcccccagcgtggactggcagcaggcgtacacgtcggcggagttcttctccacgctgatcccgtccacgccctacccccttgatgatcagatgcagaacgacatggctcaagtgcttacatctccgatggtgccaccgcacgagcacgataaggtggaggtgccgatgagctcgtccaacgtgccgacggacggggattgcggcaccacccttgccgccgctcaagaggacggcctgcccggggtggtcaacattggctagctagctgcatctgcatgtccggctcggctctctgccttcctcacttctttaccaactgcagccatgatttgatcttgtttcacatggacagatgatacttgttattcgtttataggttttattgagcactatttgtggcactggtctagatggtccgacctgcggacggttcatttatagacgtagacagttcacgatagtattagatcagacgaattaacttcctttctccatgcatgtttatctctctaaaaaaaaaaaaaaaattggagaacgtctagaacgggtctagaccccccttatatatttgaagtggaacggccgattgaactatcaacaagcaaatcaaatcaatatatcttctattactttactttatgccatatgagtagacagtaacgtagtcttcttcaccttgatattaacctctcttcgactatatatcatctagaggcgtcttgggtggtctaccgatcctaagacaaatcctaggatatctactccttgacggggttccttccagagggtcagatccaggtgttgttggcaaactccgatgcctctgcgcacatgcggaccgtccggccctaggccgcccactgttcccgctgtcacagagagcattgccgctggtacacctcgtagtgattggcacacggatcagcgccaacacacttttttgcgactccctggagacaagacatgaaaaaccatcaaatcggtcctcaatggctggttcaaaggatcactccaatgtctctctcagcaacatcatcgagccgactatggagactatgtcagcggaccgtccccaagaatatgaggaacgtgaggaacacaaagagaagttgatcaaggaggtccaggccaaaatcctggccaacttcaagatggacaggaatcacaaggtcgtccgacaacggacgactgatcaaccttcgctccgacctactgcagctacccccaaagtaagtgaaataaacgaaatctaagcttttagatcttacatagatgaatgacgagaacatatgcaacaaataataggaggtatgcaagatgattaaaagagtctagcacatgcatttgataaattcgttgttgctaattttccgtcgcacaaggttgaaactaaggaaaatacacgtggttcatcggttgcaaaatggtacgactaatcccagccactttacaatatgccgatgaatacatctccctaccaaccacaacctcctacataaatcggggtaaatccaccgatctgcgcgcggttagaccgttcgcgcatgaggacggactgaccagacaacggggactggcctcgttt

SEQ ID NO: 2325 - DNA, 1278 bp, Zea mays
cccacgcgactccgccccaccactggtcaacgaatctttcctgcactgtcctgtccgccgccgctcaacctcatcggaactccactcctcctcacccccacagcaactcccacctcatggagaaagctgcgcacgttgccgccggcgcgacgcaagagcaggaatcgtctccgaacaggcttgacgacgcagcgaggcatcatggctctgctgaagcgattcctgaaagacttgcggtggtcacaggaggaaacaaaggagttggcctagaagtatgccgccagcttgctctcaagggtgtgacagttatccttacagcaagggatgagaaacgaggaaaagatgctgccgagacccttcgccgtgaatgccaactcccaaatatcatattccatcagctcgatgtcagagatgatgatagtgccaccacattggcccggtatgtcgaaagaagatatgggaagctcgacatcttggtgaacaatgcagctatttcaggaattgtagcagatgaggaaggcctgaaagctctcaacattgatgcagagacatggacatctggcagggcagctaatcttctgaaagaagtattccagaataccaatgatgaggcattcaactgtctgaataccaattactatggatgcaaacgggtaacagaagctcttcttccacttctgaagctatctacatcaggaggagcaaggattgtcaatgcctcctcacttgcgtcggagctgaagagactgccaaatgagaagctgcgaaacgatttgagcaacattgacatctgggacgaggaccggatagaagcagtgctcaacacattcttggaggacctgaaggagcgggcggctggaagaggctgggtggcccgtgatgctaccagcctacagcgtatcgaaaatggtcatcaatctgtacaccaggatcatggcaaggaggtacccggagatgcgcatcaactgtgtgcgacctggctttgtcaagacggacatcaactggaatctgggggtcctgacgcctgaacaaggtgcgagagggccagtcatgctagctctcctccccgatgatggaccaactgggtgctattttgatcagacagaaatggtgaacgtctggtgatcagattgaatggcccttgtctgtcgtcggttatcgaatctgctagtttattttagaactaaaccgctagaaataaaaaagagcggatggagtgttataactttcctgaattcatgatgacataaacacaaaaaaaaaaaaaaaaaagcggcc

SEQ ID NO: 2326 - DNA, 1209 bp, Zea mays
ccacgcgtccgagctaggcagcgaactaaatagaccctaagtaaaacggcttgacgacgcagcgaggcatcatggctctgctgaagcgattcctgaaagacttgcggtggtcacaggaggaaacaaaggagttggcctagaagtatgccgccagcttgctctcaagggtgtgacagttatccttacagcaagggatgagaaacgaggaaaagatgctgccgagacccttcgccgtgaatgccaactcccaaatatcatattccatcagctcgatgtcagagatgatgatagtgccaccacattggcccggtatgtagaaagaagatatgggaagctcgacatcttggtgaacaatgcagctatttcaggaattgtagcagatgaggaaggcctgaaagctcttaacattgatgcagagacatggacatctggcagggcagctaatcttctgaaagaagtattccagaataccaatgatgaggcattcaactgtctgaataccaattactatggatgcaaacgggtaacagaagctcttcttccacttctgaagctatctacatcaggaggagcaaggattgtcaatgcctcctcacttgcgtcggagctgaagagactgccaaatgagaagctgcgaaacgatctgagcaacattgacatctgggacgaggaccggatcgaagcagtgctcgacacattcttggaggacctgaggagcgggcggctggaagagactgggtggcccgtgatgctaccagcctacagcgtatcgaaaatggtcatcaatctgtacaccaggatcatggcaaggaggtacccggagatgcgcatcaactgtgtgcgacctggctttgtcaagacggacatcaactggaatctgggggtcctgacgcctgaacaaggtgcgagagggccagtcatgctagctctcctccccgatgatggaccaactgggtgctattttgatcagacagaaatggtgaacgtctggtgatcagattgaatggcccttgtctgtcgtcggttatcgaatatttatcatctgctagtttattttagaactaaaccgctagaaataaaaaagagcggatggagtgttataactttcctgaattcatgatgacataaacacatacacatggtaaaacgttcttatgatcagttggtgtagtttccatatctcgagactagttctctctctcctcgtgc

SEQ ID NO: 2327 - DNA, 3600 bp, Zea mays
attggtacctcgagccggcgggatcgatactgaacactattttctctctgcagaagatactccatccttcctgtgatcttccctaccttctcttgtatcttcctccactcctgctgtgtatcttcctccactcctgctgttcggttagggattagtgagtattgctaacaattggtatcagattcgttcgatcctcggagttttctacctcgatctgttttcctcgactgctgcatcgacatgtcgctcgatacgaagctcatcctcaacgccattagcgagctcttcgacaagttcgacgcgcgatggtccatgagggatgccgcgcgggaggcatccaggcgcgtccctgttccgacccagtgcacggttgtcggagccgacgtggtcgccgacaactggggcaacctcttcgacagtggcgtcgattccgacgagcagcgctacgaggaacccatcaacgccgacaattggggtggattcttcgatggagcagacgtgtctgccaacgccgagttcgccggccactgggacaacccttcctccaaccccgacgcgactgcctatgtcacaccagaggttgcggtggaatcggtgcacccggccgcacgcggacgcttcttcaacgacgattcgggtgccccgcttgactcggacgacgacagctccgtccacggcggccacggatccgtgatgtcccatctcctggagcgcgaggccgacaccgccttccttccccactcggatcagcgggatggagttgaggcgtggctcatcctgcgccggtgcactcccgcctccttcaacgtcgcctccaccgaccccaacaacgaggtctcgagcgccgttaccgcggacgcgctcgctaaggccgcgcccgcgctcttcgcttcgagggcgcccagaccatcgctcaagtacctggagctgcttctcccggcagaaatcgacttcgaccacattgacctaccgactgctgccgccgcagggcacatcgtcgcccaggtcaccggcaacaacgcggtgtccgtggtggaggaccaactcaggtgcaccctcttgctcacgcgtaacttcctgtcaagccaccaccaggccgtcagcaaggagtgggacatggtcgccgtcgtgcacccagtgtgcaacctggggggaaaaggtggacgccatctgcactggccagatcgagcacctgctactgcagcacctcaagccttcacctacctcgattggtgccaaggcggtgttcgatgaaatgcagcaaagcaccaattccgcgacaacgacacccgcatcctcagctctgacaacaacaacgactacaaccatggctgcaccggccacctggctggacgcgcagcctgctgtgtcgacatgctcatcagcatcttctgctcaagaagatacaccaataccactcctcttccttcgcggtggactgggtatgatggataatgtcttacctgctaattctactttcctgtctaccaacatatcactcagcagcatggagtgtctgagagagtttatgcttcaccttaagctcggcaccgccagattcactatttgtgacgaaagtgtagtgaacctgtggtcgtcgccggtggagcgagttgttcagcaacaaacatggctacaacttgagttgacaaatagtggtcttgacctatggcctatctcatggcaatcgcaacaagtctattttggtactcaccatggattcgctgcatggcccaggagccatggcacaattcttgtcttcgattttagcaataccttgtcctggaacaactcaatgtcgattgctgcttcatgcccttccgtcccccgtggccccccgggtgatggagattctatgaaccggtgtttcagttggtgttggaagcctccatggttacatccaggtcagtcgaaattcagagatttcctctggtggtctttttggtatttccaatttgtcaggtccaagtattatgggtgcagagcatcacaattactaactccttggacaccacctatgacattatgtttggttggcgatgaccttcttgtgatgctagttattccaagtatgctactgttatctcggtgctattttagtggagtagaatgtgtgctggcagctgcagatccgttattttctacatttcatgctgagagagagttgttctggaagccaccttggcaacatctagttcctaacaccagatctgagatacagttgttgatggagtttgtctatctcaatacaggagtctgccgttctctgcacatgattactaaattttctaagcaatactttgttggcctatctttgctaattacaagggaaaaatttatgtctgggagaataatgttggctcttcttccacttctgaagctatttacatcaggaggagcaaggattgtcaatgcttcctcacttgcgtcggagctgaagagaatgccaaatgagaagttgcgaaacgatttgagcaacattgacatctgggacgaggaccggatacaagcagtactcaacacattcttggaagacctgaggagcggtcggctggaagaggctgggtggcccgtgatgctaccagcctacagcctgtcgaaaatggtcatcaatctgtacaccaggatcatagcaaggaggtatccggagatgcgcatcaactgtgtgcgacctggatttgtcacgacggacatcagctggaatctgggggtcctgacgcctaaacaaggtgcgagagggccagtcatgctagctctcctcccagatgatggaccaacgggttggtacagagatgaaatgggcgataagatgggcagcctattatttttcaaaatggtcaagtattcatcactagtcgagggattttgtggtgtgcagttttcatttcctaatattcaattgtgcaagtcttggtcacaggagttagccaccaacacagaaagccatttactaccagaaatgctagaagcggccaatggttatatttgtcatgagcttcatcttatgcttacctctattggagtgacacatatgatcgattgtgttaaatatttgataggggttatcgacttgctaactccatgggatcctggcatagtggtcttcaacctcaagttcctgatgctttggcttgagggcaagccaaatcttaagaaggggggaatgtcagtactgatgagatggaaaacggtgtggtggctgatggcgggtcgcgtccgcctcgtgtgcatcatctgagcgatcgtgtatatgggccggaccgaagaaagtgacctgttgggcgcctgcgtgcgcgaggatagctgggcctggtttggcagcttgtaagcaagtagtacttatgcactgcctgatggaagggtcaggattatcgaaaacatgaacaactatttcctctctgcagaagatactccatccttcctgtgatcttccctacctcttctcctgtatcttcctccactcctgctgtgtatcttcctccactcctgctgttcggttagggattagtgagtattgctaacacatggcctgcgtgccgagcgcgagtgggggagggagcgcgagtgggaacgccggcgctgaaaggaagacgaagaaac

SEQ ID NO: 2328 - DNA, 876 bp, Zea mays
atccgctttttatctttaaataaaccggcgtctcctgccctggcggggacgccgctgctgacagggcacctgatcgattgatttcctcgggcagtcagcggcgctcaagagtcacgagcttactggttgtaagcaacgatcgacgaacgaaggggtgtagggagtggaagcaagaggctcagcgttctgttcatggagagccgcaaggaggagcaggcggcggtggggtggatgacggtgccggcgttcggggagtgggacgtgaagaacggcgccgtgccggactactccatggacttctccaagatccgcgagatgcgcaagcagaacaggcgcgagctctcccgggccagcctcggcggcggcgacgacgacgacgacgacctactccagaagaagcagcagcagcagcaggaggagggaagcaaggcccagccgcgcaacaagccctccgccgccgtcgcggacgacgcccaccgtcgagcgctgcacgacgactcccctacggggaggaagaagttcctgagctatttccagtgctgtaccagagcgtgaagaaaactcccaagacttgttcttcctctgctgcgctgcgcaggtagctgcatgtttgggtttccttctgtaatgtatgtaaagcatgtctgcgtagttaaagtgtgtgatcctgtcacccatgccaagcatgagagaggggaggaacgcccatggctcacagcttctagtgcagtgtggtctgagaaaaaaagattggatctgatgaagaagggtgtggcttgtgtgtttttgtttgttgctgtacgagattggatgcacttgagatgatgtattgacgattgtccatcttgttcttccttttcaaaaaaaaaaaaaaaa

SEQ ID NO: 2329 - DNA, 4391 bp, Zea mays
  misc_feature (2314)..(2314): n is a, c, g, or t
  misc_feature (2808)..(2808): n is a, c, g, or t
cggtttactaactccatgtgaaagttcagactttgtgattttatctcccttcaaatactccagatcagcgagtgcccgggcttcgcgtccttacccacaggggatgatgagcagcctcgcctcccttgaaaaactgcatcgtctggtgagtttgttctgctgtatttttgagctctatagacgagccagcctcctttccattactgaccactactctattattagatcattgaagaacctatttcctcagttctcttttattctcttcaaaatgatgcaatgttccgactagtttctaacccatgtacaaattaagggcagtacttaaaaaatgttttctacacgtatccaatctaccaatactgtgaccattttaaactaattcgaattctgtccaaatcctaggtacattagccaatggtaaaaaacaagcaaagaatatgagaaataccgttgccctaatgctgggagaagggggagagggattgaacaacaaaacccaaatcccggacgaggtgggcgacatagaaggaagaagggatggaggaagactggaagagaagagagggactgagggagctgcatgcgggctctcttgatgcaccagatggtgcgccgctattcagtgctagacagtttggttgtgagagagaggttagttttagaaactagattttagtttagttttttttttttgctggctcttcgtgaggaagagatgcaactgcatgtttggcgtgaagtcaggcagctgcatgttcggttgaccgctcgccggccgtgtccgtatttgggttggggagggaggtgctcttgtgttgtgcttcccaccggccccggcctgccgcctgtccttctcctctcctctcctggagagctgcatgttcatctgaaaagttgacaacgacagacagttcctgaccacagggcgcgatggacgtcccggccgtggcggaccctggaacggagcgaggcgaaggcgcgctgatccagtgcccgtactgcgactcggaggcgatgcacaagctggcgcagatcctcctcccgggcctcgccgccgtctgcgtggacggcaccacgggggacccgttccgcagcccgtccgcggtggccgtggacctccgcaaggagatggtggactacatcacgcagcggagcgacagcttcatcgcggacgcgctgatcgagtcggaggcgaaccaggacgcgcccggggccgaggtgcccgacgaccccttcgagaccgtgtccgtcttcatggacgacttcgccagcaccaagcgcaacatcatcggccacgtctcagggtggctgctcaccgacagccgcgacgacaagatcgacgacttcgtgcaggagatggaggccaccaagttctggccgctggagcgccgggaggccgtcgccgagctcctgctcaagaacgtcgacctcaagaccaggttccactgccccgagaagtacgagaacgaggagcgcctcgaggaccacaaggcgcagtgcagcttccgccccgtcgcctgcgccaacgacggctgccgcgccaaggtctccgtccgctgcgtcaaggaccacgacgccgcctgcgtgtacaagctgctccagtgcgagcagggctgcgacaagcgcctgctcaggcgcgacatggaccgccactgcgtcaccgtctgccccatgaggcccatgaagtgccccttcggctgcgattcctccttccctgaccgtgacctcgagaggcactgcgcgcgagtcccttcagccgcatctgctcatggtccttaaggccatccataagaaaggccggtcggaacaagacctcaaggaccttgctcaaaagctggaaaaggttttgtttttctcatccccactcatcgacctgctttttcaattggattcagcgctcaccgtcctatttgcttccgaaatacgtacagtgattgtgatgagattcagttttaacagagaagcccagtttggtctggtaaccttgccaatcttttcaactgattattatataaaataaacttgcgcttttgctcctgtagtttgatggagatggtaaactggctaaggctctagatgcaagacctcttactaatgttgtcaaggacctcgaagccaagatgaaaggtggacagtcaagttaaaagggctgggtctttcatgcagacagacttcacagaatggataatggcattgtttagtcccacgcgcagcatacatacagagaagaatatgagttttgttttattcttatctcctttacgattttttttcacatttctccctgtctgtcagagttttgttttattcnttatctcctttacgatttttttttcttcacatttctccctgtctgtcacaaacaaaccaattgtcagtcagtatgcatagtcgtccgctattgctctgtatcttcagcttttgtatgaggatattatatcatttgttttggtatataaatcaaagaacgggccatgtttccagcaggcttgttctgtaccaaactgatcacttgttaatcatgatgaatgaggcctgctgatattcacatcgaacaacagcgaggttaatgagttgcatgtaccagtcgagctacttgggaattgggtgtacctcacgattttgttttggtagaaagacaccttttccgaatttgagatgtgaatattttgatctatatactgatccttttcctgaagcatagtgaaaatattttggaaaacacttcagaaatgctaactccgctttgctctaacattttagcaaaataatatttgagagtcgttacggttgcgaggagacaanaaagtgctcttagtacggttgtttttgcatgccctagacatatcaagtggtgtacctaacttgtgcaacggacacatggcttgttccaacacacactatagttttcaacccaacaacttgcagtttggtgtgtatcagacatgcaacaccaccggacgtagtgtgtgaaaactttaagttggttcaccgaacgtgaccgatgtcacaccaaacaacgcataggatagtagttatgctggaaaggcaacccgagagcctatgacgctcaccagactccacactagacatgggtttcagagagcacgaaaatcaatcttcagctccaacgagcaccagacgtgtttaatgtgagcatcaacatctgacacgcaacaatggctaatttttagccattgaaaaagagtcaccaaattagtactagatataattggtacgagcatcggtcagtgtcctcgcagtgcctacttcaagaagtaataattggattctttgagtgggcttataagtagacctagatgccattctcttggacttcctaactattcatttgcatttgcatcgccgttcttgtatccagtggcaatagttgggtgtatttgctggtggttctcttgttgctactcttggtgatggaaccaacaataattattggaagactaaaatgagtacatgcttgagatcagtgaacacgagagtttgggatgttggcacttcataatttcatagtgcttcatatgaataacccgacaccaagaaatgaagaaaatttgcaatacaattatgttgctctcaatgtgatatgtgattcaattaatcaaaaagcgtttgagcaggtcaaagtatcttgaattcttattggaggtggggaagagattggaagattcatataatgacgatcaatgaagcaaaattatacactctcaaagacaagttgataaggttcaagatgcaagaagaagaaaacatttcacaattgtttcataatatcgatgtcatagtaaataagcttagaaacttgggtgacaaaatgagtgttgaggatttctctcattaatttttagatgccttccactaaggtttgacacactggtaccaattattataagaagcatcttcaaagatatcatccctatctaagcactgcatgatgtgataatacaaaacacacattatttaaaaagggatgtagttgatcaagagaatgggatcctaagacgatatagcaatgaaaagagagagtaagacttcgatacgataaaatataccataatgagacttgataagatggaatatatttaagatttaattttaataggtgtacaaaaataattatttatatgattgaacttggcttagggcatgtacaacttcattaatggagggatttattgagggatctctaagagttatgttaaaaaaaatcaagagatgggcccttcgtgaagactttgtctcttcacgactctatgtatatatatagtttattaactatattaatgatctaatgactcagagttgtatcgtgcggtctcttacctatctcttgtatctgaaaaatcgttccaatggctctaggttataca

SEQ ID NO: 2330 - DNA, 2019 bp, Zea mays
tgggtacctcgaggccggccgggccgggatcaaatccaagaactctcaatcagccagcccacagccaattaatctctcgctagagggccggccggccggctagctaaccacgagagaaaaaaaaaagatcgcgattgctttcgcgcgcgcgctgcgagaggcgctccggccatgtcttcctccccagcagacctctcctgcgtcctcccccgcgttctcatcgtctcgcgccgcactgtccgcaagaacaagttcgtcgacttcgtcggtgagtaccacctggacctcatcgtgggctacggcgcggtgccggtgatcgtgccgcgcgtggcgggcgtgcatgcgctgctggactcgttcgagcccatccacggcgtgctcctctgcgagggcgaggacgtggacccgtccctctacgagtccgccgacgcctcgctctctccggagcagctggaggccgtgcggcgcctgcacgcgagcgacgcggccgtcgaccgcgagaaggactccatcgagctccgcctcgcgcgccgctgcctggagcgcaacatcccctacctcggcatctgccgcggctcgcaggtgctcaacgtggcctgcggcggctcgctgtaccaggacgtggagcacgagctggctgaggcccagcaggtccaggtccagcacatcaactacgccgactacgacgagcaccgccacccggtgcgcgtcgtgcccggcacgccgctgcacgagtggttcgcgggcgacctcgccgacggcgcgcggctcatggtcaacagctaccaccaccagggcgtgcggcgcctggcgcagcggttcgtgcccatggcgttcgcgccggacgggctcgtcgaggcgttctacgacccggcggcgtacagccccggcgagggaaggttcatcatgggcctccagttccacccggagcgcatgcgcaggccaggctccgacgagttcgactaccccggctgcgcccgggcgtaccaggagttcgtccgcgccgtggtcgcgtaccaggagaagacggcggctacgcacttgccccggccgggcgccgcgctccccctccccgcgtcttcgtcgcccaagctgagcaaggagatggagaggcggcgcaaggtcatctcccggagcttctcgctcgccaaggacatgtacctctccggcggccgcaccaagccggcggagcagcgcgagctcgaagccggagccgagttcctcgagtcgaacacggcgtcgctgagcgtgcagcaggagaagcggctgaagcagatgggcgccacggtcggaacgcgtcagggtacctcaacagcctcaaggtgaagggcgtacgcgaggcggcggcgcgggcactcatggcggagatgaccgtcaaccaggtctccgacctcgtcaccttctaccagacaatgggcaagatctgctccgaggtgctcgatgccaagctgcagggtttgcacctcagcacgaacctgtatgaataaattaacactcagcgtgcagtgtatcaacctatatcggtgttcccactcctgcttgcggatcctggatccctggtgttattggcatgatacatcaatgtcgttaaagctaaaaaaaaaaaacatatataataacagagtgtatagagataaatgtcacaataacatcagagtatttattacatagcggaagtcttacaaaataaaatataaatatggatcgaactaaaatccatccttggcgccaaaaagtcaactgggagacgtcgacctagatctctcacgaagacatcacaacatcatccatgcgcctcaccatgtggtacttgtccttaacctggcacttgagattccagttaccagggtgattcttcagatcctcgtgaccgcactcggattatggtgacggacgcgcggttcatggcgcaaggcggagaaacgtgcccccgcgggatctcttgtcgccgacgagcaatccagagggccaacaccaccgcctgcgcccgatgagggtcccagcaaccccagcgcgccc

SEQ ID NO: 2331 - DNA, 1764 bp, Zea mays
cccacgaggatgaagagacatgatgggagataatataacgacaagaatggcgcaggctggtgtaattcaattggtgcctactttacaagaaggtggtgtgagcgatacccaatgtgttatgccacaacaaatattggaacagcacgattatggacaattgaccactagcacagcactgattgatgagagtggtacagatttgacgattaaaaagaagctagattttaatgtgagtggagtaagcttgagaagaccggataacgcgaagccaaagggcagaacaatcagggatacagaaaaaagagttattaagttgggggcaaaaggagacaaaaaaaagaacagaaagtgtcaaaggtgtggaattgcggatggtcacaatagtcgcacttgtctatctgtggaggagaataggcttcggttggccaagcccttactggtcgaaagagagggcggcccataggttctaggaacaagggttcatctagcgctccaaactggaatgaggcatgcacttcaaaaaaacatcaaggaggtgtcacagacaatgattcatctagtggggagtagatgatttcatattttatgacaaatgtaatgtagtgccatacttgttattacaactatgggtgaatttataaatgcttgaaccagtcgatattcacaaagtataagtaataatgatttactgcatgtattgatatgttgtgtaaactgtatacgaaatatgcgtaaatgtgttatgaaaacagcgtaattcgacgctatacaaattttggtggcaaaaactggctaaaaatgtcttggtgaagaaaacaaacgacacaataaattgtgatttaatgtagtaacataatttttattacacatgtgtgcgagtagacaaatgataccagtaggtattgacaaaacaataaggctgtacagatttgcataattgagctaacaaaacagcgtaattcgtatgtaattaaaattattgtaaactgggtacaagtttgcgtaaatgaactaacaaaacagcgtaattcttattagacataagaatttgtgacacatactggtaaataatagatttgtgaagaaatcagagaataacaataactagtgagtacatcactgatataaatatgaccaaacagtcgaagtttgaactgaagatgtttcataacttgtttaacacacataggcccaatttttatctaaaaactgcattagacatgagtgtcttgatagcttgggtgaaaagcatagaaagtttcaatacggttacatagacatgcaacaaggaggtttggcttcacaacatcttgttccgtaacaaggaagccacaaaatgtttgttccatatcaaacggctgcgattcacagaaatgttgatccagcgacacagctagcgtccaaacttgaatctttgaatttctggaggcaacgggaggcacttgttcttgctatggaaggtgaggtaatgtagagccagagatcgtaggtcaccagagttttcctgcataatacagattatcccgaggtgaataagttgtatctgaaatgttgaacgtataaatacaaacagcataatcataaaatgactcactcgttttataaattgcttgatagaaccatctgtatggtcatagtactggatgtatctcatgacaaaaaagccacaatcattagagccagctatcatggtgggacacataggtggcatgtcaattgggaaatttccaaattttgggatgcgtgaatgggccggactgtgca

SEQ ID NO: 2332 - DNA, 3449 bp, Zea mays
gattatataatggtaagtagattaccaaaactaaccaacataagttaaataaagacctaattataaaacaatgagacatggtataataagtgttgttattgcatagtaaatatttatacgagactaacgcaacttgaacggatcaaatcggagttaaaacggaggagttatgaatttcctaaggttttatgtattcaatacaagattaaccaagagattaattttaatacaattttcatgtcaaaacagtggcactatatgatgaacaataatattacaaaattataggaactagaatggatcaatttggatctaatatgaattttctatgaattaaacaagttctaacaattatttttacattaaaaatcattttctatttaattttcctgggttttctaatcttttagactgcgcgtaaatttctaggaagcacaggggctacggcgcaagtattccaagactcagtctacagtaattgtggacggcgggttttatttcctaaattccataggtctcttacgcaaagtgtgcaaaccgaagcggtatcgtcccccgtgggccgtccgatttctgtgcgacggttaagattttaaaacaggcatgatctaatcctagtcattcgatcaattcttgacgttccagattagatccaagccctattgaaccggtacaccactaggaccgttgattccaagatccacgctcagattttacccaggccggggtcaaatccacaccctcaaatcaaaaggggacgattggatttaatgtgccgaacaggtattctaccagtctaatcggaaccatccacccgtgatccaacgaccatgattttatgaacccaggtccactcctatccatccgacgatgacagcggacaccatttccccagtcgcaaggttttcacgagatctaaccacagtcgtcgatttcctgatcaatggtcacgctgctacgtctatcaacagcagaggcgcaacgcactaggcggcactgccaagtccaaacgccggatgtccagacgccggcaaagccgcggggcgacggaggggagagcaggactgggcaaaggtgctaggcggcgcgcggtgagcgacgaacaatgccggaggtcgctggcagctttgggctggtcatggcggggcgcggaccagagccacgggtgaaactgcaaggcagcggcccgatggagtgacgacgacgagcacgagcacacaggcggagcgggcgcggacaaaagggtggagacgatgccagcgcagccgtagacaagaccgtggatacgcatgtccgccccatccctactacaacacccaacttcggttgcatctccgagaagagaagaaagagatacgaggaagaaggatggctcaccgacgacgacgatgtggcgaatcactttgcagttcgaggccaaatctggttgaccaacgaataacaccggtctctgggcgctccccagacccgactccaaagcttgccgatggcgaggatacgaggtggcttcctcctctctcttcgataaagcacggtgcgaattccccaagggcggctcgccctggggagtatcccatcgcgcggccatggtgaccttccttgcaccgaggcagaacctcccatatacccaaggtcccagggcgggtcgacgcgcaagtccagtaaacctggccgagttcacggggttagttgtaggatatggacacgaacatttttgttgtggctccctccgtgagcgaaggaaggggatgaccaagtgcgtggacacgctatgaccgacgaacgggacccgcacgtcagtgatacgagcgcgcaccaaagttggttgcgcgacatgactgaatgggtcgagttaagcgggattcggcccatgcgcaagttcttccttttttattcttttctattttcttttctttttattttcaacttataattcaaaatttgaatcccaaattatgtcatgcacacattttattttattttaggaaagatattacttttgagtatgtgatcaaatttcaagctaactaaaattaatactcattatcttacttatttaggggaaaataatgtattctcttttaccaagaatcacttaatcttgattttttatttaagagcattctttaaatttcatgagaagaatatcttatcttactagatggaagatatttctattttatcttatgtttactcaattttcttagtgttacttcctataaaaggcgtagaagggatatccgaactcctgacacattttagggtttacataaacacatcaatccgtctaagttgtcactcgattgccaaaaccaaagaaagacctttcactcccctccctctttcttttggaatcttcccctctctctctttggaaccaagtccccaacaaagtataatactcccaccaaagtataatatatatttaatatggtccaaggaaatccaaagagagtagcaattttggtcacaatataattttcattaatgattgttaaatcataaaagtggtagttaaaatatgattacttatatatttaaatgtgtagtcaaattatattgtgtattgagatttaataatcttttttttttttttttgtaataaacaaataatatagccataagaatgaaaacgtccatacattacccattacaattgattgataataacaaaaatgacttacaatatttgccaaattaaaaagaaataaaagcatgcaataactcaatcctatcaactattttgttggacctctaaaatgtgacatgtactagcctatgtcaattatataatgagtgcgttgatagataagctagcctagtatttgttatctagcatatccatctcttataatttatgcaaatagactagtacatatatttacaaaactctcaaatgatgatagctaaattattgataaatagttaaatatcatttgttcttatgatctttgtagcttatatatattattataagactgcgcaatatcctctgcaattttggtggcatccatagacacaccaagtagaccacgccttgagaacccagcagcatagagtccatcctttcctttccattcatttggtttgtttggaaatccactttgctgtgaaaaaaattcattctcctgcataccaatgaaggaacatgtactctagataaataaccatgttcagtgcataataataaaaacaagtataagatagcaaaagaattatattatcaccttcaaccaataaggaacattactcttataacctgtggcaagaatcacaacatcaaatgattcaatcctaccatttgtaaactctacaccatattcttggaaacttcgaattgcaggaaatacctaaaaacatacattaagtataatagtatgagcaatgcaattaatatagttacatgatgatagtaacataaaaataaaaatattaattaattactttaa

SEQ ID NO: 2333 - DNA, 2346 bp, Zea mays
gtgaatgattgggtggttcagcatactacaaggtcgaataagattgtgtgggggcaacaccaattcaaagtaatggctgatgcggatgctagaaagtttgcatgtgaatgcaagcattgggagcatacaggtatgttatattgggtaattgttatatacaactgtttatttgtaagtgacaataagcagacacattatttatttgttttgctataggtctgctttgtgtgcatcttttacgaacatttatgcatctttagattgatcgtattcctacggaatacatccttcagagatacacctactctgctatacaagatgtgactttttcaagggatgataagaatttgaagggtaaagacggtgagactaaatcatataggcaaaagatgttgcttaaaaagtcaatgaaagtagtacatcatgcaagtctttcaaaggctggatatgatagagccctggagatgatggatgaactgcttttgctactttcacggttggagccagatattgaaggtgatgatagtactagtgatggcgaaggaatacaggtatttaatatattaattgtaatagccgtgtattttaattgatatactaagttttaagttttggtgaatgggaaatatgagaaacttgcctgatacagggcgacaggaatgatgtaagagacatgatgggagataatctaacgacaagaagggcgcaggctggtgtatgtgtaatatgttatatgatgtttactatgcataatggtgtgtactgtttgtcataaacacaactatttactgtcaattgtatgatttgtcaggtaattcaattggtgcctactttacaagaaggtggtgtgtgcgatacccaatgtgctatgccacaacaaatattgggaacaggtaatacatgattataaaagaggaaaagttgttgtaatacaaaatagtaacgattggaccttgttgctgattatgaatgattatgaatggtatatgtgtgcagcacgattatggacaattgaccactagcacagcactgattgatgtgagtggtacagatttgacgattaaaaaggtaatggtgctattaaaaacgcatgtgcatggatattatttaaaattacatacaaataattggatttaagtactaatatttaaaaatatcatatttttttcttaattgtagaagctagattttaatgtgagtggagtaagcttgagaagaccggataacgcgaagccaaagggcagaacaatcagtgataccgaaaaaagagttattaagttgggggcaaaaggagacaaaaaaaagaacagaaagtgtcaaaggtgtggaattgcggatggtcacaatagtcgcacttgtctatctgtggaggagaataggcttcggttggccagccttactggtcgaaagagagggcggcccataggttctaggaacaagggttcatctagcgctccaaactggaatgaggcatgcacttcaaaaaaacatcaaggaggtgtcacagacaatgattcatctagtggggagtagatgatttcatattttatgacaaatgtaatgtagtgccatacttgttattacaactatgggtgaatttataaatgctggaaccagtcgatattcacaaagtataagtaataatgatttactgcatgtattgaaatgttgtgtaaactgtatacgaaatatgcgtaaatgtgttatgaaaacagcgtaattcgacgctatacaaattttggtggcaaaaactggctaaaaatgtctttgtgaagaaaacaaacgacacaataaattgtgatttaatgtagtaacataatttttattacacatgtgtgcgagtagacaaatctctgataccagtagttattgacaaaagaataaggctgtacagatttgcgtaattaagctaacaaaacagcgtaattcgtctgtaattaaagttattgtaaactgggcacaaatttgcgtaattgtgctaacaaaacagcgtaattcgtattaaacagaagaattcgtgacacatactggtgaataatagatttgtgaagaaatcagagaataacaataactagtgagtaaatcactgatagaaatatgagcaaatagtcgaagtttgaactgaatagtgcattatacaagagatgtttcataacttgtttaatacacataggtcaaatttttatctaaaaattgcattaagcatgagtgtcttgctagcttgggtgaaaaacatagaaagtttcaatacagttacatagacatgcaacaggtagtttggcttcacaaaattttgttccgtaacaaggaagccacaaaatggttgttccatatcaaacagttgcg

SEQ ID NO: 2334 - DNA, 2391 bp, Zea mays
ttttttttttttttttgtaataaacaaataatatagccataagaatgaaaacgtccatacattacccattacaattgattgataataacaaaaatgacttacaatatttgccaaattaaaaagaaataaaagcatgcaataactcaatcctatcaactattttgttggacctctaaaatgtgacatgtactagcctatgtcaattatataatgagtgcgttgatagataagctagcctagtatttgttatctaacatatccatctcttataatttatgcaaatagactagtacatatatttacaaaactctcaaatgatgatagctaaattattgataaatagttaaatatcatttgttcttatgatctttgtagcttatatatattattataagactgcgcaatatcctctgcaattttggtggcatccatagacacaccaagtagaccacgccttgagaacccagcagcatagagtccatcctttcctttccattcatttggtttgtttggaaatccactttgctgtgaaaaaaattcattctccttcaaccaataaggaacattactcttataacctgtggcaagaatcacaacatcaaatgattcaatcctaccatttgtaaactctacaccatattcttggaaacttcgaattgcaggaaatactttaatgttgccggacttaatctgtgctatcgtccccacgtcaagcaccggtgtcttaccagacacttgtttgagctccattggacccatgctaggccgaggaataccaatttgtgcagtgtctcctaaaatgaaccaagcgagtagaagaagaatccggtccactatttggacacgtagaaacttgaggagccacacagacaaactaaaagttgagatccccatgacctctcttggaagtacgtgccccgaacgacgaacagccatcgatgtgtgcacgttgtggttagcgaggtcgagagacacctccatgccagagttaccgcagccaacgactagcaccttcttgccttggaaggactcgccgctacggtagtcacatgagtgcattacttgacccttgaagttatggattcccggcatgtcaggcacaacaggctcggcgttctctcctgtggcaacgatcagccatttggagcggtactctcggatagactcctcgccgctttggccgttgagagtgccagtggggatgacatctttggtgcggacacaccagtattcaccgttgtactcggcagcgacaacctcgaggctgaaaaatgggcggatgccaaatgcgcgcatgtactcattgaggtagacaaggaactgctgccgggttggatatgtggggtaggtgcgtgggaagtgcatgagcgggagctcacagtagcgcttgggtaggtgcagacacaacctgcggtacgtgcggcggtgccacattgaggctacgcacacgtcgcgctctaggagcacgtagggaatgtataacatggtgagcaacgccgcgcatgccagacccgccggccctgcacccacgataagcggcccacgtagcacggccacgccttgatcgccgacagggatgccggtggttgtggccctcgcgatgctgcgtggactgtacaccagtgaatcgtgctccattttgtctttcgtctcatcggagaaggtggagctgtgtgccagtggctcgtgcgccatcttcccctctatctcagtgaagtggtggtccatctctcggtcgaccgagatgatcagcacaacaactcctaactcaactctctctcctactcaggaaaggatatacgaggaagggatatatggatcgtttttcgattaggatgttctacctattggtctcgtgcatggtcggggcctcgttatccgctgctccaccaatgcaagcacactaatggtttgcctgatagaaaagatccggatcagatgctccgaggaagcaggacacaatgaacatgcatacacacaccaacgtgctaataatagatcagcaaacatgcatgcttgttgatccattcgttttggactcaccgaggcgcgcgctaagtcagccccagagggaatgagcggttgctagagtccgatgagacttggagcatgcatgatgtatattcttagcctgtagaacttatccacagataattattattctacaagtctgctaatacaacattattctatatataagagatatgcatgcgtggatatagatctactataacctaaattagttaacaaaatgttaatattgaattagatcacgcaccaataatgataatacaaccaggatatcacacttacatggtaaagaacggagatgtttacaagcaaacagtggcgggtcctggatttagagcgtgggtatttgaatttttttgg

SEQ ID NO: 2335 - DNA, 776 bp, Zea mays
ggcgattgggtttctcgaggccggccgggatcgattgccatacgcttcacacatccatccatccatccatccatccctaaaaatcaaggctacacaccaacttactttctaggtctcaaattaaatggcctcctcgtcctcctccttgctgctggcgtcgatggcggtggcggcactctttgtcgtcggctcgtgtggcggcgcgctcaccttcacgatcggcaaggactccagctccaccaaactatccctcgtcactaacgttgccatctccgaggtgtcggtcaaggagaagggcgccctggactggtcggatgatctcaaggagtcgccagccaaaaccttcaccctcgatagcaaggagccgattaagggccccatctccgtccgcttcgctgtgaaaggtggtggctaccgcgtcgtcgatgacgtcatccctgccgacttcaagcctggctctgtttaccagacaggcgaacaaatctgagtaatggattctgctgcgtgcagattatattgatctctaaaataaatgtttgacagagactaattaagcacacaaacaaagcaaggcactaattcatttcctatgtttactttgtggtaggcaactgcaaaacaatgtattgtatgcatgttctcctctcacatatgttgttggtgtgctgtatatataattaatttcttaactttttttaaaaaaaaaaaaaaaaaaaaagaggcgccccccttaagtagaaaaaaggcgcaaaaaaaaaaaaaaaaaaaaggggcgg

SEQ ID NO: 2336 - DNA, 1670 bp, Zea mays
gcacgagaccattacctagaacatcctaatcaaaaattcttctttctccgtcctttccatcccaggtcgccaccgcgtctccgcccttccctcctccccaccatcttcagcacgaggcagcacgcgcggacgtccctcccgacacggagaaccccgctccgcgcgctcgcattcatcgcgccgccacccaggtcccagccggccgcgcgcccgcgcccccccgccgccggccgtgccatgccgcggcggggcgagacggcggtggtccccattgacgtggcgtccgccggcggcgggcgaggcgatgagcggcccaagagagagcgccaccggagccacggccccggccgccacggtccgcaccggagtcgcccgccgcccccgcccccgccggcgttccggccgttccggcggtggttcccgttccttgtgccgctattcatcgtcgctaacatcgtcctcttcgtgctcaccatgtacgtcaacgactgccccgcgcacgcgcgggccaccggcgccgcgataggcggatcggtcggcgagagcgccaccgcgcagggctgctggctcgcgcccgagctcgggaggttcgcgttccagtcgttcaaggagaacccgctcatcggcccttcctccgccacgctgttggaaatgggggcactggaaaccagtaaagttaccaaagatcacgaagggtggcgcctcattacatgcatttggttgcatgctggagtcgtccacatactcgccaacatgttgagcctcttaatgatcggaatcaggctcgagaaggaatttggtttcataaggattggtacactgtatgtgatctctggtgttggtggcagcttgctgtcttctctatttatggtgtcaaatatatcagtcggtgcttcaggtgcattatttggactattgggctcaatgctgtcagagctcataacgaattggacgatatatgagaacaagtttgcagcactcttgactctagttatgatcattctcatcaacttagctgttgggatccttccacatgttgacaacttcgctcaccttggaggatttatgtcagggttctgtcttggttttgtgctgctaatgcgaccacagtttggatatattaaccaaaagaactctcctcttggatttcccatgggcgtaactaaacggaagttcaagacatatcaagtcatacttttggttatttctacaatgatactagtttctgggttcaccattggattggtgttgctatttcaagggttcaatgctagtgagcactgttcttggtgccattatatgagctgtgtgcctacttcaaagtggagttgcaacgcaccaaataactactgtatgtcttcacagctcggaaaccaactaaatctgacatgtgaaagcactggaaagaccgcatcatatgttctcagcgatccaaacaactcggaggcgattaaaaatctttgtgtcggtctttgcagttaatagtaatgtctgcattttctaacaggaaattaatgctagcatatctatggattatatgactagaagcctatgcttacattatgattctctggtaatgctattgcggcttctatggtattttcttcttgtgcatgctatgtacaaaaaagacgagttgctcgtggggaagatggacaatttgaggcact

SEQ ID NO: 2337 - DNA, 1698 bp, Zea mays
ggtccagacttcccggggggacctcgcgaggggcggggcgggcaaagagaagaaggagaagaaaaggcggagggaggacgacgggaggggaagtgatagtgggatggtgagggacaggcggggagcaggagggagggactcaggcggtagggaggaccaggatgatggggagagggagatccaggagctctgggataccattgcgggtggtgactcagaggatgaccaagaaggtgttagaaccatagatgatgataatttcattgatgacaccggggttgatccagctgatcgttatggcagtgataatgagcggcattcacctgggcattatgcacaggctgaggagggtgaggaggatgatgaaattgagagactcttcaagggtggtaagaagaagaagaatgatcgccctcgtgcagatattggtcttatagtggaacaattcattgctgagttcgaggtagcagctgaagaagatgcaaatttgaatcggcaatcaaagccagccattaacaaacttatgaagcttcctctgctcatagaggttctctccaagaagaatcttcaacaggaatttcttgaccatggagttctcactcttctaaaaaactggcttgagccattacctgatggaagcatgccaaacatgaatactcgatctgctgtactgaaattattagctgattttccaattgacttggaacaatatgaccgaagagagcagcttaagaaaagtggcctgggaaaggtcattatgtttttgtccaaatctgatgaggagaccactgcaaataggaaattggctaaggagcttgttgataaatggagtcgaccaatattcaacaagagcacgagatttgaagacatgaggagatatgatgatgaaaaagcaccttacaggcggccacaaatgaagaaaccatcaagtagctctggaatggaatccagagatgatgatgttgatgctgacttttcacaacgcaagtctgggcaaagtagttcaaggcagcatgcttctaggccagaagcctcgcctttggactttgtcattcgtccacagtccaaaattgaccctgagcagatacgagctcgtgctaagcaggctgtccaagaccagcgtcggctgaagatgaacaagaaattgcagcagctgaaagcgcccaagaagaaaaaccttcaggcgtcaaagctcagcgtggaaggccgtggcatgatcaagtacctgtagatcacccactgtggcatccgcagtcagcagtgtcctgcacatgatacagcgcctgcagggattgctgaattggtatgaagcatcctaccaccattccatggcaaacagctcggcatcagtaattgcttggatcttttatccaagtatttttcttgcctgcaacatccgtgcttcagaaaccagttgagttggctacactatcattgcagaggcatatactacgagcttgcataaacatggcgctttcctaccagagtggtgcctttatattgtataaatatttgtcatgtttatgagttacaattagctagggttgaagttcgattgtttgtacttgaaagaaagtcatcacttgtgaaaaatcgaaacatagtgcgacaaatgattggttgtgcttaccaaactgtaactcaattgtgataaattacaattcttcagcagtcctcaaaaaaaaaaaacccccccgc

SEQ ID NO: 2338 - DNA, 2044 bp, Zea mays
gccggccgggttcggcttcgcggccccccccccacgtgtcctccccctcgcgccgtcgccggctcccacggtccaccgacgactcttcttcctcacctcctcccgctccagctccagctcgtctctctcctcgcctcgcgtagggtttcgcttcccgtctcgccgccgtcagcatgggggacaactacgatgacgaaggcgagccgatcgtgaacctcgacgaacgggaaccctcccctgagcatcagccgtacgaagacctcgatgacgacctcgacggcggcggcgattggacccgcgaccgctctccgacccccgtccacggcgacgacggcggggcagggtcctcctccaagccccgaaagcgccttctcaagaagggcggcggtggaggcatgcccggcgatgacgggctggatgactttgggttggaggacgaggacgcggacccttcggctgaggcgaggaagaggaagggctcgtcgtcgctgagggacctcgcgaggggcggggcgggcagggagaagaaggctaagaaaatgcggatggaggacgacgggagggggagggacactgggatggtgagggataggcggggatcaggaggaagggactcaggcggtagggatgaccaggatgatggggagagggagatccaggagctctgggataccattgctggtggtgagtcagaggatgaccaagaaggtgttagaaccgtagatgatgataatttcattgatgacactggagttgatccagctgatcgttatggcagcgataatgagcgacattcacctggacgttatgcacaggctgaggagggtgaggaggacgatgaaatcgaacgactcttcaagggtggtaagaagaagaagaagaagaatgatcgccctcgtgcagatattggccttatagtggaacaattcattgctgagtttgaagtagcagccgaagaagatgcaaacttgaataggcaatcaaaaccagccattaacaaacttatgaagcttcctctgctcatagatgttctctccaagaagaatcttcagcaggaatttcttgaccacggagttctcactcttctaaaaaattggcttgagccattacctgatggaagcatgccaaacatgaatattcgatctgctgtactgaaattattaactgattttccaattgacttggaacagtatgaccgaagagagcagcttaagaaaagtggtctgggaaaggtcattatgtttttgtccaaatctgacgaggagactactgcaaataggaaattggctaaggagctggttgataaatggagtcgaccaatattcaacaagagcacgagatttgaggacatgaagagatatgatgatgaaagagcaccttacaggcggccacaaatgaagaaaccttcatcgagtagctctggaatggaatccagagatgatgatcttgatgctgacttttcacaacgcaagtctgggcaaagtagttcaaggcagcacgcttctaggccggaagcctcgcctttggactttgtcattcgtccacagtccaaaattgaccctgagcagatacgggctcgtgctaagcaggctgtccaagaccagcgtcggctgaagatgaacaagaaattgcagcagctgaaagcgcccaagaagaaaaaccttcaggcgtcgaagctcagcgtggaaggccgtggcatgatcaagtacctgtagatcacccgctatggcatccgcagtcagcagtgcccagcacattatacaggacctgcatgggcccagggattgctggattactaagaagcatcctatcaccattccatggcaaacagcccggcatcaataattccttggatcttttttccaaatatttttcttgcctggtagggtgcagcatctgcgcttcagaaaccggttgatttgagcactatctatgagcatgtataaatatggtgcttttcaagcagagtggtgcctttatattgtataaaatatttgtcatgcttatgagttacagttaactctgtcaaaaaaaaaaaaaaaaa

SEQ ID NO: 2339 - DNA, 985 bp, Zea mays
ccggccgggtaggtgatcaccggcccgggaaaaaaaaaatcagggagtaactggggcccggcaaccaaacaagcgtcgtcattcatttcctcactcagcgaggctaggcaagctggccgtcaagctcaggccgtcaggcgatacaactacaagcctacagtgcctacccctccgccgcctagagagagagaggccagcgatgacgaagacgacgccgccggcgttcgtgtaccggatcagcacggccgacgagtgggcggagtttcagcgcacgggcgccacccttggaggcgacctcgacagctccaccggctgcatccatctcagcgacctaaaccaggtgaagatgactttaaaaaactttttccttggaaggaatgatctgtacctactgcaaattgatactttcaagcttgcagatgggttaatttatgagctaagtgatggtgataactattttcctcatttctatggccctggtcggagctttgcacctcttcaactagatactgttgtgaaggcagacaaaatagagtttgcagacaatgattttacctgtggtctacttgatggaagttatctcccaagctgatctgtagagtctcaccttcatcttagcaatgctcatttgagttctctgccaaaggttagtgtttaatatgtctatatatgcagaagtcggtcatatatttgagtgacagattgtaccatccagaattttccacagttattcatatactttctggtggaagataaaatatgaaactgtatgtaattgacgcatcatgatggatacggatgttcattatgctatagcaagtagtacaatgtgtacttgctgtcatgttacatccagtgcctggttgcataaacaataagcactatatgttaccttgggtaacatacttgtaataatgatatgaattcaaaaggagaatgccacttcaattgttttttcaaaaaaaaaaaaaaaaaaccgcacgag

SEQ ID NO: 2340 - DNA, 873 bp, Zea mays
  misc_feature (749)..(749): n is a, c, g, or t
  misc_feature (848)..(848): n is a, c, g, or t
  misc_feature (861)..(861): n is a, c, g, or t
gccggccggcccgccaaaccaaacaagcgtcgtcattcatttcctcactcagcgaggcgaggcaagctggccgtcaagctcaggccgtcaggcgctacaagcctacaactacaagcctacccctccgccgcctagagagagaggccagcgatggcgaagacgttgccgccggcgtttgtataccggatcagcacggccgacgagtgggcggagtttcagcgcacgggcgccacccttggaggcttcctcgacagctccagcggctgcatccatctcagcgacctaaaccaggtgaagatgactttaaaaaactttttcctgggaaggaatgatctgtacctactgcaaattgatactttcaagcttgcagatgggttaatttatgagttaagtgatggtgataagtatttccctcatttctatggccctggtcggagctttgcacctcttcaactagatactgttgtgaaggcagacaaaataaagtttgcagacaatgaatttacctgtggtctacttgatggaagtgatctcccaagctgatctgtagagtctcaccttcatcttagcaatgctcatttgagttctctgccaaaggttagtgtttaatatgtctatatatgcagaagtcggtcatatatttgagtgacagattgtaccatccagaattttccacagttattcatatactttctggtggaagataaatatgaaactgtatgtaattgatgcatcatgattgggatccnggatgttcattatgctaaagcaagtagtaccatgtgtattttctgtcatggtacatccagtgcccggttgcataacataagcactctatgttaccttgngtacatacttgtnatatgatatgat

SEQ ID NO: 2341 - DNA, 3704 bp, Zea mays
cattgggtacctcgaggccggccggggaggcctttccccggactttgtgaatcccctccacgctgcttctgcattccttcgttcctctattatttctccacccctttccccccgtctctctgtgctcacccctctttctctaaaagactgaaaacaatagaaaggaacaaggggggaagaacaccaaacaagcagaacttttttttttgagaactccatgggctgtggaattgtccccagggagtcccctctgggtttgacgagattcatacagatacatatatttaatttttttcccctttcgtttgctcaagaatttacctgtacaggcgaaaccgcttctttgttcccttttttttctgtgtttgttttattgggattttcctctggtccgttcttcttcacctgtgaggtggtgagaagcagagacaatcatgggaaagcaaggaccctgccgtcattgcggagtcacaagtactccgctgtggcggaatgggccaccagataagccggtgctctgcaatgcgtgtggctcgaggtggagaacgaagggttcattggcaaactacactccaatgcatcgcaatgacaatattgatgatgatgaacccagagttagcaagctgaagccaccgacgtcaaagttgaagtcacagaagaaaaaaacaaatcacattataatggagaatggaccattctctagtcagaatttccgaaagatgggggatgatgacccaagctatcggtctagttcaggatctgcagtatcatactctgggagttgtgccccatatggtgctgctgatgcaagtgaaatgactggttcagcacagtcacatgcttgggagtccctagtgccatcaagaaagaggagctgtgtcacccgtccgaagccttcacctgttgaaaagcttgcaaaagagctgaactctatcatgcatgaagagaagttatattacctttcagaatcatcagaggaagacctactataccatagtgaaactcctatcggttcctttgaaataggctctggaagtgtgcttctaagacatccaaactcgaaatcactggaggaagaatcaaaaacaagctcaattcctgcagataataaatcatatattacaagtgaatcctattcagactctgcctcatttgtcgttcacagtggaaacaaggcagcaattaacttaaatcttccaactgcaaggtcgaagaagtcgccgctgcatatggaagacaatgctagaagggataaacttcattatgagaatcagcatgtcctggagagtgttgattcgcctttagtttcagtagatttagaggatgttataaactatactaacttcatgaaatatctaactaaagaggatcgacgtcagttgctcaaatttcttcctcctgtggactccttaacacctcctgaaagccttagaagcatgttcagttgtatccaattctctgatgctattgacagctaccagatgctgcttcgagagggaattctcgacccatccttatgtggtgatgaggaatggaagaaagtgaagacgcttgccttaactaatttaacaaaatgcagttggctggagtgctataaacagaaaaagggagctaaagaaaccgggggagtggggggcatcagtggaccggaaggctttaccaagtctactatgaaaccactcaaaagaccccgtgacacccactttcagagtgacgcagaactagatggtaccatgaggagtcctctaagagttctaaaatccggggctttggctcttcagtttgaaagttcatctttgccaaaatctagctatgccaccgaagattcaacctgcactggaggagcacctaatctattcatgttacccctagaaaagctaccattactggtcccttctcagtatgccgtctctgatcaagacttgctgctggaaatacctctcaacgcacgacacccagaggcagaacttctctgtcaaccatctcagctgatgagctctataaccagcagctccacctctatgggcggggttgctgaaggagaagggtacctgaagcaaccatagtctcaggtcacatcagcaagcagcttaggaacagccagtagttgcagtttactttaacctcctggatcgtgtcgcctctctgtgccgatcaccaatgggcctaagtgtccttatttacataacaatgtgcttcgtatgccaacttggcgaattgtcggttcagctaatatttgtagcatgcttttggatcggctttctgctggttttctgtaacatatggctcatggagaaagcattaacttatctctgtatggaaaaaaaaatatcaccatattgtaggaaaatgaaaaaagaggataatggagagttgtttatgtgatattgtcgtttgctatggatgttgaagtgttagttagctcacctgtttgtccagttgattcttgagccaagacaatgtggatgatgacagcattggttggagatatgtgcaagtgcaactggatggccttaggtcactggagaataggtcactggagaagagagggagaagaaacctaaatctaagctctgagtataatgttggaaacctaactctggatgatgcattaaataatagaagtaattaggcataggcccattacatagacaacacccacatacaatacgcggtacatctaacacagcccataacacagtagctctaacaatagcttatccatgaaacagttggcataacctaagcttataacacagtagcttagtgttatgggctaactgtttacatctaacacagcccataacactaagccaactgtttaccgaatattcgacgagttgttatgttaagagtcttggcaggcataatctaagctaaaatcataggtacacaagtgcagcagcagggagggaggccgatgacgaccatggacatgtaggtgaaactactgccgctgccagggcaagcagagtcatctcctaagtgtgacgaactaattacatccacatgtgaacgtattgacaatttttttgatcggaaatactgtagcaatgtcctaccataattttatttcattgacagatcagatgatcacttactcacacaactagggataaaaacagacgaaaaacccatctcccgttttcgtatccgcattttatcattggaaatgggatcggatccgaaatagtcaggaatggaaatgggagcgggataaacggaattgcgaaaacaaacgaaaacggaaatactaacggaaactcataatttaatataaatagaaatggtattgatgtttgactagtgattgtttggcaggacaataactaaaacaaatagatatagagaggcaacattctattgttgttcggttgctaatagtgtacatttagctgcattaaatgttgtttaagactttagaccacttgtctttgaaaagaatcgatggttacaatggtcacttgtgctataatttgtcacctaaagacacgagactttagtttatatactaatgcatattagactcgtccatatttatcaaacggaataaatacgggttcaatccggataaaaacgggatcctgcaaaaatggatggaataaaccctctcctgtttccgtctcgtttccatatttttccgtaaatatggaaacggtcgggtcaaatgtagaaaacggtacgggtcgggacaagatttacga

SEQ ID NO: 2342 - DNA, 2022 bp, Zea mays
agggggaaaattagaggacattttttctccaaccctttcccctctctttctctctctcatctaccctctctctaaaagactggatacagaacgaggaaaacaaacacccgaaaagaaaggaagaagaggagaagaacaccaaacaagcagaacttttttttttgagaactccataggctgtggaattgtctccaggaatcccctctgggtttgacgagattcatacagagaaatacttcttgattttccccctttcttttgctcaagaatttacctgtacaggcgaaaccgcttctttgttcccttttttttctgtgtttgttttattgggattttcctctggtccgttcttcttcacctgtgaggtggtgagaagcagagagaatcatggggaagcaaggaccctgccgtcattgtggagtcacaagtactcccctgtggcgaaatgggccaccagataagccggtgctctgcaatgcatgtggctcgagatggagaacaaagggttcattggcaaactacactccaatgcatcgcaaggacgatattgatgacgatgaacccagagttagcaagctgaagccaccgacatcaaagctgaagtcacagaagaaaaaaccaaatcacattataatggagaatgggccattttctggtcagaatttccgaaagatgggggatgtcgaccaaagttatcggtctagttcgggatctgcagtatcatactctgagagttgtgccccatatggtgctgctgatgcaagtgaaatgactggttcagcacagtcgcatgcttgggagtccctagtgccatcaagaaagaggagctgtgtcacccgtccgaagccttcccctgtagaaaagcttgcaaaagatctaaacttcatcatgcatgaagagcagttatattacccttcaggatcatcggaggaagacctactataccatagtgaaactcctgtcggttcctttgagatgggctctggaagtgtgcttctaagacatccaaactcgaaatcactggagaaagaatcagaagcaagctctattcctgcagataataaatcatatattacaagtgaatcctactcgggctctgcctcgtttgccattcacaatggaaacaaggcagcaattaacttaaacgcttcaaatgcaaggctgaagaagtcgccgctgcatatggaagacaatgctagaaggggagtagggagcatcagtggtccggaaggctttaccaagtctactatgaaaccactcaaaagaccccgtgacacccaatttcagattgatgcagaactagaaggtaccatgaggagtcctctaagaggtctaaaatctggtgctttggctcagtttgaaagttcatctttgccaaaatctggctacaccaccaaagattcaacctgcactggaggagcacttaatttattcatgttacccccagaaaagttattagtggtccctcctcagtatgtcgaccctgatcaagacttgctgctggagatacctctcaatgcacgacacccagaggcagaacttctgtgtcaaccatctcagctgatgagctctataagccgcagctccacctctatgggtggggttgctgaaggagaagggtgcctgaagcaaccatagtctcaggtcacatcagcaaggagcttaggaacagccagtagttgcagtttactttagcctcctggatcttgacgcctccatttactgatcaccaatgggcgttatgcatccgtcattccctaatttacataacaatgtgcgtcatcttccaacttggcgaattgtccgttcagctaacatttgtagcatgcttttggattgggtttctgctggttgtctgtagcatatggtccgtggagaaagtattatctccgtgtgaaaaaaatatcaccttattgcagggaaatgaaaaaaagaggatactggagagttatgcaaaaaaaaaaaaaaaactattgtttgctatgggtgctgaagtgtcagctagctcacttgtttgtccag

SEQ ID NO: 2343 - DNA, 2347 bp, Zea mays
gcacgagaccattacctaaaacatcctaaccggacagcaggtcgacccccctccgtgaccgtctccgtccgccccccgccaccaccgcactcccatccagatgggagtgcgcaagaggagctttcggcattccggtctcgctcgaccaaccggatccccgtgagagtccccacccacaccccgagggcggcgtcgggtcgtcggggacagctgatttcacacgacgagccggcgagccggccggcatttcgtcgtcggatggcgccggcctcctcctcgtccgccggcgtcgcgtgcctcgtcctgctcctgctcctgctcctcgccggcgcctccgcggcgcacggctcgttccaggctaggcgtgctctgtcagatgaccatgggagcggtatagtggcgcgatggcggaggttgctcgccgacgctgcgactccagcgaacaactctcttgtgctggctgcggcgaggactcaccggagcgaccccttcgccaaccttaccgcgtacagcggcggctggaacattagcgacgagcactactgggcttccgtgacgtacaccgcggtgcccctcttcctcatggccgtgctgtggttcgtcggcttcggcatcgtgatgctcgtcatctcctgctgctgctgctgcttctgccggggcaagaacgacgcctactcgccggggtgctacctcagctccctggtgctcctcatcatcttcaccatggccacaatcgccgggtgcctgatcttgcacggcggcagcgacctgttccacgggagcaccatcaggaccgtcgagtacgtcttcgggcagggcaacctgacggtggaccacctgaggaacttcgccgacagcttggcggcggcgaaggacatcacgatcaaccagatcttcctcccggccgatgtccagcagaagatcgacgtcgtcgaggagaagctcaactcctccgcgggcgtcttctccactcgcctgcaggagaactccaggaagatcaagggagtgctgaaccacatggagcacgaactgtttgctgttgcagctgttatggctggcctatcaatactcggattcttgttctccgtactggggttgcggtttcttgtctccctactggtgatcgctgcttggatccttctcaccaataccatcatcagttctggtcttttcctcctcttgcacaacgtggtggcggacacgtgcgtcgcgatgggcgattgggtggcgcacccgcaggcgcacacggcgctggacgacatcctcccgtgcgtggacgtggccacggcgaacgagtcgctgtaccggagccaggaggtgacgtcgcagctggtggcgctggtgaacaacgtcgtcgtcaacatctctaaccggaacttcccgccggggctccgcccgctctacttcaaccagtcggggccgctcatgcccgtgctctgcaacccgttcaacccggacatgagcccccgccggtgcgcgcccggcgaggtcgacttcggcagcgcggcgcgggagtggaagcggttcgagtgccagaccacggggccgccggggtcggagctgtgcgccacgccggggcgcgtgacgcccgcggcgtacggccagatgacggcggcgacgagcgtcagcaaggggctctacgagttcagcccgttcctggtgcagctgcaggactgctccttcgtgcgagagacattcacgtccatcaccaactataactgccccggcctcgagcagtacagccgggacgtctacgtcggcctggtcgtcatctctgccggcgtcatgctgtccgtcgtcttctggatggttcacacacggcaccgacggcggcgcgccatgcgcaagcagctgtgactgagatcttgatggcgcgccaggccacgccacgattgagctttagctgttacaaccgtggtccacgcatccgtttcaaatttgtacaatactcactcggttctaaaattaatcgttgtcgtttaatttctaattctgaaggagtcaaatattttcagtttaattaaatatatacatattaatatctgtgatatataatttatattatttagatacaacgtcaaatctatttttataatagtctattcagaaatataaatatcatttatttattaaatatttaaatctaaaaaaggtttcattgacatgaatatggttaaaatatctattttaaaacggaaaacagtaccattacatatctttaaatgaaaaatcgaaatgacgcacgtggtgtggttgctctactaggtaattttgtgtgtcggttgttagactgtctagtagagcgtaaaaaataagagacgtgtaactgtaaatcatatgtttgaca

SEQ ID NO: 2344 - DNA, 2121 bp, Zea mays
  misc_feature (650)..(650): n is a, c, g, or t
  misc_feature (679)..(679): n is a, c, g, or t
ctgtgcatgcatgaagaatcaccaccggcctgctcaccgctcgccagtcgccatcaaagaaatcaagccggtggtgacccgatcggccatggtggtccagtccagcagggcgcatcatatcctcgtgacgccctgcatgaaaacgaagctgctcggcatgcatgtgatcagcaacgacatgtaatcgctccccctagttgcctaatcgcttcgacacccacgcaccgggtcgttggtgacagtgacgcggccaattttgggcgacaacgaccgctagctgatccatttcaagccaagcgcccccagcgagcgagcgagcggtggatccgcgccgcgggcggtaaatctactgcctgtctgtctcggctgggtggtcggcgcctcgcgtgccccttttcagctttcgctgccacttgaaacgaacgagccgcagcccgcagccgcgcgccgagcccccaccaacaactacccgcgctacgcgtacgtagcgcactccactggaatactggatcgctctcggagcagggaaggagctagctagctagctggcgcaggctgtcctcatgttccaaaagtctcgtccggtacctcgaggcggccgggaattcccgtccgtcttcatcccctcgcctcggcacaagctacccggngggcccggacgagtggtgccgtggcggtnctcgtagctactgcactgcatcactataaagctaagctccaggccccgcgccccccatctatcgcgagatctagcgagcgagcgcgcacactgctggcggcaccaggctacgacgatcgagagagccgccgtgccagcacattgtccattgtccgcgcggcgggggatcgggcggacgcgcacataatatggcgcagctgccgcccagggtcccgaccgcggtgcaccgctggccggagggcggccaccacggcgcggcggcgtgggccgatgacttcgccgagttcgctgcgtcgcggcggggcgcgcaccgcaggtccctgagcgactcggtcgccttcgtcgaggtggcgcccgcggccggcgagttcgacaggctcgacgacgaccagctcatgtccatgttccccgacgaggccgccgccggcggcggcggcggcgggtcgtccgcggcagggtccgagaacaacggcggcagcagcgacagttacggcgataggcgcggcggcggtggccctgcggcgggaggcaccagcaccaccaccagctgcaatggcttcgatggtggcgagcacaacgaagccgcggacgcgcaggcgacggggcaagctgccgccgccgccgccgcctccacggagctgatccgggaccccaagagggtgaagaggatccttgccaaccggcagtcagctcagaggtcgcgggtgaggaagctgcagtacatctccgagctcgagcgcagcgtcacaacactgcagaacgaggtgtccgcgctgtctccccgtgtggcatttctggatcagcagcgtaccatactgaccgtcggcaacagccacctcaagcagcggatcgcagctcttgctcaggacaagattttcaaggatgctcatcaagaggcgttgaagaaggagatcgagaggctgcgccaggtctacgagcagcagaacctcaagatgtcagccggcgctgctgcctctgaccatggcccgccaccggtgcgcgcggagaaagagctcatgagctagctacccagtcgatccacgcgtgcccgctgtgcagtgcagcccgcccgccttatcattaattaacatggagggaacattgcatcatgatttctctttttttcggattatgtggatgttttcttctttctttctttcttcttccattgacacgtgtgcgttaattctttgtatgttgattttgggatttggttcactgtgcaaattgtggtaaagtcatcagggaaactgatctgttgtgtaaatcacttttttgaagcattacattcctgggaatctggttacccatgatttttgtacggcctttctttttttcccctttagtagtgtgattatataccacaatatttggcaggttcgatgtaattgaattagcaatgtgggcagctaaaaaaaaaaaaaacaaaaaaaaaaaaaaaa

SEQ ID NO: 2345 - DNA, 4709 bp, Zea mays
  misc_feature (3446)..(3446): n is a, c, g, or t
cggatcaggtcgccggccacctccaggaagagggaggagtggagagggagaaagaagggaggaaaaagagtgagagagcagtcccgtcgctgccctccttgctgctcgtcgaacttctagcgagctgctccgacgacgacgcgggtcaagaccgacggtggtgggtggagttgaacggcccagaggaggacgtcggggcctaggtttcccgtctaagcgagtaagatacgaaataggtactttttaaaaccccttctatttacttataattaatccacagtacaaacctcataatcacatgtgtctgctcagtgcctccacggctccccaaaccacaccagccgtgaacgtgttaacttcacttttggaggcgctccacaagaacctgcacggcatctaccttacagcagtccttttgtacgttcacgggatccaaggagcaaaaaggcagtagcagagcacatgtcaacaaacacaagtgacaaaagaaacgaggatgacggagcagagcaccaggtcagtcaacctcttcagttcacttgtgcttccttcccgggcccttcaaggaaactactgtagcaccacctcttcttccatgtgtatttagagacgtgcgcgcgatgctcaccgtcgagactcgatcgagagctaatgcaagaaaagaaagaggtgcgagcaagagggatgaacggcgccggcaatggtgagccctcccttgtagttgtagcggaggaagggccgccgaacgatggcaacggcgccggggttcacgcacccaacttcggcgcgaatgaagcggacacgctgctggtggtggcgacactgatcacagcgctgacgtaccagctgggcaccaacatcccgggcgggtactggcaggacgatctcaaggggcacgacggcctcgcggggcacgtcgccggagacccgatcatgcgtgacaagcaccggcggcggtactggctgttcatggcggcgagctgggtggggttcggcacctcgatgctgctcacggtggggttcatcacgggggtgcccgcgaggtcgcgcttcgtccggttcgcgttcctgctggcctactccagcctcgtgctcacgttcgtgacgtcgcagccgcgcacgtcgctcttctgggacctcatcatctgggctgtcgtcatggcgctgctcgccatcgccaccaagtacctgcgcctcgacaggctccccagatgggcgcgtaccctgtgccctgctcctccatccgcgttctgctgctcacgttcgtgactcgtgagcgagctcgccatggacgatcgacctcgtcatctgggtcgccgtcatggcatcgacgcatcgtcgccatcgtcaccaagtaccagcacgtcgacagacctccccggctgggtgcacaccgtctatcttcagtaccagcttgctagtagcaacaatgtgtgtgttttcaaaaaaaaggaagaatgtgtttttatctttgtttaattttggccgtaatgtcttgtttagtggctgatgttcttgttctctgctactgtgtgcgtcctcattggttgatctgaatctgatgttaaatgtatcgctgttcagtcggtgctgttcttgtacaaaaaacgcacaccactctattgtccatgtgtggaacggtcgggataaatcttgttcgaccccgcatggttttttatatttaaccccatcgaaatcagacaaaattcagaaacggtacggaaaacagaataataaaatcaaaataggtacaaaaacgatttgacatgtatcacatctgttttcatttatcccgtatttatgcggggttatcttatttataatacgatcatatcctttttgatagcagtccattaaaggcttttcggttatttttaatccatatggattggagggaattgatacggattgggagagattttgacttactatggattgaaaccccctcaatccccctcaatccatatggattgaggtagaatcgaacaagcccagcggcctacagtctgctaggctcctcacatgattcacacaggcataacacccctaaccctaagtcgagtacacaaacaccactcacctagacgcagagacgcctacacaccctccaggcttgcagcgccttaatgtagctatgttgccatgctgatatggatttttaaagaaagatgttataaatttttactaaattgttgacagttctgctatgaatttttaaagaaagatactgccatgctggtatcttgaatataatgtactcatgtaacctgaagttcatgttttcgttttccctcccatatcccgactattttcgaagcgttctggaccgtattgattcgttttcgatataccattaatctcatgtgttgatcctgttcccgctcatcccgttttacatttcgtgtctggttacaaatgtaaaaatgaaaacatgagagggtttttttgcgaccgattccaactgtttctgtcatcataggagcaaagccaacatgcatgtaacaacgaaagcaacttagccataatgggaactaggaaccgattgtagctctccggcttcacacaactcacatattggagggagcgaaactacctagcgaccggccctaggggtcccattgacaactctgcgccagccgagaatggagccgacaaatactttttacagggctaaattaaaccactacaatgatgtattctcactaaatcactaacaatagacatatataatagtttgagttagtattatattaaaaacgatgtagtattatactaaaacattaatgaacaacaataccataaaatacataatgagactataccacatacagtttaaatcttataaggggctttagttaggctcatggcttgggagcggtaggagaagttggaaccccaccctcatcatggctaaaccatccttggcgccagcgtcgtgcttgtcgagcatgttggaccataggcagcaaggcccacacgaaggagcccaaggccaggaggggtacagtcgtcgtgctcgagtcatgcacatgcgacatccagcaccacacgagcatcgtggagcggagacatggtcgcttcctccttttgtctattctgtccaactgtcaaattattatgcttgtgatgaagcaacccaattttaccatgacggcatgtggtcgcccgccctatcatgcgtgagttaactcatgaagattcattttggtcaaacttcgcatagggtatgattaccaaattatgcataggctcttggcttgacgttcgattctagggtcggcttccttctccgctgttttacccattctgacttcatgctaatgaatttgtagaactctttcttgtcttttaagaactaactgatcgaactaggtacatgacttatacaccaccgagggtgagaaggaaagagagagtggatgtagacttataccttttgatcaaantggagaccccttatagttgtcgatggggtcgtagaagactctgaaagttgagcacctcccgcctcattcgtttctcttccttgcgtgttgggacctcaaggaggagcgtaggtggcgttgaaccgttaggatctacaggcgtcatggaaaggttggatgattttcagtcactaaaatgctaataggagatcatatcctttctgggtgtgtggtggctagggttagcaaaagtgaaaaaaaacatttactagcgagtcagtaatatccttgttaatatagcactcgtgataggggctacaaccatgtgaggtttatgcaccccgaccagggagcatggaagagatcctggctcggacccccaagtccaataggacatatccatcattctcccctttattctcgactttattattctttatctttctatgttccaccctttgataaattgacatcaagcccaatgcattatagttatgtcccaccaaactcattacctataacatgaccttctatcttaagacaaggtaattttcttggtcttgtaagatcgttgtctcatagccccttaatctataatcatatgcttttctctaaacccataccggctatgtgctctctaaacacgctggatggaagatcttttgtgagtgaatccgttaacgtcttatgggttctaatatgctcaactttaataatttgatcctagatattctccttaacaatataacacttaataccaatgtacttgacatccctacttgactttttgttgtcggagtaaaatactgttggcttattgtcatagtatattctcagtagtcttctatgccatccaccacccttaatttgggtacaattttttacctgcatcacctacccagttgctttatacatcaccacaaatttagcatgcattatcagtgacgcaacaactatctatttataactcttataagaaacaatccactagaaaatgtgaagatatatctagaagtggattttaatgtatcaacacaacttgcctagtcgacatctgaatatctcgctctcaagggaactagaacttctatatgtaagtatgaggccttttgtttcttgcaaatatctaagaggcttcttaactttttttctagtgctctatatttggattaacttgatatcagccaagcatctcggttgtaaatgctaagttagggtgagtacatacttgagcatacataatgattctgatagctgaagcatatggtatttacttcatttgat

SEQ ID NO: 2346 - DNA, 1040 bp, Zea mays
ggtaccctcggagcacgggtaaaattcaggtacccacccgtcaccactacggcactaccccttcagccccagatttctccaagcctccgggacgaggcgcatccgtccatgggggccaaggcggcacaccggcgtggggtgctggacctggaggcgcagttcgccttcttccggtcgcagcaccggcaccccgtgaacgcggcggcgcacgtgctgctcacctggcccatcctcttcaccaacctcttgatcctccacttcctgccgctgccgctgcccgtctcccccgcgctggccctcgcgctcgcatacgccgccgcctacctcgctgtcgaccgcagagccggcgcagtcgcggggctgctcttcctcgccgcatgggccgccagccgcgccctcgcggcccgcctcggcttcgctctctcctggaagcttgtcctcgtcacgcagctcttctgctggacctggcagttcctcggccacggcctcttcgagaagaaggggccgagtgttagtgatcttcctgaggtgttcttgatggagccgttcctcatcttcctgcaggtaaccacaggcacagctgacaaacatatactgaacaaactgttcggctatgagccgtatcctgggttctgcaagaacgtggacaggaagatcgaagccgatctcagggcgagcgagagctcaagcagaggaaagactacctgattgattgggaattcgggagtgatcctccggagcggtgcgcgaaattgtaccatctatacatgtagcatattgcctgccatttgtgttgttttattcaggtacatgatgtctgcgcaccattatatagtgtagtaaacatcagtcatgtgtgttgaggtcagcttgaatcccgggaggaaggtagagagcggtaataatctcctcgtttactgccctataatttgctggtcaaagataatctatcttgtttaaattactatgtttaagatgaactaaattttacatgatccatcccccttcatagaaaggggaggatgagtgtcaacacaacc

SEQ ID NO: 2347 - DNA, 987 bp, Zea mays
cctcggcgccggccggtgggaccctcgaggccggccgggcccggacggcactaccccttcagccccagatttctccaagcctccgggacgaggcgcatccgtccatgggggccaaggcggcacaccggcgtggggtgctggacctggaggcgcagttcgccttcttccggtcgcagcaccggcaccccgtgaacgcggcggcgcacgtgctgctcacctggcccatcctcttcaccaacctcttgatcctccacttcctgccgctgccgctgcccgtctcccccgcgctggccctcgcgctcgcatacgccgccgcctacctcgctgtcgaccgcagagccggcgcagtcgcggggctgctcttcctcgccgcatgggccgccagccgcgccctcgcggcccgcctcggcttcgctctctcctggaagcttgtcctcgtcacgcagctcttctgctggacctggcagttcctcggccacggcctcttcgagaagaaggggccgagtgttagtgatcttcctgaggtgttcttgatggagccgttcctcatcttcctgcagatactgaacaaactgttcggctatgagccgtatcctgggttctgcaagaacgtggacaggaagatcgaagccgatctcagggcgagcgagagctcaagcagaggaaggacaacctgattgattgggaattcgggagtgatcctccggagcggtgcgcgaaattgtaccatctatacatgtagcatattgcctgccatttgtgttgttttattcaggtatatgatatctgcgcaccattatatagtgtagtaaacatcagtcatgtgtgttgaagtcagcttgaatcccgggaggaaggtagagagcggtaataaaaaaaaaaaaaaaagccctataatttgctatgtttaaattactatgtttaagatgaactaaattttacatgatccaccccccttcatagaaaggggaggatgagtgtcaacat

SEQ ID NO: 2348 - DNA, 1287 bp, Zea mays
gggtacctcgaggccggccgggccgggcttgcgattcccattcataagaccgccccccgggccggccgggcaggagacccccgcccacgaccacacgcaggcagcaagcagcagccgcgcgctcgcctaggactaccgactacgagtagtgctcagccctccatcctcagcgcgcgagtggctgctgcgcattcctctctttatctgtctctgtgcttgtttaatttgtgttcgtgagtaggcggccggcacatatggcagcgcagtccatgctcatgtcgaccagcgtcaacggcggccgcgcgctgccgtctcttcaggccgtccgaccggctccatacccgcggctaccgctgccgtcgtcgtcatcctcgtcaggctacaggcactccaagtccgtctccgtgaagacgctcgccctgttcggcaaatccaaggtcaagaccgcgccggcgaagaaggctgctgcgcccaagcccaagccgaaggttgaggatggtatcttcggcacgtccggcgggatcggtttcaccaaggagaacgagctgttcgtcggccgcgttgccatgcttggctttgccgcatcgctacttggagaggccattaccgggaagggcatccttgcccagctgaacctcgagacgggcatccccatctacgaggcggagcctctcctcctgttcttcatcctcttcaccctccttggcgccatcggcgctctcggggaccgcggccgcttcgtcgacgaggaggtcaccggcctcgacaaggccgtcatccaacctggcaagggcttccgcggcgccctcggcctcagcgagggagggccgctgttcgggttcaccaagtcgaacgagctgttcgtggggcggatggcgcagctgggcgtggccttctccatcatcggcgagatcatcacggggaagggcgcgctggcgcagctcaacatcgagacgggggtgcccatcaacgagatagagccgctcgtcatcttcaacgtcctcttcttcttcatcgccgccatcaaccccggcaatggcaggttcatcatcggcgaggaagaggaataggctgctggcctcggacatgagtcgtgtgcgtttacttttacctgtgactgtgagtgatcgatcgattgctgtgtatcaattactcgtgatgagacctcgaaggtagggtgtcgcgttgggttgtctgcttgtagaaacaagagcttatatataaattactactagctaatatgccatggttgcaaaaaaaaaaggcccctaaaaaaaaaaaaaaaaa

SEQ ID NO: 2349 - DNA, 1499 bp, Zea mays
  misc_feature (20)..(21): n is a, c, g, or t
cctcgaggtctcgtgccggnnaaaaaaaaaaaaaaaaaaaaaaaaaaaaaaaaacagactggcctcgaggccgcagctgccccccgcccacgaccacacgcaggccggctgcactagtcgcgccccagcctcacgcgctgcccgcgtctgtgattcccattcataagagctggccacgcggcccggcgcgggaacagacccccgcccacgaccacacgcagcaagcagcagccgcgcgctcgcctaggactaccgactacgagtagtgctcagctagcctccatcctcagcgcgcgagtggctgctgcgcattcctctctttatccgtctctgtgcttgtttaatttgtgttcgttcgtgagtaggcggccggcacatatggcagcgcagtccatgctcatgtcgaccagcgtcaacggcggccgcgcgctgccgtctcttcaggccgtccggccggctccatacccgcggctaccgctgccgtcgtcgtcatcctcgtcagctggctacaggcactccaagtccgtctccgtgaagacgctcgccctgttcggcaaatccaaggtcaagaccgcgccggcgaagaaggctgctgcgcccaagcccaagccgaaggttgaggatggtatcttcggcacgtccggcgggatcggtttcaccaaggagaacgagctgttcgtcggccgcgttgccatgcttggctttgccgcatcgctacttggagaggccattaccgggaagggcatccttgcccagctgaacctggagacgggcatccccatctacgaggcggagcccctcctcctgttcttcatcctcttcaccctccttggcgccatcggcgctctcggggaccgcggccgcttcgtcgacgaggaggtcaccggcctcgacaaggccgtcatccaacccggcaagggcttccgcggcgccctcggcctcagcgagggagggccgctgttcgggttcaccaagtcgaacgagctgttcgtggggcggatggcgcagctgggcgtggccttctccatcatcggcgagatcatcacggggaagggcgcgctggcgcagctcaacatcgagacgggggtgcccatcaacgagatagagccgctcgtcatcttcaacgtcctcttcttcttcatcgccgccatcaaccccggcaatggcaggttcatcatcggcgaggaagaggaataggctgctggctgctgctgctggcctcggacatgagtcgtgtgcgtttacttttacctgtgactgtgcgtctcggtgcgcgcgcgtaagtgctttgctgtgtatcaattactcgtgatgagacctcgaaggtagggtgtcgcgttgggttgtctgcttgtagaaacaagagcttatatataaattactactagctaatatgccatggttgctaaaaaaaaaaaaaaaaaaggcccccgggcggccgatcgagatctagaacctcgtgcccatcaacgagatagagccgctcgtcatcttcaacg

SEQ ID NO: 2350 - DNA, 1724 bp, Zea mays
attctgaacacttggactataatgctttgtaatctggattgtgatctgtacttgtattgtattgtctggattgtgatctgtacaagtactgtattgttgattgtgatctgtacttggactatagaaaaatacttgtatatagaaatactgtacgagagagcgaatatactaagagctagtttggaacctaatttctcttgaaaacatagaaatcccaaaaataagttttccaaactagccttaaaagaaaaaaagaagagatttatttctagtgtcgtttttttttccaactgaaatcaagagttgagattcttcattccgggacgatggagagaacttattcagtctttcgcaaagcagaaaaacagaactgaataccctaccgaacacaacacgcacgctacatcctgctattacggttacaacggaccgagctacttggcttcacgcgagccctcgcggcgcttctccgggtcccggccggcggcggggtccccgtggccgacggcgaccttggccacctcagtggccggcgtgccggacctggccttctggtacaagacaaggtagccgacgacgccgacgataccgaaccccaccagcgccatggtgcccgggccgtacggcagcgggcggcggccgcgctggtgcagcacctctccggggccccggcccggcgggcgcatcgactcctccacccctgccgcgcgcacctcctccgcgctcatcttgtgcgtgtcggcgttgcggcgccactcctccgtgccgctcttggccattgtttgttgctctgctagctctcccctgcgtttgtgagctgctccctgctgcgatgcggcaacaaggtctgtgctaatataaggtgcaaagcgaggtggcaacgtggcgccatcgccatgaatggaacacgtaggggaagcacgtgttggacgtccaggcgacaccatgacctgctgtgccagacacagacagccatatggctggtagagacagacgtgcagagtagaaagcggagcccggcgcgattgttgttcggtcagtgtatgcgtaaaataagaatataggacgcacacgtacgatgcatcgacgtgcgggcccacgatacgtatgctctggtcttttggatacgtctcgagagcagaaaaaccatcgttgatggctgctacggcagtgcgacggaacattagaagtgtctttgcaacgcgatttcggggacagttggtttagttgcaattgaatttcattttaataattataatttagataaaactaattaaattcatatatttatatattatcttaaatcatatgaaagagataattatatactatatttatgttatagccaagtaagtaaaaaagtgtgctataagttgtacatcggaaaaatagtatgtaaatctatagaatcaatttctatctctcacctacatgaatttgagatagtcttatatgataactttgaaaaatagtgaaatgtcacattctaaaaaaatagtctatttcattagtaagatttcaattcctcaaaatgaaatcaaaatgaaagaaagtaaacgagacctaatgttttttatacggtttatatacgatttacgtgggtagatgtagactaagcgatccgtgataagattatctcggacaaaaggctctttatggcgcgtggttatctgactaattaggcagaaatctgttgggatatatgggtcccaatatatatatac

SEQ ID NO: 2351 - DNA, 3254 bp, Zea mays
gatgaattacaaagtatagtatgcaatattccagccaaaaaaatgtaggaatgataaggctatctccagcagatcccatatcgcatcccctatttcacacttctctctgcaaacagtgtcatctacagttccacgtcccatattttacacactctactgaagacagtctaaactccctgattctgatcacccagggatcagacatcgaggacctaaaaccacccagtaacgtatcaaccaaacacggcaacagcgaccagacagaaatgaagcctccaaatacatggccctcggctttgaactggctattgtggttcttctcgagatcatccaggtttagtaactgatagacaatcattataccaaagaagcataatttaaaaaaccaaactagccattgaatcgctcaaactcagttctggggctcagaccagcagtggagtagtagtcgtgtggttcaaattaagttagatgccataatatatatttccatacactgcagcctagcccctggctccctgctgccgcacacccaggaacccaggagtccaggacccgaattctacacttctgctccaatcgacatgtgttttcagggacctatggtttttaacccatactatgttttgccttgtcatatgcacgataagcatatttgggcgttaggcatagtcgtttgattgcaaaatgcttaaatgctatttaatccaaggtgaagctataggcttatagctttttcgttgccataagttataaccataactagtgttttcttgggtgttagtttgggagttttgtggagatcgggggttcagcccatccatatttatgtcataacagctgccagttttttttttgggtgtgaaccagctctgttccgttttaaaaggttgtgctaaagtagaactatctgttgataacatatcgatctgtccaatatactgtatcatggttcttctcagatgttgctgctttttgtaatataaaatactattgagtagatttgttctctttatggaaatgaatgatgttccatcaatgaaagatgtatatatctgttcaaatatgcaaacacaagtgcgatctagatgtgtccttgcactgcacaaaacatcacatacatgtgttttactacagtacagccacatgtgatgagatatagcttggaaggatcattttctaagttgcgatatctcataggcctgtggtttggaactattgatcaatttccctgtggtttgaaactattgatcaaaatcagccacaatgacatgccagctttgtaatggctacttgttacgtcttcataccattcacacagttacccaagtaatggggtgtgtttggtgttcccttgatggatataatgttcagaagaaaatactgttatagatgatatactttggagtttcttatgtcacaagtgaagtgatctttttttatccgttgtcataatatcttaatgattggccaaatttatgctgtattatgctgaaaagtatgccacgttacaaaagttgacatcttaaagctttactgaaatgaggtccccaacttcaacaatttcttattttgtatggagcatcattcctttctagagctaccaattaacatacaaaatacttgtggagggcgcctggatgcttgtgtttcactatgctcatgcggttatatatacgttaacagtagtgcgctcatttaccttgcttttgctactactgttattctgcttgtgttgctatgtcagagagacaccactgggctaacaaccgagaatagtgagctgaagattcgcctgcagaccatggaacaacaagtccacttacaagatggtaatatttgttctacccttatgattgatgcattgtccaatattttacttgttagatcaactaatattttacttgtgtgctcattttcctatgcttcatgccagagcctgtgcgcatgcgaaatatatgaacatgttttctgttcctggtgcagctttgaatgacaccctgaaaacagaggtccagcggctgaaggtggcaacaggacaggtgggcaatggtggtggagggatgatgctgaactttggggccatgccacgcctggtcggaggcaaccagcagatgttccacagcagccaagcgatgcaatccgtgctggcgacgcaccagctgcagcagctccagctccactcccagcctcagcagcagcaactgcactcgctgcagctccagcaggtggcgagagacctcaagatgaaagggcatctgggcggccaaggccagtggggcgatgggaagtctgggagtgggagcaggagcagcggcagctgagcctactggcaccgtggcacgggagttttggtgtatgtggtgagcaggaatggtgatcccttgttttgggggatgttgctgtgcaggtgtaattatcgttaactcagttgtctatctataggcccagttcagcttgagttttatggttaactcggcgatctttataggctcagctcacctgcaacgcacttcagttcagaaactcggatggtggcagatgtttgtctgttggatgttgtttgtatctcttttgctagtttaagggtaaaaatggttggcatttcagtgtttcaaaaaaaaaaaaaaaatctcagccaggcgctaaaagttagcacggtactagtagggtattcgatttaggccttgttcgttttcgtcggattgcacccggaatcgttagaatcatgtcaccatcaaaaaactcacaatgcactacatcattgataatagtcatttctcaaaccaaacatctcataacatattttttttcatgcgccgctcacttaatttgatccttgtatcaacgagaacatcacccatgtttatgaattactgccatacaaaaaatacattacgcccatggccctaccgaagattaccatgatattttgcctaattctgtttcacctgaaaatatttcttaactactaatgaggtcataatgatggagaaggctggttatcaatcctagtggcaccacttatgcgtcatcagcttattgtaaatgaactgttgcgtcaaagcaaaattctttccctggttcaaatgctgcctcaagctcttcatagctctgctgaactttcatattcttcgatacagtcaggccctcctgtaatatagcagtgagaaacacgtgaccatgtgttaacctaaaaatgccaggactggacatctgattgaaaacatgtctaatcactgcaggcatgcaag

SEQ ID NO: 2352 - DNA, 3052 bp, Zea mays
cgatacagcccttccctcttcaatcctctcgtcatttcctctcgcttctgctcagctgcaacccagcgcgtagatcttattcttggacgagaactctcctcaagctctccgatttctgttctcgcgccgcttagcaattcaaccccgaaattcttttgcggcgcaatcttcacctgaatcttgggtcgtagccaagaagatgaacaaagacaaagctccgatgccgggagacggcggccccagcgacggcttgccgccgcagtccacgcgccgtgtcggggcgccgccctcgtcgtctaccccgccgctggagtgcgacatcagccgcatgccggacttccctacccggagcaccggccaccggcgtgcgcactccgagatcctgggcctacccgacgacctcgacctcagtgctcccggaggcggcgaaggaccgtcgctgtcggacgagaacgatgaggagctcttctccatgttccttgacgtcgacaagctgaactcatcgtgcggggcgtcgtcggaggccgaggctgagtcctcctcggccgcgggtggcggcggtgagggggctgagctggccgacgcgcccaggccaaggcatcagcacagccagtccatggatgggtccatgtcgatcaaggcggaacagctggtgggtgcgccggggatggaggggatgtcgtctgcagaggccaagaaagcagtgtctgcggcgaaactggctgagcttgctcttgttgacccaaagagggctaaaaggatttgggctaatagacaatctgctgcaagatcaaaggaaaggaagatgcgatatattggcgaactcgagctcaaggtgcaaaccctgcaaacagaagccacaacattgtcagctcagctagcattgctgcagagagacaccactgggctaacaaccgagaatagtgagctgaagattcgcctgcagaccatggaacagcaagtccacttacaagatgctttgaatgacaccctgaaaacagaggtccagcggctgaaggtggcaacaggacaggtgggcaatggtggtggagggatgatgctgaactttggggccatgccacgcctggtcggaggcaaccagcagatgttccacagcagccaagcgatgcaatccgtgctggcgacgcaccagctgcagcagctccagctccactcccagcctcagcagcagcaactgcactcgctgcagctccagcaggtggcgagagacctcaagatgaaagggcatctgggcggccaaggccagtggggcgatgggaagtctgggagtgggagcaggagcagcggcagctgagcctactggcaccgtggcacgggagttttggtgtatgtggtgagcaggaatggtgatcccttgttttgggggatgttgctgtgcaggtgtaattatcgttaactcagttgtctatctataggcccagttcagcttgagttttatggttaactcggcgatctatataggctcagctcacctgcaacgcacttcagttcagaaactcggatggtagcagatgtttgtctgttggatgttgtttgtatctcttttgctagtttaagggtaaaaatggttggcatttcagtgtttcagatgaagatctcccgtctcagccaggcgctaagttagcacggtactagtagggtattcgatttaaggaataagttagttccttcccatcatcttattccttagaaactaatgattaatattagtacgatgattagaatcatgtcaccatcaaaatactcacgatgcactacctcatcaataatagtcatttctcaaaccaaacatctcataacagattttttttcatgattgatcgagcatttggatattacaattacatactccattgtaaaatataattgttaaagattttttttcttgcagcgctcacttaatttgatccttgtatcaacgagaacatcaccatgtttatgaattactgccatacaaaaaatacattacgcccatggccctaccgaagattaccatgatattttgcctaattctgtttcacctgaaaacatttcttaacaactactaatgagggcataatgctggagaaggctggttatcaatcctagtggcaccacttatgcgtcatcagcttattgtaaatgaactgttgcgtcaaagcaaaattctttccctggttcaaatgctgcctcaagctcttcatagctctgctgaactttcatattcttcgatacagtcaggccctcctgtaatatagcagtgagaaacacgtgaccatgtgttaacctaaaaatgccaggactggacatctgattgaaaacatgtctaatcactgcagcttggtgtttccaatgtaagatagcttctactaacaagttgttacaaaaatttgtcattggaaaaaacaataaaacagtaattaatctgaccataaaccaaaaaaacagcaataataagatgctaaattgagtcccccccccccccaaaccaaaaaaaaggcaatagaaactacccttgcataacaccacataataccgaaccccatacaaaaatcctcaaaaaagcataaccaacaattttacattttagcttcagagagttgtggaataacatataccttttgaacatactcagcaaccgtgctacttataattttcttgattgtttctttcttcacttttgatggcccgattaagtgtagagcaacttctttcggtatcttcagcgccacaaaagagtaattactaatcagtaagttagaacaacttctgcctatatgcaaatgagttcaactgatataaactgaaatggctacttttgagtgggaacttacgtctggagttttccctgaatatttaagatagcatcacgtggaagacaatgtcaacaaacttaaacagtattagttttcatatgccaaatttaaacaacatatagtataatatgcaagcaaccaaatttaatatcttatttacagcctaactggtatggcatattgaactcagtatcctttaagtacatctgaggtgaattcagaatttgcaggatgag

SEQ ID NO: 2353 - DNA, 1603 bp, Zea mays
attgggtacctcgaggccggccgggatggagctacggtacatgtgtggagcaaggaggccccccggcgcccgccgggctcgaccaatccctccagactccagtatccagactctctctcgggcctctcggctctcctctccccgatttccttccccacccgctgtcagtctcactccccgcgcgcgcgctctctctttcctcgccttcgccgccggcgacgagcttgagctcgagctggttcctcgtatagaagacgacggccgcggtatggagcccatgaacgtagacaacggcggctgcggtggccttgacgcgcagatcgaacagctgatgcagtgccgcccgctcgccgagcaagaggttaaggcactgtgcgagaaggccaaggagatattgatggaggaaagcaacgttcagcctgtcaagagtccagtgacaatatgtggtgatatacatggacaattccatgatcttgtagagcttttccgaattggcgggaagtgtccagacaccaattacttatttatgggagattatgtagatcgtggctactattctgttgagactgtcacgatgctagtagcactaaaagtgaggtatccacatcgaattacaatccttcgtggaaaccacgagagtcggcagatcacacaggtgtatggattctacgacgaatgcctacgaaagtatggcaatgcaaatgtatggaagacatttacggatctttttgattattttcctctgacagctctggtggaatctgagattttctgccttcatggtggtctatctccatcaattgaaaatcttgatagtgtgcgcagcttagatcgagtccaagaggttccccatgagggacctatgtgcgatctcttatggtcagatccagacgaccgatgtggttggggcatctcccctcgcggtgctggctacactttcgggcaggacatatcagagcagtttaatcacacaaacaatctcaaactcgtagctcgggctcatcaattagttatggagggatataactgggctcatgagcaaaaggttgtcaccatattcagtgctccaaattactgctatcgatgcggcaatatggcatccattttggaagttgacgactgcaacagccacacattcatccagtttgaaccagcccctaggagaggtgagccagatgtgacgcgaagaacaccggattatttcctttgagctgtcgatgttaccgtttcccagcctgtgtcgtgataatcgatgccaacgtctgctggatcaagggccagacagaaataacaggggaatgccgaagcactatgcccagagtttcacccttttcaggcgacagagaagggcggccatccacctacaactctggccgccctctgttttatgcactttttacagagtcgtggaactggccaaaaagaccggagtaccatttgcacctgtgtagcgtaagcttgtactacaaataggcgtgtgctaatctgtatcaccattcatcaattgcaacgaactgttgaactccttccatcagtaaagtaaattttggtaaaagaacggcttacagtgtcggtaatgacactatcaaaaaaaaaaaaaaaa

SEQ ID NO: 2354 - DNA, 1613 bp, Zea mays
  misc_feature (1609)..(1609): n is a, c, g, or t
  misc_feature (1611)..(1611): n is a, c, g, or t
gttttagaagtactcccgagactagttctctcatcgacctctccagcctctttctcggatcccccctccccgatttccttccccactctgtcagtctagtgccccgcgcgcgctctctcgccgcctcgccgccggcgacgagcttgagctcgagctcgagctggtttctcgtatcgaagacgcggccgcggtatggatcccatgaacgtagacaacggcggctgcggcggccttgacgcgcagatcgagcagctgatgcagtgccgcccgctcgccgagcaggaggttaaggccctgtgcgagaaggccaaggagatattgatggaggaaagcaacgttcagcctgtcaagagtccagttacaatatgtggtgatatacatggacaattccatgatcttgtagagcttttccgaattggtgggaagtgtccagacaccaattacttatttatgggggattatgtagatcgtggctactattctgttgagactgtcactctgctagtagcactaaaagtgaggtacccacatcgaattacaatccttcgtggaaaccatgagagtcggcagatcacacaggtgtatggattctatgacgaatgtctacgcaagtatggcaatgcaaatgtatggaagacatttacggatctttttgattattttcctctgacagctctggtggaatctgagattttctgccttcatggtggcttatccccatcaattgaaaatcttgatagtgtgcgcagcttagatcgagtccaagaggttcctcatgagggacctatgtgcgatcttttatggtcagatccggacgatcgatgtggttggggcatatccccacgtggtgctggctacacttttggccaggacatatcggagcagtttaatcacacaaacaatctcaaacttgtagctcgggctcatcaattagttatggagggatataactgggctcatgaacagaaggttgtcaccatattcagtgctccaaactattgctaccgatgcggcaatatggcatccattttggaagttgacgactgcaatagtcacacattcatacagtttgacccagcccctaggagaggcgagccagatgtgacacgaagaacaccggactatttcctttgagttgtggtgttaccaattcccagcttgtgctgtgataatcgatgtcaacgtctgctggatcaagggccagacagaaataacaggggaataccaaagcactatgcgaaacttgaggtcctcattgccattggtcagtgcaagagatgtctgcaatcctgagagaaagcaattgtgccaagccatgcccgagtttcagccttttcaggtgatatagaggagcggccatccatttgttacagctctcgccgccctcccttttatgcactttttacagaggcttggaattggcaaaaaagaccgaactttcaattgtacttctgtagcgtaagcttgtaccaataggcgtgtactaatttgtatcatcattcatccatggcaagacattgttaaactccttttcatcagtaaattaattttttgttaaaaaaaaaaaaaaaaaaaaaaagcgctccgaaaaaaaaaaaaaaaaaaaaanangg

SEQ ID NO: 2355 - DNA, 2429 bp, Zea mays
ttttttttttttttttgaactccttccatcagtaaagtaaattttggtaaaagaacggcttacagtgtcgggaatgacactatcagacagccacgatgtttcgtcagatttgttactgacgaccatcacagagttcattttgttttgaagtacaagcgcaagaatcaacagctcaacatggaggagagatgaacagcatggtatatctatctttagtgcaatgcaagcgcaaccttaggttgctgctacgtacgtagcagtagtatgaggatggaacgtacggcaagattggtcgtcggtcaccggccgtgtggtgtgacggcggcatggcaatggcatgtagcagcagcaacggtctgggcctggcagatagtgtacacgcccgccgtcgcgcatgccgggcggtcacacggaggtgctggcgagcagctggttggcggcgacgcccctgcccttcatgacgtgcttccggagtccagggatgtggacgttggtgatgtagtccgcccagtccacgccccgcacgtcgaagtggaaccgcgccctctccgccggcgacatggccgcgagcagcgcctccgtgttggcgttgtcgaagcggccgccgtagaaggtgtagggccggtagatgctgcccaggtggacggtctgctccacggacctggcgcacaggtcgcgcgcccgctgcgccagcgacgacgaggacgaggtcgaccgggcgctgcgcagcagcgcgtccgtctccacgtagctggcgaactgctccatggtgtcgaagaggcgcatgggcggcaccaggatgggctgccccgccgcgtcgctgtaggggcaccgcgtgaagtgctggaacaggaaccggctcaggtcgccgaacaccagagggttcaccgtcgacgacgacacgtggtacacgtgcatcccgggccccgccgcgccgccgccgtgcttcgccatcgacgccagcgtcgcgttcaccaccatgtccgccgggaccacatcaagaacaccatctggatctgcgaggaaccccgtcagctggcctttcccgtaatagaggaccacaggatccatcatcctgttcccttccatccagcccgggaatgggtccctccaggtgctctcgatgacgctgggcctgatggtgaccaccggtatctctcctcgcatggagttgatgaccatctcccccatggccttggtgaacacataggtgtcttgccacccatggagttttgccctctctaggcccaaatctttcatttcttgagcaaacgagggagaatcatcggggcggtgtcttgtggagtagaaggccagcttgatctctgcctcgatgtccagcacgggtatcttgtgccctggagaagaagaccaccccggcagctccttggctatggtgtctcccatgcgaaacggcttctccagcaccaggccttgcctctgtccattcacgtaggctgtagacacttgcaagaagagcttgaggcgtcggaagcgctgcgcgaagctcatgatccggaacggccccacggtgttgatgtccatggcgacgtcgtaccgctcgtcgaacgtggtgttggccgctgagttgatgatgacgtccacctggtcggcgatctcgtcggcgaggtcgggcgcgatgccgacgttggcttccctgacgtcgccgacgacggggaccagcttccttgcgatgaagccgtcgtagccttccccgtggatgtcctgcaggcatttgaacagctccgtgtccacgacctcgtttcgcaatctcgccaacgctgcttcgctgtccttggccttgatgagcacgtacaccttgccgacgtcagggtttgtcctcaaaatcttctcgataagaacttttgccaggaaaccggtcccgccggtgatgaggaagttcttggcgccgagaaactcggcgacaccgatcccgccgccggcagctccaggcggatccccgtgcgccgggtcgacgaaggacggcagcggtggcggcggcctcgatgagccggcagcagtagcggaggacgacgacgagcagcacgccacggcgccgccgccgtgcaggcgcctcgacgacgacgacgacagcagcgggagaaggaggccacggcggcggcgggatccctcggcggcgccgaagccggggaggacggcgcgggagaggttcacgcaggaactccccattggcccgcgcgcgcgcggccgcaaagaaatgcaggtgcgggcttggttggtggtgcgcgagggtaagctctcccgcgcgggcgcggttgcggtttgcagcagggtagtagtaggtgggtgggtgttaagacgaagctgctacttcctgcctgctaacgtgcatgcgcgccaaactttcacctgggcggaacgagatgacgagggcccaagctagctagtgagtgacctgcgactgcgac

SEQ ID NO: 2356 - DNA, 2017 bp, Zea mays
acgaaacggatcccctcgagtcgagcgaaccgaagccgaacatacccacccatcgtctcgtcgtctcgtcgcgcgtgggcgtggctctctctccccccacctcctcttttaagacgacgccatcgccagccggccctccctcgccgtccggcgccgtcctccttcgtccttccctctcatcacagtttccacctcgcgaggggctcgcgcgcgcgcccatcccggccgatcgactcacgaattcgcgcgcgatcatattcgtgcaagggcatccccgcacggccggaagcacggaatcacttccccgccccccaattcccgggctcctcggcgccgatccctcgccggtgttcgctttccggcggtttccgcggcgtgtcgcgggcaggcgcaggcggctcggctcggttgtttcctcctcgtgccatcatccatggaggcgaagcagcgcccgcggcacggcggggagaggaggccgccgccggcgacggacggcggcgaggagtacgacccgtggacggcgtggctctacaagccgcgcaccatctcggtgctcctcgtcggcgcctgccttctcatctgggcaagtggagcacttgatcctgaaggtactgccgctcacagtagcgtgacatcaatcaagaggggtgtctgggctatgattgcagtcttccttgcctactgcacgcttcaggcaccttcaacgatacttattaggccccatcctgctgtctggcgcctggtacatggactggctgtcgtttacctcgttgctcttacctttcttcttttccagaaccgtgacgatgctcgccagttcatgaaacaccttcacccagatcttggagttgaattgccggagagatcttatggagcagattgccgcttgtatgttccagaaaaccctaaaaacaagttcataaatatttatgagacattgtttgatgaatttgttgttgcccatatccttgggtggtggggcaaagctgtaatgatacgaaatcaacttctactttgggtcttgtcgattggctttgagctaatggagctaacgttcagacatatgctgccaaactttaatgagtgctggtgggatagcattatcttggacatattgatctgcaattggtttggtatttgggcaggaatgcacacagtccgtcactttgatggcaaaacttatgaatgggttggattgagccgccaacgaagtatcatgggtaaggtgaaaagatcgttgagccagttcactcctgctcaatgggacaaggatcagtggcatcctttcatggggccactgcggttcatccaagtgctgttcctctgcgttgtcttcatgaccgtggagcttaacacattcttccttaagttttgcctttggatccctccaaggaaccccttggtcgtgtacagattgatcctctggtggctgatcgccatcccaaccatccgcgagtacaactcctacctgcaagacaggaaaccggtgaagaaggttggagccttctgttggctctctctagctatatgcatagtggagctgcttatctgcatgaagtttgggcatgggctgtttcatgacccgatgcctacctggctgatcatcttttggagctcggtcgggactgcactcgtgattttcttgctttcgtggtcatggaggagtcaccaaaggttcaggagaaagcagctctgattgtttcagtttgctacttttctttttcgaattttatataggcgttgtacatatttgatatggtttgtgatgtaacttacgttttaggggtggccatttttctgctgcccctggcaggaacttggtttgtcacgatagatcatgcattgttgacaacatgagattgattaataaattgaaataaccgcgacatcataaccagttgtaattaattattaaagcaaggtcactgcatattttggttccaaactaattctgggccaacaatgcacagttctgtaatacgaatgaccaatcattatcttaaaaaaaaaaaaaaaa

SEQ ID NO: 2357 - DNA, 959 bp, Zea mays
cccacgcgtccggggttctgctgaagatttagctttgaaagaaatgattgaggctactgctagggaagaggaactgcgaaaggcaaaacaacacgacagggaaaaactctgtaatatcggccgagcattggcagtgctcgcatctgcatcatctgtaagcaaggagcgtcaggagttcttgggacttgtcaacaaggagatagaactatacaactcaatgcttgaaaaggaagtggtgcagaaggtgcagaagaagctaagagagcatacatagctgctagagaggattcagaccctcatgctgaggctgctgcagaagaaaaaatttcatcagcacttattgagaaggttgatgctatgctccaagaattagaaaaggagattgatgatgtggatgcacaaattggaaatcgttggcaactgcttgataaggaccatgatggcaaagtgacccctgaagaggtggcggcggcgacagcttatctcaaggacaccatagggaaagaaggcgtgcaagagctcatcagcaacctttctaaagacacagaaggaaaaaatccttgttgaagatattgtgaagctagcatcccaaatagagaacaatgaagaggaagaggaagcacggtagatgggagagtatatggaaacatcacactcgttcagcagtcaaaactcatgtattgaaaggcaatacatccatttcttgtgtctcttgactgactttgatagtgacttccaattagcaaggtagattttctgtagaaaggctcatgctgacatgcatttagttagccgtcgtgttgtgatttggtaggtaaattgcaaccaaaatttagaccggttgcatggacgtggataatacagatcaattgtatttgttatgctactatgcaatcccgaaatattggatctgtttcaaattctcaaataatcattgatggatgctatttattgaccat

SEQ ID NO: 2358 - DNA, 1629 bp, Zea mays
ctccttgcttcgattagcaacacatgagtagaattatttctgtaggttttggtagatgatgctttatagtagtagagattatatgttagaaaagaaaattttagatattgaggtcgatgattatcttgttcgttttcatttatccgttttgcactaccattttatcgaataatttgtatatcattgcgacattgcactatgtagtggtgaaatagttagattaaaataataaaatttatgtatggtaaaatcacaaacggattacgaaaccttttctttttagagtatatcacatttgtacataaattatcttggtattatatataagttatctttgaattatatatttccgttgcaacgcacaggcactcacctagtgtatgtgtgtgtatatatatatatactacttattaagacagtaacagtagtctgcctctcctgttctgcctccgtcgtgttctgcctcccctctcgttctgcctcccgcgcctccgataaggctctccctgttcggccatacgcacaaccgctctctctccctctcgaagcgacgcagaaccgctcgccagtgtcgcagtcgcctcctgtccctctcctctctctttgccgctgccctcctctaagcatctccctctcctactccctcctctcaaagcacttgttggccccccaccgccgcatctgcatcccataatcgcctacgccatcgccgccgccttcgggtccttctcgctcagcctcgactgctcgctcatcttcaccgaggcgctcctcacccccgccatcccctccgtgtcggcgtgcgccggcggcatcttgcccagtctcagccgatttatccttcggtctgttagggccttatcaaaccgccgccacggcgaactcgcgccgctgccatgttcgcctcgcgcacccaccatctcctcaacaacgttcaaaccgccaaccacgacatcctcctccacaacccgacctctcacgcatcccaacttggtgcggcgtaaacgcgcagcagcacttcgcctcggtcgaccacggcctgcccccaggcgttgacatccagatccatctcgctccgatctacattcgagaagtttgtctctggcatcgattccccaatctgaatcattgccgacgtcttctttgggtggacggtcgaagtcacgcgcacgcacatcccacacttgttcctccccggcggtgcattcagcaacaccgtcttcttctccgtgtcggagcacctcgggccataggggcagacccgtgaacgacattcttttggcgtgtcacgacctcctgtcgcaagctcgatgctctccccatcgacacgtgagccccttggagggagccccgacctagattttactgagagtttctcctcatcaacctagatctcagtttctctggactttactgagcactcaacattgtgtttttttggttgctggtaaattgctcatttactgctatagttgattagtaaatataccggtattagtatttatatagttactggttacttgtaatacaaacatttttcattgaagcgcgtatatggtttgtaaaataccagaacagggtcagtacttttatcattggcgagtatcttttatgtgagtaatattttta

SEQ ID NO: 2359 - DNA, 1367 bp, Zea mays
ctggtgatcagcgagatcgactcgtaagccgttacctggctgcaggccgcgaagctgctcgctctatacctcactggagacaaggctagtgcgcaggatctaaactatgttgcctatgatctggctttaatcgcgctctactggtctggacctgggtcgtaggtatgggagtcgatgcggttgtaagactagatctattactgcttaactacatattatggtctgggttagatcccgtgcatcctgtgcattgctagatattacagaatgacatgttgatggtcggttgctaccaccattttaattgaaagcatgaactcatttgcaccatggatactataatcttgtgttttcagttttgaataggtttccataaaactaataatcattccagggcatagggttgatgatgtgattactacaatatagcattgaaagtacactactatttaaacctcttcatgatcagcctagcaggtttgttggacatgtgttggataaatcactgtcacaaacttgtgtatgcctatggcctatgcatatggcctctctttcaatgagataaatctgccgagacacatcatcaacatttatttgtttgccttgagatatatcttccgagacacttttttagtgtctttataaaaaacacatagttccttgtttaagatattgtggtcccggcatcccaaacagaaaacaatgaagaggaagaggaagcacggtagatgggagagtatatggaaacatcacactcgttcagcagtcaaaactcatgtattgaaaggcaatacatccatttcttgtgtctcttgactgactttgatagtgacttccaattagcaaggtagattttctgtagaaaggctcatgctgacatgcatttagttagccgccgtgttgtgatttggcaggtaaattgcaaccaaaatttagaccggttgcatggacgtggataatacagatcaattgtatttgttatgctactatgcaatcccgaaatattggatctgtttcaaattctcaagtaatcattgatggatgctatttattgaccataaagcttacggaatcattattgttttagctgattttatcgtgaccagttctgatcaatctacgtgcctgcgtggttgctgcattattctgcttggagtcaattttcattagttaaaattaaaggctgcgattttgcaccgaaatgtttctgggcgatcaggccatcagggccacattgccacattgatactcgggcatgggaagttggagccctgggctcttatccccttcatttacacgtcagttatgttgctcgtacaacaatgtttgcagtgaagaaatcgaatgtcacattctgcaggcatgca

SEQ ID NO: 2360 - DNA, 2080 bp, Zea mays
gaacttataccaaaggacttatcagcctgcaaatagaggaggtgcaaatgacaactccatgattgaacaaaaactagaagatgaaagagacgacaatccaatatattcatatacaggttgtggctaaaatatttgagtcatcgagtgggttgaaaacatagccaatacctaagactaaaatgttgaaatgaataaacctcacaaatatatgtataacatgatgaccaattagatgtctagatgagtagaaaattagggttgcaagttgcattatagagcaagagtgcaaccacatgttataccctattaacttcatttctaaggcctaacacaaaaggatgtttgatataatctattatatacaaatctacatacgacatgtgtgtgaggtgtgaagagcaagcataggcttcacaagccattcaccacatgggacagtcgagcaactcgttggctagaaggtttgtaatccctcctatagttttgttttaaagacaaatttctcttattttagctaatatttataaaaaaatatatattaccatctaaaatatacagataaatttaatattgcacttttgtgtaaacttacttaaaaataaataagttcaccataggacaaaactaaagtgacctagaatttgaaaattagcctagataagttcatagtttgaaaagttccacaacattcaaagtgttcactttttgtaactagaggaactatttctcacctcaattttacattgcctaatattttgactagttggaagtgtaatttagtacgaaaggagcggtattcgacgagtctttcatttatcgtttatcctcactcaaccaaatggaatatcttaagatactcatctttgttccctctaaaacccaataaaaaaaagtgctccgttggacctttcccctccatccaagaaggcctaatcaaaaaaccacatcaaaaccaagaagtcaagactcaagaaccagcacggcaccgccgccagtccgctacatggaagccgcagcctccgcccttctcctccttggcctcagcgccagcctcgctcccttcgcctcggccgcggctccgtacgacccgccgacggtgccggagctcatggaccagttaggcctcccgcgcgcgctgctcccggagacagcccggcggtacctcctacacgacgatggcacctttgagctcttcctcgacgacggttgcgtggtagaggcggggggctaccgcgtcggctacgacatcaagctctccggcaccgtgtcccctgggtcggtcacggggctcgagggcgtccgcgtccgcgtgctgttcgcctgggtgcccatcaccggcgtcgaggcggccgacggagaggtcactgtccacatcgggccaatcaggaagtcgttccccgccgttgggttcaaatccagcccccggtgcatcatcggattggcggcggcagatatcttgcctcctttggtagaacagtagtcaggctgcctgatttgttaggatttagtcgaaatttgcggtgtcaacaagattataatttccttatgcttttctgtggcatgttgtttctgaaccctcactagtgtctgcgatagcacacaattacacgattattgtattgtttagtgtgactatttgttttctatcgaacagaaaaacgaagactataacaaaaaaaaaaaaaaaattttcttttgttttacccaaacggaaatcatgcaccccagtttgctgtagacttgtagttccacaggggagatgtaattttcatccccacactgcgattgggtgagtttgctgcaccaaagatcatgcactgtcatgttggacgcggaaatggcaactaaggttattgtgcaaaagatcatgtgctttcatgttcaaggatgtgttcaggaaaaaaatagcgaataggaagaaacaaccgaaaatattaaaaatatgtattgaagatgacgaagcaactgaaaacataaaaaaagcatcgtgaagagaaagaagattgaaaacataaaaaacggaaaatttaaaaagagactaaaatgaaacaaatagaataaaacgttaaaaaactgagag

SEQ ID NO: 2361 - DNA, 1275 bp, Zea mays
gaacgtcgccgtccgggacggagcgcctcgctcgcaacccacccctcctctctcggcgactcggttctccctcccgcgggacgccaccggagctgactgccgctgctggggcctggccgttctctcatggtcatggagacgccttcgcaggagatggacccagagcaacatggggacaacatggcaggcaagggtggagctggacaggtctattggtccaacgcaatgtctagttttgtgctcaaatatttggccgacctagttgcgagtggaactaaaatcacgagcggcttcaagcaagctcatcttaacagctgtgctagagctttgtatgagaagctaggtgtccagcgcaccggcggacaagtcggcaaccatctcaggaagtggaaaaggatttatgcgaagatcgagaagctgaagaacctggatggagctgtctgggatgaacataattgcgtaatcagtcttgacgcagagcattacaataaccatattaaggaccaccgtgaggatgccaactacttgaacattccggtcgagcattatcatgagatggccattatatctggcaacagttcggcaaccgctgctgcatatgttcaaggatcaaatgagccacttggtgttgaagtgactgaaacagatagtgcaccagctgtgactgaaacaggcaatgcaccaactgtgactggaacagacaacaatgcaccgaaacccacgtgtagtgtgccaagtgaacaattcggtggtgacgacggaacgcactcatcaggcaacaatggcgcagaagagtcttcagatactaagcagccaccaccgtcgaagaagcagagggtatacactgacgatgacttggttgtgataatgagtcggagcctcggcgagcttgcttcggctataaaaaggctttccgaacaacccgaccttcctgttccgaaggggttgtacgaagagctgaagagcatcccagggttcgaggaggcacatcttgagcactactatgcttacctgtgcgagaatcctccgcttgcgagggcattctatgcgctgcctcagctttctagcaaagttacgtgggttgctaggtacgtcaagaatcacagctccgaactgatgtagctactctgatgatgtggtggtattttggtctagtcactagggatgaaaaaaaaaaactctttttgttgtatgacagacagcatggaacgtgactatagtagggatcttttaatataacataacgtagattagtggccaaaaaaaaaaaaaaaa

SEQ ID NO: 2362 - DNA, 2816 bp, Zea mays
cattgggtacctcgaggccggccgggagagcgagtgtgctagtgagcgtgcgtcgcgtcgtgcactgcagtagcctcagctcctgtctcgtctagatcgatggaggttgccacgcacatggcaaggtccagcaccgtgtactggtcgctgctcgccgtgttctcttggttggccgccgccggcgcaggccttggcgacggcgggaggtcgccgccgcaggtgtacgtcgtgtacatgggcgccgtgccgccccggacatcccccagcctgctcttggaaagccacctgcgcctcgtcagcacggtactcaagaggggccggagggcagacagcttagtggtgcaccagtacaagcacggcttctctgggttcgcggcgcggctgtccaaggacgaggccgccgcgctgaggcggaagcccggcgtcgtctccgtgttcgccgacccggtgtaccagctgcacaccaccaggtcctgggacttcctgcagcagacgacgacggccgtcaagatcgacgacgccgccggcgccggccctgctagacgcagcggcaacaagaaggggtaaggccgccgcacccgccaacgacccgtcgtcgtcgtctccggcggcggacactatcatcgggctgctcgactccggcatctggcccgagtcacccagcttcaacgacgccggctttgggcgcccacccagccggtggaagggagtgtgcatgggctggggatgacttcaactcatccaactgcaacaataagctgatcggcgcgagatactacgacctcagcagcggtaagggggccggcaccgagcggcggcgggtcgccgcgggacgacgtgggccacggcacgcacacgtcgtccacggccgccgggagcgcggtgaccggcgcctcgtactacggcctcgccccggggaccgccaaggggggctccgcggcctccagggtcgccatgtaccgggtctgctcccaggcgggctgcgcggggtcggccatcctcgccggcttcgacgacgccatcgccgacggcgtcgacgtcatctccgtctcgctgggcgcgtcgccctacttccgcccggacttctccgcggaccccatcgccatcggctccttccacgccgtcgccaagggggtcacggtcgtgtgctcggcggggaactccggcccgggcgccgccaccgtcgtcaacgcggcgccctggatactcaccgtcgccgccaccaccatcgaccgcgacttcgagtccgacgtcttgctcggtggaaataacagcgccgtcaagggtgtagctataaacttctcgaacctggacagatcccccaagtatccattgatcaccggcgcagcggcgaagtccagctcagtttctgacaccgactcagcaagccactgtgagcccggcacgctggacagcagcaagatacgagggaagatcgtgctgtgccaccactcgcagagcgacacgtcgaagctggtgaaggcggacgagctccagagcgccggggcggcggggtgcatcttggtgatgaacgacaacgagagctcggtggccaccgcctacctcgacttcccggtcaccgaggtcacctccgccgccgccgcggcgatccacaagtacatcgccgccgccagcgaaccggtggcgacgatcacggcggcggccaccgtgacggagtgcaagccggcgcccgtggtggcctacttctcgtcgagggggccgtcggggcagaccgggaacgtgttaaagccggacatcgcagctccgggggtgaacatcctggcgtcgtggatcccggcgtcgtcgctcccgccggggcagaagcagccctcgcagttcaacctcgtgtccgggacgtccatggcctgcccgcacgtcgccggggccgccgctaccgtcaaggcgtggaaccccacgtggagccccgcggcggtccggtcggccatcatgaccacggcgaccacgctgaacaacgagcgcgagcccatgacgacggactccgggtcgccggcgacgccgtacgactacggcgccgggcaggtgcacccggcgggcgcgctggaccccgggctggtgtacgacgccggggaggacgactacctccgcttcctctgcaactacggctacaacgcgtccactgtgaggctcgtcgcctccaccctccccagcgggttcagctgcgcggccaacgttagcaaggacctcatctccgacctcaactacccgtcgatcgccgtgacggggctcctcggcaataaatcggctgcggcgggccgaagccggaccgtgacccgcaccgtcaccaacgtgggggcgcaagaggcggcctcctacacggtcgccgtcagcgcgccgcccggcctggacgtgaaggtcacgcccagtaagctcgagttcaccagaggcgtcaagaagctggccttccaggtgagcttctcccgtagcgggaacgacgacgacgcggcggcggccaagggcgccctttcgggctccataacatggtcagacggaaagcacatggtccgcagcccgtttgtggtcaccagctgaaacatcatggcaatacctgacgcgcaggcacgtcaagaaatgctgtgatctcagatataaagtataggatacgatgttgaaagccactgctagtggcaaactcagaatcatcgaagattctgaaactgggccttccaaaacgccttggtcagaaatgacggttaaacattctaatataatgtcgaaaccttaggctcatgtacaatgggaaatagtaagcatcatgacagctggaagtattcagtggaactcgatgcacagtttgc

SEQ ID NO: 2363 - DNA, 1433 bp, Zea mays
ctgtgcggcgctcgagccggccgggccgggacggacagcccttcctccccattccgagttctgacccacgctcagaatccatccatttctatccccccacacagatacacatcccccttcccttccccgcaactactctgtgctctctactacacgcttctatctaagagaacagaccagaccacgcacgccggcagagaaaaaccagaattctccaagcaatcctatcgccaacccggccacggatcggggctgccgtctgtttccgccggcgctggcgccgacgccgatgggctccgccgatcgcagtaagatcgacgggatcgtggtgacggagaaaggcgccaggagctgcgtcgaatgccgcgccaccaccacgcccatgtggcgcagtggcccgaccgggcccaggtcactttgcaacgcttgcgggattcggtaccgaaagaagaggaggcaagagcttggcctagagcacaacaagcagcagcaacaacaacaaaataatggcgaggcgaagactggagtaaaagacagctctagcaacagcagtagcagcgggagcagcaactttcacgtggtgcagaaacggaggctcctaatggaagtggaggaggctgctctgctgctgatgaccctatcttcttcgcccgcatccacattgctacatggctaggaaccctgcaacaccaaatcaacgatgtacatacacacacaggcttccccaccccacaccttgcacagtcaccatccaacgattccagtccaaatcgtacatgtttctcacaccagtctgagatagggaaggagggggcctatctcgggattgtgtgatcttctgataggggtggatgattagtgccaacctaatcactccattgatcgtcttgttctctgtttccgtcctacctgtagaccttgatgtatctgctatgtgagttgtggtaggctccataacaagaggtcctgttgatctcacttccccacacatctttttctctgtccttttctctctttttttttatgttctccctctttcggttttgtatgtactttgatgttgcccctttgtgagggatggatgatcaaaaggagacgccatcctttctcattctggaataatcaaggatgtgagctctttcatttcagctaaagttcgtgttgctgtgtcatgaacaagaaaaaatgcagtttcggggtcggtatgtttaaaatcgtacatgcgtgctggcggctaaagaacgcagatgactatgttcattgacgctgagcaggatggctacatgtggatcagctgtcagtaacagactgaagctgccaaagtgtttttgttagcacatctaatggcatgtcttattgcaggtaaatagatgacgagaatgtgacggcgcgatttatgcaaccctcggatagctgttcttagtgacagctgc

SEQ ID NO: 2364 - DNA, 5010 bp, Zea mays
  misc_feature (781)..(781): n is a, c, g, or t
  misc_feature (2621)..(2621): n is a, c, g, or t
  misc_feature (4215)..(4215): n is a, c, g, or t
agcctcagttaatggttacttttcatactacagtctaattttatctcatgccaatgcctacaaatgctataaccaaattgaaatgtgttgaagtgaactgaaataaatgaacaaactgatgtatagatatgttcactatttaaatagcatgccatcatatatggagaagagttacccggaataggcttgatgcccattcgtcaagcacagcctgcacatacaagaagcaaatacatgtgattagaaaacaagtaaaatataagatgcccaacataactgatacagaatcatatagttgtttttttaaaggatttcccttaatgttgggttatttttctgttttgacctctttagagtaaacaaattcttcagttcgttacatggacactaacagcagtcagacttactggaaggtctgtgttcaacttggcagccttccttgcaagactagctaggaacctcaagatatatatgtctaatgaaattgctgcttgaactccaggtctttgtactttgacagcaacaatcttcccactggagcggagcctagcctggtaaacctacaaaagtaagaaaaattgaacattgtatcactggagatgaaatgccacggttgtccatgctaggaagtgtgaattgactaatatttgaatttatcatggaagttcagagttccatcctattatgcctttagttttctcaaattcaactccggtaagtaactcatttgtggttccttcaaagaaacatgtgatatggtgttgaaacttttcagatttcnactatacatatacagtacttttaaaagggcagacatagtgccggaggctcccacataagtggggattgagaaagggataaaccgccgcaaacctttttccccgcaaacgcagagaggttgcttcaaacccacgatatacgacgattcagtgagccattgcactaggcaatacttttagttgctcctaaatttgaagtgcacttattttcgtccctttagaggaacacacaaaagcaaatattaatgtgcaaagctgaagttcagtgcatatcagtttggtgttcgaacttgaaacaattgggcgtgattggttcgcctgccgctcgcgcccaggctgctcgcgtgcattgactgcgcctgcatgcgcgtttggttggctgcacagagcctgtacgcgcgggtgtaggcaaggccgttttgggctctttcacctgcatgcggagggaagcggcgacgctcgtttccatcgggacaggcccgcgacgagccaggcgtgcccactgccgcgaaccaatctcggtaaatgaaaatgtagagaggatgcaattatattgcagccagataactaataggtaatagctcaactatccaaatgcacgtgactacatgcaactgtgctctgctttcgtatttagaaatacaaaatgctgctaagagtggttaatcgattcatgacatgaatgaatacattaaaaatgataaagtgatcacacctgcccaagagatgcagcagcaacaggctctggtgttatctcagagaaaaccatatccagtggaagcccaagctctttctctataatattaaaagcaacatcgtttgaaaatggtgctatgcggtcctgaagtagtgagagctcatcaaggtatgcaggtggaacgcctgcctgcagcaaatgaaacaaagaaggcgacaaatgtcaaacatctaaagctaaggcactccaagcttgcaatcgcaatatgaacaggtgaaataaaaatgtaatgactagtgaacctcaccggccgtgacgaaactgcttgtgcgatcttcacaaatgcctgtgattaaaaaaggaacatcaataaactttatgatcatcagataaggcaataggaaatgagacataccgggccaagctccaagagtatcctcctgagctgagccgcccgaagctgcaaagacaacaccaaccaactcatcgtgtcaagcacagatggtgaaacacgccagggaatttgatcaaacagaaagcgtgcacgggacggatcacaagcaaacggagcgtgagcgcggacctcgaacatgtcgtcggcgcgctcgttgacgcgatcgaggtaccgcagcgcgaaccaccggccgaaggaggtgccgatctgcagggagcggcggagcacgaggagcgggcgccggcggtacacggccgcgatgccggggaggtcgtacgcggtggggagctccgactcggtggccgcgccctcctcgaacaggtacccggagcacctggtgaatgcgtcctcgtcggagctgacgacgatggaagcgggcgcggaggcgaggggaggcggcaccagccgccgacgtggccgaggcctcccccgcagagcaggcgcagggactgcactgggctggaggagaagcatctgggttttcagatgatgcggaggatctggggagattcgagttgggaacggaggctctgagtggagctgcagcgagcggggaagacgaaactggagaaacggatgggataggcataggcgccaaatggagtagtagtgtttgtaacggcgtgattttttgtggctcagcattttccggcgcaaactccacctccgaacgcgcggcccagaatctacnaaaatcggaaaatcgccggggggcgtaggagacgacacgacggcacgttcagcggcgcacgaaatctacgcctctcagaagatcacgacgaaacgtgtctggtgcccgactcttctgaactctgaactatgttatccaataccgttggtggtgggccgcagaaccgcgcgcacgggggagccaatggcgatcgtggccattctcgtcgcgcccaccgccagctacgtcgggccgcgccgccggtggcgcgccgcggcagcctcgtcttcggcggcgtccggggtggacctcaaagcgctgcaggccgccatcgataaggtgagcgccgaggggcagtccgcagcaccggttttctgattggttagcaagcaatctgattagctgatacatttgggttggatgctgctgcagaaaagcagcgatgatgttaggcaggcgctggaccagctgagagagagcggatgggccaagcggtggggctcgcagccctatgtgtcgcgccggacggtcagtgctgtatcttctcaggcatcaatgattgagcgcttcgtgtttgcaggatgcgtactcctgtcatgcgttttgctcgtgcaatttttacaatgcagtagcatttgatggttgtgtctggctctgattgattctaactgatgagcctgcattctgaaacagacatctctacgggagctcactacccttggaatcaagaatgctgagaatttagcaattccaagtgttagaaatgatgtgagtgttgttacttgctccacagttccagtctttcgtatttgaaatgctgactgctgttcagctgttagccgaggcaaatgtagcatcattcagagctaaatatcccgtgcttttcagagtgtaatcctgcgtcttctttgagtgcaggcggcattcttgtttacagttgtgggtaccactggattcttagccgtccttgcaggccagctccctggggtattgctatttccatgacacctgctctatgtactttcagaggactagaatcatggggtacctgcaaaattgattgtgatcccgacatctaaatgaaaagaaattcaaggtttaatgaatcttctactattatttctgccaggattggggcttctttgtcccctacttgattggaagcatttcattgatcgtattggctgtcggaagcgtcgctccagggtacgtgtttcttctcctgtgcatgtttggaagagagattcagatgcataatcttttccatggccttatacagatgtatctgtctccaaaattacatcatgtcctggagcaaagtttgcttagacatgaataaggcaagactagtgtcctcatataacttagactgtctaaagaaaaaaagaaaaaaaaaacaggaacatgcaaaatggtcattcggttcaatgcattactgctaacatgacaaattgtatcccaatataaaatgatgctcattcttttgggacagagaaatttgcacgctccatgtaaaaatgttgcatattaattgtcaaaccatgttaattatgcataccatcattgcagtcttctgcaagcagcaatcggagcgttctctacagtctttcctgantaccaggagaggattgctaggcatgaagctgctcatttcctaggtatgtgattctcatttcctagcaaaattatatctgcagtagtaatttactaaatggatgttctgttgaaaatccagtcgcctatttgattggcctccctacccttggatattctttggacatcggaaaggagcatgttaatttgattgatgagcaattacaaaagctaatatacagtgggcagcttgatggaaaggaactagacaggttagctgtagtttcaatggcaggactggctgctgaaggtctagaatatgacaaagttgtaggtcaatcagcagaccttttcacccttcagaggttcataaacagaactaagccgcaactaagcaaagatcagcaacaaaaccttaccagatgggcagtcctgtttgctgcatcacttctgaagaacaacaaagcagcccatgaggcgcttatgtcagcgatgtcccaaaaggcaagcgtgttggggtgcattgaagcaattgagaatgcatcctgatcaaaatgtaacctgagtagtgtactagcatcgctggacccgatattgtttcaccgcttctgactactactgttgttggttcgttgagcctgaggaatcaggtggaggagaggatcgaggcgtaggaaggagaaaccctaatcatcaccgtcgattcctgtacttcttctgtagacatcagaaactcaggccacagggaggaaattcacacaatgacaaaaacaatagcctaatctgctgccatttactatcaaaaaaaaaaaaaaaa

SEQ ID NO: 2365 - DNA, 1473 bp, Zea mays
acgtgtctggttcttctgacctctgaactatgttatccaataccgttggtggtgggccgcagaaccgcgcgcacgggggagccaatggcgatcgtggccgttctcgtcgcgcccaccgccagctacgtcgggccgcgccgccggtggcgcgccgcggcagcctcgtcttcggcggcgtccggggtggacctcaaagcgctgcaggccgccatcgataagaaaagcagcgatgatgttaggcaggcgctggaccagctgagagagagcggatgggccaagcggtggggctcgcagccctatgtgtcgcgccggacgacatctctacgggagctcactacccttggaatcaagaatgctgagaatttagcaattccaagtgttagaaatgatgcggcattcttgtttacagttgtgggtaccactggattcttagccgtccttgcaggccagctccctggggattggggcttctttgtcccctacttgattggaagcatttcattgatcgtattggctgtcggaagcgtcgctccaggtcttctgcaagcagcaatcggagcgttctctacagtctttcctgactaccaggagaggattgctaggcatgaagctgctcatttcctagtcgcctatttgattggcctccctatccttggatattctttggacatcggaaaggagcatgttaatttgatagatgagcaattacaaaagctaatatacagtgggcagcttgatggaaaggaactagacaggttagctgtagtttcaatggcaggactggctgctgaaggtctagaatatgacaaagttgtaggtcaatcagcagaccttttcacccttcagaggttcataaacagaactaagccgcaactaagcaaagatcagcaacaaaaccttaccagatgggcagtcctgtttgctgcatcacttctgaagaacaacaaagcagcccatgaggcgcttatgtcagcgatgtcccaaaaggcaagcgtgttggggtgcattgaagcaattgagaatgcatcctgatcaaaatgtaacctgagtagtgtactagcatcactggactcgatattgtttcaccgcttctgattactgctgctgttggttcgttgagcctgaggaatcgggtggaggagaggatcgaggcgtaggaaggagaaacccaaatcgtcaccgtcgattcctgtacttctgtagacataaaaaactcaggccacagggaagtcaagtgctcgaaactcgaaaggcaaggaaattcatacaatgacaaaaacaatagcctaatctgctgccatttactatcatacacgtgtgccccaaatattactcccatcttttgttttcgtatataatgcgggattgtcctctccaacaccacactttgaccattaatatcttgtatgctgtaatattcatactgtgaaagtggacattatataaataacgtgtttcccaaatatgaatccc

SEQ ID NO: 2366 - DNA, 2674 bp, Zea mays
ctttatattgttgtgatatttggactttatgcggtcaaatgatgctagcattgtttaatattgtggttgcaatatttggattttacgaggtttgaatatataggacgagcttggaccggcacgattcaacaaaagcacggcttgctttagagtagaactgaccattgtttctacttttcaggccctaaaagtttttttttatcttcttagcccgatcccagcactagactggactggactgagaccttgtactttgaagtaagatgcatgagttcgttatgcggattcgcaaggcgcgcgtacagtacagctcggcacccaacagctagtagtacgcacgttccgttaatccgctggatggatggatcgatcggagacggacaggggcggacgcgcggcaaacgtacggtgcagttattgtcgtccgccggatcgatcaatcgaccggcgcggcggacggatcgaacagtgcccgaacatgcacgtccgtcccctacgcctgcggcgtgcagcatgcgcgcggatcgtagtccccggtcgatcggatgcgcgggccggaccccggcgctgccgaccgggaggcgggagacttggttcgtttcgcacctgctgccttgtctcgcgctcgcgcggcgcgtcaggggtggttggtcgcgtacttgcgttggctgctgcctgggtggctctccgcctctcctggccacggcgagactgatgcgcgcgctggcccagctttggtcgctgttgcgagctggtctggacagcgacccggcccggccggccggccggccgccgagaccgaaaggaagcaacgtacaaccagcaggaagcaaggggtgagagagagcgagagaggaggggcgtgcagccgtccggtccagcaggcgacggaatggaggacacgccgggcaggtcgctgtgcgcctgtgcctgcgtgcgcgatcgcgagtggccagtcaccagcaggccggccattaaaggagagcacgtgacggcgcgccagtcgcttccttcgcttcgcttgctcgggcgccggcggggaccaccagggtaaaagccgagcgcgcaggacgcgacggcgacggcgacggcgacggacgggacgggtcccatgagcccatcaccacgagcggcgtggacgtggaggtggatggaatgaccgatcgaccgatcgatcgcgagtgatgactgatgagtgtggcgtgactccgatccctgatccctccccatccctagctttccggcaacgcgctaccgggccgggggcctagggtttccccccctacggatgctttgccggaaacggcaacctgacgccgaggcgcgcgcaccacccctgcgcccaccggctccttccctgcgccgcgctgatgataactcagtccctgcacaggccccggccccggccccagccccaccaccgctactccactaggccctggttgctagccagctcgcttgcttgcttcgattccgattcctagcccccgtgccatcgctttcctctcgttatttagccctccgttcccgaccctcatcctccgctccagacttccagcatctccgctccggctgcgctctgccttgctttcctgctacctgctctagcgcgagcgagcgaggtacggcggccgatctggcggcgcaggcggagggctcggccggggccggcaagtcggcgccgaacatggggaggggccgggtcgagctcaagcggatcgagaacaagatcaaccgccaggtcaccttcgccaagcgccgcaacggcctgctcaagaaggcgtacgagctctcggtgctctgcgacgccgaggtcgcgctcatcatcttctccaaccgcggcaagctctacgagttctccagcacgcagaggtatacacgcgcgcgcgcgcatgtactactactacccggcagcgtgcccgcggtcaccttgccagtgccgggcagtggtcacacggcgctggagtgccttggtctcgccggatctcgctagatctgcccgtgggatgttgctggatcgagcgtcgcgagcagtttctgtcttgcgcgaggcgagagagtcagagaggagagccgagagagctgccgtttcatgtggcttccggacacgggatccggctactgccacggctcatcttgggtttagttagggttttgcttttctggtcccttgggtagatcgacctctcgcatcacttttgtcgatcggcatcacgctgcgtcttgaattgatccgttggtcttagaagtgtagtcgcggctgtcaaagctcaactcttcaaattcatgacgacctgagcagcagcgcatgaattccctatatatggatctggttaaacaaaacggctcctggtttcagttactacagacgtagtccaaagtctagaataatacatgaagtttcagaagcatcaccttccttcttctttgttttatttttttaaagaagcatcataaattgacttttgtttgaactgaaaagtcgtctcaagtagtaggttcgtttatgggcctgtttggttcggcttttttctgacgagcttttctgaaaagctggctgtggaaaaaagctggctgtggcggattctggcgcccagaagctgtaagaatccgaaccaaacacagcgtatatatgatccaaaggaaaactcgaccaaagaaaagaaaaaaaagc

SEQ ID NO: 2367 - DNA, 1238 bp, Zea mays
gattcctagcccccgggccatcgctttcctctcgttatttagccctccgttcccgaccctcctcctccgctccagacttccagcatctccgctccggctgcgctctgccttgctttcctgctacctgctctagcgcgagcgagagaggtacggcggccgatctggcggcgcaggcggagggctcggccggggccggcaagtcggcgccgaacatggggaggggccgggtcgagctcaagcggatcgagaacaagatcaaccgccaggtcaccttcgccaagcgccgcaacggcctgctcaagaaggcgtacgagctctcggtgctctgcgacgccgaggtcgcgctcatcatcttctccaaccgcggcaagctctacgagttctccagcacgcagagcatgccaaaaacacttgaaaagtaccaaaaatgcagttttgcagggcctgaaacagcactccagaatagagagaatgagcaactgaaaagtagccgcaatgagtacctcaaactgaaggcacgtgttgataatttacagcggactcaaaggaacttgcttggtgaagatcttgagtcattaggcataaaagagctggagcacctggagaagcagctcgattcgtccttgaagcacataagatctacaaggacacaacacatggttgatcaactgacagaacttcagaaaaaagaacaaatgttttgtgaagcaaataagtgtcttcgaagaagactggaggagagcaaccaggttatatggcagcatgcgtgggagcaaagcgagcggcattctgaagtgcagccgcagcagctcaatggcaataacttcttccatcccctcgatggtgctggtgaacccacccttcagatagggtatccttcagaggcactgactagctcatgcatgaccaccttcctgcccccgtggttgccatgagatcgaactactgcgcaattccgaattaataagcatggccgcatgcagctgcctgtgctatacgttgtgcttggagtgtactttaaggttcttgcatggcaagtatgtgtgtaacatttgtgatgaacatggaaactatccacttaattctcgaataatcaatgaactgggtaagattgtaacatagtgctttatgcctaaaacattaatttaggctgcgtgtgaatgatggaggttgtgttccgcgtgttcaaaaaaaaaaaaaaaagcagtttagggttggtgaggaaagtgataaattta

SEQ ID NO: 2368 - DNA, 1390 bp, Zea mays
cattgggtacctcgaggccggccgggcaatttggagaacaataattccaagattgactacaggccatcagcacaagatgttcatgagtatttggtagatgcctatgagactcgagtggcttttaaggagaagaagaagcttctagcaccactgcctatcagtgatgatctgaaggcaactataacatcatcgaagcgagagtggggcacatcctggtggcagcaatattccatcctcttttgtagagggatcaaggaacgacgacatgattcccggcccacgcgtccgatcacccaggtcatagctacatcggttatcttaggtttactgtggtggcactctgatcccagcacactaaaaggtctagaggatcaggctggcctgctgtttttcatcgctgtgttttggggcttctttccagtgtttactgcaatctttacattccctcaagagagggcaatgctgaacaaagagcgcgcagtcgatatgtacaagctcagtgcatacttcttggccaggacgacgagtgatctaccacttgaccttttcctcccaatcatattcatggtgatcgtgtacttcatggcaggcctcaaagcaactgccacacatttctttctcagcatgttgaccgtctttctcagcataattgctgctcagggactcggattggcaattggagctactctgttggacatcaagaaggcgacaactctagcttcagttacagtcatgacattcatgctagcaggaggcttctttgtaaagagcgttccaccattcatctcctggctgcgctacctgtccttcaactaccacacgtacaggctcctgctgaaggtgcagtacgaccccgtgccggacatcctgaccaccacgaggcacatggacagcggtggcaccgaggtggcagctctcgtcgccatggtcatcgggtaccgggtgctggcctacctgtccctgagaagggcgaaggccctgggcagctagcgcatcccttcaccgcagtgactgaagcctgagctcgtggagcgggttgggtcattgggtgtgtagggaagtttgtgctatattgcgctgtgaaaagatggaagtcttttttttttacttttctgtctttttcaactaagttctgagcaagtaccaacactgaagaacaaggatctgtagcgagtgtaccagagacaagctgtgctgtaatttttccttcacaacgattgcgtggttaaagtgattgagtataagcgtgagtttagattgccggcatattcttaggatgggtagctctaggacaaattctgttcatactcccaagaacgcgtacatttcatcaatgacattatacgagttcttcgcgaaaaaaaaaaaaaaaaagcggccctcgagcttc

SEQ ID NO: 2369 - DNA, 3191 bp, Zea mays
tgaggactacaaatctggtgtgcaatgcctacatgagcaaaatacttgtgcaggtgatgatattctccacctcggtctgattgaagtgagagaatgtttttgttcatcaaaggttcagcatgtcgttgaaactgaaaactgttccgcgccgctaggtcggcctttttacggcccataatatattctgctgcgacgcctgcctcggcgtccgggcatcgccatcgtagacacggcaaaggagacgccggaaggcccggacggaacaagcgagatatttaaggacgcctttttggcgcgaccccacgacatggcggcatatctatctactacacacgcctttaaaacctttcgccctcctccgcgctcccggctcctcccagcaccagcaagcagccttatctatcccctcagctctgcagctcagtgtccaccaccgccgcctccttccagctgggtggaagaaacatgtcgcgaatggcgcccccgtctccgcctcagtccctgaagcccccgacgctgcccttctccccgcccaaaaagccaccgccgatgccggtgtacaaggacctgcacttcaaccgcgacctctccgccaccaagaagctccaggccggagtggacctggtggcacggttgttgggggtcaccctggggcccaaggggaggaacgtggtgcttggcaacaagtatggccctcccaagattgtcaatgacggggagaccgtccttaaggaggtaacgccatgcttccagaaattagctagctgctacccgaaacaacagtatgcagctatttggttagactggatctggattgaatgaatggcatgatgaagtgaaggcacaaaacatgttgatcactccactgattactgttcaattcttgatcgatcttgttatcttatttgcaatgttaggtctttttttcactctgttctgaacacaagtggaaactgcaaatttgttattgttgtggacttcgggcactaatgtactaatatgagatgcttctcgttccgatcatgtcctttttctgatcatgttttaatacttccaatgcccatgtatcaatcacactgtgtcattcaagatcgaattggaagatccattagaaaatcttggagtgaagctggtccgacaggctggagcaaggaccaatgatattgcaggagatggttgtaccacatccataatccttgcccaaggcctcattgctgaagggatgaaggtgtgcctatctcttctctaattagttttctatacactggtaacagcgaaaaaagttgctatgatgaagttgttgatttatagattctgagtcaggatcctgcattgcttcttataattgtttcataaagtaggttcttgcagctggaatcaacccagttcaggtcgcacgtggcattgagaagactgctgctgctttggtgtctgagctcagactgatgtcgcgggtggtatgattttcgagtttgtaaaagtttttttttgtgctctgtaaatccactgtggagatatcttagtggtgtgtaacctgttgttttctagattgaagaccatgaaattgcacatgtggctgcagttagtgcgggaaatgattatgctgttggaaatatgatttatgatgcttttcaaagagtaggtagacaaggaatggtgagaattgaaaatggaagaggcaccgagaacagtctggaggttctggaaggaatgcaatttgaacgcggttacctctctccttactttgttaccgatcgtggtaacatgacggtggagttcactgactgtcagatactattggttgacaagaaaattacggatgctagtgagattataaggatactggacagtgctgtcaaagaaaactatccgttgttaataatcgccgaggatgtggaagaacaggcaatggctgatttgataaaaaacaagctgaaagggacaattaaggttgcagccgttaaggccttctcttttggggaacaaaagactcaatgcttggatgacattgcaatcatgacaggaggtacactagtgagggatgacatggggcatatactggaaaaggcaggaaaagaggttcttggttccgcttctaaggtggtaatcacgaaagattcaacactaattgttactgacggaagcaatcgtcgagcagttgaggaaagggttgctatgataaaaggccaaattgagaattctaaggaaagttacaacaagaagatattgggtgagaggatagcaaggttatgtggtgcaattgcagtgatccaggttggtgctcaaacaatcattgagatgaaagataagaagctgaggattgaagatgcacttaacacaacaagggcagctattgaggaaggtgttgtagttggtggtggatgtagcctactaagactgtcagagaagattgacgcaatcaaggaatcatcgttggataatatagagcaggaggttggtgctgacatcttcaaacaagccttgagttaccctacctcactaatagcaaaaaatgcaggggtgaatggcgactttgtcattaaaaaggtgttactgaatgatgatgcaaattatggttacaatgctgccaagaactgctatgaggacttgatggctgctggaatactggacgcaacaaaggttgtgaggtgttgcattgagcatgctgctgtagttgctaagtcctttctcacctctgatgtggtgattgttgaggcaaaagaaggcaaacctattcgaataagacccccaatgcctcctaggcacttaattcccccaatgcctgcttcaatttcaggtattcgagtgtagcaggcgtcctttccaccaagaatcagcctcaacacaacaagactacgggcccggtacccccaagtttctaagataataaagcaaagaaaacatagtgaaattttgacgtcaaacgtggctttgtatgattgctccaagaagctctatgcacgctatcgcatcatcggagcagcagcaagggtggatgatatgtgttatatagggaatacaaaggtgaacaattcaattttgatgttcaaatgctccttaccgtcataaatatacttctgtttttttaggaacatatactttaatagcttcgcttagtttagaattttttttttttgaagaggagaagaattactcattattatattaagaaacaaaccgttttagtcctg

SEQ ID NO: 2370 - DNA, 2168 bp, Zea mays
aattcggcacgaggccgcctccacctcctacaggctacaggcctacagctgcgacctgcgagcgacggctataaaaccttcgcctccactcccagccgcgaagccctactcaacttctccttttcccccggcgattattccggccactgaccttcgttgcgtgccgctcgagaacccggttcgagaatcgacggcgcgcggctgcatgagagggtgatataaaatcgataaaaaggacgagcagcacgactctcatttttttgggggagggttgcggtggaagaggattgcgctggagagaacccaattttagggcggtgccggcgcgaccgttccgggatcgggagctttatctggggggcgcgagggatcacggccgcggcgacgaccgaccgaccgaccgaccggccggccaacccaaccccaccaccaccagtccccgcggcccgcgtcgaggaagaagaagggataggagacggagacggagacggagccggtggtcgcaaggatggccgggggcatgcaggcggcggacgcggcgggccggctgagcgcgctgctctcgctgctcgcgctgcgccggctcctcgccgtgctccagccgctggccctgctcctgctcctgcccttccggtggcgcgcgcggccggccggggccgtggccgcggccgtggcgtccgatgccgccacggcctccgcgccgggggccagcgggtaggaaggggaaggcgtcgtcgtcgtcgtcggtggttctgcgggtgccggccgggtcccccatggtcgccgcgcggaggcaggcgtccgcgcgcagggaggtcgccgtgcgccgggcgcgggaggccgggcgggagtacgagctcgtccccaccgctcgcggcgagacgctcttcacgcagtgctggtggccgcgcccgccctccaccgttaaaccgagggcgctagttgttgtcatgcacgggctaaacgagcacagtgggaggtacgaccatttagcgaggcgattgaatggcatcggcatcaaggtgtacgggatggactggactggtcatggtggaagtgatggtctccatggatatgtgcaatctcttgatcatgctgtcagtgatttgaaaatgtacctcaagaaagtgttagctgagaaccctggtcttccatgcttctgcttcggtcactcgactggtggaggtatcattctgaaggctgcacttgatccagaggtagaaactctccttagaggtattgtcttgacatcaccagctgtccgtgttcagcctacacacccaatcatagcggtcatggcaccgatttttgccctcatcgcgccgaggtatcagttcacggcgtcccacaggaacggcccgccggtgtcgcgcgaccccgaggccctgcgggccaaatacacggacccgctcgtgttcacgggcgccatccgcgtgaggacgggctacgagatcctccgcctgacgtcgtacctgcagcagcacctgcaccggatcgcggtgccgctgctggtgctgcacggcgccgacgacctggtgaccgaccccaggggctcgcgggcgctgtacgagcgggcctcgtccgcggacaagtccctcaagctctacgacgggctgctgcacgacctcctgatcgagcccgagaaggacagggtgatggacgacatcgtggcgtggctgagccccagggtctgacgccgccggcgcgttgcggtgctggccgtaggacgcgagcggctttttgatcatctgctgagcgcggaggacctgcaggccgaggacgcctcgcctccggacggtgggtgatgacgcggtctggtctggtaggctgcggaccgagggagagcgggtgtgccttctcgcccccttggtgtgctgaactgctgatacgatacgaggagcaggacaggagtacggagaactactactacctacggctatgggcgatggctttactcgcgcctcccggtgtgtcccgagattttttttcggggacacgtacgaattatgtaacggagttcgtttcgccgtgccacacgcacgagcggtgtccgatacacctatagaaaacgactttccatattgcgagttgtgtgatgtattcacacaattctgaatcagagttgcaacttgcaacggattcttaaaaaaaaaaaaaaaaaaaaaaaa

SEQ ID NO: 2371 - DNA, 2603 bp, Zea mays
cgaaaggacactttaatttttctggtctttaatcccgaaaagtgaaacgcaggactgtttattttttacacttgactttggtggccctgacctttagtagttgagatgaataatgttatctggttcgtagctgggagcttagctgtgattcttcttcgcttactttgtggttaccttgtatcgtgtattatctgaatgtgatctgggagcttaggtgcacaccagttcaattgcttcccattccatattggtgattatccacaagttgttggcttggacatttaattctgaggggtacagattgttgggtacacatcatttataacaaagattgacgtatgaactaatattttccttgtggcccgtttggttcctaggaaccgttccctgaaatgatttatacccggattgtttgcctaatttatataagctttgggtggattcctggacaaacgaacaatgccttattcagtttagcttctccttgttgaattagtaaaactacatgctagcttgaagttgcttatagtttatttactacatataaccataaaaatattaactgctccaaacgttaagctgtaagagcatagaatgagattctatactatagtaaggaaccaaatggtaataatgcagcgaacaatttagctaattaatatttggattttgtcagaactgcaggcccccctgagaggctctgataaatttatcagtctgatgttaccctgtagattgtgctgtgtaatataggtcatggtggaagtgatggtctccatggatatgtgcaatctcttgatcatgctgtcagtgatttggtaagagcaattggatatcttcacagctgtctgagactatctgtgtaaattcttattcaaaatgttctgatcaatgtagaaaatgtacctcaagaaagtgttagctgagaaccctggtcttccatgcttctgcttcggtcactcgactggtggaggtatcattctgaaggtaacgtcagtggtgcttacttctccaagtgtactgttacacatttcttttctgctgtatgttctaattgttttggttcttggcaggctgcacttgatccagaggtagaaactctccttagaggtattgtcttgacatcaccagctgtccgtgttcagcctacacacccaatcatagcggtatgccttgttcttccttaatctatatttaatctagtacagtacttgtatccttgaaaaaacgaagtaggtggcatgtggagtaatatttgtcatgttgtttatttaaacaatcctcgctcgtccaaattgaaactacatgtctccaaataggtttactatgaaaatgtatttcacaatcaatctaataattagttatttgatattagaatgttagtacttccccaaataaagtggtcaaagttaaaattgtttgactccaaataactagtagaatttctataccttgaagaaatgaagcagaaacacggttccttgtggtttcctaaacattgtgtcctaggttcagtaaaatttgggctataacatattgatccacatttttatgatttgatttgcctgagttttttttttttttgcgcttgctaccaattttgtggttattatagttatagagtgtgaagtctgcaggcaacatatgtcctcctcacccatctcaagaaaaaaaacatttctgcttccaactacaggtcatggcaccgatttttgccctcatcgcgccgaggtatcagttcacggcgtcccacaggaacggcccgccggtgtcgcgcgaccccgaggccctgcgggccaaatacacggacccgctcgtgttcacgggcgccatccgcgtgaggacgggctacgagatcctccgcctgacgtcgtacctgcagcagcacctgcaccggatcgcggtgccgctgctggtgctgcacggcgccgacgacctggtgaccgaccccaggggctcgcgggcgctgtacgagcgggcctcgtccgcggacaagtccctcaagctttacgacgggctgctgcacgacctcctgatcgagcccgagaaggacagggtgatggacgacatcgtcgcgtggctgagccccagggtctgacgccgccggcgcgttgcggtgctggccgtaggacgcgagcggcttttcgaccatctgcaggccaaggacgcctcgcctccggatggtgggtgatgacgcggtctggtctggtaggctgcggaccgagggagagcgggtgtgccttctcgcccccttggtgtgctgaactgctgatacgatacgaggagcaggacaggagtacggagaactactactacctacggctatgggcgatggctttactcgcgcctcccggtgtgtcccgagattttttttcggggacacgtacgaattatgtaacggagttcgtttcgccgtgccacacgcacgagcggtgtccgatacacctatagaaaacgactttccatattgcgagttgtgtgatgtattcacacaattctgaatcagagttgcaacttgcaacggattcttatcttctgctcttctcacagtacctcctagcaccgtaggcattggtttatagtgactaattttttagtccctc

SEQ ID NO: 2372 - DNA, 3226 bp, Zea mays
gatttatctctgttataagagccaatagcatcataaaagatatcaatacagtaaaaatgatcgtgtagttttttccttctcttcttaactgacaaaatattgatattggaccattcatatttggtatatcaataacaacttctataaaaaaactttgacttcttcaaccttcacttctcaaatcatttaaacgtattctcacatcaacaactaaagacatggactggacaatatttttgtccttcttttgcaacaaaagggacaaatcatttgtaatgcgaaagatttgcaacatcatactcatgattagcacaaagcaaaatgactccattttagcaaccaaacctatagcccttgatggattccgctgtccttgatttataattcccaaaacttctattattgactcccacattatttcaatacgaagcaaagtcttgtagtgggatccccatctgttgagtttgtgatccaaattctgaagaaggcggccaagttggcgagcgaagcggaggcccgtcgccgggaggcttgggcatgtctaatcctggtaaagagcattggaaagctgttcagtggattttcagatatctacgtggttcttctagtgcttgtttatgttttggtaaatctggagatggtctgattggctatgttgattcagattatggtggtgatttagacaggaggagatctctttcaggttatgtctttactattggagattgtgctgtgagttggaaagctcgtttacaggatactgttgctttgtctaccacagaagctgagtatatggcaattgcagaagttactaaggaagccttatggttgaaaggtatatattcagagctatgtggaattaagtcttgcattaccatctattgtgatagccagagtgccattcatctcaccaaagatcagatgattactgagaaatccaaacatattgatatccgttatcacttcattcgtgatatcattgaaaaagggttggtgaaggtatgcaagatcagtactgataataatccagctgatatgatgacgaagcatgtttctgttgctaagtttgagctatgctcaaacttagttggtattataaattagcccttagtggctgttggcgtcggcaagataatgatgcatttgtttaaggtggaggtcgccatcgtgatgctacaaggaatttgtctcaaggtggagtttgttgagtttgtgatccaaattctgaagaaggcgtccaagttggcgagcgaagcggaggcccgtcgccgggaggcttgggccggaggagatatttatctcaattgtaaaatctcatgcgatctgtaaccacccaaaaatagtgagaagttgccgaccggcgcccgtggttttttccccttcactttggaggggttttccacgttaaatccgtgtcttctctgtgattgatcctatttgtgtcgcattcatttctaacactttctagttagaggcaaaagaactgtgtatacataatcgattgcatacagcaggtgccaggtgacgatgacgttcattcatccatctgattaattgtcaggtgattgcttcataagcatgttatgttgcttcaaaggcaagattagtagcaggtcattgactgcatacgagcaatgcagtgaagggtgagcggaatcaggcactctactactgattaactaaaagctcattctcgagaagtagaaaaagaaacaccactgagatctgagttatatatattggcatccatgttctagttgaggtctcatgttctagttgaagcgtgtgacgcgcggtgggtggtctagggcgtggttcgatcgggtgcggcggatggttaacacgtcaaggttcgtttagtttgatccaggtgatagacatttggtccatgactctagtgatgaatagcgaggtgacactgctgctacattgtacagtagaaatctctaccgtttaaataatgagcatataatctaattaagatccattgacaatctctctgacagtgtgtgcttcgtggcgcgaattccgggcgtacagcagtagactactacatacatacatgggcacgcacaagatggtgatggtccaccgtttacgtcacctgcaagctttttgagaacctcaaagctagccacccacgccgtaccggcactgcttctccagtggaccaatgctagctgcttgctgcagactgcagcttgcaacctgtgcccatgccccatgctttggtgttgtgcctttctgctcctgctccagaaccccaggcccaggcaagcaatgttccactgtctgttttgatcttgctcccttcccaagcaagcaagcaaattttggtcccttttggggtccttcaaaacctgcccgccctgagatgctccctccctccgtcccctgaccacagtagcctgctggcctccctgtccctgacgcaagcgtggtcgtggtcctcgggccttggagcagaagagcaattttgtctttggaatctgcttcgttccgtatagagatggcaacagggaattccccgtcggattttggcttcccatccccgtccccgcgacgaaaaaacttccccgcggggatccccacgaacgtttgcgggggacatttcttccccatccccgttacccgcggggataaatccccatcggggatccccgtccccgcataaattataattagatcgtacttcatttgttattaatgtaaaatattttcacttatacacattgttagatgtaaaaatcattatgtgtacattaaaatgaacgtatttgtacaactagtgatctcttggcaagataattatttatttttttatcattaactattatatgaaaacatcgtcacatataagtttaacgggtccccgcggggaacggggatggggaatgcttccccatccccatccccgtttacccgtcgggggagaaaatttccccgtttacatccccgtgggggaagaaatttccccatccccgtcccctaatagaggaattccccgcggggaatcggggatcgggtccccattgccatctctagttccgtagccacactcacaagttagggtttagggttatgtgcgtaatccattgttttctttgccagtttcattggaattctcgaagcactctcctccgcggtaagagcaactccaatagttatgtaaattttagctctctaaatcacagatttaagaagttgctaaatgacttttggagta

SEQ ID NO: 2373 - DNA, 1855 bp, Zea mays
tgcagctgtgctcaatgatgatatggttggtttgacaccctactagtcttcttgatggtgtggctgcggctctggaaggagaggaacaggctattttcaaagtatgaatctgtatggtgatgataaaaatttccaattagcctttcataaaaaagaaaaagagctacagtaactaggatctattggagtttctgaatcaattgcaagtagactctggtagaattttttttttttttttgctagcatattttatttatttattttggttattttccactttcatacatgaggacattaggttattttccccatgaaatatctaaggagaactaaataaccagcattaataagtacacagtgtttacaagttctcaagcatgtgaatcactacaacacttactgaatccgcagctagccttatctacctatggagtcagatcttctaaaactttctataccacatggtgcagatagcagcaaatattgcaatgccactgaaaacacacagcgtgtcgaaccggcactcgctgcgtatcttctcttccttcagctcactctgtgccttgaggtacaaattgcaagactccagcacctcatcgtagttcctgctgcggtggcagctcagcgcctccttgaggaggaggaggctgcagcggccgttgagatggacgccgcccatgtcctggatctgcatgctcagttccgtcagcgcgagcgtcgaaggctccccagcctcctcgccgcccatgcctgtcacgcggaacttcatcagcaggatgcattccgccacctggcagggcaggacctccttcgccggaagcacagacccgaaccgcagaacgaagtcagcatcggtcggccagtgcctctgcccgctcagcgggtgccagctcgtcaggttcactgccctcttcatcttcttgttgacaacaatccagctcagctttacaccatcgttcaactccctccatagcttgccgtctttcctttcttgctccattgagggtaccggtgacaagccactgacagtggataggaatacatctccgttgttgttctcgttgttttcagccgagtgttgagacaggtcgatccggaacgggtagttgtagaaccatccattggcactgtctgagctgggaattccccatatgaccttcgagtagagcgcatggcctttgtaccatacatcgatcaaagacacgaaatccgaaggcaatgagttttcagaatcgtccatgccgccgtcgtcgtagtagtagtagtcagactcagcccattcttcggcaaagaagttagtttcattggcttgaaccacagggacgtccttgttcagtataagtgtgaaacaatccgcatagaacttcctgaacccaccagcagaggcaattaagctcctaacgtcatctcgtctcattgatggccacagagatgtgcaggcattttcccacagatcctcttcatttgatatggcacgaaaatcagcgcaggcacagcctgctcttgccagagctgcagcatcgagacgcttgagtatgtcgtaaaagaggtcagcactcagcgatgccatgatcacagccagctgcagttgcagctaaaagagatgacacccaatcaagctcaagaatcaagattcgtcaggcggatgaggtagagacgactgactggactgttcagtattcactccttgagcagcacaaggtggcgtcagggtttaaataaggataggtcccagctgtccttcctcgcatcgccatcgcctagtgagtaatgtcgccggatgcccggataagcgcaggccggaccatggcgtacgaggggtcgcggctcgcgggcgtatcagcgagccacgcga

SEQ ID NO: 2374 - DNA, 2372 bp, Zea mays
caacaagaataactcaagtgatccaaggttacgagaatcatacgttcaagtctaagtttgagtcatggccagtaagtaacacgtcagggagtgccagcacggaggaaggccgagggaaagttacagcactcttgaagcagaaaggtgttgatgtcaaaggaatctcaaaaactagtgtgccagtaaatgacgaagttcctcctttgctggatggcggtggaaagcttgaggtttggtgtattgatggcagtgccaagactgctcttccaaaggaagaacttggaaaattctacagcggagactgctatgttgttctctacacttatcattctgctgacaaaaaagaagagttctatctagcttattggattgggaaaaatagtgtacaggaagatcaagaggcggcttttcaaatagctaatacaacttttaattctttgaaaggaagacctgtccagggtcgtatttatcaaggaaaagagccaccacaatttgtggctattttccagccaatggttattcttaagggtggtactagctctggttataagaaatttgtagaagagaagggtctgaaagatgaaacgtattgttctgatggcactgctctcattcaaatttctggaacagcggttcataacaataaaacgcttcaagttgatgcggtcgcaacatccttgagttccacagattgttttgttttgcaagctaaaaactcgatgtttatatggaatgggaatgcaagttcttttgaacaacaacagtgggctgctaaagttgctgaatttctgaagaccggtgttgctgtcaagcattgcaaggagggcactgagagctctattttctggtcttctattggtggaaagcagagttatacaaatagaaatgctgcacctgatgttgttattagagagcctcatttgtataccttctctctgaggaatgggaagctggaggttactgaaattttcaatttttcacaagatgatctgttgaccgaagacatgatgatacttgatacacactgtgaggtttttgtttggatgggtcagtgtgtggagacaaaagaaaaacagaaagcatttgacattggccagaaatacgtacgacatgccgtggcctttgaaggtatttctcctgatgtgcctctctataaagtcaatgaagggaatgaaccttgcttcttcaggacatacttctcctgggatagcgcacgatccgtgattcatggaaactcttttgagaagaaactttcagttcttttcggaatgcgttcagagggtggcaataagggctcaggtgatggtgggccaactcaaagggcatcagccttggccgctctttcatctgcattgaatccatcgtcgcaaggaaaacagtcagatgagaagcccacaagctcagatgacagcgagcatactcaacgagcttcagcaatggctgccttgtcctctgcccttaatccatcgacaaaacctagcagcacacaggcacaatctcattcaggtcaagggtctcaaagagccgctgctgttgcagcactgtccaatgttttgactgcagagggatctcatagcccccgccacagtaggtcgtccccaacatcagatgcagacaagactgaattagttcctacttctccccatcaattagaaacagggactgcagaagatgtccgaacagagcctgatgtctcacaggaacaaacagctaaagaaaatggaggccagacaacctttagctatgaacgattgatatcaaagtccactgaccctgttagtgggataaacaacaagcgcagagagacatatttggtggacagtgaattcgagaccgtatttggcatgactaaggaggagttctacgagcagccaaggtggaagcaggagttgcagaaaaagaaagccgatcttttctgagacaaggctggcttcgaactaataaaagcccttacgtcgcacaggattgtccagcattctcatcatgctcgttccgctgatgatgatcgatcaccagcagctttatccgtgagttgtataggctactcttttatctgcacatggtttgggagcattatatatatatcccccttgcccgtccattattctgaggtcgttcttgatgttgacctttcacgtgttttctttttttattgtattataaaaaatcaaactggtgtaaatggcattactagtgagatttttgtaagtaatggtgcatgggcaccaaggtgtatgcaacatatttttgttgtaagacttcagcttctattgttctggtggtgttctattgaccactggtctaatcatctttactggcttaggtaatggccaactcaaaccatggaaataacctcgagagggggggccagg

SEQ ID NO: 2375 - DNA, 2057 bp, Zea mays
tatatatatatatatatatatatatacacgcgtgccctgcatcactaaaacagtgaagtttaaacagtgttacagctgagaagccgttcggcttctgcacggcacggccagccgaccgattctggcggccagtgctggagccgctgcgggccgccgcgcgttcaccagaagccggaccaaaagttaggtgtttggttgggcttccagcttctggcggccagaagcccaccaaaagcttaaccaaacgcggccataggcgatgcattggacgccgagcgcgtcaagcatttcggcgggcgggccgcgggggaaagcaccgccaccggcgcgtcacgcgtgcatgcatatgcatgcccggcccggggcgcgcgtccggccgggggtccagaatcagaactccgagcacgagcgtgccgccaccttgcccggcctgaatcatgcatgcatgcatgcatcgacggagtgggctagcgcctagctgcaagccgccgcgctgctgcctgctggtgctcggactcggagaacgcagtggcggcgcgtgcacgcaccggcgggccggccgcgtcgagtcgttgctgtgtctcctgtcctgggaggaaccacgggagggtgtgcaggacatgcagtggtggatgagtgcagtgcagtgcagatcggtcgagcttttcggcgcacagcacactgaggtgcgacgctctgatgcgcgttcgttcgttgacaccgttccacgagagaggagacacctggcctttgtgacagtcctgcacattcgagtgctggcggaaaaaaagtgtgtttggtctcgacacatggaagtgccatccattttctaattaacgtgtccggcggagggagggcccctcgtgtcgctcgctcgcttgctcgttcgctgcatccgattcgctgacgtgcgtggttcgccgctgcccgtgcatcggtcatgagcgccgttccaacagccgcccttatcctgttaatccatccatcagtcccaaccacaggccgcgcgcgcgcgccgcgcccccggcatggccatggccacccgtccaaggccgccccgcccgcgcaccaagtttcctcgtggtccgagcgcgttctcaaacggaaaacccgcactcccgtgtctcgtcgtcccgtgcgtgccgctgacttctcggcttggccgggcgggacacgcccacggcatcgcgatggctgcgcgcggccactgcacgcgcacacggcggcgtcccgcccggcggtttccccaggcccagggcatccacgaggagaggacaagcgcgcggcgcggtcgagctgttgaaacgccggccgaggttgattttctcgtgcgatggacacgacacggtgttgacgacgacacggtgttgacgtggccggcgccgttgacgcgttgcggttgcgcggaggaaagagatcgcgcgctagctagctctgaaaagtcactagcgttcaggagcaccaggcaggtcttgttcttttacacacacaatccaactctggattaacacggtttgaaactaaatttatgtcacaatatatattccaaaataaactaaggctactctaacttttttattcggttaaatctattatggattataacccaatggtttggaaaaaaaattaaactatgcaaaacataaattaaatgatggatttaatctcattatgggattgagtgtgaggtatggattcattcaatttagatccggattaaatccgtgataagattttattccatgtaaccgaacaaaaccttatatagacgaccagcgggacgagactgtcaaggtgtaaaaccggtccagcgttatgtggttaggacatgtacaatggttgtcttaaattgtgtcttcaagtgtgtttaaggtggtaaatgtaaaaaaaactcaagacatgtatcttgacgaaggcactatattttggctctatactcgaggcagaggactagcttaatagtcaatttaatttattgaagtttatgattggtgcagttattgtagtaagacacggggtttagacacatctactttattatatcgtattttagcttg

SEQ ID NO: 2376 - DNA, 946 bp, Zea mays
gacagcccacgcgtccgctcttgataatattaatgtggtgcctttaacaacagagtcagaagtaggccacaatgagcattcaaatgaagcacctacaaaaacttttgcagaagagacagccaaactacctaatacttttaagacaccagaggccaacaatgaaagcacacatagaaatatggaagtgcttgtagacaagcctgaggagaaagttgttgtcaatgcgtctaatcttggtaattttgttgggaagcctgtgttccaagcagagcgcatatacaatcagactcctgtcggagtggtcatgggtttagcttggaatgctatgggtggttcgaccttgtacattgagacagcaaaagtagaggaaagcaaaggcaagggaacactttttgtgacaggccagcttggcgatgtcatgaaagagagcgcccaaatcgcacatacagtttgtagagctgtattactagagaaagaaccaaataatcccttttttgcaaagtcaaagctgcatttgcatgttcctgctggagccacaccaaaggatgggccaagcgctgggtgcaccatggtaacatcgatgttgtccttagccatagggaaatctgtgaagaaagacttggcaatgactggtgaagtaactctaacaggacgaattcttccaatcggtggggtgaaggagaaaaccatcgctgcaaggagaagcggggtaaagacgatcatattcccatcagcaaaccgaagggattttgatgagcttgcttctaatgtaaaagaaggtcttgaagttcactttgttgacaaatacagcgaaatatatgatttagtttttacaagtgacaccaagacgcaggaaagctagtgattaactgctcgaattcatttcccatttcaattgttggcaacaacatattcaaagcaatcgagtttcatcaaatatgatgat

SEQ ID NO: 2377 - DNA, 1486 bp, Zea mays
  misc_feature (1453)..(1454): n is a, c, g, or t
  misc_feature (1486)..(1486): n is a, c, g, or t
acccgcactggccccaccgggcggcagacgcctggccgggctgcggccaagtggccacctcctcgcgtccggcctggcgtccccatggcccatgcacgcccggcctcgccttcccttccccgatatctcttcgtctcgccgccgccgcgcgcgcactctcgtgtgacgtgtcccagcagtccgtccagtccctggcttctctcccccttgttgctcttggctccgcgatggcggtgggttgcttcaaccacgtgctctcgccgcttgttccttcgccgccgggtaggcgcgtccgagcggcgctgcggtgccggtggcatcgtcacccgctgaccgcggtctccctccggcggctcccgtgcggcgcggcagctggtcgtggcacgcggcggctcgcggcggcggcagagtcgcaggccgtgcaggagcagccggcgcgggccgaagaggccggcggggcgggtgccgctgaggcgtcctccaagctggttctggtcgttggcggaaccggcggcgtcgggcagttggttgtagcatcattgctgagcaggaacatcaagtcaaggttgctcctaagagatccagaaaaggcgtcgtccctgtttggcaagcaggatgagagtgtactacaggtttacaaagcggacacaagaaaccctaatgatttggatccacagatgtttgagggagttacgcatgtgatatgttgtactggaactacagcatttccgtctaagcgctgggatggagataacactccagaacgtgtagattgggatggcatcagaaatcttgtcagtgccttgccacagacagtcaagagactggttcttgtgtcatccattggtgttacaaaatacaatgagataccatggagcatcatgaatctctttggtgtgcttaagtacaagaagatgggagaagactttgtctgcaattcagggataccattcacgattattagggctggaagattgacagacgggccctacacttcgtatgatcttaatacacttcttaaagctacagctggagagcgacgagcagtagtcataggcaaaggtgacaagcttgtgggggaagttagcagacttgtggtagcagaagcttgtatccaagctttagatattgaatccactgaaggacaaatatatgagattaactcagttaagggtgaagggcccggaactgacccagagaaatgggaggagctattcagatctgctcggtcagactagtggcattctgcaaagcgtagtaacgtaatgtaggaatatgcatcgtaatacaatgtaatccatagagtgcagccctaattcaatagtcactgaacagtagcgatcatgtagagaatgtttggtttgtgtacatagtatgagcattcagatatgacgattatacctcctaaaagtgatagtttttgttggaaagtaaaatgttcagtgttatcctnnaaaagaaaaaaaaaaaaaaaaagcggccctcn

SEQ ID NO: 2378 - DNA, 2527 bp, Zea mays
ctcgacaaaaaagttgttgccgattcacacttcgccggtacttctttgccgagagtcacactcggcaaagagttcgccgattattttccaggctttgccgagtgtctgaagcactccgcaaactagttgtgtccgatatatactaattttataaaaattacaataatttattgtctatatggaaagacgagatggatataataaatatgaagatgataaattatttgaggggacaaacattcaagagcatttgatacatgaggttcattgttaaccgttaaaattaacgtctgaaaaatagaaaaaaagtcgtttgcatgtccagcgatatatgtatgggcatactaaaaattgcagtctcactctagtatcattgcgtcctttttctaaggccgaggcctccacgcctcgcgtaccgttttacccgccattttcctctcctctcctctcctctccctccatctaaggagaggagagatatgcagctcacgagctccaccaaatcctgacctcccaaagctgtggtcgcgatccaaacagaagggaaatgatcaggcgacaacccggcatggatcggttcctgcagctgctggccgccggcgtggccgtgctactgctagtggcaccgccggccatggctgacgacgacattgtagaagtcggcgtcaactggggttcgcagctctcgcacccgcttctccccggctccgtggtgaagatgctcaaggcgaaccgcatcgccagggtcaagatgttcgacgccgactcctggcccgtcggagcgctcgtcgactccggcattgaggtcatgctcggcatccccaacgacatgctcgagaccatgagcagcagctacggcaacgcccaggattgggtcaaggagaacgtcaccgcctacggtgacaagcttaagctcaagtacgtaacgtgtacattaattagttttcaaaaaaattaattaatgacgaacgaaatgttgtctgcttgatgagaataataggtatgtggcagtggggaacgagccatttctcaaggcatacaacgggtcattcatgaagaccaccttcccggcgctcaagaacatccagaaggcccttgacgaggccggcgtcggcaacaccgtgaaggcagtcgtcccgctcaacgccgacgtctacgtctccccggacgacaagccatcttccggcgcgttccggcctgacatcaacggcctcatgaccgacatggtcaagttcctgcacgaccacggcgcgcccttcgtcgtcaacatctaccccttcctcagcctgtaccagagcgacaacttccccttcgagttcgccttcttcgacggcggcaagaacatccaggacaagggcggcgtcacctactccaatgtgttcgacgccaactacgacacgctcgtgcacgcgctgaagaaggccggcgtgcccgacctcaaggtcatcgtcggcgaggccggctggcctaccgatggcaacaagtacgccaacttcaagctggcgcggcggttctacgacgggctcctcaggaagctggccaagaacgaaggcaccccggtccggaagggcaagatggaggtctacctgttcggcctattcgacgaggacatgaagagcatcgcgccggggaacttcgagcggcactggggcatcttcacctacgacggcaagcccaagttccccatcgacctgacggggcagggccacgaaaagctcctctccccagttaccgacgttaagtacctcccgaaccagtggtgcgtgttcgacgacggggccgaggacaagtccaagctgcctagcaacgtccagtatgcatgtgcgagcggcgactgcacggcactcggctatggctgctcctgcaatgggctggacgagaagagcaacatctcctacgcgttcaacatgtacttccagatgcaggaccaggatgtgcgcgcctgcgacttcgaagggcttgccaagatcacagacaagaacgcctccacgcgcggctgcctgttcccggtccagataatcagtgccagtgctcgggtggcgccagctctattgctggcggcgctattggcattgcttgtgattgtgttcgtgtagagtggggatttcgtcacttcgtgtagaactgtgttcgcgtgaccaaaaaaataatatgaattccttgctggcataaaaaaaaaaaaaaaaagagcaacccacagattgcgaaactacaacaagtgctaaatatatcatatttatgtgataacaaacaaagcttattacgagcaaactagcaaacaaccatcaaaactcttgctacgaggcatccctggattgctctaagttggcaaacaaacataggatgtcaatgttaggtctataagatcccagcccatgaccctagccactagaattgatgaaactaagtgtataccttcgagatgggaagtcaccatgaaaattgggaatccggcgaatggcatcggagacagcgtctatatagggcctgtttgtttcagcttatagattatataatctggattata

SEQ ID NO: 2379 - DNA, 787 bp, Zea mays
  misc_feature (777)..(777): n is a, c, g, or t
ccggccgggactctagtatcattgcgtcctttttctaaggccgaggcctccacgtctctggaaccggctcgcccgccattttcctctcctctcctctcctctccctccatctaaggagaggagagatatgcagctcacgagctccaccaaatcctgacctcccaaagctgtggtcgcgatccaaacagaagggaaatgatcaggcgacaacccggcatggatcggttcctgcagctgctggccgccggcgtggccgtgctactgctagtggcaccgccggccttggctgacgacgacattgtagaagtcggcgtcaactggggttcgcagctctcgcacccgcttctccccggctccgtggtgaagatgctcaaggcgaaccgcatcgccagggtcaagatgttcgacgccgactcctggcccgtcggcgcgctcgtcgactccggcattgaggtcatgctcggcatccccaacgacatgctggagaccatgagcagcagctacggcaacgcccaggattgggtcaaggagaacgtcaccgcctacggtgacaagcttaagctcaagtatgtggcagtggggaacgagccatttctcaaggcatacaacgggtcattcatgaagaccaccttcccggcgctcaagaacatccagaaggcccttgacgaggccggcgtcggcgacaccgtgaaggcagtcgtcccgctcaacgccgacgtctacgtctccccggacgacaagccatcttcccgcgcgttccggcctgacatcaacggnctcatgaccg

SEQ ID NO: 2380 - DNA, 3375 bp, Zea mays
  misc_feature (2434)..(2434): n is a, c, g, or t
  misc_feature (2508)..(2508): n is a, c, g, or t
attattgattctatatatatatgtatatataaggaaggtctagatccgtttcaatccgtatcccgaggtaaatccacgattttagctaacaaatcctgaaataaacccaaaactctaactgattctgcacgcgcggaccatccgcaccaccagaggcgggcgcagagggtattcatgggtatccattgaatacccaaaatttttataatctatagtaatttgccaataatgtattacacaaaatagcattagaatactaatttctttaagcttttgaatttttgaatacccaatatcaaatgtctgggcccgcttctgcgcaccacgagtgcatactgtccggacagcggacattttggtgcccgtagagtataccttataaagttgtttaggattacccttaactgttgagataagattaattccttattattgtacatgtgtctttaatatttaaatgatttaaaaaattagtttaggctaaactcattaaatccaacaaagaaacaagcagcactctggcggccggctcgccggcagacgacggagtatctgagggagaaaattgggcggcacgtcatgcaacgaatgatgcgctgccaaccaacactgcttcgccaagtgccaaactcgcttcccaaacttttaatccccttgtgttcgcccactcgtcaggttgaggttgtttttttcccacgaaagcgaatgcgagcgccgagcgtcgtccagtcgcgctgcatgcgtgcgagcacgtcgggtagggtcgtgtccttgcattgtcgttgtctataaaagcgggcgcgcctcggccccgccgcgtggcctccgacccttcgagccccacccgacgcgacgattcctctcctccgcccgttcccaccgatctcacgctctctctcttcctccgtcgcgtcggcgtcgccatcgccggccatgggttgcggtggctccaaggaggccgtggccaccggcaacaccagcgccggcagcaaggtcctccggaggaagtcctcctccgtctccaccggcgcaagccacacctccaccacgtcgccgtcgtcctccggcgtcgtcgtcaaggacgtcgtgaaggatgcggcggcggccggcgaggtgatgacgcccgccgacgccgagaagcctatctctgtcgaccccaaggcagacgccatcgtggtgatggacgccaagaaagaggagggcaacaacaaggtggccgtggaggaggatctgcttcctgaatccaccatggccgacgaggcgcttgctgtggaggaggggcccaaggttgacgaaccactcaaaatcaaagacggggaggagaagacggttgagagccaacacatcgaagaggagcatccgatgaatgaggatggtgagctcgctagtataccattccaatttctaatctaattacagagtgaaactgaccccctccgcccctcgatcgtgtgtgttcgttacgtatgcggttaatgctgcaggggattcagccacggaacccctggaagcgagaccggcggtcgacgagcacaaggcgaaggaggcgacgaccgtcgtcccagcaccgtcggcggaggaggagaagaccaccaccgacgaacaggccgctgccaactaactgattacaaggaggccaagagctagacgacgtgcatccaccacgatgcattttgttcaactgaattcgggcgccgggcgggctgtctctttttgtgtatcctcatgcatgggtgctttcgctgtacgtgggccgggctggagtcactcaatataatgtgttcgatccatcgacccattcgcgaacccgtctatgtgcaatgcatctgcgttgtggactactttacattcttatttcccagtgtgcacatttgcaccgcattccctcacgcctcagggcggagaggattcgaggtgatttaccatcttctataggaagaattcgcgcgtggaggcccacagactgttcttgggtcggcccatagactgttcacaggccagccaaatccaccgtgttctggcatagcggccactccttcctttccttctttgttgttaaatttatttatttactctctcggtgtcaacggacggagacaaaaataaattaattcgtccctcaatcctctccaatcctctcatgattcctggtcaccaaattagtccttatacttcaatcgacatgtgttgtgatggattagaatgtaaattagtttaagttacatcacaatctacctcaatacatataggttgggattaatactagattacccaaactagaccatagaaggtgttaaattaaaccgctacattttataagacccttttaaattataatatgcatgttttaaattttagagtgataggcggctctgtgttactatatttgatcacaacgtaaagaattatgcacatgaataagtaaatattacantataaaacggtcattatgctatctttagcagatctcttattccatcttctatcttatcttatatttcaaacttnactctgcaaacagttccacatcctctattttacaatgtctgttagagacaatcttatcacctcatttcaaatacaatttttctatatcatgcacaggtgatagaggtctctcctacacctgaacttaagcatattattgttgatattgattttttgcaaaatggtgatgcagggatgtacgaagacaaagtgaagcacgcatctgaaaaaaggaagacaagtaaaaaggttattgatgcaatgaagggtatgcagctggaaatacgtaacgaagcaagccatgcaaaccggagtaaaaacaacgtgagaatagaagtcagttaggattttgtctttaggataaagtctcgggataagcttgagataggatataaaagcattattgtatgctgttgctgaaggggtagagagagaaaaaaaagaaacatgttgttatagtgtctagacctattatctactatctatttcccttttctatttctctttggtgttttgttgagtaaaacatccaagtttctctgcgaaagtgggaattctttgattgttttcacgaagaaaaaaaacagtcattggcggtcgcggcaaacacagcaaaagcaccatcacttttgttgttttctgcgagcagattgagggaaacagattttggcgactccgctggggagcgatttgtaatcgtttcacggcggcaaactgctggtgattggcgtcctcatcgccaatcatagtcggggctatggaggacaagacagcgaagaaagcggcgccagacaaatctgaagttcatcccttgaacgtgatcaaagtcacgatggaagatcttacagaggcagacaggaaggagatgaagaagaaatcgcacgagag

SEQ ID NO: 2381 - DNA, 1006 bp, Zea mays
ccggccgggatatatgcgcgcctgccgccccggccggccggggcctccgacccttcgagccccacccgacgcgacgattcctctcctccgcccgttcccaccgatctcacgctctctctcttcctccgtcgcgtcggcgtcgccatcgccggccatgggttgcggtggctccaaggaggccgtggccaccggcaacaccagcgccggcagcaaggtcctccggaggaagtcctcctccgtctccaccggcgcaagccacacctccaccacgtcgccgtcgtcctccggcgtcgtcgtcaaggacgtcgtgaaggatgcggcggcggccggcgaggtgatgacgcccgccgacgccgagaagcctatctctgtcgaccccaaggcagacgccatcgtggtgatggacgccaagaaagaggagggcaacaacaaggtggccgtggaggaggatctgcttcctgaatccaccatggccgacgaggcgcttgctgtggatgaggggcccaaggttgacgaaccactcaaaatcaaagacggggaggagaagacggttgagagccaacacatcgaagaggagcatccgatgaatgaggatggggattcagccacggaacccctggaagcgagaccggcggtcgacgagcacaaggcgaaggaggcgacgaccgtcgtcccagcaccgtcggcggaggaggagaagaccaccaccgacgaacaggccgctgccaactaactgattacaaggaggccaagagctagacgacgtgcatccaccacgatgcattttgttcaactgaattcgggcgccgggcgggctgtctctttttgtgtatcctcatgcatgggtgctttcgctgtacgtgggccgggctggagtcactcaatataatgtgttcgatccatcgacccattcgcgaacccgtctatgtgcaatgcatctgcgttgtggactactttacattcttaaaaaaaaaaaaaaaaaaaaaaaaaaaaaaaaaaaaaaaag

SEQ ID NO: 2382 - DNA, 3761 bp, Zea mays
aattcggcacgaggatccagagaaaaaaaaaagagagacaaaaaccgccggcgagcatgcggcacgcgacccggctcggcggttcgtgtcgctgcggatgagagctcgctccctggactttacttaactctactctgagtctcggatgctccagagtccagacttccgggattagaaatccacgcacatcgccgtgcacgcacgcgacgccggagatgtccgtggccgtggggaagcgggtgctcgatacgggctggctcgccgcgcgctccaccgaggtcgcgctcaccggcgtccagctcaccaccacgcacccgccggcagctgaccccgccccagccgcgccctggatgagcgccgccgtccccggcaccgtgctggggacgctgctcaagaacaagctgatccccgaccccttctacgggctgaacaaccaggccatcatcgacatcgccgacgccgggagggagtactacaccttttggttcttcaccacgttccagtgtgccctgtcaggaaatcagcatgcgactttaaacttccggggaataaactactcagctgaaatgtatttaaatgggcacaaggaggtactaccaaaaggaatgttccgaaggcacaacattgatattactgatatcctccatcctgatggtaacaatctgcttgctgtccttgttcatcctcctgatcaccctggcaaaattcctcctcaggggggccagggtggtgatcatgagattggaaaagatgttgctacacaatacgttgaaggatgggattggatgtgcccaataagggatcgaaatactggtatctgggatgaggtgtcaatttccatatctgggcctgtgaatataacagacccccatctggtttcaacttttcatgatgattttaagaggtcatacctacattgtacacttcagttggagaacaaaagttcttggattgcagattgtaccttgaaaatacaggtttcaactgaacttgaagggaacatttgtttggtggaacaccttcaaagttatgcaataacagttcctcctcaatcagatatagagtacaccattccttctttattcttctataagcccaacctgtggtggccaaatggcatgggaaagcaatccttatacaacgttgagattagtgtggatgtaaaagggtttggagaatctgattcctggagccattattttggattccgcaagattgagagtacaattgatgattctacgggtgggaggatcttcaaggtaaatggtgaacctatttttatccgaggagggaactggatattgtcagatggccttcttagattaacaaagaagcgatatatgaccgacatcaagttccatgctgacatgaacttcaatatgcttagatgttggggtggtgggctagcagagaggcctgacttttatcatttttgcgatgtctatggtctgatggtatggcatgaattttggataactggagatgttgatggccgaggaattcctgtatctaaccctaatggccctttggatcatgatctctttcttttgtgtgctagagataccgtgaaattactcaggaatcatgctagtctagctttatgggttggtggtaatgagcaagttccaccggttgacattaacaaagcactgaagaacgccctcgcgctccatccaatgtttgtaagttaccagacatcaaaaagtgaagtaatatatttatctgaagaatcaactgaccctagtaaataccttgatggtactcgggtgtatgtgcaaggatcaatgtgggatggttttgcgaatggtaaaggggacttcactgatggtccatatgagattcagtatccagagagttttttcaaggacagcttctacaaatatgggttcaaccctgaagttgggtctgtaggggttccagttgccgcaacaattagggccacaatgcctccagtaggatggagcattccgattttaaagaaaagaattgatgggtacatcgaagaagtaccaaatccaatatgggactaccacaagtatattccatactcaaaaccagggaaggtccatgatcagattgaactatatggagccccaaaagacctggatgatttttgtgaaaaggcacagctggtgaactatgttcagtacagagcacttttggaaggatggacttccttcatgtggacaaagtttacaggtgtcctaatttggaaaacgcagaatccttggactggactaaggggccaattctatgatcacctccaagaccaaacggctgggttttatggttgccgttgtgctgctcaacctattcatgtccaactgaatttggccacctattttgtggaggtggtaaacactacagctgatgaactcaaagacatggctgtcgagatttcagtgtgggatctagatggtgcatgcccctattacaaagttaccgagaaaatagttataccgccaaagaaagtgaagcaaattatcgagatgaaatacccaaagatgaaagatgccaagcctgtgtattttctgctcctcaagctcttcaggctgtcagacaatggaacaatctccagaaacttctactggttacaccttcctgggcaggactacaaatcgttggagcagtatcggcagaaaaagattccattaaaaattgattctgatgtttcagtctcaggcacgagtcacaaagtaagaatgacagtagagaacatctcaaagaagtccgtggcagacagcacacgttcattatcagcaatggatctaggtgatgcaagtggttcccacagcactcgcaaagaaactactcggaagggaaacgggagcgatggactgtggaggaaaatacgcagtggcctcggggtcgcaaggccaagcgacaaccgaagaacactggaggtcaacgggaccgattcaggggttgccttcttcctccatttctcagtgcacacctccgaatcatccacggacggggaggaatacaatgacacaagaatcctcccggtccactactcggacaactacttttcgctgacgccgggggagaacatggccgtcgacatctcgttcgaggctccccaggggtccagtcccagagttgtcctcagaggctggaaccatcatctggaccacgccgtgatgatctgagatccgtgtaataaaataagcacgtaccgaataaagtgcagacatcagatcgtgttcgtgcctgctgttggattataattaggcttgtcctaattttattttattttattaaataaatcgtacgacctaaattgaattctaggttaaatggcttcaaggtactctatatccttcgtaattgttttagatgtcagtgttatttaaagcttatatatacatccttataaaagtataattattgtatttagagaagagaaagtaaaaaaagaaaatataaaaaacagattgcctcgtacggtcgtacctaaagatatacttgttttaagataacattttgaactctaagtatactagtatttattaaagatagtaatttcaactcaaattacacagcacccggcaccaatatctcagcgtcaaagccaccagcaggcccgctggcccgtacgagtgcagcaccagcaccggcgtccgggcccggaagtctggatgccaacggtcgtttctttcacccgccgtcgtgacctgccgaggcaccgagaagcacgtggcgccagcacccgccgacagcatggctgccgcgtgtgcgctacggcctacgagtggcag

SEQ ID NO: 2383 - DNA, 1700 bp, Zea mays
tctttgaagtggcttaatccggatcaatgcctggctgccattgttgagggtccaggaggtatttggtgtgatgttgacgttgctgagttctcgtactacggtgcaccagctcaaaatccaaaagtgcaaatgttcaccgagcttgttgataagttgtgtggcagtgatgaatgtattggctctggctctcaggttgcaagtcaggacacttttggaactttgggcgccattgtaaaacggcgaactggcaacaagcagataggtttcctcaccaaccgacatgttgctgttgacttggactacccaaaccagaagatgtatcacccattgccacccaaccttgggcctggtgtttatcttggagctgtcgaaagggcaacatctttcatcacagatgatgtttggtatggaatctatgctggaacaaacccagagacatttgtacgcgccgacggggcattcatcccatttgctcacgacttcgacatctccacagtcacaactacagttaggggtgttggtgacattggggatgttaaggttatagatctgcagagtccacttaatagcctcatagggaggcaagtatgcaaaatcggcagaagttctggtcacacaactggaactgtggtggcttatgcccttgagtacaatgacgagaaaggaataagcttcttcactgacctccttgttgtcggcgaaaaccgccaaacttttgatctagaaggtgatagtggaagccttattatcctgactggccaggataatgagaagccgtgtcccattgggataatatggggtggcacagcaaaccgtgggaggctaaagcttaggtgtgaccatggccctgaaaattggaccagtggagttgatcttggccgccttctggatcgtcttgaacttgaccttatcataaccaatgaatcactcaaagatgccgtgcagcagcaaaggctcgcgttggtggctgcagctaactctgctgttggggagtcgtcgacagcagctgttcctgccccagaagaaaaggtggagatcttcgagcctctggggatcaaaatcgagcagctgcctcggcacgacgtttcggcctcgacggaaggggatgaggcagctgtgatcaatgtggaagagcgccagttcatctcaaactttgtcggcatgtcccctgtacgcgacgaccaggatgctccgaggcaaatcgcgaacctgaacaatccgtcagaggaagaactcgccatgtcgctgcacctaggcgaccgggaggccaagcggcttcgcactgacacagaatccgaccttgacctggagaagtgacgcactcatttcagcgtattcgcattgaggagtcataaaagtagtccgaaagaagatgatggtcacctgtggttcagcaaactgaacctgcagcagtagctgcagcttcctggcacaagccttatcatgtactatggtgaaacttgattcagcaattgtaggatgttaggtggtatcccctgcagttttgctgtgctcatgagacttgatatgtacaatgctgaatcccaccctatcagaacaatgcaggtagtgataaagtggtcttgatcagttttctctgtccaaccattaaaggtggagttgtttcaagatcactagatcagcttccggaaaccttgtgtcttcaccttttgaattattcttacaagttttttactggt

SEQ ID NO: 2384 - DNA, 2679 bp, Zea mays
actccacaaaagcctaacccgtcgcgagatgagaggacaccggaaggccatgtgccggcatcttccccgccgcccgatccgggtcgtccgtttgtcgaggggacatggacgactatgcagcccgagctccagaccaacacacgggggccgacacatgacacgggcgcaacagtattgactgctgttcgtctcatccctgacgcagtgaccatgatcacctatgacctagccgagctccgtgcctccgtccctccatctcccttttgcattccgcccccagattcccgaatcctccggctcgccccctctccgagactccgactgcctcccctgaagctagctagcctcctagcccctggtctggtcctcccgctgtgcctgtgaggcgctgctctaccaaggaggccgctggctgctccgctgcgctgcagtgaggctgcaaaagctggcggcttcttctcactgggcgtcgccataaacagtggagattcccatccccattttcccaattatggatagccagcggcaaccgggggagcaccgctgaggccgctcgcccgccatcccgcccgccattgctcccgtcgagggtcacagattatcctacatattgtagctccgcaacctgttcagcaaaatgaggccttcagatgacagggcacagctttcaggctttgcacaatcagatgaatcgacacttgatgtggaggggcattgctgccatcagccgtcattcccttgttcgccgtcaatgcaaccgattgtttctgggtgcacacacacagagaacagcgcggcatacttcttatggccaacatcaaacctacagcactgtgcagccgaggggcgtgcaaactactttgccaacctttcaaagggacttctgccaaagattggccgtcggctgcccaagggccagcaagcaaacagcttgcttgacttgatgactataagggctttccatagcaaggtactgcgttgctttggccttggaacggcagtgggcttccgcatcaggaaaggggttctaaccgatatccctgcaattctttgcttcgttgctcgcaaagttcacaagaagtggcttgatccggcccattgccttcctgccattcttgcgggtccaggaggtatttggtgtgatgttgatgttgttgagttttcgtactacggtgctccagctcaaactccaaaagtgcaaatattcacagagctcgtggataagttgtgtggcagtgatgaatgtattggctccggctctcaggttgcaagtcaggacacttttggaactttgggcgccattgtaaaacggagaactggcaacaagctggtaggtttcgtcaccaaccgacatgttgctgttgacttggactacccaaaccagaagatgtatcacccattgccacccaaccttgggcctggtgtttatcttggagctgtcgaaagggcaacatcttttatcacggatgatgtttggtatggaatctatgctggaacaaacccagagacatttgtacgtgctgatggggcattcatcccatttgctcatgactttgacatctccacagtcacaactacagttaggggtgttggtgatattggggatgttaaggttatagatctgcagtgtccacttaatagattaatagggaggcgagtatgcaaaatcggcagaagttctggccacacgactggaactgtgatggcttatgcccttgagtacaacgacgagaaaggaataagctttttcactgacctccttgtcgtcggtgagaaccgccaaacatttgatctagaaggtgacagtggaagcctcattatcctgactggccaggacagcgagaagccgcgtcccatcgggataatatggggtggcacagcaaaccgtgggaggctaaagcttaggtgtgaccatggccctcaaaattggaccagtggagttgatcttggccgccttctggatcgtcttgaacttgatcttatcataaccagcgaatcactcaaagatgccgtgcagcagcaaaggcgcgcgttggcggctgcagctaattctgctgctggggagtcgtcgacagcagcagctcccgtcctagaagagaaagtggaggagatcttcgagcctctggggatcaagattgagcagctgcgtcggcacgacgtttcggcctctgaagcggaggaggcagctgggatcaatgtggaagagcgccagttcatctcaaactttgtgggcaggtcccctgtgcgtgatgaccagggtgctccaaggcaaattgcgaacctgaacaatccgtcagaggaagagctcgccatgttgctgcacctaggcgaccagtagcccaagcggcttcgcagacagaatccgacctcgacgggaaacggcgaagcgctcatttcagtgtctctacatcgaagagtcgcaagtagtccgaagaaggtcacctggagttcagcaaactgaacctgcatcagtagcttagaccagcagcttcctggcacaaacattataatgaactatgctgaaacttgattcagcacttacatgatttgggtggtattcccttcagttttgctgtgctcgtgaagactttaatatgtacaatgctgagtccctgtatcaaaacaatgcaggtagtgataaaatcgtattgatcaccttcaaaaaaaaaaccaaaaaag

SEQ ID NO: 2385 - DNA, 1053 bp, Zea mays
  misc_feature (1022)..(1022): n is a, c, g, or t
cctgcagcccagcttggcggtcgagcatacacgggcgcaacagtattttagctgctgcgccaccccgccccgggccgctgacccagtgaccatgatcacctagccgagctccgtccctccatctgcctctctctctttcttcccgcggcctgtgcccccagattgccgcggcctccggctccgcccctctcctccagcaccagcagtccatctccggctctcttcctccctctcgctaggcgctagctaggctctagcccctagtctggtcctgcccgctgtgcctgtgcggctgtgcgtgcacagcgaaggcgcacagctagcggcttctggccactgggcgtcgccataaacagtggagattcccgcccccattttcccaattatggatatccagcggcgaccgggggagcactgctgaggccgctcgctcgcccgcacgccattgctcccgccgagggtcacaacttatcctacacatcgtagctccgcgacctgttcggcaaaatgaggccttcagatggcaggacacagctttcaggctttgcacagtcagatgaatcaacacttgatgtggaggggcattgctaccaccagcagtcattcccttcctctccatcgatgcaaccgattgcttctggctgcacacacacagagaacagcgctgcgtacttcttatggccaacatcaaacctgcagcattgtgcagccgaggggcgcgcaaactacttcgccaacctttcaaagggactgttgcccaagtctggccggttgcccaagggccagcaagcaaatagcttgcttgacttgatgactataagagctttccatagcaaggtgttgcgttgctttagccttggaacggcggtgggcttccgcatcaggaaaggggctctgacagatatccccgcgattctttgctttgttgctcgcaaagttcacgagaagtggcttaatccggccctatgccttcctgccattgttgagggtccaggaggtatttggtgtgatgttgacgttgntgagttctcgtactacggtgcaccagctcaa

SEQ ID NO: 2386 - DNA, 806 bp, Zea mays
  misc_feature (161)..(161): n is a, c, g, or t
aagtagccaatgcaagcagcaggcgtccagtgtgttcatcagttcagctagaatcagcagaggcagtccatttggcccgagacgccctgtactgctccaaaagcttcccggcgtccggcaccacctcgttgacggcgccgagagccatgaaccgctccgcncccgccgccaggtcagggaaccttgccccgtccggaaggttggtgcccgccgtctggtccaccgctttgatccaaatcgggtggctcccgagcgtgacgtccacgagcccgacggcgtcgccgccgaagaacgccttccccctggagcactccgtgaacgcccgctccaacgtctccgccacgaggagggcgttctggagcgcctccgctctctgcccgtccgtcctcgacctgaacagcgcgctgaacgccgggaagaacttgtcgtcgacgtaggccgcccagaaccgtgccgtggcgcggtcgtaggggtcggacggaaggagcggagggccggtgccccgccagatctcgtcgacgtactggaggatcacgagcgactcgcacaccgggcggccgccgtggatgaggaccggcaccttcttgtgcaccgggttggaccggagcaggagctcgctcttgttgccgaggtcctcctctatgtactcgtagctcagccccctgagtcccagcgccactctcacccggaacacccaagggctcgacgacttgcccagcagccgcagctcgccatctcctaccccgcctccagccgctgccattgcaatgtgtgtgtgcagtgtgttgctgtctgcggtggcgttt

SEQ ID NO: 2387 - DNA, 507 bp, Zea mays
tcgccgccgaagacccccttccccctggagcactccgtgaacgcccgctccaacgtctccgccacgaggagggcgttctggagcgcctccgctctctgcccgtccgtcctcgaccttgtcgtcgacgtaggccgcccagaaccgtgccgtggcgcggtcgtaggggtcggacggaaggagcggagggccggtgccccgccagatctcgtcgacgtactggaggatcacgagcgactcgcacaccgggcggccgccgtggatgaggaccggcaccttcttgtgcaccgggttggaccggagcaggagctcgctcttgttgccgaggtcctcctctatgtactcgtagctcagccccctgagtcccagcgccactctcacccggaacacccaagggctcgacgacttgcccagcagccgcagctcgccatctcctaccccgcctccagccgctgccattgcaatgtgtgtgtgcagtgtgttgctgtctggcggtggcgttgatcagct

SEQ ID NO: 2388 - DNA, 3592 bp, Zea mays
tgcaggattagcttaggaactgacttgtaacgagtacagacctccccttatatagatgcacaatcgatctaattaaatctacttatcaaatttaccttatttgcattgttctttccgttccttatgattagaagagtcttagtctagtcctagtattagtttctctcgacctatatctgcgctgctatttcactctatgccgatcagaggtgtcttggacgacctgtcgaccttaagacaacccctggaactcttcttttcgacaggttctttacaataggcgatatccatgttcttcgtgtagaagaagatcctcgccatcatgggccgtccggaagcggatgagacatcgtggactgtccgacttagagtcatagaccatccatactgccatgaagagtatcatcagacaattccgcaccaacaaagaggatatttaaatataaatagaaaatatgaatgaaggatttggtaagaggagcggttggagacagcttacagtacgcggacgacacatgattctggtccgcgcagagagtaccttgaccagtctatcggctggctgacgatcgacttcgataaaagcgctgtggtgccgatgaacgcggtgcccgtttgcccgggctttctggatgagaatgagatcgacccgaccggacatgcttgctgaggtgcaagaaccgtggacctcctccacagccgccaggaccccataatccttctgtgcacaggcacagcgttgcattcaggttccataccccaagtgctgggcgcttgctttgcgagctgcagtctgcagggagacatcgaagctgcagcctgccgctgctccgcctacccaaacaaaaacaaagtgtctgccgctatataattagctttataattaaattatatttcatacttactaaccacattttagtcaagagaaccaaacacccctatattggagtcccatttagattccccctctgctgctatttgctctcgtcgaacccgactgtatcgatttctttgctggttggctttggtcatctcaccgtttcataggtcttagtgttagacaaaatcgcagatcacctgacaccaaatactgctccaagtacaaatcccccctaactaattgtcgggtaaagtagttgaacttgggactagtttgaaaacataaattccttccgagattcttggagattgagtaataaattgaataatttccactcaattttcaagaatcgtagaaggactaatgtttgcaaacttgcctttatgaatttatttcggttcgagaccgtaccactgaaggtgtccagcacaagtagccaatgcaagcagcaggcgtccagtgtgttcatcagttcagctagaatcagcagaggcagtccatttggcccgagacgccctgtactgctccaaaagcttcccggcgtccggcaccacctcgttgacggcgccgagagccatgaaccgctccgcccacgccgccaggtcagggaaccttgccccgtccggaaggttggtgcccgccgtctggtccaccgctctgatccaaatcgggtggctcccgagcgtgacgtccacgagcccgacggcgtcgccgccgaagaacgccttccccctggagcactccgtgaacgcccgctccaacgtctccgccacgaggagggcgttctggagcgcctccgctctctgctcgtccgtcctcgacctgaacagcgcgctgaacgccgggaagaactagagacaggaaaggggaacgggagaacggctgagtccgagagctcgagaacggattcatcccctcctgaatatcgtaccttgtcgtcgacgtaggccgcccagaaccgtgccgtggcgcggtcgtaggggtcggacggaaggagcggagggccggtgccccgccagatctcgtcgacgtactggaggatcacgagcgactcgcacaccgggcggccgccgtggatgaggaccggcaccttcttgtgcaccgggttggaccggagcaggagctcgctcttgttgccgaggtcctcctctatgtactcgtagctcagccccctgagtcccagcgccactctcacccggaacacccaagggctcgacgacttgcccagcagccgcagctcgccatctcctaccccgcctccagccgctgccattgcaatgtgtgtgtgcagtgtgttgctgtctggcggtggcgttgatcagctgggatgctttgtttgactattagtagcgagaaatttgccataacaccacattcgtggattcttcgtggattcgacggaatggagtccaaagtaatgaatttgacagtatgaaaaagcaaaccaggtgaaaggccgcactcttgaatagacatgtttttcctattaaccgatgacgaccaggattaatcttctgccgtgacaattagttaccttgttcacggcgttcgttctcatcgtctctctggctgatcgtgtccgagcgctctggccgagcgctagccaaaggcaatgatggggacggacgccgtgaataagacaactaatggtcacggaaggagattaatccggggacgaacgcggtgaataaggcaactaatagtcacggaaggagattaatcctggtcgtcgatgagtaataaagaaatcatgtccattccctacttttttatattgtcgaatccttttctttagccttcgtttcgttgaatttcattatggcaaatttctcgctaacagcagtgaggtgagtgggcaacttggaatttgcatctggtaatttgttcttgtaagttacggtgacttctcaacaaacaaatgcacgttctgtagaatcaacgagtactagaactttgggagcgctgcacgcgcgcggctgctgatgttccttgcacgtaagagaatgtctacttcctagtggctccagtgcttggcgcaaggcgaacgggaacgaccacacggcggcgtcagttctacgttgcatcgaagtgtgaacaactacatcaaacaacccaccgtgtcaactcattggaacggcgtcgtcggtgcctctgtcacttgttctcatgcaactcctgatgctttgtttttcatctgtatagtcagtatggcgtgggcaactgcaattagatcacactgacacctgccaaaaaaatcttctgcacgacaaattttggattcagatgtgtagttgcttagcagtagcagtatgtgtcgagttgagcgcaagacgccaaacaccttgattttagatggcagcttcacagagaatgaacacctgtgaactgtactcatggaagacattgaagaaacaacacctagtcaactaatccggctttaacataatcccccatctgcaccgcaaccgcatgcaagtccgcaagggatcgtcggtccgggcatttctttcaagttgtgtacgtatcacacggcccacgatatccacaggtagtgcagtttgatggaccgatgaattggctgaatgatgaatagcacccaccaccaccctctcaaaagaaaatgtggctgaatagcaacatctgtaaaaaggtagatttggtggatggcacttggcagtctctaaaaaaaaaaaaggaaaaaaaaaaaaaaaa

SEQ ID NO: 2389 - DNA, 1001 bp, Zea mays
ccagtggagacaggcataagcggctgcagtgcgccgcgaggttgtcagagggttatcgtgtaatggcgggcatggaacataatcaacagacgttcaagttagatgcagaggcgcaagatgactcttgcacatcatttgaggctcatcaggttggtgttgatggtgggacacatactgatattgctgatgacaatcattacaggagtcacggctttggtggtggtgcagaacatgggttcttcggtaatcagtgtgacacaaaagagtgggacttcggtctcagtatcggttgggaaaagcatgattttttgtcaacaaacaatgtcatagaagaggtgttcgggaagtgctgtgacactgctgaccaggaccttatctgagccagacgcggaggcttcttgtcagctgcgaaaactttagggttctctgaattgtacagcagtagttggctattttgatttaatgcctcacttgttcttacaggaatctcatctctgttcttggaacatcatctgcttgtgatttcgtcacatgattaatgtaaatccgtagatatcatctgtcgatctgttgatagcctgtggcatgtatgtatcatctttgttgtgacggtgtctcttgacctgagcgttttttctatgtgctagcgagggtcatgtaataaaagctgttgttgttccttgaccctgtctgcaaataaatgtaacctgccagtcaatgtattccgaaaggtcatttttatctgatctgaaatctgtagtcgtttccgcggctcgttcgtcgtttagtgtcattagtgtattctcgttatggtagccattccgcgggccatcagcccatcagtgacattagcgtattctcaatgcagatattagagcaattttaaatacacagtcaaccgttggttataaagatccttatagcatatgccatttaggtcatgtttggcatggctctggagcagaactccaaggaggagctgggcaggggcatacaaacac

SEQ ID NO: 2390 - DNA, 2288 bp, Zea mays
  misc_feature (356)..(356): n is a, c, g, or t
ctgcggcggccttcacgcacgagccttcgccgcctatacttgcgcttcgtcgagccggtgaattgtggtctaagaacaagagggaaggatctttctccagacttcgcaattttggacgacgaggtaaggaagtgtatattcgtgcatactcggtgtttgtttcttggtggcgactgcaattagctttagttttctcttagtgttagggtctgtttggataccaaggctaattgctagctagctaaaatttagctctagtacatccaacatgagagctaatagttgagatattttttagccaagtcttcaactagttattagctaacgacctagccaaccataactaattgagctantttttagccctaactagtatctcaaacaggcctttaaccttcatgcttgtgcggtgtggttttataaacatgtaaccacagcttggttccaatcttgtattactgtcatttcgaaatataagatgttggtaattaaattgattggaactatgtgtctcttttgctgcacccagattcataaccataatcatgtttaaacacgtgctgtatgaagagtcatctttcatttatcaagggcaactgattttggtctaccatatcgtcctcgcataagtaatttttaggatattgcttataattgtgatacctttgagatcccttttgttaacatagttttatgagcttaaaatcttagaagccatctagctttgaacatgattgattggccactcttcttagaaagttgtcttgaacaaaaaatgaactgcgtgggtattatatgagaatactttggttacatttgaggcttaaactagctcaaagcgcctccaagtaatttgatgccagggattaattcaccacatttgttatgcctgtacatggaagtttattgtagaaggctttcaatctatctgattagatttacatctctactattgtgctatataatttcacaagttcaaaaaactaacagtgtttttatctctcttctatgaggtcatgctcccccttgcatcatttcatgtccctacaggttttgtgttatctggtttgtcgggatggatgccaaaaagttcctgcagctggtcgaagagaagaaaaggaggatcctcgagaagaaagaagccccactaaagtggcagcagaagctagaagcagcagttaacgtcaaagctgatgcagaagcgaaggcgaaaaaactaaaatcaagaaagcataggaggagaggagattcttcctcggactctgacagtgactatgacagcgatgttgatcggaaacaccggaggaggaaggatcgtagaaggaacaagaagcatgagcattctgactctgatgatgccaggagacgcaagcgtaggtccagaaagggctcagactcaagtgatgagagcaaccgtgaatatgaaagcgggtctgaagaagaacgtacaaagaagaagcgttcgcacagaagaaagcatcacagacactcttcaatgtcagactctgaagacaacagtgatgaggatgagcggagatctgccaaggaccattctcagccccgcagacgccaccatcagtcttctgatgatggctcggacaaggtcaggttgagacatgggaagcgtctgagatcaagtgacgagaatgctcggccagattccaacagccataagcatctcaggagccaatccttggaggagtcatcagatgatagagatgatgatggaccagagaagataagaaatggcaaaaggtatcacaagaatcatcaccgtcaccaccaccatcatcgtcaccatcggcaccaccatgaaagacataataactcagcagaacctaatgacaggaggcaagtactgaaagatgaccagagggcccttgaaggtagcagtgcagactgaaggtatccaccagaggacggaaagattgattcttcattcgtgatgttcccagttatttgttgtgctgataacatttctttgatttgggctatgaaacgttagaagatactgtggccattctaccaattatgttggttttgagaatttgataatactgagttaacaatgaagcatgattatccaaaaaaaaaaaaaaaaaagcggcctaatactctatagtgcaacggaataatttatctggtaaaaacagaactcggattatctttcatttgattacaatgacatttcatgtattttcttcgtttttttctgtatttgaagcctcggtagataacttgcttttctgggattttacgtatctgctcgccctgccctcgcactggtc

SEQ ID NO: 2391 - DNA, 1333 bp, Zea mays
ccggccggggatgtatgtgcacctgctgtcttataaaattgtcggccttggcccaagccaaggaccctttcgcttctctcagtctacgactaggcggcggcggcggccttcacgcacgagccttcgccgcctatacttgcgcttcgtcgagccggtgaattgtggtctaagaacaagagggaaggatctttctccagacttcgcaattttggacgacgaggttttgtgttatctggtttgtcgggatggatgccaaaaagttcctgcagctggtcgaagagaagaaaaggaggatcctcgagaagaaagaagccccactaaagtggcagcagaagcttgaagcagcagttaacgtcaaagctgatgcagaagcgaaggcgaaaaaactaaaatcaagaaagcataggaggagaggagattcttcctcggactctgacagtgactatgacagcgatgttgatcggaaacaccggaggaggaaggatcgtagaaggaacaagaagcatgagcattctgactctgatgatgccaggagacgcaagcgtaggtccaaaaagggctcagactcaagtgatgagagcaaccgtgaatatgaaagcgggtctgaagaagacatacaaagaagaagcgtttgcacagaagaaggcatcacagacactcttcaatgtcagactctgaagacaacagtgatgaggatgagcggagatctgccaaggaccattctcagccccgcagacgccaccatcagtcttctgatgatggctcggacaagatcaggtcgagacatgggaagcgtctgagatcaagtgacgagaatgctcggccagattccaacaaccataagcatctcaggagccaatccttggaggagtcatcagatgatagagatgatgatggatcagagaagataagaaatggcaaaaggtatcacaagaatcatcaccgtcaccaccatcatcatcgtcaccatcagcaccaccatgaaagacataatagctcagcagaacctaatgacaggaggcaagtactgaaagatgaccagagggcccttgaaggtagcagtgcagactgaaggtatccaccagaggacggaaagattgattctccattcgtgatgttcccagttatttgttgtgctgataacatttctttgatttgggctatgaaacgtggtcattctaccaattatgttggttttgagaatttggtaatactgagttaacaatgaagcatgattatctgaaatgtttaagtattagatcaccaaaaaaaaaaaaaaaaacggaataatttatctggtaaaaacagaactcggattatctttcatttgatt

SEQ ID NO: 2392 - DNA, 1003 bp, Zea mays
  misc_feature (614)..(614): n is a, c, g, or t
ccttttcgcttctctcagtctacgactaggcggcggcggcggccttcacgcacgagccttcgccgcctatacttgcgcttcgtcgagccggtgaattgtggtctaagaacaagagggaaggatctttctccagacttcgcaattttggacgacgagatgcacttccttgcatcatttcatgtccctacaggttttgtgttatctggtttgtcgggatggatgccaaaaagttcctgcagctggtcgaagagaagaaaaggaggatcctcgagaagaaagaagccccactaaagtggcagcagaagcttgaagcagcagttaacgtcaaagctgatgcagaagcgaaggcgaaaaaactaaaatcaagaaagcataggaggagaggagattcttcctcggactctgacagtgactatgacagcgatgttgatcggaaacaccggaggaggaaggatcgtagaaggaacaagaagcatgagcattctgactctgatgatgccaggagacgcaagcataggtccagaaagggctcagactcaagtgatgagagcaaccgtgaatatgacagcgggtctgaagaagaacgtacaaagaagggggttgcgggcgggaanaaagcatcacagacactcttcaatgtcagactctgaagacaacagtgatgaggatgagcggagatctgccaaggaccattctcagccccgcagacgccaccatcagtcttctgatgatggctcggacaaggtcaggttgagacatgggaagcgtctgagatcaagtgacgagaatgctcggccagattccaacagccataagcatctcaggagccaatccttggaggagtcatcagatgatagagatgatgatggaccagagaagataagaaatggcaaaaggtatcacaagaatcatcaccgtcaccaccaccatcatcgtcaccatcggcaccaccatgaaagacataataactcagcagaacctaatgacaggaggcaagtactga

SEQ ID NO: 2393 - DNA, 4658 bp, Zea mays
ggttgaggaccggtagaacacatgtctaggacatgagagacacatatgtagattgtagtacgctacctatagagttttgatagttgagcctcaaaatcatccagtaatggttttgcacattttggcttcataactcagcaacgcggttccgaaggaaatcagaggcggcggcacatgaagccatatatagcggagggcgtgtcacggtaaaacaacttcgttaaaggagcatggtcgttacatctcatgataagatttggttcattttgcctttaactgaatggatgagctatatgtatctagaagtaagaagtatgttgggaatgtaaaacaccttctataaataaggaagaagagctgcaccaaggagagatccataggagtttttttaccttgacttctatattttgattttgtaaagtgtggccctaaccattgtggtttctctatggtaaattcctgtgcaaatctggttgctttggtttttggatttattttctcttctcaagctcttctatttgaatttttgttagatttgttgaagctgagttcgaagggaagtttgggttggtctccgagacaaaggagacactcctagaattattgccacctatgataaattcccgtgcaaatctggtttctttgggttttagatttgttttctcttcttgtgctcttctatttgaatttttgtgagatttcttgaatctaagttcgaagggaagtttgggttggttcaagacaaaggagacactcctacaattagtgccaccagtgggtataggctgactcatcttgagttcaagctttgaccagttgagtttgaaacactttagaaaaaaaaaccccaagtcgagtttgaaaactttcatccatttacaaaaggttgatctttttgagttgaaactttggaacagtcttaaactcctgcgcagggtaagcggcactacgagtaccgactagaaggacgacactgccgctctattttgaaagattttttatttgcctcttttcagacttccatttcccgatctgagtttcgcttgttttagtaacgtgatactcttccggccatcaattggttgatgtgttcttggtttcgaactttttgaagagatttttggtgtcataaaggtttgtgctgaacttttggtaatcaagccaaaattgtttatgagatcaattttattgaccctcgttgatcctctccctctgtctctaattgcctatttgatccttcggagctatcatattttttttcttgctgagagcatgtttatctcattaattgtaattagtgatcccatctgtataacatcatcccactaattattgccgagagcaggtttagccaacacacgcttctttgtcgaaatcgtagtatgaaatggatgagggatgcttgttttctgatcgttcacactcgatgaggatgcaatctactagtgcagtactatcttttaggtaggaatactataggaggcggttgctggctgctgctgaagagtcaagaactcaagatgacccctcgcgcagttcatgcatgggcagcgcgcgcagggctattctgaaaccatccacagatgtcgcaatcaaccaaagcagcagaatgtcatccatagtttccacttgccagcagcacaagggcagatgccgcagaagattctaaacacctcgcctttctctctctctctctctctctctctctctctacacatgcacacttagcttttccatctccttttctcctccaccgaaaatgattcgatttggcgatttttttctctctctctctcactctaaaaccgcccattttttcagctataaatggccccctcgtccatgcttcaattccctttccccctctccccgaactcccttgctaggttaccacgttcttctgcccttcaggccctccctcatctgatcatctctctcactctttcagtagcagcgcagttttgttactgacacacgccccctgtcctgcctgtctgtgttgacctgatagtactagcaaagtttggagactccatccaacctcttgtctctgaaacttggacttgttgccgatcccaaggggaggttctgccaaaatttcggcttctgaacatccatttccagaggggatcgagggaggttctgccaaattttgctcctttgatcataagtttcccagggggaggttctgccgaaatttcatctcctgtgctgtgacgaccatcagctttccagggggagagattctgccgaagttttgtgggctgaccatcagtcttccaagaggaggttctgccgaaattcccttctctcatcatcacttctccaaggccaagcagtcctcctggtcctgccgaagtgttctctgaacaagagggcatgcatgcactccttcttgtccctgatgttagactagctagctagcactagcagagactgaggccgcagcgtctgttgagaattcagatgttgttgttgctcgtcctgtccgagcacctcctcctgtccggatttatgatcggttccgccataacccgcctcgtccagtccttctctgtcgttttcctctactggttctatgtcttctcagtgagctgccactgccagtagtgccagtagttgatctcacctttttcaagttaataacaactcggcactataacaaagaggtagctaggtatatacctgccaaacaaacaagagggagtgaaaaaacttcagattacgcctcagtttgtgagctagaggtgaccatgtcaagtggaagctcgtttgggtcgagccagtggactcagagatccaggtcggcggaggatgacctggacctggacctccaggccgagatggagaagaggaggaaacgaaggaaggagtccaaccgagagtcggctcggaggtctaggctaaggaagcagcaacaccacgacgacctcacgtcacaggtataattatttatttttttcacggacattaattatattaccatagcagaaacaacaaggatcgatattgatgaattcgtatctgcgcgagatgtataattttgtgggcctaattaatatataaacacaggtagaccagctgaagggccagaacaagcagctcaacttggcgctgagcacgaccagccaaaacctcgtggcagtgcaagcgcagaactctgtcctgcagacccagaggatggagctggccagcaggctgggcgccctgaccgagatcctctggtgcatcagctcaagcaccggcactgctgctcctcctacaaacccagccatggtgaacggcggcgtcacgacgacatggagctggagcgacgcctctggtgatattcttggcgccagcgcatggaaccaccagcagcagcagcccatagacgcgtaccggtgctattattagctagctctacaagctagctagagagaaggcggtggtagggccaggaggaaaggaggcttgttgcttcgccatcgtttgttttggaggcgacggcgacgttttgttggtagagcggaggagcctaaaggacggacaatggcaactttgccttggctttctgtgacgtgaatgcagcgcagttgttctcttgtagttgaggagtatatatataggaaataataatattgggccagatagtgaaagagaggtaggtgatttgaaagctcttcatatatatgtataagggaaattatatgcgtaatgatgatgataaaatgctcattaagatgtcgatttgatggtaacaacttgatatccgttgtgcctctctataaaccctacgtacgggtgcactctcgattctgttttccatcttgtatgtttgatcgctgatgataatgttcacttattagatttggattttgattgctcttgagactctgaatacattcctgtctacgtttctgttgcatgataaatatctggaattgaattccattctaataatagtaatttagatatatatcaattaaactaattcgattttatgcaaaacatatcaatatcctattattagcaagatgtcgaagatatttatgtgctacatttttactatagagcagtgagtcaaagatcgtcttgttacatagtagaaaccaattctagtaatacataaaaccatttcccatcctccacccatgaatttgatataagcttatatcaggactttagaaagtggtgaaatgtcaaattccaagctaaataagttactttattaagtgaattctaattcctctaaaatgaagggatccaaacgttccgtaaagagattctcttcatttgctataggtttggatttagaagagattttaaactatttttttaaataaaaaacaaaataacctgagaaaagagcgctaggtaagtgctctatatgtgtccaaacggttgtattatatacgccacgaacatgcttagccagcctaggcatgggcggtatagatctgtttggtttcttatctaaggtatcataatctgtctaagtttagtcgctcaaattaaagaggtaagcttaggcagaaaagttagtcacattgtggcgttttagatagcaaaccaaacagcctgcctattgcgcaaatagtaaggcttagacacgacgtaccatttagacgtgccatgcgagcacttactcttagacatgccatgtcaacacttacccg

SEQ ID NO: 2394 - DNA, 805 bp, Zea mays
gtcgcgccagccatcagccgcgtcccttcgcacaactaccagttccattttgtgcgttcacatcttctctcctccctggcaactgcttccgtcatctccaccatccccacgttctcctccctccgcctctcgctctgcgcacatccccatgcccacgccgagcgcttgcgcctcaccgcccccgtcgcagccgcggccgtggcggcgtcgacgacctcccccgactttcccgccgtgggcgccgtcctggggaagcccacagtgctcgtgggtagtggtcgagaagatcggagccgcggggttcaagctgaaggaggtggtgcgatgtccatctcctaggtcgtcgtcctcacgctcctggagttctggtcagtgagatgttcatcttcgtgctcagcctcgtcctcgagttgtcgcgcaagcagcgagagcagcgtgggtctcatcatcaggatcacaccaacaggaaatgccaggcgatggtgcatgcatgatgaagctgctgtccattatattgacatgattgatcagaccacgcttggtcaccggatgatcaagaaacaattcaacaagactccaagagctggctggcaaatcgattgcttggaacagagcttggcttcgattctttgcattttgcaagaatcgattaccaagataagaaaaggcgtaaagctggcaaaggcttgaggttatatggcgtggctcaagaactttcggttcatcttcacaggtatttaccaatgtatttcgtgtcgattatagccctccagatggctttggctttgaagttttagatgaaaat

SEQ ID NO: 2395 - DNA, 5017 bp, Zea mays
gaaacagtgagcaaggccaccaggacaatactatcgcaaactccttactaacctacaaatcaaattgccatggacaccgagggagtactgtatgatgagatgatatgacggcaaaagtgcttgcgctcgttgttagctccagcggttcagccagcatcccattcctataacaggttggtcaaacgccacacccatgcattcatccgttttgacggagccaccgtgatgagggaggccgcgagcgcctccgccacccacgtacgcgcgcccggaggaaaaccaaacgccaaattgaagcagcaattatcaaaacgcctggctgtccgcattacattcccaatccactaaccgatcgatgcgctcgtcggggccggcgggcaaagccaccagtggtcagagatctagctatggcgccggcgcttctgctgctgcgacttctggcattgattgcgacggcaagggaggcctgcgcggcgagggcgttcgccgcggcgtccaacgcgacggcgcatggggcgacggtggtggccgggaagctgaacgtgcacctggtgccgcactcgcatgacgacgtcgggtggctcaagaccgtcgaccagtactatgtcggatctaacaacagcatccaggtatgcaacacacaccaacaccatatagctacccgtgccatcctgcgccgcatgctccggcacttgatctctcttatctcttctcgctctcacctcctggaggtgtgtgtgtggcagggcgcgtgcgtgatgaacaccctcgactccgtggtcgacgcgctcgccagggaccccgcccgcaagttcgtcgtcgtcgagcaggtacacagattaagcccaatgatgtgctcactttctgcgtctcttgctgtccattcgctagctctcatacgagttcccagatcgacgcgattgctgagtacagtactatcttgatcagaaccaaagcagccgtgtcgtcttcttagctagagtgaatacttgcacactataatatgctagtttggttatgggtacttacagagtacagtgatgaatctaggatttaaaattagggtgatccaatcttatgaatattaaaataaataaatgagtttgcattttaaatcctataacatgtgagaatcaaagaaaaaataaatcaaaatcatatagcatgatggacaagttttgcataaaaactgatgaagggactacatgaactagaattttgttggtaggatcactagagtactatttagtaggggaatggttgtcattttcatggataagaggatacaggtacaaacttatagtgatgtcattctcttgtcagcaactatgtcgtgttccatgcatgtctatttagcatcaaaatatatcaaacacgggtcatagaatttttcattctattggtagagcttatagcttaaattaatgttattaagtacaaaaggattcactcctctgaatcactatcatctcctggtaccagccaaaaatgacacttctttttttctgaaacactcaagagctgagtatctttgtattaaagaagaggaaaatgatctagacacaaaggacaaactcatgtcaagtaggccataaatccaggcacattaatataattaggatataagggaaaatatgccaaaatggaaataaagattaattaaaagaaactgggactatcgtggtcaaagggctctttaacctgatcaaaggccacatggaaccaaaactgcttgtgagtcatatgattagtgaaccaaaaacaatctcgcctggaatgtgcaccacgaattcagggcttcaaaatctccgaaaagtgacaaagtttaggccaaatatttcaggcatagaaaaggacttctctatgtttgttgctttctaagtcatgatattagccttgaagtcagaatttttcttagctttcaggcttttttccaaaggtggtgggcagagaaaatcccaaacattcaggcagtagtccgcaagctcgtggattcgggtcagctagagttcatgtatggaatttgattttccttattctattttgctttgtctcgatactgttttcctctacaaaattactggtgggtattatgattcagaaatggtggatggtgcatgcatgatgaagctgctgtccattatattgacatgattgatcagaccacgcttggtcaccggatgatcaagaaacaattcaacaagactccaagagctggctggcaaatcgatccttttggacattctgcagttcaagcttatttgcttggagcagaggtaactactattaacatcatatttgcgatgaagccattttgttcaccaaaaccagtatgataagctcctacatttttctaaacagaaaatacaattctcataattatcatttttcagtctggcattgcaggcacatggtatactaattaaagttactaaatgaatattatatttgtacggtggatgcaaatgttaagccttagtgattttcctgggtttaattctcaatacatttttttcttgacaatcaacatgcgactgtgcaaagcatatgaatataagatttttttatttcaaactgtagcttggcttcgattctttgcattttgcaagaatcgattaccaagataaggaaaagcgtaaagctggcaaaggcttagaggttatatggcgcggctcaagaactttcggttcatcttcacaggttcttatcctccttaccccacaattagttctgcctattccattcattagcacggtggttgcgaatgttcagcctttgaagggaatttgactcggtggtggttaaattgcagatatttacaaatgtatttcctgtcgtttatagccctccagatggctttggctttgaagttttaggtgaaaatatcttgcctgtccaggtacatgtacgcaaccatttccatgctcctcgaaccttacatgcatcttagattgaaatttgtaggatgacatgctgatgtttgactataatgttgaagaatgagttaatgatttttgttgctgcagccatagaacaggtaaactttcaatattgttgccacaggctgtagttcactagagcaattaattatgcttcgttcaaagtaagaaattggatttaattaacttgtgatgatcaggcaaactttacgcgtacaaaccacataatgtggaccatgggagatgattttagttatcagtatgcagaatcttggttccggaatatggacaaacttatctatcgcgtgaacaaggtattgctgattttaaactgaagctctcaagttttgatacacagttttcttgttcagctgtcattttaatttacctttctgcaatgatactactacgtacaaagtcttttttctgtgagatgctgcctaagcacattagtcatgtgcaatatgccacggttaattgatgtcgtggaaccgatgaattagaaaataatgcccggattgctgcaggatggccgagtgcatgcactgtattctaccccatccatttacacagatgcaaaacatttgtcaaatgtatcttggccagtaaaatatgatgagtatttcccgtgagtccttgaactgatttaatttgagcagcatgaaaaattctatgctaaaaaaacataatgaccttgtttacctacaaattgcagctatgctgattcaaaaaattcatattggactgggtactatacaagccgtccaactttcaagcgatatgttcgagtgttgagtggttattacctggtatgatattccctctacagctacatgactcatgatgattttctactcattatgttatatatgaagaatccttgggaacctgtatttgtttgcaggctgcacgtcaaatagaatttttagtaggtaggaggagttccttagggttgttcacgaccagcttggaagacccaatggcaattgcccagcatcatgatgcagtctcagggtcaacaaacaacacacgacagatgactacttgaaacaccttgctcttggagcatctaagatattgaaatttgtaatgtcttggtataaaagttttgttggttgccaattgatggtcttcatctaatttctagatgtgtgtatggttgattcattcgtttcttttatgcatttcttcttgcagaatgaaagcattaatggtataatgttggatatttcattcagagaggctcaagtgatagctgcaagtagttctaccttgtgcccagttttcttgttctttaggtgagttgatcttaatttaaaggtagttgccttctttcattcaattccatgttcttgaccttgaattattgagtccaaaattatggtcttgcaggtcaatgaaagttcccatttttggggcgttgcttagatggttggtcctgttgactaccaaaatgacttgaacttttggtgcatggacaaatggactagaagctttcctgtaacgtggcacatcatacgatgctggctgatccccctgttcccagatttctttgtactttaaccaaaggagaaccaagttggctgtcgtctcccactgtggcactattttttgggttaaaagtataacaccatcgtgagttgaaactcttgagacatagagataaaaaccaataaaactcacatccgacgtgattagcatgaccattactcatcaaaaatagttgaaataaattcttcactccaatctaatccaaataccagatcttcataagaagagcatgccaatgacattgttttggcaatcagttcatggttacacgacactactatgacagacttattttgaaacatagaacaatgcttattcaacattattatacaatcaagatcctaactttttgggggggttgcaacaatggagagtggagacaacatggagacctgagctgagcttaacccgcaaaagatcatacaccattctgtgatgcttcacaaggttccgcacctcaaattttggtgaaactgccttgttgttgtcttcatatctagcgcactggcatcccatgtagactgcag

SEQ ID NO: 2396 - DNA, 2383 bp, Zea mays
  misc_feature (2378)..(2378): n is a, c, g, or t
cattgggtccctcgaggccggccggcgttccccgcggcctgcgcgcgcgttctctccctcacctccgcccctctctctctctctcgctctcgctccgggcgacggctgggcgaccgccgctttatccgtgcggcccttccttttgttctcccgtccccccaaccccccttcgagctctatctgtctcttcctctcgaggcgacgcctgggctaccgcgccgctactgcggcctcccgcgacaggtgcctagtctccatcaggtgccatgtcttcttcgggctcttcaccggcgacgtgcactgccagctctgcatgtatacacccaagtcctttactgggtccgccgccgcccctatgtacttcgttaggtttagtatgttgttaagtttgtaattctagggtctggagggaagcatagatctcaagaggggtgaaatttggtggtaatttcctgagaatttcaaggagacaagggcgtggaggttgtttctggagggatctgtgagcacagcagcagaaatttgaggttggtggtagcctgttgatccacgatggtgggtaaggagctggtggtgcaaaggaatggccctgttgacatacgtgagattgctgcaaaggccacgcttcgggaggtgcggcagagcgggcacacctacgtcgaactacggcgtgtcgggaagcgtgtcatcttcttctgcaccatctgcctcaccgagtgcttcagcgacaatgtgctgtttgaccacctcaagggaaacctgcattcacggcggtatgctgaggccaaggttacgctgtttgggcccatgccatggccgtttaatgatggtgtgctcttcttcaacaactcacgcgagaaggatccgctcctgctggactcaagctcacagagcaccagagagcttgccctggttccagagcctgaggtttcagggaatgatactgaggtgacatcaaggctgagagatggttcaacctcctctaatggtgtgaaaggtgcacgctatggtgcaaaaggccgtgctaatggtagaactgctgctgtatctgaagatcacatgctttcaaaccatggaactgatggtcctgttgttattcctggtgtattgctaaaggatgttgtttcagatttgcctgtgcatcttttgggctatgggaatatttcatacaggatctgtgaagctagcaagaactgcaggaagataagcaagatctggtgtgcttgggtaggacaaggctcccatggttttgagagttgtaacacttatgagcaatctggatttgccatagtcaacttctcttatacctatgatttaggcaggaagtggtcttctgaggaacaagacctgtctgtctctgctggatctttctttgtaattgatgatgctggacaccgtggaaagcgaatgagaaaatcattctctgatcaagaagcatcttcagaagagtcaaacggtcagaacagctctttacagggcagtaggcaagctattgtgacttgttcaccggtaggtacctcaaatgatcttcaagttggtctcttatcaagcaaggcagcaaggagagagttgaggaagcagaagcgaatagcagctgagaaagtgtgtgatctttgcggcagaccaatgctctctggaaaggatgttgccaccttgctgaactgcaatacaggaaaactagcttgcagcagtagaaattcaagtggggcttaccatctatttcacacttcctgccttttacactggactattctgtgccaatacgagatgctgaacgatgaaatagctaggaaggggaagagcaaccgaggaaggaaggcaaagaatgcacctaagagaagcaaaataacgtccatagtttgcccagaatgtcagggtactggaattcacgtcaacggagatgaacttgagaagccaagcatttctttatcagagatgtttcgcttcaagatgaaagcaatcgaagctcacaaagcatggctgaagagacctgaagtgcttgaaaactgttccactgggcttcatttcccctcagaacatgtggagaactctgaggagaaggtgatgccactcaagtcacttcccttctatgccgctgatgggtagaaagatagttgatggcagctactggaggatgctgcagttgttgatgtaaataagctcgcttgacagttgtggaacagtgttgttagatgctcacctacgtgcattatctcagttaacctgtgtccgccagatgataactaagacatttaaactggcaactggctgaactattgtttttagctggattcactaaacatgtacgcagcccatttcgttgggttgggtttgctgcttacaacttccagtttcattgtttctgattactaaaaaanaaaaa

SEQ ID NO: 2397 - DNA, 4731 bp, Zea mays
  misc_feature (388)..(388): n is a, c, g, or t
ggcagatgggtgatggcaccgtcagatcatgaattcatctgctggttgttgatagcttcatttttctattgccctcggaggattttgtttggttacctctgaaagaaaatagtgtagaggtctctgtaaagaacgtaagatatcccctggcatctttgtggcctaaaaaaggattatgctctagagatgctcgtggcctcatgggtctagtctattctatgtggtctcacgttgacagccacacagaaacttatttctttttttagaaaacaaatcgaactgctattcacgaaatataataaattaggaaatacatcacgctacagtagtgtctccttctgcgtggttgcgtgtcacgtcggtgttgtttggtgtgcaggcaaagacncgaaatgtcaattcgggaaccggtgccagaatagaacgtttaggcacggaaacgattctcgcttcgtggagctaaaacctgtcgacaccggcaaaattgcatctaaaaactcgacctggccaataataaaaaaaacgaacggttggcagggaaaagagatgaatgtgaccgtcatattctagccattcccttcgagaaaacaaggcgtgtgaagtgtgatgctgcctttttttatctgcctgatagaatcatgcaacccccgcgtcagtcatgtggatgtggtttactactgcttcacgaatcggcgatgcgagaagttcacggaaggtgcgtgtcctgtttgggtttttgtagtttggtcgggagattacgagaataaagccattctcctccgtatttgttaggtagaacgaagtcattctaattttttgtttagtttaaagatacaatagaacgaagttatttcgttctttatttagttagaaagccatggacaagagagcgaacaaaacgctcgtgtccgatcatattgatgaaacaaagacatctaagtatataatagaaatagaaacttagaagccgctcgactctattttattataaaccaaacatttagaaaataaaaatagagttctatttttctccactcttcgtcaccaaacgcaccgtaatttattctgattagacacctctcgataaacacgatatgggactatccaacaaacgattacaataatagttttgtcgaaaatcaaaatattcaaaaatctgatcaaatttatgaaaaagagtgccaaatactataaaaatatatttcagtgaatctaataaatataaacacagttagttttttctaataagtttgatcaatttttttgctcgccagcgacaaccctcccttcatcgaacgtctggtccgaatattcttcttcgttctcgcgtttatctgtgcagccctgcctttcttctcccgttccccgcggcctgcgcgcgcgttctctccctcacctccgcccctctctccctctctctcgctccgggcgacggctgggcgaccgccgctttatccgtgcggcccttccttttgttctcccgtcacccaaaccccccttcgagctctatctgtctcttcctctcgaggcgacgcctgggctaccgcgccgctactgcggcctcccgcgacaggtgcctagtctccatcaggtgccatgtcttcttcgggctcttcaccggcgacgtgcactgccaggtacgctcctcccccttccccctccacccctcctcttcaattttctgtgcgaaaccgagcagccaaaccctaaactacgctatttgtattcggatctggtctaattacgcgtgcttacatgtattatgtctactaacctcgattgtttttgaattatcagctctgcatgtatacacccaagtcctttactgggtccgccgccgcccctatgtacttcgttaggtttagtatgttgttaagtttgtaattctagggtctggagggaagcatagatctcaagaggggtgaaatttggtggtaatgtcctgagaatttcaaggagacaagggcgcggaggttgtttctggagggatctgtgagcaaagcagcagaaatttgaggttggtggtaacctgtggatcaagcatggtgggtaaggagctggtggtgcaaaggaatggccctgttgacatacgtgagattgctgcaaaggccacgcttcgggaggtgcggcagagcgggcacacctacgtagaactacggcgtgtcgggaagcgtgtcatcttcttctgcaccatctgcctcaccgagtgcttcagcgacaatgtgctgtttgaccacctcaagggaaacctgcactcgcggcggtatgctgaggccaaggttacgctgtttgggcccatgccatggccgtttaacgatggtgtgctcttctttaacaactcacgcgagaaggatccgcttctgctggactcaagctcacagagcaccagagagcttgccctggttccagagcgtgaggtttcagggaatgatactgaggtgacatcaaggctgagggatggttcaacctcctctaatggtgtgaaaggtgcacgctatggtgcaaaaggccgtgctaatggtagaactgttgtatctgaagatcacatgctttcaaaccatggaactgatggtcctgttgttattcctggtgtattgctaaaggatgttgtttcagatttgcctgtgcatcttttgggctatgggaatatttcatacaggatctgtgaagctagcaagaactgcaggaagataagcaagatctggtgtgcttgggtaggacaaggctcccatggttttgagagttgtaacacttatgagcaatctggatttgccatagtcaacttctcttatacctatgatttaggcaggaagtggtcttctgaggaacaagacctgtctgtctctgctggatctttctttgtaattgatgatgctggacaccgtggaaagcgaatgagaaaatcattctctgatcaagaagcatcttcagaagagtcaaacggtcagaacagctctttacagggcagtaggcaagctattgtgacttgttcaccggtaggtacctcaaatgatcttcaagttggtctcttatcaagcaaggcagcaaggagagagttgaggaagcagaagcgaatagcagctgagaaagtgtgtgatctttgcggcagaccaatgctctctggaaaggatgttgccaccttgctgaactgcaatacaggaaaactagcttgcagcagtagaaattcaagtggggtgagcatctttgagcattctttgctactgtattcctgtttcataataattgctcttatagattagagagcatggacctgtttacctttttgtacattttttacctgaaaacatagcagttatgtttccaccaaattccaaatgttctgtaatgacttctctacacttgatttatgcaggcttaccatctatttcacacttcctgccttttacactggactattctgtgccaacacgagatgctgaacgatgaaatagctaggaaggggaagagcaaccgaggaaggaaggcaaagaatgcacctaagagaagcaaaataacgtccatagtttgcccagaatgtcagggtactggaattcacgtcaacggagatgaacttgagaagccaagcatttctttatcagaggtctggagcacatattcactcttctgctgtcagtccctgatttttcattcaggcaacttcttgcaaattacttctatagcagccgtgcacctgaattggttggatattggcacttgcagatgtttcgcttcaagatgaaagcaattgaagctcacaaagcatggctgaagagacctgaagtgcttgaaaactgttccactgggcttcatttcccctcagaacatgtggagaactctgaggtggaatcagaggcacactgttcgcaatgttctgttaacacaggtataaatccactcacaccagtctccatttccctttgcaggagaaggtgatgccactcaaatcacttcaattctatgccgctgatgggtagaaagatcgttgatggcagctactggaggatgctgcagttgttgatgtaaataagctcgcttgacagttgtggaacagtgttgtcagatgctcacctacgtgcattatctcagttaacctgtgtccgccagatgataactaagacatttaaactggcaactggcaactacacgtacgcagtccatttcgttgggttgggttgggtttgctgcttacagcttccagtttcattgtttgtttctgattgcttatgccacgcttctggatgtgcccgccagccagacgtcttgcgctacacgtggtttgctattatttggaaaccgtagttgcgccaaccgtagtatgttaaacacattcatgtcctttcataccgtaaatgtttgagcattttcaacaatgtcttaaactggtgcttcaaattgaactcaaattgaaatatagatattccaacaatgtcttatttctaaaatttgtcaaaaaaattatagagcatcctatctagggctggacaaaatgcttgtggctcgctggctcgctcgtttcatggtcggctcggatcggctcgtttgaattttgtcacgagctgacatccttgctcggttcgttaacgagccagctcgtgagctaaacgaactacaatattccagtaaaacgaaactatgtacatattatttacagaataattgatgaacatgttatatatatgtgaggtgtctatgatctatgaattaaactaatgattaatgaactatgcctat

SEQ ID NO: 2398 - DNA, 1257 bp, Zea mays
cttttttttttgatggaaattagatatatatgttactgagttatacacggtgttaaatgtcacgacgcgcgtgtatacatatccacacgagtacacgacacgcgaggggtttgattattttttgaacataatggtaggagctctgcctctcaattaagaaggaattgacccagttttaagggaaaccgggcccaacagacaacaacaaccccacacagccacacacacaatgtccatcgtgagtcatcgttgcggagttttttttttttttttagcagctccgactccccaagacaggcaacacaaggccgaaggaaacacgacgatgactacgaacaccgcagaagagaaggaagactgtggcacgccgtcgttgccaagccacgagatactccactcgagacaactccgattcttcaccagcgagacttccaaaaccttaatccaccaccccggtttgcacgaagatccgctggcacgcgcaccaccgcaaacgccggcggggccactgctgcccacatgcctacgccacacaccaccattgaggagccagatcctccgctcctcaccgtcgcacagctgacgcccgcccacagtagtagacaaggccgtgagggaggggaggggtggcaaagaagagagcgccgcgccacaatgcatgcacgagccccaaactgccatcgacgcaaccgccaccggccgccagcgccagctgctaagggcagatccggcctacacgccacaaacccaacaccaggaggagcacgcccgccagccagttccaggcccaccacgccatgtgtccgccgccgaaacggcgcagccccgccaccaccagtagatgccgccaatccatcacctggatgcacctgcaggaccagatgttgaaccaccgagcacagccccccgacgacgccggggacaaggaagacgacggcgtgggggacgacgcccgccccagcaaccccgcggctggaacttgaaccgcccggcacagaacccgctcagatctgagcatcggaagaccaaacgaaggagaaatgccggagaaacgccccgtagccgccatctttggaggtcgcgccggccttcggcagtctcctctggcgacggcgaggggggaaatagaggaggagagagtggcggcgctagggctggggggcctcccgtgtcgcccgagcggaggacgacgcgggggctgttccctggctgaggaccccggtttgattatcgaagtgcgaaaagatagggtacccc

SEQ ID NO: 2399 - DNA, 1809 bp, Zea mays
gcacgagaccattacctagaacatcctaatcgaaaacccgcgctgttcccagctcgctcctttcgagagtgtactactgtttagtccgcgcgcattgctcggaccgagccaccgagttcttgccgcgcgccgcagcagcagagccattgccgcgttcgctcgcgccgcgcggttcatgcgccaggagtctgaggcggctacctagttaacggcggggcatgcgtttcatcacaggcggcggcggcgtcggaggaggaggcggagtaggaggctcggcggcgcggtcgtacgagcccatggccacggccgacaccacgagcctgcactactggctgcactggcgggtggggctctgtggcctgtgggtgctggcctgcatggccgtcgcgggctacctaatctggcgccacgagggccccagcgccgaccggcgtcccggcggcgcgggcgcgggggcggggctgtcgtccccgggcgctgcggctgacggcggcaaggagaggtgtcacggggtgctgtacgacgacgaggcgtggcggccgtgcctccgggacatccacccggcgtggctgctcgcctacaggctcatctccttcttcgtcctcctcagcctcctcgtcgtcattgtcatctccgatggcggcagcatcttctactactacactcagtggaccttcattctggtgacgatttacttcgggctcggcacggccctgtccatctacggctgcagcaggttcgccgaggagaacgtcgccgcggcggcggcggcggcagacatggaggacggcgcgggatacgtcgtcgcccgtggcctggggcctgctgctgctaagccggccttggatgaacgagacggtgccggagaggtcgctgggttctggggctacctgctccagatcatctaccaggcaaatgcaggcgcggtgatgctcacggactgcgtgttctggttcatcatcttcccgttcctcaccgagaaggactacagcctcaacttcctgttgatcgggatgcattcggtgaacgcggtcttcctgctgggcgaggccgccctgaatagcttgaggttcccgtggttccgggtcgcctacttcttcctctggaccgcgctctacgtcgtcttccagtggatcgtccacgcagctacgccgatgtggtggccttacccgttcctcgacctgacatcgaacctggcacctctgtggtacctcgcggtggcggcgctgcagctgccgtgctacgtggtgttctggctgctgatcaaggtgaagcaccacctgctggccaggtgcttcccggtctcgtacgtacgctagctaggggctagggcacaagcaggcaggcccgtcttctccgccgccaacggtgagagcaacgcaagctagctagagaataatatatggcgggtccgggctgtttataatttggtggtggtggtggtggactggtgatggggagtgaggggacgagcgtttcgtgtgcaggtgccctccccgatcaagcgaagaacagaggggagtggcgcgtggtggaagggaaggagatgcgtgcagtttttttacagggggtataaaaactataaaatagtttggtgtacattggaaggaagctaagcatggtggtagtctttatttgagaatttttttgtatttttttttgccgtggtggagtggaagtgaacaggagagaggttcagggcagcagggaatggctgtgtatagctttgactgattggatgagattgaaatgaaatgaaatggagaagatactgttccttgacatcttaaaaaaaaaaaaaaaaaaaaa

SEQ ID NO: 2400 - DNA, 851 bp, Zea mays
tttttttttttttttttgaacaacaagctggacaatctcaatctgctggtacactgtaccggcacctgctgcaggagatgcaaatcgatctgcatgcagtggagttctttccgacgaacagcaaccaattaaccagcctaagaacaacacaacccactgcaccgatgaccgatgtgccttgcacacaggacacagccatacacacgcgcggccggtgtatatatatacaaacgcagctaggtgactttgtttcgacgaccttaatttctactagaactagagtagaggagctagcacaagcgacgcactttgtactaccggtgtgacgacgacgacgacggagttggattattgattggccgggtcgtcgtccagctgagccggcccccgttcaaggtcttccgggacccttgggtgggtcgtggcggttgttggggccggacggctggtagtcgttcacctccacgtccaccctcgccgtcggcctgcccgtgtttttcatcatcgccgccgcgatcgccgtcgtgtcctgagagtaactgagcttcagagccggcggcgggtgctgctggtggctccccaggcgcaggcttcttggcgtggggacggcggagacgagcggggcgaggaggaggacaaggaagaggaggcaggagggcagcacgaggagcggcttctcggcgtggcgctccattctgcctgcctgctcgctagcgagtcggggtgtatcttagtcgcggactcgatcggagggaacgaggtgccacgccaccagccaggaactcgaaactgcaatggggctgctggatgaccccggccggcctcgagggtcccaatcgcccttaggagtg

SEQ ID NO: 2401 - DNA, 5489 bp, Zea mays
  misc_feature (2364)..(2364): n is a, c, g, or t
gctgcttttgctgatggatatactagtatgatatatagaagtatatcttgttcgggtgcttcgaactaacaagctggacaatctcaatctgctggtacactgtaccggcacctgctgcaggagatgcaaatcgatctgcatgcagtggagttctttccgacgaacagcaaccaattaaccagcctaagaacaacacaacccactgcaccgatgaccgatgtgccttgcacacaggacacagccatacacacgcgcggccggtgtatatatatacaaacgcagctaggtgactttgtttcgacgaccttaatttctactagaactagagtagaggagctagcacaagcgacgcactttgtactaccggtgtgacgacgacgacgacggagttggattattgattggccgggtcgtcgtccagctgagccggcccccgttcaaggtcttccgggacccttgggtgggtcgtggcggttgttggggccggacggctggtagtcgttcacctccacgtccaccctcgccgtcggcctgcccgtgtttttcatcatcgccgccgcgatcgccgtcgtgtcctgtgtgtgtcccaacccaagacaaagtcgtctgtcatcaggactacagcagcagcagctagtagatgacaagcatatgaatccatccaccatcgctgaattaattagttaattgattgattaacctctgtacgtatattcgctaacagttgtgccaaatcaagagggagaaacacggcagcaggcgggagagacctgacggaaacagccaattgccagtacctgagagtaactgagcttcagagccggcggcgggtgctgctggtggctccccaggcgcaggcttcctgcgatcgcacaggcaaaatcagcagccgagaccaagagaggaaacagcgggggagggtgggagttagcggaggccatgcatggccgaggctcacttggcgtggggacggcggagacgagcggggcgaggaggaggacaaggaagaggaggcaggagggcagcacgaggagcggcttctcggcgtggcgctccattctgcctgcctgctcgctagcgagtcggggtgtatcttagtcgcggactcgatcggagggaacgaggtgccacgccaccagccaggaactcgaaactgcaatggggctgctggatgacgccgggtgctgctgccgtgccgctggctttaaacaacggcgttcctcactggcgtccgtctggctgctgaacgtcaactaaaatgtctaaatctaaataaatgttaccggctttttcccccagaaaggtgaaatataaaatttggacagctagtaggagcgggactatgccagtgccactctggttcaacctactatacgacagatctgcagcacctcctcacactattgcacagcgtaattgctagtgtgtgtcttatgacacagcgaataatgtttttttcccaggctacaaataattgcttgtcgtcttggctcgctttcttttcaatatataattaacaagcagccgttctcgttaaatttttaatacaactctgtaaaccctacccgctagatgcacgataactcgtaggttatacctttggtgttgaattgaatgagtacgacaccgttaggacgacgatagtcaacttagggacggcgaggtagacggtagtgtccttttccttattgatcgtgtagagacagattcgatatctagagttatgtttgggacagggtacacaaatgttggttcactcgtgtcggcttgtttactatttaacaccggtagaaaagagttctaaacctgtggcgcaatttagtttttaatagaggtttcggttatcaagcgtgtcagtagtatttctagtggcggtttattaagtaacctatcattagaaatccatgatttatacgttcggttttcttaagaaaccgtatgtacaaatcgatttctatagacatcttccttagaaaaccgtcattaaaaactattttttctgatttttttagtttttcaaatgaccttgtacgaaaaaaaaacaccaacataaaaagttgtagatctctaaaagttatgaaactttatagttcactacttttaaaaaaaaatcatttcggctctcaaaaattgcatctagatttgtcaaatttgagatgcaaattttgcaaacgatctcggacggaaaaaagtatccaaaaaaaacttgtagaacttcacgcgaggatgaggttctgggctacacaaaacaaaaatgcaatatagacatgaagtaagtgatatgcggagtggtggagatggctacacgcgaggatgaggtcggggttcgattcccataagtcatgtagcacgcgaattttacangaaaaatgctatgaaagttcaccgatgtctattagataatgttttaggtggttatatgggtgaatcgctcgacacttttaaaactcatcaacggcacatgcactaccggcactcactgcattattgtagcacgggaattttaggcggaaaattggtgtgttttaaaactcatcaaccctaattgggcacgtgcactaccggcactcactgcatcaacaattcccaagctccagtttggctgcggcgcgcgcctagatattttgcccatctatcgtctcacccaagctcacgcagtagtggtgcttcctgtacgttttgggaagcttttagcgattgtcaaatggcatataaagtacagtagtgcacggtgacctgcgcggcactcgatcgcacagacagagacctctgcatgcattttcaggaagcggaaagcgtttcagaactcttgttgcccatcaacaacatttgacttcgctagctctgcggagtagtggctcactccgataaacaactatcatggcctggccactactggcctcccaagtcagagcttagtgacttatttttggtacttaggatcttgaccatgcagggtcccgcacttgcatgccccggccccccgtgttttttgcgggtctctcgacctcgacatctcgtcgatgccgccgccgccgccgcccccgagcgcgcatgttgcttggtctctcttgtgatttgcgaatggaaagaggcgtgcatgtactgatatcacgacggccggtcagccacaggcccacagtggcgaatcgaagaactgagggcctcgactgatgatccgggctgggaaccggccggttccgacggcgaaacaaccggcgcaatgcgcggccggtggagcggtgggccggcggggacagcgacggcgtattggcagccggcttcgatccgggctggccgtgtgaacaacacttctattaagggcccgttcgtttccgtcggattgcggattggaatttggtaggtatcactattcccgttcgtttgggcctgaaccggaagtaaactcggcccggttttgctttctcttccctccaaggaccggcacaaaccctggcctcgtctcctccggatcgattcctggccaaagcgacggcgagacgttggcgacgcatgaggacggtgcgaggtcactgcgtggcggcgcgaggtgacggcgggccggcgccgcgcagccccgacggcaagcctccccggcaccttctcaccggtgagtattgagctctcccatcctcatttttttcttgttcttgatggatatggaaggggggcgagagtagcgagcggtgtgcaggcggcggtggaggccggccgtggccggtggtgacgaggatgagagggtatgcttccgatgaggaatgagaggagcagatccagtggcagagagatttctgttcctaggggatgcagagggtctaatcggattccagggagttcagtcgatgctttccgatggcactatgtccagaggcagcagcaacggtgatgagttagacgctgatgacgatgacttgtgggtgtcagattacaagggggaagaggcgaactcaagagccccaaaggcgagtttcccgaattttgacagcagcagtgaggatagtgatgacaagagggaaaaccttggcaacggagaagaatactgatgaaggttgggacagtgactgaatgacagggctcaaggaagagaaatgttgatacgtgatgcatcaacgaaggccagcaccaatggttgtcaatgcaggttctttcatcggtggtcttgctcacgtacttgtcccaacgaaatctcgaggaggtagaagagtactcgtggtttccatgagaacaactgtctgaaagttgttgaagcggatgagttctcataaaatgtccttagattgtttagccccaaaatgcacgaggtgatgtgtttattttcactgaacctagtagtagcccggagcggtctgtgcaagtctgtatattcagcaacttcttcttgtatatgtttatgatgaacctaggtgtgatatatgatttgtctatgtgtgatctgtgatttgtaactttatattggttaaaacatatatcagttgttttttaaactgcgatctgtgatctgtctatgtgtgaatttttccagctgccgaactgtgatctgtcagtttagatatatgtctcaggaataattcggagaactgtgatctatcgaattattcggagaactgtgatcccagtttagctaatatgtcagtttagctatatgtcagaaataactcggcaaatcacagtatgtcagtttagctccgatcctaagctaccgaacagagcaacagagaattattccagctgaaacctgggctgatcaagtgaaaggcccggaacaagtgaaagacccggatcaactaaaacctggcctggaactgttattggcctggaactaaaaccgggctgccgaacagggcctaagtctcttgaactcagtttcgggtaccctttctccttttcttgtgctatattttttataccatgcatcctagatctcctcttagcacagggtcttctttggccgggggcgagaagcgtacaaagccgccggcgctatcgtcgttgggcggcgtacgtgacgctgccacgcccgactgggacagaaagattcccgatcgatcagtcagtccatggaccagcaccagcttggcgtcctccaaggctccaactccaagggcaaggcatgagatccagccgtcttttttgcattttaattcttttagggttttattcccacaattacgcttttttagtctcattttaaaaaatcaccctcacctcggcgtcatcaatattgtcaccgagctacaacgtgttggcgccaattaattaatttgacgtgtatatataagagtcgacgcctacgtggatacgacgtgacagtaccatggcgccaaggtcagcgctatggatctcggcggcgacctccatgcatataaatataccgcttcggccgtcagttttttgatttttggatgatagcagtcattttatcaatgattcttcttcatacttagtttatttggtttatgaatttgtgttctattgttggtgacctaaat

SEQ ID NO: 2402 - DNA, 716 bp, Zea mays
tttttttttttttttttcggagcaatgatttttttttttttttttgatactgtaccggcacctgcagcggggtacgaaatcgatctgcatgcagtgcagttctttctgacgaacagcaaccaacacaacttaacgacccaccgatgtgcttgcacacggccatacacacgcgcggccggtatatatatacacatgagctagcacaagcaacgcactctgtactaccggtgaagacgacgacgacgaaggagaaggattattgggggcgcgcgtacgtcgtccagctgagccccgttcaagttcttccaggacccttgggtgggtcgtggcggttgttggggcccgacggctggtagtcgttcacctccacgtccatcctcgccgtcggcctgcccgtgttcatcatcgccgccgcgatcgccgtcgtctcctgagaggaactgagcttcagagccggcgggtgctgctggtggctccccaggcgcaggcttcttggcgtggggacggcggagacaagcggggcgaggaggaggacaaggaggaggaggaggcaggagggcagcacgaggagcggcttctcggcgtggcgctccattctgcctgcctgctcgctagcgagtcggggtgtatgtatctcagtgaaagagtcgcggactcggagcggacgaggtgccaggaatcctgaaactgcaatcccgcccgcccgagggtcccaa

SEQ ID NO: 2403 - DNA, 2016 bp, Zea mays
cattgggtacctcgaggccggccgggaccacgtaccagcagccagcagccccgccacttcccccctcgccgcttgcgatggcggtcacgcgcgtcgccgtggccgccgccctctcggcggccccgctctcctcccgccgccaccgggttgccctcccctccgcctgccgccttctccccgcctcggccacctgctgcaacagccgcgcgccgatgtcgctgcaggccgccgccgccgcacctgccgccggcgcggtcgacgaggagactcctgcctcctcccctccgtcagatgctagcaagggggtggagaacctggtgatcatcggctctggaccagccggttacaccgctgccatctacgccgcccgggcgaacctgaagcctgtcgtgtttgaagggtgccaggtggggggtgtccccggcgggcagctcctagtcccccccccccccccgaatttccctggcttcccggacggtataaccgggcctgatctcatggacagaatgcgcaagcaagcggaacgctggggcgcagagctttaccaagaggatgttgagtttgtgaatgtaaagagcagcccgtttgttattcgtagcagcgaccgtgaggtgaaatgtcatagtctaatcattgcaactggagctacggctaagcgcctccgtctgcctcgtgaagatgaattttggagtagaggcatcagcgcatgtgcaatatgtgatggagcttcaccgcttttcaagggccaggttcttgcagttgttgggggtggtgatgtagctacagaggaagcagtatatttgacaaaatatgctcgacatgttcatttactagttagaaaggatcagctacgggcttccaaagctatgcaggacagagtactcaacaaccccaacataacagtacatttcaatacagaagccatggatgttgttagcaatgacaaacggcagatgtctggcgttcatctgaagagaagagatacaggagaagaatcagttcttactgtgaaaggtctattttatggcataggacatactccaaacagtcagctgttgcagggccaaatcgaacttgatagtgctggctatattttagttaaagagggctcagccaaaacttcagttgatggtgtattcgctgctggtgatgttcaggatcatgaatggagacaagctattactgcagctggatctggatgcatagctgctttgtcagttgaaagatacttagttgccaatgatcttcttgtcgaatttcaccagcctgttcaagaagaaacaaagaaggatattacagataaagatgttcaaatgggctttgacatttctcacagaaaacacaagggacagtatgcactccgcaaactataccatgagagtccacgactcatttgtgttctatacacttctcccacatgtggtccttgcagaaccttaaaaccaattttgagcaaggtcatagacgagtacggcgagtttgttcatcttgttgaaattgacatcgaggaggatcctgaaatagcagaagctgcaggcatcatgggaacaccttgtgttcaattttttaagaacaaagaaatgctcaggactgtatcgggtgtgaaaaggaagaaggaatatcgggagtttatcgaggcgaacaaatgagttgagcacgcagtggaccccctcaaggttttttgaagtcagtagttcttttggcgctattttgacgccaccccgtcccccggtggccaatttttcatcagattttaagacgagcctggtctagtgccatgccaaaggaaactagccgatccctcatattggattatacagctcaaaatatattctttgctgtgtgtgtacaacatacatggagttgaccccccaccccctgctgatcaatgatcattgcggcattgccttgacactgccaatgtgcaaactatttccacggattagcatacattaatctgaagtatatatatactcggcaatgctgaatccattttgaccaaaaaaaaaaaaaaaa

SEQ ID NO: 2404 - DNA, 3581 bp, Zea mays
cattccgtccctccccccccgcccggccatcctcccctccgcccaccaacgcagcagcagccagcagccccgccacttcccccctcgccgcttgcgatggcggtcacgcgcgtcgccgtggccgccgccctctcggcggccccgctctcctcccgccgccaccgggttgccctcccctccgcctgccgccttctccccgcctcggccacctgctgcaacagccgcgcgccgatgtctctgcaggccgccgccgccgcacctgccgccggcgcggtcgacgaggagactcctgcctcctcccctccgtcagatgctagcaagggggtggagaacctggtgatcatcggctctggaccagccggttacaccgctgccatctacgccgcccgggcgaacctgaagcctgtcgtgtttgaagggtgccagatggggggtgtccccggcgggcagctgatgaccaccaccgaggtggagaatttccctggcttcccggacggtataaccgggcctgatctcatggacagaatgcgcaagcaagcggaacgctggggcgcagagctttaccaagaggatgttgagtttgtgaatgtaaagagcagcccgtttgttattcgtagcagcgaccgtgaggtgaaatgtcatagtctaatcattgcaactggagctacggctaagcgcctccgtctgcctcgtgaagatgaattttggagtagaggcatcagcgcatgtgcaatatgtgatggagcttcaccgcttttcaagggccaggttcttgcagttgttggggggtgggtgatgtagctacagaggaagcagtatatttgacaaatatgctcgacatgttcatttactagttagaaaggatcagctacgggcttccaaagctatgcaggacaggttgattatggcgaatgtttcagagtactcaacaaccccaacataacagtacatttcaatacagaagccatggatgttgttagcaatgacaaagggcagatgtctggcgttcatctgaagagaagagatacaggagaagaatcagttcttactgtgaaaggtttattttatggcataggacatactccaaacagtcagctgttgcagggccaaatcgaacttgatagtgctggctatattttagttaaagagggctcagccaaaacttcagttgatggtgtattcgctgctggtgatgttcaggatcatgaatggagacaagctattactgcagctggatctggatgcatagctgctttgtcagttgaaagatacttagttgccaatgatcttcttgtcgaatttcaccccggtctccctttcccccgccgtccctcgcgccttatgacatctggtgcacataccaacttcattttgccttggacactattataatggaggatgactgtacaatctttactggatccacagtatcgtgaacagctgcaatcatctacttttgttattttgactggtatttctagtttatgtatcatcacatgtcagcattgccatgtagccacattggaatttattcatatatgaaaatttgaacataggctttcatcacttcttatatcacatggttgattcacttgtaccatcttttgctggttattttctgtactaaccccaatcaagtttacaaggtactgttctttctcataattttttaatttaaatgcagcctgttcaagaagaaacaaagaaggatattacagataaagatgttcaaatgggctttgacatttctcacagaaaacacaagggacaggtatttatgcatagattgacccacatgatgaaaatgttaatttgaaaactgacactgagctttcttcctttgcagtatgcactccgcaaactgtaccatgagagtccacgactcatttgtgttctatacacttctcccacatgtggtccttgcagaaccttaaaaccaattttgagcaaggttggttcctgaagttggtactgtatctgattggtctaatttaagggctcatattctttttaaaacaacctaccaatcaaccttaaagcaccttctttttacaatggtaataggatacatacaacttgggtgttaaaataaaatcaacatatagcttcacaacattgtgtgtggtacggcgactagcagacacatgctgctattgtgatgcaaaattctcattttatgatctgtgtatcttagtttaggttgcttgttttattacttgctaattgctaatttatcttgcaggtcatagacgagtacggcgagtttgttcatcttgttgaaattgacatcgaggaggatcctgaaatagcagaagctgcaggcatcatgggaacaccttgtgttcaattttttaagaacaaagaaatgctcaggtttgttatctgtacttcaattagtttggttagttctgttgtgataagattcttcatgtttgtgcctatcttttctcttctaggaaatggtatacactttttttggagaatactgaatgaacttgcaaaccaaaggcacaggcacatcttggctaaatattggactagttggtgtatgtgtattttatcgttcttggccaaacattatctgatgttctcgaataaaattttgttaaacaaaggcatgcaattgaattcttaagtctgtcttctttgtactctgatgcttgtgagtgatgtcgatctctggggcgagttctgtattatcatgtcttaggtacgcctttgtctcatcttttgttatcttggaacatgcaggactgtatcgggtgtgaaaaggaagaaggaatatcgggagtttatcgaggcgaacaaatgagttgagcacgcagtggaccccctcaaggttttttgaagtcagtagttcttttggcgctattttgacgccaccccgtcccccggtggccaatttttcatcagattttaagacgagcctggtctagtgccatgccaaaggaaactagccgatccctcatattggattatacagctcaaaatatattctttgctgtgtgtgtacaacatacatggagttgaccccccaccccctgctgatcaatcatcattgcggcattgccttgacactgccaatgtgcaaactatttccacggattagcatacattaatctgaagtatatatatactcggcaatgctgaatccattttgatcaaggaagcgactggaaatttgtttgtatgcgtgtggaagcctccgctcactgcaggcctgccagtcaccaacgctccatcacacaccagcctcctgctgctgtggcgaaggtttcgccttgttatcgccaccgctctgtccccggcgaacccgtcacctgcgctgcccgcccgccgccgcgaggggaaactctcggccgcttctggaaaccacccgggctccacatgtcgctcgagactagccatcacaaacacagaaacaaaaccggcgcacggatatacgcgacccgcctcccaaagtttagaaaaacgtttctccgatagttctttaaataaacttgttaaatttagttatttactatctaactatatttactttttagatttgacaactcgatagtaacttactaaatacagta

SEQ ID NO: 2405 - DNA, 1591 bp, Zea mays
  misc_feature (20)..(20): n is a, c, g, or t
cgacccacgcgtccgcctancctgtgtgacggagatttttaaatattcctgatccactaaagcagagtaataatcttggacgcagtgtcagtaaaggaaacttttaccggatacgcagcgcatttgattttggtgctcgtaagcttggcaagattcttcaagtgccttcttgtctcactgttggtgaagtcaatcagttggtgaggaacactctatttatttaccgtactggtttaaggccagatgttttggttgtctcttctgaccttgttacaaatgatcctgtatcatcagacttagatgtggaaagagtcaacaatgttgcgcctaacaattcctgtgatgttctgtctaatcagctcagtaacatcaacatttcagattccaataatcatggctcaataaagcaaaaagaatgtaactctatggctgatcacaaggagataaaatctgtttctttgggtttgctagatagtgatgccacaaatcatgcaactaccgattcagtaagtataaggggtggtggcaacttctctgaagcttcaccagtacctagtgaaaccagtaccttgcaatcagaaacaggcaagaaagttgatgttagaaatgacacaaccccatcatactatggggtttcagcaaagcagtttacaggcagatctcaccactatattgaagatactaagcataatgcttacccctattctactggtttagttgatggtctgggcacatctaattcagttttaacatcggatacacaacctggaggtaacaacaatgacacagtgccaaatctcactggagatttcgatacaaatttgcataatcttctgtatgcacgggggttccatcaggacaatcctatgactcaattgtactatccaatgcccatgccaccacccctgcaatatcagaacatgcacccatcaaatggccatggcagaaaaaatccgtatggatatgctggtaggaatggggttgtccctggtcatgtttatccacctagctattttgtgtataggccattgtatcaagcagatgatcatatgactttgaggactcgtggaacaggcacctactttcctgacccagtacgttccctccttgattatattcatcttatgtccttaaaacttaaggaacacaggcacttgtccatatgtttgtttattcattccgtgtgctgtacatgtgaacagaaatactaattttcttgaaatctagtttccgtgatctacaattctaattttcttgtaatttagtttccgtgatttactattcttttatatgcaatgatttgaccattatgcttatgtttttttacttcagaaaagtgttacttaggtttgtcctctattttttattgtttggtcagtttttttcttttgttcatgctaattttgtctgcctaatgggacacttcagaatttgcgcaaggaccgaccacctactggacgtggggagagaggaaggaatcattcccatcagaataattatcataagtttcaccaccacacccgaccggatatgcctgtagatatgatacctttggaggaattgcggcatgagctgccactgcaggcatgca

SEQ ID NO: 2406 - DNA, 1291 bp, Zea mays
cgacagtacgtcccaaactcgagtttgatcgaggcgtccgtgactggagtggttgcatacttgcatgcgttgttttgtctctctctccccctctctgtgtcgctgaaatattggtcacgtccattccaatctcatctcaaatctgtccatgggctgacaagaccgcgcgctgaaagcatttgcgtggtggctgctgcacgcagctgggcgcggagttcgtgggcacgttcatcctcatcttcttcgcgacggcggcgccgatcgtgaaccagaagtacggcggcgcgatcagcccgttcggcaacgcggcgtgcgcggggctggcggtggcgaccgtcatcctgtcgacggggcacatctccggggcgcacctgaacccgtcgctcaccatcgccttcgcggcgctgcgccacttcccctggctgcaggtgcccgcgtacgtggccgtccaggcgctggcatccgtctgcgccgccttcgcgctcaagggcgtcttccacccgttcctctccggcggcgtcaccgtgcccgacgccaccatctccaccgcccaggcgttcttcaccgagttcatcatctccttcaacctcctcttcgtcgtcaccgccgtcgccaccgacacccgcgcagtgggtgaactcgccgggatcgcggtgggagcggccgtaacgctgaacatcctcgtcgccgggccgacgacgggcgggtccatgaacccggtgaggacgctggggccggccgtggcggcggggaactaccggcagctctggatctacctgctggccccgacgctgggcgcgttggcgggggccagcgtgtacacggcggtgaagctcagggacgagaacggtgagacgccgcgcacgcagcgcagcttccgccgctgacgacgcacactggccgcgggcgcgagacattgtccggccgtgtcacgcacgccctcgtcgtcctcctcctccgccgcgtaacgcacggccacgacgtgtccgcggtcgtacgtgctgtgtctgtgtgtaccaataaataagccccgttttgcttcgtccagaacggtccagtgctatgtgtacgtggtctgtgttgtgatttgcgaattggattattgtgggtcgtctcgtcgaggtctctcgggtgtcgggtgggtctgatgcgatccatcagcgtcgtgtccgaataaaagccacgccgatgcgccggctgacgggcatctggatgtgtgatttctgaacaagatttgcttaatttcacttgcttaaaaaaaaaaaaaaaaaaaaaaaaaaaaaaaaaaaaa

SEQ ID NO: 2407 - DNA, 3633 bp, Zea mays
cgtctcgctcacccgcaaggtacgccaccgccaccgtcccgtccacatgcgcgtgcacatgcacgctcgcatttctttctgctccttcttccttccttcctgagttccgtgggtttttttttcttctgagtgcgcggtttatttttcatatttccacacgtctgatgatcttttagcattgtttttttttttgtgtttgtgtttgtgtattgtgctattaattgttacttgagggtacagacatgcatcctcgcgaattttataccgtgtaggtcaaaggctcaaaactaacgttacaacagtcttgtgtctgaaagcctgtagcgacacagccctgacagcactagtactttaagaaataataaaaaaaatgtaggcgtgatcgatgtcataagttgttgactgttgataattgatcccttacagtagatgatctcatgatcacttgatcatttctgtgatcttatatatactgctcagtttggctctttgcatcgttcttgaaatctctcgatgttgcatgctgacgagagacatttggagcttgaagcagcaaatacaactagtgggcaggcttgctagcatcgctgggtgtgatgggctgatggatctccactccacgccgcctgaaacctgcctgcttcacacgcggcgctgctgtgacctgtgagcctgcaaaagtacacccaggtggctgcaacttttggcttggctaagcggcgccccacccctgccaccacacgacagtacgacacacgtatgaaaccgggccggggaggcgtgtgcgacgccacgccatcgtgtcccccctaaccaaccttcattcggcttgtttcctgtgtgttgttctccaggtccagggtaaccgctcccgggaaataaacgacacgcttgtttgaattttgcattgggttgacgaatttcgaattgctggatttgggttcgcgcgctgatcccgggggaaaaaggtccaaaacaacgtaagaacacatcaattatattgatccgtagtagagagctgatgtctgcttgttcccaagaacatttattttaacaatgggaatggttttggcctacaattaaagtagactttcgaatattgtttttattagtaggcaatgaaaagctagagtgcactgtcaaaaaaagtgacgttctgatcgaaacgtgacaataaactgcgtctactccatgtacttagcttgtaaaagctcatgcatggggaagaatcgtgcacgtgaaccagatcgggtagcctgtcacgttccccagccttgaatcgaaactacaccgggtctagttaattatattgtcgataagagacaacgtacagcgtttttggaacaaagaaaaatggtacccccagctccaattatttcatgatgaagtacggctcttggacgtgacacggcaaaagggggcgacagtacgtcccaaactcgagtttgatcgaggcgtccgtgactggagtggttgcatacttgcatgcgttgttttgtctctctctctgtgtcgctgaaatattggtcacgtccattccaatctcatctcaaatctgtccatgggctgacaagaccgcgcgctgaaaacatttgcgtggtggctgctgcacgcagctggtgcgcggagttcgtgggcacgttcatcctcatcttcttcgcgacggcggcgccgatcgtgaaccagaagtacggcggcgcgatcagcccgttcgggaacgcggcgtgcgcggggctggcggtggcgaccgtgatcctgtcgacggggcacatctccggggcgcacctgaacccgtcgctcaccatcgccttcgcggcgctgcgccacttcccctggctgcaggtgcccgcgtacgtggccgtccagggctggcatccgtctgcgccgccttcgcgctcaagggcgtcttccacccgttcctctccggcggcgtcaccgtgcccgacgccacccgttctccaccgcccaggcgtttctttcaccgagttcatcatctccttcaacctcctcttcgtcgtcaccgccgtcgccaccgacacccgcgcagtacgcgttctctctctctctctctctctctttcagtgcattgacagcatgcatgttgccatcgattcatatctgaatttctgctgctcctgccctgccctgcccttcgttcttgcaggtgggtgaactcgccgggatcgcggtgggagcggccgtaacgctgaacatcctcgtcgccgggtaagtctccttgctagcttatatgtgttgtagttgtagtagcacgtgataaggtgatcatcttcatacgtgcacgcatgtggttggttgagctgacctgtaacgctgaacatcctcgtcgccgggccgacgacgggcgggtccatgaacccggtgaggacgctggggccggccgtggcggcggggaactaccggcagctctggatctacctgctggccccgacgctgggcgcgttggcgggggccagcgtgtacaaggcggtgaagctcagggacgagaacggtgagacgccgcgcacgcagcgcagcttccgccgctgacgacgcacactggccacgggcgcgagacattgtccggccgtgtcacgcacgcccgcgtcctcctccgccgccgcgtaacgcacggccacgacgtgtccgcggtcgtacgtgctgtgtctgtgtgtaccaataaataagccccgttttgcttcgtccagaacggtccagtgctatgtgtacgtggtctgtgttgtgatttgcgaattggattattgtgggtcgtctcgtcgaggtctctcgggtgtcgggtgggtctgatgcgatccatcagcgtcgtgtccgaataaaagccacgccgatgcgccggctgacgggcatctggatgtgtgatttctgaacaagatttgcttaatttcacttgcttaaaaaaaaaaacaaaaaaacgggcggccctggagccggcctctcgtctctcggccagtttttccttccatcagaccaagtttgattcatatcacaccatgaccatgcatgcgtatgcgtattcagtagaaaattaatatacccagacatatacacatcagagttattaaaacctgatgccttttgagcgcttctccgtgactccgcgttcggcgcaggttccgcccacggtgtgccaacgcgtggcaggtgtgtcggacacggttttctttcttcaattcaacagaagagcgtcgcgtccgtgaggctgccgcagtcccgcaacagtttggaaaccagacctcccagccacgccacccgtgacgccactaccggctccgagcgccgcagatccggttcatgggagaggatttcccctgctcttcctgcccgatctcgattcccgtgcacgcggtggcctcccacatcactcgcgacgctacacgccacgcccactcatcgccgccatcaaagcctcaacgaaccggaccgtcggatcggagcgggggtgcgaggtagcttccgacggtcggcctatgcgctgccctgccctcgagggctcgacgctggtggacaagtcatctctgcgctggggttcgatggagcgcggctgtcggggcggacgttcctacgctccgcagatccggtgcgctagggttccatgagaccgagcgccgcagatcc

SEQ ID NO: 2408 - DNA, 2619 bp, Zea mays
  misc_feature (196)..(196): n is a, c, g, or t
  misc_feature (2549)..(2554): n is a, c, g, or t
  misc_feature (2557)..(2557): n is a, c, g, or t
  misc_feature (2559)..(2560): n is a, c, g, or t
gtgaaattagcgatgagcgtgtagcgattaggccctggactgatatagaatagtgagattagcgatgagcccatgcggtcaagaaaataaggcgtcagcgaattcaaacctccccggaatctctgttcaaattttgatctcctggctcctgccacctgctttccaaaaagaaaaaaatctgatccgaaatagagcnggctacaatactccgggtagctggcttctccgttgtttatagtgtattattgttttgtgatgagctttgcttaaacaagctacttggaagcagtcctataagctgagacaatgttcttccatttccgcggctatatcttttagctcgcattattcgagagcagttggggagatgtggcctcaagtggcgggatgccattgacctcgatccatccccctcaacatgtgcgtccgcagcctagctatatacaccatctcgccctccaggcccatcatcacccccagcacccaccccacctgcccacttcgtcttcctcctctctgtcacctcgccacccttcttcttgcgttctccatcgcattgcatctgtagcacgcagttctccctggtcttcttccgcacgcgtctctccccgttctgccagtcctagttgaaccagagaggctgttcttgtgcgtgtgagagagagagctggacaccgtcgccccacccattacgccgtagccaaacctggagaaaaacctgtgaagcatgtaactccagtccctgtccaaaatccaaacccaagccccccaaaaaaaatcacaaaaaaaaaaacaccttcaagatcgttctccaaaagctagcaccggtaatcagcggcgaggcgtaagtcggtaggctggatacgcccccactaattccttagcacaaaatcaacaaaagcctccggatcatgtaagtttcgccaccatcatctttgctcgccgcccagcttaaaaaaacaaaaaaaaaataagaaacccagcagcatgcatcgtcattagtagccatcagtcgtagcctatcgatcgtcctgggagccatcccagcattatcgtagcattacctcagcaaaaaccatcaaatcatgtaattagtgtgctcccgcgtcctatttctgctgcactgccggcagtcgaaaaaaaaaccaaaaaaaaaagattgtccttgagagtgagtgagagagcaagcaggttgctagctgctggtagagagagctagcagttacagccgaccaggtagctagatagctagccatggagccggggtcgacgcccccgaacgggtcggcgccggcgacgcccggcacgccggcgccgctgttctccagcggcgggccccgggtggactcgctgtcgtacgagcgcaagtcgatgccgcggtgcaagtgcctgccgctgccggcggtggaggggtggggcgtggcgacgcacacctgcgtcgtcgagatccccgcgccggacgtctcgctcacccgcaagctgggcgcggagttcgtgggcacgttcatcctcatcttcttcgcgacggcggcgccgatcgtgaaccagaagtacggcggcgcgatcagcccgttcgggaacgcggcgtgcgcggggctggcggtggcgaccgtgatcctgtcgacggggcacatctccggggcgcacctgaacccgtcgctcaccatcgccttcgcggcgctgcgccacttcccctggctgcaggtgcccgcgtacgtggccgtccaggcgctggcatccgtctgcgccgccttcgcgctcaagggcgtcttccacccgttcctctccggcggcgtcaccgtgcccgacgccaccgtctccaccgcccaggcgttcttcaccgagttcatcatctccttcaacctcctcttcgtcgtcaccgccgtcgccaccgacacccgcgcagtgggtgaactcgccgggatcgcggtgggagcggccgtaacgctgaacatcctcgtcgccgggccgacgacgggcgggtccatgaacccggtgaggacgctggggccggccgtggcggcggggaactaccggcagctctggatctacctgctggccccgacgctgggcgcgttggcgggggccagcgtgtacacggcggtgaagctcagggacgagaacggtgagacgccgcgcacgcagcgcagcttccgccgctgacgacgcacactggccgcgggcgcgagacattgtccggccgtgtcacgcacgcccgcgtcctcctcctcctccgccgccgcgtaacgcacggccacgacgtgtccgcggtcgtacgtgctgtgtctgtgtgtaccaataaataagccccgttttgcttcgtccagaacggtccagtgctacgtgtacgtggtctgtgttgtgatttgcgaattggattattgtgggtcgtctcgtcgaggtctctcgggtgtcgggtgggtctgatgcgatccatcagcgtcgtgtccgaataaaagccacgccgatgcgccggctgacgggcatctggatgtgtgatttctgaacaagatttgcttaatttcacttgcttaatttccgctgcgtcnnnnnnaanannacaaaacccccccacacccaaaaaaaaaaaaaagcaaaaaaaaaaaaaaaaaagcggcc

SEQ ID NO: 2409 - DNA, 1098 bp, Zea mays
acacgagtaaccagtgctaattttaggcacaaactacagagagtattattgtatatgcctagttgtggcaaatatctcaatcttcccaagaatgtcccctccaccacatcagtcgtaacaacaatcagctgtaaataatgtgaggcgagcaactgaacaggaatagcctgctccaaaaaagacagacatccaaaccccagatccaagcaaaaccccctagtattgtggtgtacctccatgtgatggatgcatggaggctcggtagaaataaatgaatcagaagcttctcttaggctgcacggctatcatcagctgcatttcaccacgaatggactaaagacacttaagaattgtgaggttcgcattccgagcttgaggtcaacttctccgccacccaaccagaagaaatcctcatccaatttggtgatagcttcatctatgatgaccggtatgtttgtttccatcccgatgcaagtgacagcgttatgcacaaacccagtaagcttgtgtgactcctcttctggtgccaacctcatgttaaatctctttttcggtatttgcttctcatttagttcatacaggaagttcttgatgttttcagcgttaagccgtgccatatactgaacaacaacgacatagtattttgaattctttggattactgcaatcaacaacatctacagcagcttgggtgttcaccatgacgatactcttgcagagctgggcgactgagtcggctcggagcaggccgcgccgctcctcgagggagcggtcatagtagtcggcgggaacgcgacggaaggcgaagtcccgcacgccgcgcgcggccaggagggctgcgagatgaacctcggtagcccccgcgtcggcctcgcctttctctgagggcgcggtggagatggagagcgccccgaggcggtgctgctgcgcggcgagctcgaggtcagaaatacggccgaggatgcggagctgacgcgcctcgaggtcggccgccgcggcgcccatggatgccggacctggcgtgtcgtcggaggcgcgtcagtcgtcccgctgcggtaaactggacgcaggccgacgcgggcgccgcggcggacgggtg

SEQ ID NO: 2410 - DNA, 2024 bp, Zea mays
  misc_feature (79)..(79): n is a, c, g, or t
ctcattgaattagtacgtactcaccgtttgtcctagcattttgccaaaccaacgagcctccaagagaaaagaaggcgcngcaccaatcgccgccccagtcccaggctccggcgctcgtgttccaaacggccgtgctcccgttccacccacccccatccctcctccactcacccggcctccgtccgatccgcccacgcagccgtgtcggcctcgtgcgcaacgaagaccggccggccggctcacccgccctcccgcccgccgccatgcctggctcgcccaaggtcttcttcgcttcctccgcctcgcgccgctccggggcactgcgccggctgctctcctcgccggccttctctgcggcctgcctcttcttcggcctcgccggctttctcgccgccgcgctcaccctctcgcgctccccgtccatcactcacagccgctgccccgactcctcgcgcccgctctccgtctccgtcgcgtgggaccgtcgtccaggggatggctccgccgcgggctccgcggagctcccggcctcgctcgccaccggatcgcgcggccgtcacaaggtcatggccttcgtcgggatcttcaccgggtttggctccatcggccgccgccgcgcgctgcgccggacgtggctccccgcggatcgccagggtctacttcgactggaggaagccactggtctggcattccggtttgtgattgggaaaagcaattcaaagaacaagatggccgctcttaacagagaagttgaagaatatgatgattttgtgcttttagatctcgaggaggagtatagcaggctcccatacaaaacgttagctttctttaaggcggcctatgcattgtatgattctgatttctatgttaaagcggacgatgacatttacttgagaccagatagactttccttacttttggctaaagagcggtcacatccacaaacatacattggatgcatgaagaaggggcctgtttttactgatcctaaattgaaatggtatgagccccaatcctttttactcggatcagaatacttccttcatgcgtatgggccaatttatgctttatcagctgacgtggtggctagcttggttgcattgcgaaacaacagtttccgtatgttcagcaacgaggacgttacaattggatcgtggatgcttgctatgaacgtcaaccatgagaacacacatgcactttgtgaacctgactgcacggagtcttcaattgctgtttgggacatcccaaaatgctcaggtctatgccacccagaggtaaaaatgctagagctccatgaaagaaaagaatgcacaggtggtccaactgtggcagctgaggtgtccgagtctgaggattgatgattcttggttgggggacaaactacggatctgatagttgacctgtgtcctcacccaatagatgtgtttggagtattcatttgattcatcaggcgcaatcattgcgggagcactgctcaaggaacctatagttggctggcgtcgtaacctagcgctgtagcaaaggcattctcattcagcattcttgtcacagcagccttcattgcttctcttgcaattggaaccgtggtcgacgtctggaacgttcaatcctgtatcgtagcagaaattaaaggagttttgttgtatagaaattagaaggaaagaatgcattggcaattaattgataagaccatgcgtacacctgatgctgtggctgattgagattagggatattccttgaggttctctttttggagtaaattattttctgagccgtagtctaaaaattttctgatccataactaagcgagcaagctgagtcttgaggatgataacaagcaacgcattctcattctgcattcttatgatcagtgtttgtacttgtggcttcgaaattattttctctctcgcgaatatatatggcaagagccttgccggtgattattatactgctattaaagatgaatccttttgttatggggagcgatattgagcgtctctctccagggggattcctctagagtc

SEQ ID NO: 2411 - DNA, 916 bp, Zea mays
ggccgcccttttttttttttttttgcgaacaatgcaactagtatttcattttggagttcactcagggaagtgtcatccttttgacatccaatctcgacaagtgaaattacagtaccgctgtgggttgggaacacaaattggcctttacagaaattggaatagctccaccgcaaccttttccatttaaacaggtcatcattgtcacaggatgacaactagtttgacactacttcagcttttgtaagtaaggagatgagaaaatttgtatatctacgaagaacaaggagaaacaatttatatcccaaccaaaggaagagataattaggagttaggaggacttgaactgtaggtacatcatagagatacaataaactgaggggcctcaaggtcaagttcctgtttcatgacacagctcatgaaccagtcactgctgaatgttttgatgccactttttgctgcaaccaatgcaagttctgcctcctcttcacacaccaaaaagattgtccgggacagctcatctaactcactcagtttttttatgatcttgcctccggtagatttaataatggctgagagaacatcaaaagagggctggatgtactttgacagacagaaagtataaccagcaaataaagagttaggcctttctttagctctcataactgcatctctaagttgagacttatattgcatcctatattcttcatcttccagaacatattgtgcttctcctacaaactgcccttctctgaagctttcttttaaccagtttggggaaattatccaagcaccagagcacaaagcaatacagaaattcatagtcctgcgagcttttccaagtaacaacatgtgtgcatgaatgtccatcgcaagtaacaaaccccctaagtgtttcaacaactttgtaaggcgtgcc

SEQ ID NO: 2412 - DNA, 941 bp, Zea mays
gataagagagggtccctcgaggccggccgggacgaagcacacaacaaacctgcagatcccccatggcaggctccacctccctcgttccccttcccgtccccgcccctccatctcgccaccgcttccacacgtccacgtccgcatccccccgccacctgcgcccctcccctgctacacgcctccgcgctgcccggcgtcggcatcccgacgccgtcgttgtcgtcccagatgcccgcccctgggtcggcgatctatcgggcgccgccgcgtcctaccgggacggaagtgaggaggacgaagacgacgcagatgaagatgaggacgaagacgaggaccgcagcctggacctactggcccggttcctgcactccgtattcaggaaggcctcacgccgcgcgcgccgcgctgccaggtccgtgctgccgccttccgtccccgccgagctggtgaagttttcggtcaatggcgtgcttgtcctgacgttcttatggatcctgaagggtcttctcgaggtggtctgcacatttggaagcatggtgtttgcaagcatccttcttgttcgtggtatatggtctggggtgacatacatcagagaaaaccgttacagctatattcaccggatcgacaacgatgagaaccgatggagcagagtccagactgctggttaatattttgctttccttatctatgaacagacacactctgcgttgacaggctgtatagtacaaaaagaaaagatatggtcagcaagtgcaaactatgatgattgccattgctagacctcgcggctaaggctgtctctagcagtaagcctctctctagcagcgtgcgttatattaatcttctagaccccgtggttaaggctgcctctagcagcgttatcttttttacattctcttttatgcagttttctctgaaaaaaaaaaaaaaaaatttgcggc

SEQ ID NO: 2413 - DNA, 996 bp, Zea mays
cattgggtacctcggggcccccgggccggccgggccccactaacctgcagatcccccatggcaggctccacctccctcgttccccttcccgtccccgcccctgcatctcgccaccgcttccacacgtccacgtccgcatccccccgccacctgcgcccctcccctgctacacgcctccgcgctgcccggcgtcggcatcccgacgccgtcgttgtcgtcccagatgcccgcccctgggtcggcgatctatcgggcgccgccgcgtcctaccgggacggaagtgaggaggacgaagacgacgcagatgaagatgaggacgaagacgaggaccgcagcctggacctactggcccggttcctgcactccgtattcaggaaggcctcacgccgcgcgcgccgcgctgccaggtccgtgctgccgccttccgtccccgccgagctggtgaagttttcggtcaatggcgtgcttgtcctgacgttcttatggatcctgaagggtcttctcgaggtggtctgcacatttggaagcatggtgtttgcaagcatccttcttgttcgtggtatatggtctggggtgacatacatcagagaaaaccgttacagctatattcaccggatcgacaacgatgagaaccgatggagcagagtccagactgctggttaatattttgctttccttgtctatgaacagacaccacactctgcattgacaggctgcattatactaaaggaaaagatatggtcagcaagtgcaaactacgatgattgccattgctagaccccgcggctaaggctgtctctagcagagcagtgtaagcctgtctctagcagtgtcctttatattaatcttctagaccccgtggttaaggctgtctcgttatcttttttacattctcttttaaacaattatctctaaaagattctatcttctatctcttctaaatctcgtcctctatacatatatataactatattaaatgtatatattttttctttt

SEQ ID NO: 2414 - DNA, 1356 bp, Zea mays
cttcttgggacggacctccgtcatacccctcgccgcccatttcttgcgagcactttggtcagttggtcttctctctcggatcgcggttggggggttgcggaatgggagcaaaggcggaggagtgtgaggtgccgccgctggctgcgaacgcggaggaggcagcttccaccaatcagtgcaccctcatcttcaaaggctgttccaacagcatggaaaaagtctacgccatcagcagtcctagtaagaaaagaaaatcacagtatgagctgagtgatccaaagttgctaccacttaaatgcaagtttcgcaaacggttatattgccaggatgatgagtctgcaaccacagaaagtttaggatatgatggtattttcatgaacaagacctctgggacggacatggtcagcatacctgaagaattggactcttgtgagaacactataagcctgttttgtgggtgcattgaagttgactcaaaaaatggaattcaggaacaatctttgagaaaaatgtttgagatccggacatctgcatccagtagctcgagcaacaatttttcatcagaggcttttagttcttcccatagcagcggcacgagagacactgacagctgggctatggacgatatagagcgtcatcatccatatgtgatgctgaaaccgcataatgacgaccttgaaaggatattcaacgtgcttgaacagtatgatgacctaatggaggacgaactaatggctggcgatgtttttggttctgctgctcaggtcatggatgaaaagctttactcgaatagcgttgacgattttcagattttgccaacaggtcagactggctatcacggtgagaagaagctaaccatcgatcaagaatttgagcagtattttgcgaacctcatgctgtaggatcgagtggataattttgtgacagaaatggcgttgcgacatccaaacatggtttgcttgctgagcaaagtggcgaaccttggctaccattggagctatcgttctatggtgctgtttggtaacataaatggtaatgataataattcacacctgagtaccaacgacccgagtaccaacggtaacaagtttaaataggtcgatattagttcttagtgtggtatctgattacgattggatttaaacaaacataatttaatgtttatcggttacttattacattacaaatatgtgaaccaaacggcacatatttgtacaccgagtcctatcacttaatgtatatacgtgtgaaatgtgttcttttccagcttgtccatcaaatgttggcatcatgatgtatgttaacgtgtgcagataagaacatgtctatgcaatatagtaatagtgcattccttct

SEQ ID NO: 2415 - DNA, 1079 bp, Zea mays
cctcgaggccggccgggccgggatcaggagacctgcggagtcgcatttcgcgtggtcgagtccgtccgtgtctgtcctccgctgtccgctggctgcgatagtgctgcctgctgctctaacccaatccaaggaggatgccgaggagcccgcagctgagcctgagcggctgcagctctctcttctccctgtccagcaccagtacgagccgcgacagcgccgccctgaaggcgccggtgccagcgccaccggcaggcgcggtgcccccacggcgcacccctctcctgtcgctcagcgtcggcgaggaggaagaggacgagggtgaggacgaggaggagtacctgctgggggccggcgccctggatctgcagctgacggggcccggtggcggcagcaacagcagcggcggctacgacgacgagcggaagaacatccggatgatgaggaacagggagtctgcgctgcgctccagggcaaggaagagggcctatgtgcaggagctggagaaggaggttcgtcgcctggtgaatgagaacctcaagctcaagaggcagtgcaaacaactgaaactagatatggctgcactggtccagcaaagcagcagcaagagcagctcccacatcagaagaacctcctcatccactcagctctaggctgctaccaataggaatatgtatgtgaatttaaagccatatatgaccaaggaagaatgggaggaagacgaacaaagctagctagactagactgcagcccctctaatccatggccattcgctgattaatacgataatatctcttatttgttggcttcttctagcttgcttcaatttcctagtacagcagtttatgtagtatttcctagattgttagcgcaaagctgcctttttcacccatggcatccactctagtggtgtccaggtagtgtcgatccaattttagtatagaggtcactcaaacctctctccatgacagagctttttattcgtttcctgtcttttttttattgttctaatcataataagatacgcacacattcacctgtaaaaaaaaaaaaaaaaaaaactcgagactagttcctcgtgc

SEQ ID NO: 2416 - DNA, 815 bp, Zea mays
gctggccgggatccatctcagtttccaaggtaaacttcagagaagcgacgaaggtagacgacgatggcggtgtcggtggagctgcccaaggagtacggctacgtggtgctcaccgtggtggcctacgccttcctcaacttctggatgagcttccaggtcggcgccgcccgcaagaagtacaaggtgttctaccccaccatgtacgccaccgagtcggagaacaaggacgccaaacccttcaactgcgtccagagggggcaccagaactcgatcgagatgatgccgctcttcttcgccacgctgctgctcggcggcctgcagcacccggtcgtcgccgccgcgctggggctcctctacaccgtcgccaggttcttctacttcaagggctacgccaccggcgtcccggagaaccgctacaagcttggggggctcaacttcccggcgataatggggttgatcatctgcacggcgtcgttcggcatcaaccttgtcatcagggaagcgatctgaggctccggactgatgcctgacttgatagccgttgtgactggatcactggagtcatttcggcgtggtggtgatgatgtcttttgaagtgtcaaatgtgtgtgtgcgtttgttttactctcagaataaagctggatggagacagttttgcagtgcagattttgatacagtttccgtaaatctccttaccaatttccttgtgcgacatctgcggagcatgttatgctctcgttgtaatctccggtgacgttgatgttgttgtgcacattcctttttgagacaatctttaagccccttcagcctgtgtc

SEQ ID NO: 2417 - DNA, 1032 bp, Zea mays
ataaaagatgtgcctgtccactgtgactcgagagtccagaccatagcctgcagccacgaactcccgttctccatttccagccatggcggtgtcgatcgagctcaccaaggagtacggctacgtcgtgctggtgctggtggcctatgtcttcctcaacctttggatgggcttccaggtcggcaaggcccgcagaaactacaaggtgttctaccccaccatgtacgccatcgagtcggagaacaaggacgccaagctcttcaactgcgtgcagagggggcaccagaactctctagagtggatgcccgttttcttcgtcatactgctgctgggcggtctgcagcacccgaccatcgccgccggtctgggcggcatctacatcgtcgcgaggttcttctacttcaagggatacgccaccggcgttccggacaaccgtctcaagattggggggctcaactacttggcgttgcttgggctgatcatttgcacagcatctttcggcatcaacctgctcatcagggagatgctctaaactttgggtttatatgtgagctccaggctgggttaaccgcacaagttactcatggtctgagcataaaaactttgtgatactagtcgtttggggttttatagtggagttatcgtttctttctttgtctgtgtgttgattagcaaaagaagtgtgcgtctgcgtcttatagctgtgatggaataagaggagacagatgggttgaagcgtgaatcgtacagttcttgctgcttgtcactctctgatctggtttcgttgtagatgagatggttgttaatggtttgtgtttgaggcacgatccgccttattttctaccgatctaaagccggggtcgtaccaattttgaattattctggttttgggtttatgtttatgcgatgtattggctggtagcagttctgcattgactgcatatcaaccttaatcagctggtaccagttcttggactactttacattattcttaaaaaagccaccaaaaaaaaaaaaaaaaaaaaaaaattattc

SEQ ID NO: 2418 - DNA, 3014 bp, Zea mays
  misc_feature (1262)..(1262): n is a, c, g, or t
cggatagcgggtaatcattgccatctctactctatgtagcaattcgttgagtcatctctctttttttcaagagaatggttctttccctcacatgtgacagcggaataatccaacacagtctaggtcctgtcaccggagtaaagtaaaacggcccagctgggtcaaagctttcttgggccggagggcagtttaagttctggaaccttctagacgcctcccctataaaagatgtgcctgtccactgtgactccagagtccagaccatagcctgcagccttccatccacgaactcccgttctccatttccagccatggcggtgtcgatcgagctcaccaaggagtacggctacgtcgtgctggtgctggtggcctatgtcttcctcaacctttggatgggcttccaggtcggcaaggcccgcagaaagtaagctctccgaaatctgaatcgctcgtcgccattgttgtcttcgtttgtctccgcccaacttatttcatcaacggacataataatatgatggtttccgcggtgattcttctttaggtacaaggtgttctaccccaccatgtacgccatcgagtcggagaacaaggacgccaagctcttcaactgcgtgcaggtgcgcccaagattctgacatcctctcccctcccccgtgattaattaattgctcttgtgaggggttgggactttgggaggcatctaaatttccgctggttcttgtggttgactgcagagggggcaccagaactctctagagtggatgcccgttttcttcgtcatactgctgctgggcggtctgcagcacccgaccatcgccgccggtctgggcggcatctacatcgtcgcgaggttcttctacttcaagggatacgccaccggcgttccggacaaccgtctcaagattgggtaagtttgcttccgtagtgaggctttgcgtcagatgcagaagatgctgataaaattatgagatctccacgcacttgcagaaaacgtaaatcatatagcggagaattaacagagtttaacctgtttcggtttgttttgcaatatcagtctccaactctccatgaaaatgtagagtaccggtagtcgtatactcgtacaaatcgtctccaccaattgcactctacgcctttaaaagtgaggcacacgttatcacacaatttctttttctgccttgtttacgtggtacgaagcttctgctatattctatggtttcctgaatgctggtagtgggcaggtagccagtgctcgatagtcngtaacggtagttaacgatagcggaaccccattaaggtttatgaattcatttattgatgaattcatctgttgatgcatcaagtgactgttgaaatggcgcatgctttttagaaattttaattgagcctttgtgctgaatttctgcaccatagcgtccttctttttccccctcgaggccctagctagctacttgtctggtcaaactgtccagcctctcaatgttcacacaagtcattgctgtggcctgagactttgtggccggttacaccggtaggtgaattgtaattcacatgtttggaccacagctgatttgatttgctacgaggtcagtcaaccgctgttcagcatggtcagtgggaatggcaaattgtagtcctgtagggtttgtcctgacctaaccacttctggtttaggtagaatgtcctcagatgagtaatacaaggatggcgtgtgctaaacggttcctctgaaagtttgtggcttgcgatgcccactaatgatgtacattcggtcaactctcacctaatgatgtggagtagccttaaatgtctgttgattttattgcacactttttaagttgttcaatgtgcttctgttgattttattgcacactttttaagttgttcaatgtgcttctgttctcttggcactcaactttgtcaaaaaattctagttcaaataattcaggtcctgtttgttcatattttatggcagtaccttgctttgcagtattagcttcaccatttgtagctaacttgattgttcgagcatatggccatacaaaacactattttacgctgaatattgctttgtttatatagtggagtttaaaataggagatttggatgagtaagctgctgaagataaccttagacattgcaaattctaatcccacctggctgcctttattagtgactatcaggaagccctctgatttgtgttgcatgttgtggtccccacttgaacgagaatgttatctgaagttgtagcaaatgacatctgttagatcacacattcacacctcatcattgttgctattaattcatgccatctatcattagtagtggtcgcaagttcctactgattgagttccttgtcgtgcgaggttggggggctcaactacttggcgttgcttgggctgatcatttgcacagcatctttcggcatcaacctgctcatcagggagatgctctaaactttgggtttatatgtgagctccaggctgggttaaccgcacaagttactcatggtctgagcatcaaaactttgtgatactagtcgtttggggttttatagtggagttatcgtttctttctttgtctgtgtgttgttagcaaaagaagtgtgcgtctgcgtcttatagctgtgatggaataaggagacagatgggttgaagcgtgaatcgtacagttcttgctgcttgtcactctctgatctggtttcgttgtagatgagatggttgttaatggtttgtgtttgaggcacgatccgccttattttctaccgatctaaagccggggtgtaacaattttgaattattctggttttgggtttatgtttatgcgatgtattggctggtagcagttctgcattgactgcatatcaaccttaatcagctggtaacagttcttggacttctttatattattattatactagagagcaaaccacacacttcagagcatctccaaggaaaaactcgtgcatagctctctatttaacgcttattttctttcaataaagattacactat

SEQ ID NO: 2419 - DNA, 1050 bp, Zea mays
  misc_feature (1023)..(1023): n is a, c, g, or t
catataaaagatgtgcctgtccaccgggccgggagagtccagaccatagcctgcagccttccatccacgaactcccgttctccatttccagccatggcggtgtcgatcgagctcaccaaggagtacggctacgtcgtgctggtgctggtggcctatgtcttcctcaacctttggatgggcttccaggtcggcaaggcccgcagaaagtacaaggtgttctaccccaccatgtacgccatcgagtcggagaacaaggacgccaagctcttcaactgcgtgcagagggggcaccagaactctctagagtggatgcccgttttcttcgtcatactgctgctgggcggtctgcagcacccgaccatcgccgccggtctgggcggcatctacatcgtcgcgaggttcttctacttcaagggatacgccaccggcgttccggacaaccgtctcaagattggggggctcaactacttggcgttgcttgggctgatcatttgcacagcatctttcggcatcaacctgctcatcagggagatgctctaaactttgggtttatatgtgagctccaggctgggttaaccgcacaagttactcatggtctgagcatcaaaactttgtgatactagtcgtttggggttttatagtggagttatcgtttctttctttgtctgtgtgttgttagcaaaagaagtgtgcgtctgcgtcttatagctgtgatggaataaggagacagatgggttgaagcgtgaatcgtacagttcttgctgcttgtcactctctgatctggtttcgttgtagatgagatggttgttaatggtttgtgtttgaggcacgatccgccttattttctaccgatctaaagccggggtgtaacaattttgaattattctggttttgggtttatgtttatgcgatgtattggctggtagcagttctgcattgactgcatatcaaccttaatcagctggtaacagttcttggacttctttatattattattatactagagagcaaaccgcgcgattnagaacaacgggggccctcttaagggcc

SEQ ID NO: 2420 - DNA, 1323 bp, Zea mays
aactgcgtccccccagggcccggccgggtgccgatcaaataaatcatgctcgcgaagtaaatccaaaggtgagacgcttccccttctcctcgccgatggagtcgcttgcctcgcaagcgaggccggcggcggtgctctggctcgccggcttcttccaggccgcgcgcctccaccgcgttgtctccttctgcgccagctcgagggcactatccatcaggattgcacagtgcttcctgctgaacgggcttatcttccttgggagcttgcttacacttacatcggtggtcattccaactctactgtggatactacctgagcgatgcaatcaaacagcaggacatctttgtgaacacagggcagccatatctatctattcattcttgcgctccggccttgttgagattttttatgtattttggttttatccactttatgtcttcagcttcatattaagtacgatttggtataatgacattgccaagcatgcattggatgttgtgaaaagtaagagcctagttttgactcaatcactggatgctcacaacgtaactgaaacaaaagagcagcctgaaggatttgacagggttgcacttggtattggggaacaagtctattcaattcttcttttaaccattttctttgttgaggtttcagtgattggttacataccttactttggcaaggcaatgaacttcctgctcctgtcattgatgtacaagtggaacttctttgcagtgagtctgcatgagaggcttgatttctttgaatcaaactgggcgttctttgctggatttggtgctccatgcgtccttccaattttcttcttctctcctcttataagctatgggtttctggctatactttatccgttgtttgtcttgactgccgcaggcactcaagctgagcaagtaattgatgcactgaaacctgcacaccgagggaaactacaaagaatacctgtgttctttgtcgcaaagcgactgacgacaaaagtactgcaactgtttccggtggcacagaaagaacaatgaaggatccacagaaacaaaccaaggagggaaggccgctgtgtgtgttcggtgtgctgctaatcacaatgccctgttcgaacgaacgttgcatccgtaaggtgcgcacgccctctccgctctccgtaacgtggaagggaggggcttgccgccttgacgctgtaaatatcctgtaacatcgcccttgttacaagcatttctgtcgaaatgggaactttgaaaatatagagaattgcactttgtacaaatggttgtctacgtacaaattgcaccgtgtccttttcccgacccttcc

SEQ ID NO: 2421 - DNA, 1288 bp, Zea mays
  misc_feature (1279)..(1279): n is a, c, g, or t
acgcaccgtccggtccgccgctgcgttgcctttgccccctcctcgaggctagccccgcctcgcgggaggagatggactgctgccggcacgtgaacccgttccgcgcctgctcggggctgcgcgggctgggctacctcatggtggcgctcgtcgccgccatcgtcgccgtgtcctactacgccgtcgtcgtctacgcatggggccccatgctcctcgccgggggagcagccgcggcaggtgctgccgccgtgatcgccgccttccacatactcggatcttgtttcttctgcagcttgcaatgattctttggtgctatttgatggctgttttcactgatcctggtgctgtacctgaaaactggagacatgatgctgaagatagcgggaacccttcattttcctcttcagatgagcaagaaagtgctcctagatattgttctcgctgtcaaaatggcaaacctccccgatgtcatcattgttctgtttgtaacagatgtgtgcttaaaatggaccatcactgcatttgggtagttaattgtgttggagcaaggaactacaagtattttctcctttttctggtgtatacatttatcgagactgtgctggataccttggtactacttccaaacttcattgaattttttcaagatgaacataggcgttccagctctcctggggatattgctattctatttcttgcttttgttctcaatttagcatttgcgctgagcctcctctgtttcattggcatgcacgcgtctcttgttacacgtaacacgacttctatagaggtctacgaacggaagaagtcggtttcatggaaatacgacctaggatggaaacgaaacttggagcaggtctttggtaccaaaaagttgctctggtttgttcccttatactccacagaggatctgcacaacatccccgcgcttcgaggcatggagttccctactcgctccgacgcaatcgtctaattgcatgtgatgcctagcagagtgttctatgccatagggtttgtctcacgtttacactataggatttctatacggagatctgttaattcttttctgtacagaaatgcacacgcagttctttcgtgtaccagctgtaaggaccagacatgtatttacacaattctgttaattctttggttggtttatattttagacaaattattttcctccaaaaaaaaaaaaaaaagggggggcggtgtaaggagtccaagctagcaagcacgggcatagcggcgtggggggggggggtggggggggggggggggnggggggggg

SEQ ID NO: 2422 - DNA, 1316 bp, Zea mays
  misc_feature (807)..(807): n is a, c, g, or t
  misc_feature (1203)..(1203): n is a, c, g, or t
cattgggtacctcgaggccggccgggatgttttctctcaccgggcatcaagaaactgtcactcgccgctgggtccgcctagtcagcgacgcaccaagcccagcaagcaacagtccaacagccaacaaccagccagcgcgcgccgccaccgacacgcaccgtccggtccgccgctgcgttgcctttgccccctcctcgaggctagccccgcctcgcgggaggagatggactgctgccggcacgtgaacccgttccgcgcctgctcggggctgcgcgggctgggctacctcatggtggcgctcgtcgccgccatcgtcgccgtgtcctactacgccgtcgtcgtctacgcatggggccccatgctcctcgccgggggagcagccgcggcaggtgctgccgccgtgatcgccgccttccacatactccttgcaatgattctttggtgctatttgatggctgttttcactgatcctggtgctgtacctgaaaactggagacatgatgctgaagatagcgggaacccttcattttcctcttcagatgagcaagaaagtgctcctagatattgttctcgctgtcaaaatggcaaacctccccgatgtcatcattgttctgtttgtaacagatgtgtgcttaaaatggaccatcactgcatttgggtagttaattgtgttggagcaaggaactacaagtattttctcctttttctggtgtatacatttatcgagactgtgctggataccttggtactacttccaaacttcattgaattttttcaagatgaacataggcgttccagctctcctgnggatattgctattctatttcttgcttttgttctcaatttagcatttgcgctgagcctcctctgtttcattggcaggcacgcgtctcttgttacacgtaacacgacttctatagaggtctacgaacgggaagaagtcggtttcatggaaacacgacctaggatggaaacgaaacttggagcaggtctttggaaccaaaaagttgctctggtttgttcccttaaaccccacagaggatctgcacaacatccccgctcttcgaggcctggagttccccactcgctccgacgcaatcgtctaattgaatgtgatgcctaacagagtgttctatgccatagggtttgtctcacgttaacacaagaggatttctaaacggagatccccccccccttttctgnacagaaatgcacacgcagttctttcgtgcaccagctgtaaagaccagacatgtatttacacaattctgttaattcttgggttggttaaaatttaagacaaattattttccccc

SEQ ID NO: 2423 - DNA, 2937 bp, Zea mays
  misc_feature (2839)..(2839): n is a, c, g, or t
  misc_feature (2853)..(2853): n is a, c, g, or t
  misc_feature (2889)..(2889): n is a, c, g, or t
  misc_feature (2903)..(2903): n is a, c, g, or t
tgggtacctcgaggccggccggcacggagggagcaccagtacccaatcctcctatccattcatctcgccccgcctcggccatggcgccactgccagcaccaccgaccgcggcctccgcctccgcattcctcttctccccgccgcgaagtccgagccgctacctgcaccccaagcccaagcccaccgccaccatcctctgctcttccacctctgccgccaccgccgccggctcagcatcgccctccctctcccagcagttggagccgctctcccgcacgctcctccacgacaagcccactccgatcgcggaccgccccaccccggagcccacctgggtgaaccccaccaagcctaagcccagcgtgctctcgctccgtcgccaccgccgccgttcccctcccgcgaacacttcctccacgccgctgcagccgctgctgcgcgccctccgcgccctgcccgaggatgccgacctcgcgggcaccctcgacgccttcttcctgcagcagcaggggcagggtgcggcgccgtccccctccgacgcgctcctcctcctcaactacctccacccgtcgtggcgcaagtcgctgtccctcctcgcctggctgcgcgcgctcccagccggcgccttcccgctggacaccatcttcttcaacgtcgccctcaagtcgctccgcgccgcgcgccagtggccgcacgccgagcgcctcgcgctggacatgctcgacgcgggcgtgcccctcgacaacatcacctactccacgctcatcaccgccgcccgccgctgccgccagttcgccaaggccgtcgagtggttcgagcgcatgtacgccgccgacggcgtcctgccagacgaggtcacctactccgccgtgctcgacgtctacgcgcagctcggcatgaaggaggaggtgctcgcgctcttcgaccgcgccaggggcagcggctggaagcccgaccacgtcgccttcgccgtcctcgccaagatgttcggggaggcaggcgactacgatggcatccagttcgtcttcaaggagatgcgggaggtcggcatcaagcccaacatcttcgtctacaacgcgctgctcgaggcgctgggcaagaccggcaagcccggcctcgcgcgcaacctgttcgaggaaatgatcgaccagggcgtcgagcccaacgcgcgcacgctcaccgcgctcgcccaaaatctacggcagggcacgctggggccgcgacgcgctccagctctgggacaagatgagggagctaaagctacccgccgatagcatcctctgcaacacgctgctgagcatgtgcgcggacgtggggctcgtggccgaggccgagcagctcttcaacgagatgaaggatccggagtgccgcgacgtcccaaagccggacaagtggagctacacggccatgatcaatatctacgggagcaacggggacacagacagtgcgctccagctgttcgcggaaatgctgaagggcgggatagagcccaacataatgagctacaccattgtcatccaatgcctcgggaaggcgcataggatacagcaagcggtggaggtgcttgagtccgggctggagaagggtctcaagcccgacgatcggctctgtgggtgcttgctctctgtcatcgctctgagcagcggggaggagatggaaatggggctctcctcgctgcccacgcgtccgcagaacctggtcaagctgatcagagtgctcggcgacgcccaggtcggtggtgacgatatcacagaggagctgaagagcgtgctgaacagcgctgcccctgaagtacgccgtccttactgcaactgtctgatcgatgtatgccgcaaccacggcttccctccacagagggcaagggaagtcttccaccttgcccagacctatggtttgtactccaagcttcagagcaggaaggacgaggagtggtcgctggacctgcggtcgctctcggttggtgcagccaagacagcgtttgatgactggatgcagactgtctcggagcgctgggcgcagcagaaggacttgccagagtccttcagcgtgtacaccggatccagcacccacaagtttgcgcaggggctggcaagtgcttttgccgctcatctggaccaaatggcggtgccattccatgcgagcgaatctcaagccggcagcttcatcagttcaagagatgatctggtctcttggttgcagatgagcaggtcgtccgcagtcgttgccggatgaggcgcagtggttgtggctgcataatgctccaaattccaaaggaaagaagggctcagtgagcaaactgggtgatcatgcatttgttggcatgcagtttgtatgaagagaattggaagtctgaaacgcgtagattagacggtagcaccaagccgctcttgaaacattggctgattgtcagacttacactgctggttctgtttctgaaattcaaatgccacttcttaaattccattatatcctggtggaagaattgtatagtttttcctccctgcacacaatgtgccgatttggctactactagtataatactaccgccttggaagttggaattgactagagtttcatcacaaatgattggaagaactgctatttccattgatctcgtgtgtgtgtgaaggagtgtgttgaacagacatgctcctttggtgacatatgaaactgcctaatcctaacaactaacctatgattaaatggacgacatcatctcttgaagagatggagatgcctgttagtgtacagccatcatttcacaacagatttgactccaccagatttgtgcccttttctttctattactacagagatggtttagttttgattggtctgntctctacacaacangtttacatatagggcggcagggctgtaatgttacanctgcaacagttttngtacccaaaaaaaaaaaaaaaaaaaaaaaaaaaa

SEQ ID NO: 2424 - DNA, 1512 bp, Zea mays
cgtcaccctagatatactgtatgactcgtggtccccagcgatgactgtcagttctatctgtatcagcatattatctatgctgtccagctcgccagaaaaggttacatattttctctacatcaccttgttgaattggtgggtcttgcttttgactgcagcacgcgatgctgtccagctcgccagaaaagcaacgcccagctgataatgatcgctatgtcaagaactgtcgcaatgggaggtctccgaaagagaccaggtggtggttccatgatgacaccgtgtgatcggtgttccgattattgttgtcctgtatgcatttagttgccagactatatgggagatggacttatttcgaacgacccatttgaccagaaattaacatgctcttgtggtttgtagatgaatgtgcatcagcgtcaggcctgtactttctgattcttacaccgtcgatgatatatagaataatgtttgtatcttgtcaatttacggaacagacatgaaattcaatgcaggtcactggtttctgaatccttctacttgtatgcttggtattggtagtctgccccagatcgacctgctgtagctctagttccacttcagggcttgttcgttatgatgctaaaccatatgaattggatgagattgagtcgttttaaatccataacaagttaaatacatctcaatcccacacaatacacttcaatctacatggaattaaaataaccgaatcattcgaacgtttggtaacgcttctcgctggacgcctcggaccagagctcgtgtgggctacgtgacggtgcgatcagttctatgtatgagtattgcgaagttccgtagttattctatttagctgctttgataaatcttagttatatctagtaccaaactacaaatccgctatagtcgagtagcatacgcgaatattgaacatgccgctgcagtaacattcataacataaatttaacatacataaatgttgaaatctctataataacattcttaaaacttgtttgcaagaggtaaggggtgagttcatatcaatcaatttatagcaagaagtaaaataattctttttattaatttttttaacaaaggtgtcttgaaggttctatgattataattattttcgttaatcgtttttattttattaagcaaactatcataagcatcattctttttattaattaaattgttttaaacaaaggtgtccttgaagattctacacttatcattatatttgttaaccatttttattttattaagcaaactatcataggcatcttgacatctcgagggggctagctaactttgtttttactttgtcatttttctttataagatactcattggtagatatgtttgcactagcttctaattgcttaattttattagatgactcaacagttagaattaccaaaaaaatcatattattatagcaaattttgataactatttttaattgagtcttttgtttagtgcaaacttctttaaagaatttagcggcgtgcacaa

SEQ ID NO: 2425 - DNA, 1112 bp, Zea mays
cattgggtacctcgaggccggccggcgcgcggtcaggtgtccatctatgcctctgtctggccctgccgcgccgtccgcacgcgcgcgcacgacgcacagtcacagatagatacctttcctctcttctcccgtccggccgtcccctcttccgcggcaaccccggcgcggcatggcgagcccgtcctcctcctctttcccgtcccggaaggccctgagcaagatcgcctgcaggcgcctgcagaaggagctaacggagtggcaggtcaacccgcccgccggcttcgagcacagggtcaccgacaacctccagaggtgggtcgtcgatgtagccggggcaccaggcacgctctacaccggcgagacctacaaactgcaggtggatttctccgagcattatcccatggaggcacctcaggttatatttctgcatccagcaccgatgcatccacacatttacagtaatggacacatctgtttagatatattgtatgactcgtggtccccagcaatgactgtcagttctatctgtatcagcatattatctatgctgtccagctcaccagcaaagcaacgcccagccgataacgatcgctatgtcaggaactgtcgcaatgggaggtcaccaaaggagaccacgtggtggttccatgacgacactgtgtgatgggtgtttccggctgttgtcctgcccgcattttagttgccagactacatgggagatgatcttggcatatttcaagcgacccatttgaccagaaactaacacgctcttctggtttgtaaatgagtgtgcatcagcgtcaggtctctgtacttgttgacccttacaccgtctatagtatgtagaataatgtttgtatctttgtcaatttacggaacagacatgaaatgcaggtcactgttgacttgcaagatttctgaatccttctagttgaaagttgaaacgagggttatatatgcttggtagtctgctccagatgcagcagctttagctctagttccacttaactctagctcaaactatggcagagctcttttgggagtggctgtgtgatcgtgtaataatatatctgttgtgtgagtattgcaaaaaaaaaaaactcgaagcggcc

SEQ ID NO: 2426 - DNA, 972 bp, Zea mays
ctcgaggccggccgggccaacaggacaacgcagcagccgctgccgctgccgctgccggctgccgctacctatgctcaagtgctcagtgctcactgctcaccgctctgcccctgcctcatcacacgcgcgcacggcgcacagataccttttctctcctctcccgtcccactctcctgggcaatcccggcccggcatggcgagcccgtcctcgtccccctcgcggaaggctctgagcaagatcgcctgcagccgcctgcagaaggagctcgcggagtggcaggtcaacccgcccgcgggcttcaagcacagggtcaccgacgacctccagaggtgggtcatcgatgtagcgggggcagcaggcacgctctacactggcgaaacctacaagttgcaggtggatttccccgagcattatccgatggaggcacctcaggttatatttctgcatccagcaccgatgcatccacacatttacagcaatggacacatctgtttagatatactgtatgactcgtggtccccagcgatgactgtcagttctatctgtatcagcatattatctatgctgtccagctcgccagaaaagcaacgcccagctgataatgatcgctatgtcaagaactgtcgcaatgggaggtctccgaaagagaccaggtggtggttccatgatgacaccgtgtgatcggtgttccgattattgttgtcctgtatgcatttagttgccagactatgggagatggacttatttcgaacgacccatttgaccagaaattaacatgctcttgtggtttgtagatgaatgtgcatcagcgtcaggcctgtactttctgattcttacaccgtcgatgatatatagaataatgtttgtatcttgtcaatttacggaacagacatgaaattcaatgcaggtcactggtttctgaatcaaaaaaaaaaaaataaattaaaaaaaaattaaaaaaatattaattt

SEQ ID NO: 2427 - DNA, 1155 bp, Zea mays
cattgggtacctcgaggccggccgggggctcccccggccccgccccccgcacgcgcgcgcacgacgcacagatacctttcctctcttctcccgtcccctcttacgcggcaaccccggcgcggcatggcgagcccgtcctcctcctctttcccgtcccggaaggccctgagcaagatcgcctgcaggcgcctgcagaaggagctaacggagtggcaggtcaacccgcccgccggcttcgagcacagggtcaccgacaacctccagagttccttggcggcggcagctagctcacgtcccggcgaaccctcgtcggtggccaagggccgttacaggatgaaacaacaacaaaaaaggtgggtcgtcgatgtagccggggcaccaggcacgctctacaccggcgagacctacaaactgcaggtggatttctccgagcattatcccatggaggcacctcaggttatatttctgcatccagcaccgatgcatccacacatttacagtaatggacacatctgtttagatatattgtatgattcgtggtccccagcaatgactgtcagttctatctgtatcagcatattatctatgctgtccagctcaccagcaaagcaacgcccagccgataacgatcgctatgtcaggaactgtcgcaatgggaggtcaccaaaggagaccacgtggtggttccatgacgacactgtgtgatgggtgtttccggctgttgtcctgcccgcattttagttgccagactacatgggagatgatctaggcatatttcaagcgacccatttgaccagaaactaacacgctcttctggtttgtaaatcagtgtgcatcagcgtcaggtctctgtacttgttgatccttacaccgtctatagtatgtagaataatgtttgtatctttgtcaatttacggaacagacatgaaatgcaggtcactgttgacttgcaagatttctgaatccttctagttgaaagttgaaacgagggttatatatgcttggtagtctgctccagatgcagcagctttagctctagttccacttaactctagctcaaactatggcagagctcttttgggagtggctgtgtgatcgtgtaataatatagctgttgtgtgagtattgcaaaattctgtaattgttctaaaaaaa

SEQ ID NO: 2428 - DNA, 1909 bp, Zea mays
  misc_feature (1)..(1): n is a, c, g, or t
  misc_feature (12)..(12): n is a, c, g, or t
  misc_feature (27)..(27): n is a, c, g, or t
nattattacccnaacagccaacgacanaagggggctttatataaataaaagcacgagacgaatagggcattatcatgtcagcatctcgcgcgtaacgtgccacatgcacaggagcttagaggcccccctgctgcgtgtctcttttggaccaagcaagatgacatttcaggcagtaatttaggtgtacaggattagtcctccacataacgctgagatatgtgcaggtatgcagaaatatcgtaccctttacaacaaaagagtaggggacagaaaccatagcttgaatagcgctcatgatgaagttttgtacagccttaactagatatctaaaggctaccaaaaatctggagttacgattttacgaatacggacagcatcgacatctcattagatggactatcatctctagcatgaacatccaagtgtatatcgaaagttaagaagaatcggcgacaaatagattgcctgtacagggaagagctatcatccatctactctacacgccataaagcttgtataaaccataggccatggagacaaactagtcctccagaatgacgaagcagctcactttggaaaatggtcagttggaatatgtatttagctcaaaacacatgtgcctttttgccagtaatgatttgagaaatgtgaagtcccctgctgaaagcttcattgaacaggatccttgtttgcatttcctgaagcccaggcaaccatgataatacagccacaggtgccataacaattactccaaacaatatgtcatacaaacgtgccacggtaaccacagttttccagaccatctcagatctcctcagatatggcttgaataccagagcaatagatatgattccccagccagtcggcagaaaagccaaaagactagtaaaagtgtcaacaaactgaaactttgtgaattccaacagcacaacaatagcagccacagtgctcccaacaatgattgcctggacaaggcgataccgtatgtgcttctttgctgaatatctgtctcgaaagtaagccactgtcacaagagccacaaaagctaggaggatgcatgtccacgaaagaagatagacaaggatgcttctactattatcagcaatgtgaagccgatatacaattgcatactgaaaaaagaaaaatcgaaggtctaatatgatttccaagatgcagccccatagacctgtcgtccggagatgatcagtttcatcctcccaccacttctcccagctttgatctgactgaactgagatcccaccccggaaccatatccagtttagaaaatcctcaaagtcattaaaattcttcagccagtcaaaaccagagggattaaaaatgaatggagcaagaatccatgatgacacaagaaaccaacttgaaagtgtcagcagaatatacaccaatgtattcccagatgcactgccataagatgcataaagagttaatataacaccaagttctatagctttgatgaaatggctgcgagcatagagcctatagttttcagcaaacttcttatgctccacaacaaaacctctgccagtggctcgatatttcgctcctccgtgaaggattgtcctcccataatagtgtgtctttgttcccatggagaatgtgtagaaaacagatgcaaactgtagctgcattttcatgaaatcccacacagcagtgaggaacccgtgctcaagtgaattttcaataatcatgggtaaagctgtgaacaggcctagctgtatgacgaactgctgattgagaacagctcccagggctgcattattggaagaggaagtgttcttgttgatgtagtcctcaagcccactgagtgcaaggtaaaacgcgcccccatacaaatgcatagacagttagcacaaccatcattgtattgaaatagaacggacgcgtgggt

SEQ ID NO: 2429 - DNA, 2004 bp, Zea mays
actgagtttattcaccaagtgactgaatatgtatatgcacctgatggacacaggttagtggctgcacatgcatagaccatggactgatgaaaaccattggctaatgagatatagtgacggatgagagccactagctaattctatatgtatgtagtcagattagcgagttgcttttggctaatactccagatcagcttttggcaaaaggagggaatggaatcctgacaggcacgcggagacagcgcaagctaatcttaaattgctgtgtgctagctggactggaatcttcatcttgagatctgggttcagatcaccaagtggctgaatatatatatgcctccgcacatgagaccggagcgtttcgaggcatgcaccaggacactggtttagtggctgcatatacaggccctaattcttgtcatgttggttctaccaagtgcaaaacgcagttctgtttatttaccgaccaacgccaatgtttcagctgctactaccctgttcaacatgaaacgaagtaacaaaccttacagctactccatatttctgctcgttaacaagtagaatactaaaaagattgcaaatgctcaattgttgtaattaacacaataagaagaagaagaatagccacagagtcatcaacatttgcagatctaatcgctatccatataagcctctgattatcataagaaatatccacaacacactcatatgggtcagtgtcatgaggacagaaaaaaagatcgaacctcatttaacagtcgttttcctcaaaatcaacgccctgcggatctgagtcatccataaggttccttagacccactctcagatctggcaccccctcctgcaagatggcgcaaactggaaatattggaacaccctgcactctcctcttcagctcctcgtacatctcttcagctccctcttcatctatcttgtttgccacaatcagtgatggccgccgagtcattcctttttggtaatgctccagctctgtgaccaaatcgtgcagctgctcccaaggcgggatacccttcctgccattaagtgtggctgcaaggtcaagcacataggcaataactttggtgcgctctatgtgcctccggaaagcatggcccaggccacggttctcatgtgctcctttgatcaggccaggtatatcagccactttaactgagaagtagtcctcgtaggtcagcctgccaatgttgggcctcagcgtggtgaattcgtagtcagctatctctggttgcgccctacatagagcactgagcaatgtgctcttcccagcattgggcaatccagccagaccaacatctgcaatgctcttcagttccaggataaggatgctctcagttcctggctgcccagtactcaaacgggctatcttctcttgtctgtttgctttggatggccgcatctccttcatgacaaaagcattccccagtccacctttgcctcctcgtgctatgattaaccgctgcccaggtttcgtcatctcagcaacacaatattgcacatcttgttcttccttctcatcctcttcttcctcctcatccatgtcaaactcgtcttcatcctcccaaaattcttcatcctcactttcagtttgatctttttcatctgtcccctcctgacatgaatagattcttacatcacgattagagtttgagaactgaagcttggagcatgtatgaaagtattttggatcctctgagtgactgctgcttccctttacagtgtcatttccatcagtgttatgcttaggggcaatatgccgatgggacaagccaccatcaaaaccttctgccactatattaacaatctggtccaaatctgaagagtgttcttcagcactaggtatatcccagggatccagagctctggttggtttatttactgtcagagaaggttgctcgccttcgacaagatgaatcactgtgcctacaggtacttgtgcaatcttgtcaggacctcttgttcctatctgattcttagaaactcgtc

SEQ ID NO: 2430 - DNA, 1327 bp, Zea mays
ggccgcaggtccgcacccccccgcgcccacgcacactcgtgcgtctctcctcctcctcccccgcgtcgcgtgcgcgctctgcttcccttgccgccgtgtgctgcgagggtcgactgtcgagcgcgcgctgcttgctgctcgcctggccgtcgatgagcatggggcgcttcgtcaactccatggatccgacgtcggggctggaggtgatcagggactggaacggcgtagcccaggtcgtgctccgctcgcccaagggagcctccgcgcgggtgagcctgtgcggtgggcaggtcgtctcatggaggaacgaccgcggcgaggagctcctcttcaccagcagcaaagcaaccttcaagccgccaaatgccatgcgaggtggaattcagatgtgtttccctcagtttggatactctgggacattggagcgacatggatttgcaagaaacaggatatggtccctggatgatgagcagccaccactgaatcataatgataacggaagcaaagtttctgttgaccttattctaaagccatctgaagatgacctcaagtgctggccacattgttttgagttccgtctgagggcctctctttcaaaggatggggacttgtcattgatatcacgcatcaggaatgtcaatggcaagccattcagtttctcatttgcttatcacacatatctttctgtttctgacatcagtgaggtcaggattgaaggtctggagacacttgattatcttgacaaccttagccacaaagaacggtttacggaacaaggagatgccataacatttgagtcagaggtcgaccgagtctacgttagctccccaaatgtagtagcagttattgaccatgagaagaaacactcgtttgtcataagaaaggaaggacttcctgacgttgttgtgtggaatccatgggaaaagaaatcgaagaccatggtagacctcggcgacgaggagtacaagcagatgctttgcgttgatgcggctgctgtggagagagcaatctcgctgagaccaggggaggagtggactgggaagctggagctttctgcggttttatccactaactgcagcgaccatcttgatcatcctgtcagcatctagcgtttattcccattgtagtgctatatatttgcctcacaagagaagtatgggccccttttgtaaatgagatcaataggtagctctgttatcagttagcagctcgacttgatcctggaaccggcacaatttgtgacctgtttttttaatgtgagtattgaatgatagcagcgccttgcttcatgcataatgcaaaaaaaatggcaagatttatcaaaagg

SEQ ID NO: 2431 - DNA, 2256 bp, Zea mays
tttttttttcttctttttgtttttttttttttttttttttttttttttttttctttccaatctcatctcacgactcacgtcaacgagagacagcaacacagtgtccagtcacagtcagtgactgtcaacgctaccatggatttacacctcttttatacaagggtctttgtctttttacgtacacctgtagagtagtaacaagaactaagaagaggggagtatcaatggcaataacgaaacaaaatgaatgaaatgtataacccttccctgtcgcacgctctcactgtgcctgtattttgacccagatcccctcgctggggatgtgcccgttcaccacgaacagcatgtagtaccccggtggcgccagcaccgctgtcgccggcatcgtcaccgacgcgctgaacgcgccggctcggccgcgcaccgccacgttcttggtcacgtcaaggaacagcagccgctggttcatcgcgaacgagtgcgtcgtgaaggacggcgccaccatcgtcaccgacacgtcaccgaggccgccggcgcggccgccacgccttctccgcgccaatgccgggaccaggaaccggatcgccatcgtcgccccgtagcccacggtcgccggcgcgccggtgggggacgggtcgaggatcctcggccggagcatgtcgttggacgcgtcgaggtactccggcgagaaggcctccaggctgaggtcggtggggaactgcacgttgctgaagttgtagtaggtgtgcgggttgctgccgcccaccagcaggcggccgtcgcggaggagcaccgccgaggagtggtacagccgcgcgacgcccgccgcgttctgctcctcgaaccggtcccccggcgagtggtccgggcggtagacgacgggcgcgtacgccggggtcttggcggactcccacccggcggtgccgtccgcggcgccgttgatgatggccacctccgcgccgttgggcagcaggatcatgtcgcccatcacccgcggcgacggcattgtctcgatgacccacgccggcgtggcgtcggtgatcttgatccgcccacacgtcgtcagcgccgggacgaaagcgccggcggtgccgccctgctgcttggtggagttgtaggagcccgccggcgcgccgccgcagaccagcacctcggcctcggtggggttgggtttcagcgggagcagcaccgaggagcccgagctggggtagttccgcgggtcgccgtcgcccagcacggggtacgtccgcacgatcttgttgctgctgtagtccaagaggacggcgcggttgttggagaagatgaaaaggttgccgtctatgttgaggtgcacgaacggataaagattgttctcctcggggtccctcgtctgcaccagaaatggcatcgggatgacggacgtatccgaagggcccgcctttgggtagaactcgtagctgaactgcctccggccgccgatgatgaacgcgcggccgtcggggaggatctggttggtggcgtaccaccggttggccgagagcgcgtcctgcgtctcggaccagtcgcagctctcgtcgccgtcgctgcacgcgggcatggtgcgcgcgttgcggaacccgtcgttccagccgccggtctggacgagcgtgccgtcgggcgcgacggtgcccgaggagcaccaggtgtcggtgaagacgaagagcgggcggaacgcgttggcggcgacgtcgtactcgacggagtgcgcggtgcagtccccctgagggagcacgcgctcccgcgggttgacgcggcagcgtccgtcggggagggagaggttggagtggccgaagtcggtgcggtcgaagatgatgacgcggtcgttgtgcaggagctgcatgtgcatcgccgacaccccgatgctgcgctgctggaggtcccacctcccgccggcgccgctcgcgggcgcaatgccggcgcaggcgcaggcgaggagcaggagaagaacggcgaggtggcgacgggcacggttcttcttcttggctgccaatgcaatctccatggttgatcgatcgatgggacaggcacaggcttgtagacgtaacgatgttgcgtcgtcgtttcagggacaggttttctttgattccgttttcttggttaagtgggggtgtttagctcgttgagcggcgaagtgtatatatatgcggcagtgcccaagcttcgaccaccatttttgctccctgatttttcacacgatatcatttaaacactccagctagctggcgcctttacaatgga

SEQ ID NO: 2432 - DNA, 2140 bp, Zea mays
  misc_feature (1484)..(1484): n is a, c, g, or t
ttcactggccctacatgattgtgatgccattgacttagagtcctttcttcttttgtgtattcacttttttggttcgcatgggtctctcttttgggtctttcacgcaactggaagctggaacacgtcaatcactggaagctggaacacggcagaggtcccgtctgatagctgaacttctactcacgccagtcactcatctatcacaagccctatccgaaattaaaaagtcttatagtgacttgactaggaaaataaaagccaagtcattaggcgtgcacaaattagtattacactatccagcgacaactaaaaagaaacggagggagcagtaacagacaataaatataatattcgagaagggaggaataagactgaagaagaaaggcatcttcctggtaaagcaatactggcagcaggaattccttgccaccgcgtagcggtcatgacattcacagaatctctcctcccgagaggttaaagcaaatagaaacaggggctccctcgggcccgcctgcaaccttctcctcgcccaccttcatctccaaatacatcccatgaactcgcataaatttcttctggcggtgctgctgcttttgcttctcaactatgcatcctatgctgccacatcgaaggaggatgacgacttcctcaaaacttgcccatcgcatcgatgccataagcatggaccagagatccggttcccctttcggcttccaagcctccctccatcctgtggcgcacctgggatgcaattatcatgttctgggcatgacaccatccttgatcatccagttcttggctcctgcagagtgacagcaatatattacaggcatcgtgtcatgaatgtcatcccgccagaggactcatcatcacactgccaacttcagaagcttgttaaaagaaatcaatcaactgatgtgtacacacctgtagtgaatcctgtctcagtacttgtaggatgctcaagagaagcaacaaaccaagatggtattgtcggcccaagctcttgtcgaagcctcattaacaatgcaagccagctctggtacctggtggatccttctacagatatgtctactcttcccatgggctgcgaggttgttgcaaagggaatcccagtaccctacacttacgacaaaaatggtccaaaagatgagacattctccggaaggtcactgttcaacgaaaaggcaaatagagcaatcaattttggtgaaacatcattcaattggaacctcaacaacatcaccggctcttgtcaaaggtgtgaacaggaagggaaacattgtggattcagttcaaacaggcgacaagcattctgcctgcatcacggttctcttgtcctccccagtgcccataatgtttgtggtgttccgttctaagttgtgccatgattgatgtttattagcttagaatcttctgtgttatccaagatcctttcacatccacaagattcatgccaagaaattttaatagttttatgaaantgtactgcaaacaaacctaatgaattctgctacagtaagattcaaagaaatcctgcattttaaacatcctacaaggtttttgtctatgcttaaattgttttgcaaaattcaactgcaataaacctaactctaatggtttcctgctacgatcttgtagcagagctgggtcgctggctgctgctctgacaaagtattgtagatttttgtggtagcttacattaagagtttaagactagtcattcaaggacatcctcacagaaacttaaattattagacgccaatgtcgaattataatcacgatgggtttttttttcttgaacacgcaagagagttgtgtatcattgcattaaaagataagagaacaatacaagggccaaaaagccctacagaaaaagaaaaagacataacactaaaaaaagctaacacttaaacacctactccagagaagaaacaacgtgcctcagcctaggtcatgaccataaactgagagccagacaaacccttagcaccaacaagacaccacaaacaatactcatcctcaactaaagacaaggccctagcgacactaggcggaacaccttcaaaaacacactcgttacagtgccgccaaatacaccaagctcctaaaatcactagagagttgaagacgtttggag

SEQ ID NO: 2433 - DNA, 3918 bp, Zea mays
agttatttccttattagtcgtttccttgttagttatttccttgtgagttattttcttgtgagttgttaccttgttagttatttccttactagttgtttccttgttagttatttccttatagctgctccctctgtggctatataagcatgtacgagatatcatttggaataagaaataagtcagtcctaatctccctctcttctctacaaaccgacggctgaggggtataacctcgccagcgtgacggacagcggctacaagttacgtagccggggtccggccagtcggggatttggtgtccttgacactactcaacccatggttacttgtctaataatattcactcttcatacctgcaggttcacatgtcatcctcattgcaggtaatgctgccactgaaaattctaccattctgattctttttcttttgctacaatacaatacacttttacattgtcattttccaacaataacactataatatttttcaaacaagaaatttggtcatgggacatagttgtttgtcctaatgcagctagctcatttgttttcctttgattcagctacaacatcagtagccacattcgttgttctggtagtcactgcactctatctttcactgaagaaaagatataatgaagcaatacatctcaaagtagaaatgtttctcaaaacatatggcacatcaaaacccacaaggtacactttctccgaagttaagaagatagctaggcggttcaaggaaaaagtaggccaaggtggattcggaactgtttacaaagggcagctaccaaatggtgttccagtggcggtcaaaatgctagagaactctacaggagagggagaagacttcatcaatgaagtagcaaccattggacaaatacatcatgcaaatatcgtccgcctcctaggtttttgctctgaaggaacaagacgtgcgcttatttatgaattcatgcctaacgagtcattggggagatatatattcttgccgcaagagctcctagtaccagaaaaaatgctagatatcgctacaggcattgctagaggaatggagtacctacatcaaggatgtaaccagcgcatcctccactttgacatcaagcctcacaacattctgctggactacagcttcaatccaaaaatttcagattttggtcttgctaagctgtgtgccagggaccaaagcattgttaccttgaccgcagcaagaggcacaatggggtacatcgcaccagagatatattctccaaatttcggtggggtatcatacaagtcagatgtttacagtttcggcatgctggtgttagagatggtgagtggaaggaggaattcagacccaggtatcgagaaccaaaatggggtgtatctaccagagtgggtctatgagagagtagtcactgggcaggacctcacacttagtaagaaaatagctgatcaggagaaagaaacagtgaggcagctggccattgttgcactctggtgcattcagtggaaccccaaaaacaggccatcaatgacaaaagtggttaacatgttgacaggaaggttacagaatttaccaataccacctaagccatatgcctagcctgaaagacatcctatgccataaaacatggaggatatacaccatgttttaggaagcatgaaaagcagttatgcttactttcatgtgcgagcttagtaatgcttagcaatagattacacagtatttggatcattccactgtatcagacacatgaactgtgactcttttaattttcgatgtgtggtaacttaattagagacgtatcacattggatttgatttccagtgttgttcaattattgtgattttccggaaaatatacctgttcggttggctttaatccgtaccggtttctactgtttctttttttctcgaaagcgcaggagaactgcgccccattatatattaagcagaaaaaggggtggccaaaaaagaccaatacaaacggcctccttacggaggccagtaggaagcatacataaatgaatccatcacaccttcttaattctcagctaagggtgctgctaaatggcaaagccccttggcaccagcaatctcccattgtgccctttcctcatccgcggctctaagactcatggtaacactagggctgcacccatcaaagacgcttttcgtcctccgcttccacaaggtccaggctcccagaatgataagggaatcaagccctttttttgtgagtccattagcaatattccccaccgattcctaccagcctagatatgagctaacatctggttgaggagccaaagaatgcagaccagatttccttaacaacagataccagaattccctggagaaagaataggtaacaaggagatgatcgatagtttcatcctcttgatcacaaagagggcacttctcaggatgaatcagccctcttttaccaagcctatctgctgtcaagactctattttgtgcaaccagccagatgaagaagcgacattttggcaaggcccaagttttccaaattttcttgtgatgagggaaaaccacaaaccccaaaaagaaaccttcgtaagcagtctttgctgaatagatgccagtaggaacaatactgaaaacatgttatcgtcaacctcaggctgcagctgccaagctgaagtcatattccacaactggagataatctgttaagactcccaaggtcagcggacccttaatatcatagatccattttctatctgtaattgcctcataaacagtcatgttattgacaatcctcttgggtataacattatacaaacttggagcaaggtctttaattctcttaccatttaaccatttatccttccaaaactttgtatttctactgtttctacaatgtttttgtctctatggattgcagctgcagcagtccaaacagtcggctttaatccaaagcgaacaaatatgttcctttgatttatctgtgctcatcaatgttgtgtactacaacaagtccctgcataactcagaaaggtgttctactcttttatctcttttttttttgtgtttgtgtgtttgtggaacaaggtgttttctacttttcctatttgtggtgcataagagttattataaattcatcatgctgggtaattgataaacaactaaacctcagcaatgtgttctatatgtccttccgatgggccataattggtcaagatgcaaagacactataacctaaattgtgccaggggcgaagccagccttgtaagtcgccaggtcatccactttgctagctagagtttgcactgcagtaatacagtgcgtacagtgattttcaacttcaaaccatcagggtcagacctagctctgcacttgaactatgcatagtttcttattccccacacagccacaccccaagtaacaatgtcaccccgcatataccccaggtttgtgagcgcaactgtcctaaaatctagcaacgtggtatgcaaaagcaaggtgttattacctctgtcagtaacgagtaggaagcgcatccggaaagcggtagcgaccctcaccggagcggaggacggcggcgagaagaggaatacccgttccagcattctgaggcggtgcgcacatcggcacatgagggaattcgtgagacttcctttctggcattgggattggcgacttccttcgtggtggctacgaggtactagtgaaatccgtagccgtagcgcagtttagcgggcggcgcacacaaaaaaaaaagtgcgacgaacagtggcgttgtcggctgtaacaggtggccgtcggcgcgaggagatgtaatttaatggcccatgggcttgatttagcccatgtagaaaagcattcggagttcgaatagggaatattttgttaaaccacaaattatatttaataaatagaattcattgattatttacgacatggcacgttc

SEQ ID NO: 2434 - DNA, 2731 bp, Zea mays
  misc_feature (2705)..(2705): n is a, c, g, or t
ctggttggcaacatctatgatatgaatatatgatcctgctagaccatctatgatataatgattattgtcaagtatatgtaagtatatatatgattaatacttattctatataatattggatgttgttgtatatataacaccaaagaatatgggattctttgattttattttcaatcgtcaagtaagattttttgaactatatcttcaattaaatggatatataaacatatatacttggataatgagtactctccccgtttcgttttatttgttgctggatagtgtaaaattgaactatccagcgacaactacaaagtagccgagggaacactaacagacgataaatataatattcgagaagggaggaataagactgaagaagaaaggcatcttcctggtaaagcaatactggcagcaggaattccttgcctccgcgtagcggtcatgacattcacagaatctctcctcccgagaggttaaagcaaatagaaataggtgctcattctgaagcacttgcaaccttctcctcgcccaccttcatctccgaatacatcccatgaactcgcataaatttcttctggcggtgctgctgcttttgcttctcaactatgcatcctatgctgccacatcgaaggaagatgatgacttcctcaaaacttgcccatcgcatcgatgccacaagcatggaccagagatccggttcccctttcggcttccaagccaccctccatcctgtggcgcacctgggatgcaattatcatgctctgggcatgacaccatccttgatcatccagttcttggctcctgcagagtgacagcaatatattacaggcatcgtgtcatgaatgtcatcccgccagaggactcatcgtcacactgccaacttcagaagcttgttaaaagaaatcaatcaactgatgtgtacacacctgtagcacatcctgtctcagtagttgtaggatgctcaagagaagcaacaaaccaagatgatattgcaggcccaagctcttgccggagcctcattaacaatgcaaaccagctctggtacctggtggatccttctaccgggatgtctactcttcccatgggctgcgaggttgttgtcaaagggaatcccagtaccctacacttacgacaaaaatggtccaaactataacacattctccggaagctcacccttcaacgaaaaggcaaatagaacaatcaattttggtgaaacatcattcaattggaacctcaacaacatcaccggctcttgtcaaacgtgtgaacaggaagggaaacattgtggattcagttcaaacaggcgacaagcattctgcctgcatcacggttcacatgtcatcctcattgcagctacaacatcagtagccacattcgttgttctggtagtcactgcactctatctttcactgaagaaaagatataatgaagcaatacatctcaaagtagaaatgtttctcaaaacatatggcacatcaaaacccacaaggtacactttctccgaagttaagaagatagcaaggcggttcaaggaaaaagtaggccaaggtggattcggaactgtttacaaagggcagctaccaaatggtgttccagtggcggtcaaaatgctagagaactctacaggagagggagaagacttcatcaatgaagtagcaaccattggacaaatacatcatgcaaatatcgtccgcctcctaggtttttgctctgaaggaacaagacgtgcgcttatttatgaattcatgcctaacgagtcattggggagatatatattcttgccgcaagagctcctagtaccagaaaaaatgctagatatcgctacaggcattgctagaggaatggagtacctacatcaaggatgtaaccagcgcatcctccactttgacatcaagcctcacaacattctgctggactacagcttcaacccaaaaatttcagattttggtcttgctaagttgtgtgccagggaccaaagcattgttaccttgaccgcagcaagaggcacaatggggtacatcgcaccagagatatattctccaaatttcggtggggtatcatacaagtcagatgtttacagtttcggcatgctggtgttagagatggtgagtggaaggaggaattcagacccaggtatcgagaaccaaaatggggtgtatctaccagagtgggtctatgagagagtagtcactgggcaggacctcacacttagtaagaaaatagctgatcaggagaaagaaacagtgaggcagctggccattgttgcactctggtgcattcagtggaaccccaaaaacaggccatcaatgacaaaagtggttaacatgttgacaggaaggttacagaatttaccaataccacctaagccatatgcctagcctgaaagacatcctatgccataaaacatggaggatatacaccatgttttaggaagcatgaaaagcagttatgcttactttcatgtgcgagcttagtaatgcttagcaatagattacacagtatttggatcattccactgtatcagacacatgaactgtgactcttttaattttcaatgtgtggtaacttaattagagacgtatcacattggatttgatttccagtgttgttcaattattgtgttttcccggaaaatgtacgtgtcggttggcctttacaaggtgttctacttttcctattcgtggtgcacaagagttatatanccaaaaaaaaaaaaaaaaaagcggcc

SEQ ID NO: 2435 - DNA, 1132 bp, Zea mays
  misc_feature (862)..(862): n is a, c, g, or t
ctcgaggccggccgggagaaataggtgctcattctgaagcacttgcaaccttctcctcgcccaccttcatctccaaatacatcccatgaactcgcataaatttcttctggcagtgctgctgcttttgcttctcaactatgcatcctatgctgccacatcgaaggaagatgatgacttcctcaaatcttgcccatcgcatcgatgccacaagcatggaccagagatccggttcccctttcggcttccaagcctccctccatcctgtggcgcacctgggatgcaattatcatgctctgggcatgacaccatccttgatcatccagttcttggctcctgcagagtgacagcaatatattacaggcatcgtgtcatgaatgtcatcccgccagaggactcatcatcacactgccaacttcagaagcttgttaaaagaaatcaatcaactgatgtgtacacacctgtagtgaatcctgtctcagtacttgtaggatgctcaagagaagcaacaaatcaagatggtattgtcggcccaagctcttgccgaagcctcattaacaatgcaagccagctctggtacctggtggatccttctacagatatgtctactcttcccatgggctgcgaggttgttgcaaagggaatcccagtaccctacacttacgacaaaaatggtccaaactataacacattctccggaaggtcactcttcaacgaaaaggcaaatagaacaatcaattttggtgaaacatcattcaattggaacctcaacaacatcaccggctcttgtcaaaggtgtgaacaggaagggaaacattgtggattcagttcaaacaggcgacaagcattctgcctgcatcacggntcgacatagtcatcctcaggatcctgcagcttcagctggtagagactgctgagcaggacctcgttgaaggagaagaacaggtggtcgaagaggagccgcctaactgaggctttcgacttgatctagttgtcgtctcccagtcagctctctggcgctagggagtaatatttagttcactttattttatcatttatttttgtaagacttccgctatgtaataagtacatttatgatatttatgacatttatctctatgcactctgttattat

SEQ ID NO: 2436 - DNA, 521 bp, Zea mays
ggccgcaaattttttttttttttttttggatcgaatgtcacatctttactatataataggagttctatacaaaataaataaataattacattataaggagacaacggtccagcaacccaaagttgactgggagacgacggcctagacctctcacgaactcatcacagcatcctccatgcgcctcatcctgcggtacctggtcttgacctgggacttgagattccaggtaccaggatgatcttcaggtgactcgtaacctcgcgccagattaatgaagcgaagccggtcgaccacagccggggcggatacgcggctccggctgccgagctccacagatggcaaggccaggcgcgtgcggccatagagcacgcgggggcaccttgcacttgggttcgagagagtacacagggaaggttggaggctcgcccatggagggagccccgcccggcctccaaggaagaggagcaggggcgatggttgccgagcgccatggatgggcagcccggccggacccaatcgcc

SEQ ID NO: 2437 - DNA, 1134 bp, Zea mays
  misc_feature (1057)..(1057): n is a, c, g, or t
  misc_feature (1091)..(1091): n is a, c, g, or t
atccggctgcgattttaaaatatcacgattcgccttcaccgactatgcatccgaaaccaatcggtctcaatttattcctaattgggtgcgagaaattatttttactagcgacgctaaacaaatcaaattcttagtacggataatccgtcattctgtccgatcgagcaccagctcgctctgtttttacacagacgacttccgcgagagcatttttattccgagaaatattttagcgcagcacgattaagtgttttgggccgaatcaagtcgagcccatttggcccatttaaaaccctagccattccttgtctataaatatgaggtgtccccttgccggccgggaaaaatttccactccctacccctagccgccacaacctttctccctctcctcctttcagccgacgcacacagccacttctcgctgttcacaagcgcatggagcagctgcggctccacctccctgctcctctctccgtggtgacgtccagcacctttccatggacgcctccctccccaagctccaaggcgcacagggcagcagcaccttcattccccatggatccatggtgctgggagttttttccccattgctggaatttgttgcagccttcccatgcacaggttccagccatggccgacctcctttcttcctccctattcccggcagtagcacgccagcacagggacaacgacttccatggccggcgccccaagctccagcccctccctgcgagctccctcctcccgctgctcggtaccctgagctcctgctcttctcccatggagggcgtccagaaatttttccagcgccttcactattcatcttcctcccagcaggcccagcttgctgttcccctgctccatggcacccctgcaatattccccttcctccccctcggctcccccatccgggcacccaagcagcgcctttccttgcccctctctgtccccagcgacaagcagcggcactccctcccaaggacagcgcccctatttccctctctcggcagcgcagctcctcgcaaccgagcttcccccgcagccctcaacatcgnacgtgtcataaggtgttcgacggaatgctcgtgngaaatattatgttgtacgcagcagccccgacgtcttcgcgcgc

SEQ ID NO: 2438 - DNA, 2894 bp, Zea mays
  misc_feature (1736)..(1736): n is a, c, g, or t
gggaccctcgaggccggccgggattcctccacggaccacggccaagcggcagcagctgcagctctgagccccgggccctgcccctgcccctgccgcttcctcccctgtacggtcccctcctctttcacctccgactgcgcccacgcgcggccccgcgcgcggacgacaggtgtccggcatgctgccgccacgtccaccccgaccgacgccccttccctcctcccgccccttccacttcctcgttgtcgtctccgtcctctgtttcgcagccatcctgacgccagcccccgccgctgtagcagcagcagcatcaggggacgcggacggaggaggaggaggagaaggcggcgtcatcaggatcaggactgccgctgtcgccaggtccgccatggcatggccatcaaaatgtaaatggttgcccttacagaacagtgggaggtgtctttcgtatactcatgtttgcaaataccacaagatttggaaggacacgaagccatttatttctgcaaaagatgccctgaagaaagaaccaattagcgatgtgattgctttaaaggattccatgaagtactttgatgctgagttcttcaatgattcaaaactacgtgagatggaagatggtgcaaaggaattcaatgtacccgcattcagagaaaatcggaaattggttgcgacggagaatggtgggttgcacaacccttctgttttactcttcaaatcatcatggagtagtggcagtatgacaagtgagactagaagtttcgagtaccctcatgcgtcttctgtacatcgtccaactaatgatgaagatattgcatttatgtcggtaatcgagcttggagagcttattaggacaaagcaaataacatcacgtgaacttacagatatatttctgaggagattaaagaggtacaatcctgttctagaagctgttattacatatactgaagatttagcatacaaacaagccaaggaggcagatgacttgctggcacaaggaaaatatcttggtaaatatattgctaaccaggctgatcctctaaggcattatcgccactattggcagtacttgcaccttttccctcagcttcatttagaattatgtctggtatacatagcttctcattacaaactgattctcatttggggtgctatctgagttcaggtccacttgaagtttgtgctcatatgactaatatactgactgcctgagaattcttggtgtcaatgttgactagtgtattttttttctctttgagtaattatcttgtccctagccaaaattttgcacttaagctaaaaattcacactgacaaatcctgataccaggtcctttgcatggcattccatatggcctcaaagatataattgcggtaccacactataagaccacttggggctcaaggacgtttaaaaaccaagtccttgatagtgaagcttatgtgtacagaaggtttgttcttcttttccactttatgcatcatattttaagttgtcttgtatatcagggctagattgctagttactatacatctttcatgtgtgccatccttcttcagattgaagtccgctggagcagtcctggtagcaaagcttgtcacgggctcacttgcctatgatgacatatggtttgggggaaggacacgaaacccctggaacatcgaggaattctctactggctcatcggcaggtccagcggctagcacctctgcaggtcagtttatgtgacatgtatntgtgaacctagaaatttataatctattgattggactcttatgattttgtactgcattaggaatggttccatttgcaattggttcagaaactgcaggatccatagcatacccagccgctagatgtggagtaactgcattgcgcccaacatttggaacagttgcacgaaccgatgtcatgagcatttctgagagtttggtatttatatgtgaactctttgttggcattttcagattcataaacggtcatttgggtgatgaatatctgactattaacttgcaggataagcttggtcctttctgtagaagcgcagtagattgtgctgttgtattagacacaattcgcggaacggatgccggtgatccatcatcgcgtgaggttgctttgggtgatccatttcatgttgacatcaccaaactcactgtaggctacctcgatgacgctgagatggaggtagtacagagcttttaatctgctcagctgtctatagttttgtgtattgatcattcctgatatgctcctctatcacggtacatgttttcgtcgtcgtgattataccaggttgtcgatgttctttcctctaaaggtgtcaagctggtccccttcaagctgaactacactgtggaatcagtccagtccatcctgaacataacgatggacactgatatgcttgcgcacttcgataactggcagcgggaaggacatgatgatgactatgaggcgcaagaccagtggccggtagagcttcgtcgtgcacggttaatcccagcggtagattatatacaggttaattaacgaaggaatctaagctctacattttgcctcgacttctccactggagtcgagttacagcatttgtgttctgaacttgtgatgaacaggcgcagcgagcacggggcaagttgatcagagaaatcaaagatagcttcactgttgatgcgtttgttggcaacgtgactgactgggagcgtgtctgtctcgggaaccttgttgggatgcctgtggtcgtggtgccgacaggcttgaagagcatcgagaacccgcctaaggcggtacgaagagaagaacaacagtgacgacaggcatctacgctcctcctgaccacgaccatattgtaagcttcctcctccccatggcctcctggtgggctgggtgcggca

SEQ ID NO: 2439 - DNA, 2307 bp, Zea mays
  misc_feature (1271)..(1272): n is a, c, g, or t
cattgggtacctcgaggccggccgggagcagctgcagctctgagccccggcccctgcccctgccgcttcctcccctgtacggtcccctcctctttcacctccgactgcgcccacgcgcggccccgcgcgcggacgacaggtgtccggcatgctgccgccacgtccaccccgaccgacgccccttccctcctcccgccccttccacttcctcgttgtcgtctccgtcctctgtttcgcagccatcctgacgccagcccccgccgctgtagcagcagcagcatcaggggacgcggacggaggaggaggagaaggcggcgtcatcaggatcaggactgccgctgtcgccaggtccgccatggacacgaagccatttatttctgcaaaagatgccctgaagaaagaaccaattagcgatgtgattgctttaaaggattccatgaagtactttgatgctgagttcttcaatgattcaaaactacgtgagatggaagatggtgcaaaggaattcaatgtacccgcattcagagaaaatcggaaattggttgcgacggagaatggtgggttgcacaacccttctgttttactcttcaaatcatcatggagtagtggcagtatgacaagtgagactagaagtttcgagtaccctcgtgcgtcttctgtacatcgtccaactaatgatgaagatattgcatttatgtcggtaatcgagcttggagagcttattaggacaaagcaaataacatcacgtgaacttacagatatatttctgaggagattaaagaggtacaatcctgttctagaagctgttattacatatactgaagatttagcatacaaacaagcccaggaggcagatgacttgctggcacaaggaaaatatcttggtaaatatattgctagtcaggctgatcctctaaggcattatcgccactattggcagtacttgcaccttttccctcagcttcatttagaattatgtctggtatacatagcttctcattacaaactgattctcatttggggtgctatctgagttcaggtccacttgaagtttgtgctcatatgactaatatactgactgcctgagaattcttggtgtcaatgttgactagtgtattttttttctctttgagtaattatcttgtccctagccaaaattttgcacttaagctaaaaattcacactgacaaatcctgataccaggtcctttgcatggcattccatatggcctcaaagatataattgcggtaccacacttatagaccacttgnngctcaaggacgtttaaaaaccaagtccttgatagtgaagcttatgtgtacagaagattgaaagtcgctggagcagtcctggtagcaaagcttgtcacgggctcacttgcctatgatgacatatggtttgggggaaggacacgaaacccttggaacatcgaggaattctctactggctcatcggcaggtccaccggctagcacctctgcaggaatggttccatttgcaattggttcagaaactgcaggatccatagcatacccagccgctagatgtggagtaactgcattgcgcccaacatttggaacagttgcacgaaccgatgtcatgagcatttctgagagtttggataagcttggtcctttctgtagaagcgcagtagattgtgctgttgtattagacacaattcgcggaacggatgccggtgatccatcatcgcgtgaggttgctttgggtgatccatttcatgttgacatcaccaaactcactgtaggctacctcgatgacgctgagatggaggttgtcgatgttctttcctctaaaggtgtcaagctggtccccttcaagctgaactacactgtggaatcagtccagtccatcctgaacataacgatggacactgatatgcttgcgcacttcgataactggcagcgggaaggacatgatgatgactatgaggcgcaagaccagtggccggtagagcttcgtcgtgcacggttaatcccagcggtagattatatacaggcgcagcgagcacggggcaagttgatcagagaaatcaaagatagcttcactgttgatgcgtttgttggcaacgtgactgactgggagcgtgtctgtctcgggaaccttgttgggatgcctgtggtcgtggtgccgacaggcttgaagagcatcgagaacccgcctaaaggcggtaccaagagaagaacaacagtgacgacaggcatctacgctcctcctgaccacgaccacattgctctggcgctggcaatggcgtaccagtccgtcactgatcacaacaaacagcggccgc

SEQ ID NO: 2440 - DNA, 2142 bp, Zea mays
agaagtttcgagtaccctcgtgcgtcttctgtacatggtccacgcgttcgctaatgatgaagatatcgcatttatgtcggtcatcgagcttggagagcttattaggacaaagcaaataacatcacgtgaacttacagatatatttctgaggagattaaagaggtacaatcctgttctagaagctgttattacatatactgaagatttagcatacaaacaagccaaggaggcagatgacttgctggcacaaggaaaatatcttggtcctttgcatggcattccatatggcctcaaagatataattgcggtaccacactataagaccacttggggctcaaggacgtttaaaaaccaagtccttgatagtgaagcttatgtgtacagaagattgaagtccgctggagcagtcctggtagcaaagcttgtcacgggctcacttgcctatgatgacatatggtttgggggaaggacacgaaacccctggaacatcgaggaattctctactggctcatcggcaggtccagcggctagcacctctgcaggaatggttccatttgcaattggttcagaaactgcaggatccatagcatacccagccgctagatgtggagtaactgcattgcgcccaacatttggaacagttgcacgaaccgatgataagcttggtcctttctgtagaagcgcagtagattgtgctgttgtcggcgccacaattcgcggaacggatgccggtgatccatcatcgcgtgaggttgctttgggtgatccatttcatgttgacatcaccaaactcactgtaggctacctcgatgacgctgagatggaggttgtcgatgttctttcctctaaaggtgtcaagctggtccccttcaagctgaactacactgtggaatcagtccagtccatcctgaacataacgatggacactgatatgcttgcgcacttcgataactggcagcgggaaggacatgatgatgactatgaggcgcaagaccagtggccggtagagcttcgtcgtgcacggttaatcccagcggtagattatatacaggcgcagcgagcacggggcaagttgatcagagaaatcaaagatagcttcactgttgatgcgtttgttggcaacgtgactgactgggagcgtgtctgtctcgggaaccttgttgggatgcctgtggtcgtggtgccgacaggcttgaagagcatcgagaacccgcctaaaggcggtacgaagagaagaacaacagtgacgacaggcatctacgctcctcctgaccacgaccatattgctctggcgctggcaatggcgtaccagtccgtcactgatcacaacaaacagcggccgccgatcgatgatctggggccgaatgatgtcatacaaagatagttcaacctgctcatggaccgcgatgatccggtgatggtagcacgagggtcgttatggttatggaagctgaagttgaagacgatcagtgagccagaatggctggccacctggcagaagacatcagctgtggaagtatcaagtaccaatccacatacgggcttcttcatcagctcaaataactcagcacgtttttttttctgaagcaggcagcattgtatcaccttaacatacgttacaaaggaggttctggatttcatctggggcctcatcagaccaaaccgagccaaagaactgatcagctagcctagtcattacatgagctgcaacttctctgggagggtatttggtttctatggactagtccatctattttattctaaaaatttttattctattttagttaataaattgtaaaatacagtgagttttcgtatttaataatttagggaccaaaaccgaataaataaaagaattaaaaattagtctctagaaaccaaacacaccctgaatttacatgaaagagacaaccttcgcgtgctaagttttttacgtcacccaatggctccagctccgacatgggatctactccattcgttctaaattgtaaggtattccaaatatcttggagctactccattcgttctaaattgtaaggtatttcaaatatcttggagcgttaagcatcttaggtcctattcaggatagctctaacttcaagaaatttgatggagttagtggagcaggttattatgtgctct

SEQ ID NO: 2441 - DNA, 829 bp, Zea mays
ttggggacaagggggctccctcatttttctcgtctgaaaaagaagagagcacaacaggcatccctcttctaacctcctgatgatggcactcaacggcggttggagaaagaccttcgtgtccatcctgacgacatgctttcttgtggtggttgtaattgtttccctatcctgcgaagcaaaaggcggcgtcgtccccaggttgcggccaccattctgctttccatacgatcgtgaatactgcacgccatttcactgcggcaaagtttgccaagagtacaacttccctgctaagaatggcggctactgcgataaacgtggtgacccatggaagtgctgctgtccatattgaaacgtacaaaatgcatgcatccatccgtgctgctacctgatcgatatacatgtcaatcatcatcaatatatataatgaatgaataaaatgcatgtgttggaaaacggggggccccggaccttggtgcacccttgaccccccgactaacctaacaaaacacaccgggcccgggtggcactattgcagttaagaaaaaaatggtcgggcccgtcttgccccgattcgattttaaccttcggcaatctttacccgtgggcccgaatttcagattccttttggcccattcacccctatgggggggcggtataaacatttcactgcgccgcggtttaaccaacgtggggacggggaaaaaccctgggggttacaccaacttaaatcggctttgccacaacacccccctttttcccacgcgtggggaaacaacgaaagaagggccgacccgaattcccctttccaaacagtgtccccacctccgat

SEQ ID NO: 2442 - DNA, 2685 bp, Zea mays
cttatatctacatctataactatattacaagtgcttctgtagctcctcactcttatatacatctatatctataactcttatttggcaggttggtcgcaactgctgcagctatttagattgttgcggctgcaattcatagagacaaaatattgtaggaactgcagctgcagcaagccgcagcgaacaaatatatctacatctataactaaactacaagtgtttctgtagctcctcactctctcccattgtctatatatgaattagagcaacaatcagattctataagaaaaaaaatggaaaacattatgcaaccattgaaataaatctataagccccatatggactttaggtagcaaattctaatcctggaccataattttgccataacattactgctagatgttgttatcgttattatgtacatatttaatttgagaggcagacctgctgtatatcatgactactatatatatatatatatatatatatatatatatatatatatatatatatatatatatatatatatatatatatgtatgtactaatcaactatatatatataacgggtggagcaacgtttttttggcaggcggcgtcgtccccaggttgcggccaccattctgctttccatacgatcgtgaatactgcacgccatttcactgcggcaaagtttgccaagagtacaacttccctgctaagaatggcggctactgcgataaacgtggtgacccatggaagtgctgctgtccatattgaaacgtacaaaatgcatgcatccatccgtgctgctacctgatcgatatacatgtcaatcatcatcaatatatataatgaatgaataaaatgcatgtgttggaaaatactgcagtgcaggagcttatgatcccacgatctcccgtccgagactcaatagatttgttgggcccaatcaatatcattgcccagatcgcacttgcgtgtgtagatttgttaggccaaggcccaaatttttcggatctttatctcaacttgcacagacgacctttttagatattaccaatttaagaatttggactgttaaaaaccggttagtctctacttcaaacttgatcagatttgtagaaaagattgtcaacttctgcacgtgccgccgcgtggatatactatgaaaacatgtttcataataaatctgattatatatacctcagtgacaccagctgagctaggagcaaaaacaggccgtaatgacagaacagggaaaaggacgatacaccacctagcttatcacaaacctcaggcaagcttaagaaaatgcttggtgtcagggtcgaggccgatcaccaagataccgtacctacaaaacaaaccaagtaaaattcagcatcccaaacaaacgcacacagacatacagtagtagtttactgttccccagcatcgacacctcagaactgcggccaaaagccgaacaccgtcatgatccatgaaccgttaatggcccagcacgtacgtcaacaatagataggggggtgcatgaactgacctccactgagacccacggcaggacaagtgttatcatcagctcaccgtgtgcttgctaacctcacctcacaggccaaagcaaagcagcctttagttttctatccatccatccactgcccggtggacgctgcttttgatacctcacctttttatttttatttggctcctcttggaccagcgttagtgtgtggtggtggtgagaccaaatcatgtgagactcagactgggtggtgcttgtcgctcataacgttcatctgcatcgccgttggccaccgctggccaggtcccagatgatcacctcggcgttccttatcaccaccatatgcttttgggagaatcggttggctcgtcggcatgcaggcatccacatctcggctgaggttagagcactgacaggcgttcacgctaagaagcactggtttctttttttaccatcttatcgcggaactgaaaattcagacgtaaaggatctgaagacttacggtgcccatcaacctatttcctgcagaaaactggctggctcatcggcttgtgctggtctccatcaccaattcaccatgcgatgaaaaccatgttcagattgttgatgtttaggctgattgacagctgctgattctgcacatatgcataaaacaaaccctttcagtaaaaaaatacattttttcagtaaaactgatactgccatacttgcacatgaaaatatgaaatcaagcataaatactgtacacatttgttgaacttctgttgctcttaaactactaactcttgcattatggagagtcggaaagaacaaattcacgcatgtgagatgagaaaaggacctgacttaggtcatgcattccatggaataataaggtttcatcacgatgatgatgactgatcagtccctaaagtcagtactagtacatcctactaaagccagggaagcgaggacgacgagctcttggtaccggtcagaggctacagcagcaaccgacatatagacagattaaagaagcgcaaaagacaaacaagcaaacaaacagagcaatggcagcaggtcgattgggctctccattagtggaatatggagcagtgttcagtgcacaggggggcttccaaaagcaggatagatgccaagataacaagttgatgaggccgtccccgccacaatgtggactgcag

SEQ ID NO: 2443 - DNA, 1493 bp, Zea mays
  misc_feature (2)..(2): n is a, c, g, or t
  misc_feature (8)..(8): n is a, c, g, or t
gntcaaancaaaagttgctgagttcctcgaggccggccgcgattgttcagcatgggccaagtgaagctgaccgcaagtcacagtggagtttgattagggggcaacttttacaggatcttcgtctttctgaagaagttgttgagaagctacataaagcagatcagcggttttgtggctctgcagatctagtacttgctagattaagagggaccctgttttatgatgaatctgcttgcaaggctcttgatgatctatccgcgcttctgagatgtttgagagtatggtcggtagaacaaccaattactactattgatgtactcatgcctccgtcagaatgttactatacaaatttgtttttccaggtatactcaaaagaagggaatcatgggccgggtttccatgaaaagttgctggcagttggtggacgatatgattggttggtggaacaagcttgggatgagacatctaaatctaaacccccaggtgctgttggtgtgagcattgcacttgagaaatttcttcctaacaatccttcatctgatctggggttgcgaaggttactgtccagggttgaacctagcatcagtgtacttgtctgttcaaggggtggtggcggtctgttgactgaacgcatggaacttgtcgcagagctttggaaagctaacataatggctcagtttgttcctcaggaagatccaagtcttcaagaacagtatgaatatgccagtgaacatgatattaaatgccttgcaattatgactgaatcaggcctgtcacaaacagaccttgtgaaggtccggcatcttgattttaaaaaggagaaggatgttgaaagagagggactaataaagttcctgtctgatgcaatgtgttcacaatacaaaaatcctacgatctggagctgaccaacggccctcccaagtgcttagtgtatttgttttcaggttctagcagagcatcaaaaaatgtgtctttcgaacttccgggtgaaagcaatgtttgctgttcgaacatgtgaaggcaatcatgcgtgttggcttccgtgcatacggtgaggcagctgttggctctctgcaggttgttgccaaacgttacgccctggtctttactgaagatgggcgccgacgtgcggtgattggccaattggtataatcctggacctcttgattgttctcctgaggaccaatgccatgcaacaaggttgcttcagacacaaggtggcgtgtagttggtgcaattctgcagttttggggctgttggtattatatggatctgaaggtgcgcggttttctactacaacagatcctccgtttttgcctgtgttctctttcttgtgcatgtgattttctttttcttttccataggactaccttgtacatagttcgtttggcgtgagccatcatgtacatgcaaaatttttacattgttgggttactgacaatgaaatgctgaattttgcaactccctgatttaggataaaaaaaaaaaaaaaa

SEQ ID NO: 2444 - DNA, 1013 bp, Zea mays
cccacgcgtccggcacgcagccggcgccagccatttcttctacattctcaatctcaacggtgcggctctcgttctttctttctttcttcctttctgtttgctgcatcgatgtagggaggaggaggaggaggaggaagcaagtatccatctgacagcagggtgccccccaatggcgacaagatcgacatctacgatttcggcgtgatcctgctcgaggtcgtgaccgggaggcccatcacgtccatacacgaggtggaggtcatgaaggagcagctgcagtcggcgctgacgtcggagagcccggggcggcggagggcgctggtggaccaggcggtgagccgggcgtgctccgacgagtcggcgcggacggtgatggagatctgcctgcgctgcctggccaaggaggcggagcagcggccgtcggtggaggacgtgctgtggaacctgcagttcgcggcgcaggtgcaggacgactggcgcggggactcgcggagcagcgccagcgaggagtcgccgctgtcgccgtcgcagatcccgccgcggagggacagggagaccagcgcctggtaataagccaagcccgctctaggtgactgttgttgggcgatccgattaggcggcgaggcaggcatgcatcaagtgagatttcgttggtaaacaagtgtacagcagctgcaggctgcagctgaagctggaaacccaccacaggatgtgtacagctctttgcttcggcctactagtactagcactgctttattttatttttttcaatgcgtctttgccacctcattgattcacctactatatggatcgtttgactatgtgtaagcacaactgtatttggcgtcaatcttaccagaggtctcagttgtaggaccaagcgtgacttgacttgctgttgcagcgcatttggctctttgcatggcacgatacagtcagagtcagaaggccaaacaggcacactactgtggattagtgagtgcactgctctccaacagttcgatgtaatgcag

SEQ ID NO: 2445 - DNA, 1342 bp, Zea mays
gtcagtccctcccaacctccattccttcctcctttgccaatgcagctctgatctctcctacctgagaatgtcagtgtgagtggccattccatctgcacaacatcctcctccacgcacgcacgcaaaacatacaaaaaggcagaagcggaggagatgaaggcaatggccgggccaaagctgctcgtcgtccacgcgtcgtcgaacaaggccctgaacgggatggcgcccacgtcgccgccgtcgcccggctggtcccggtgcctgtggctggtggtgttcctggccttgttcacctgcgtgtccctcctgaccgtgctctccacggcgcgcgcctcggccggggcgccggcgtgccaggcggcgtcgctcacggccagcgctgccggcgccacggaggccggcctgccgcggcacgtgttcgacgcgctggtgcagtacgcggcggcggcagggaacttgtcgtcgagcatgccggagccggacgtgcgcgcgatcgcgtcggtgctccggcggcgcgcgccgtgcaacctgctggtgttcgggctgggcgcggagacgccgctgtggcgcgcgctcaaccacggcgggcgcacggtgttcctggacgagaacccgtactacgtggcccacctggagggcaagcacccggggctggaggcctacgacgtggcctacgccacggcggtgcgcgagctccccgacctcctcgacgccgcccgtgccgcgcgcgccgccgagtgccgccccgtccagaacctgctcttctccgagtgccgcctcgccatcaacgacctccccaaccagctctacgacgtcgcctgggacgtcatcctcgtcgacggcccgcgcgggttcatggaggggtcgccggggaggatgtcggcgatctactcggctgcggtgatggcgcggaccaagggcgcggagacggaggtgatggtgcacgactacgagcgggaggtggagcgcgcgtgcggccgggagttcctgtgcgacgagaaccgggtcacggcgaccagcacgccgtcgctcggccacgtcgtcgtgcgcgacggcgccgccgccaaccgggaagccttctgcgggccgcccgccggcgccgctcagaaatcgaaaccgagctaagcgagtcgtagtcgttacttctccttcaaacaaatcatgtaattaactcaaggaagtataggtcagtggttcctcgtatttttttcgaacaaatcctgtgggtggtggtggtccaatgatttctcccttcaaacatactgtaatgcctgacgtgccaacacatttgacacgtttaagagaaattttgcatttacaactcttaaaaaaaaaaaaaaaa

SEQ ID NO: 2446 - DNA, 1456 bp, Zea mays
aaccacctcccgaatcccatcttcttcatctcgctgcggcctccctccacctcctcctccactggagccgacacttgatccattccccatccccatcccacgcggccaccaccaccttctcctcctccccctctccatatctctctctctctccgggcaaggaggaagaggagcagtagatcagtcgtagcaataaatccgtcacgcccagctcgcctgcacgccggctccgcctcgccattgccttgctccaaccaagcaggagtagatgaagggactgagcggggcgaagctgctggtcgtgcacccgtcgtccaacaagtcgcccggcggcgcggggtcgcccggggcggttctgggcgcgcggcgccgggtgtgcgccgccgtgttcctggcctgcttcgcgtgcgtctccctggccaccacgctgctgtcggccgcgcgggaccccggcggcgcgggggcgaggtcggcggcgttcgcggtgccggtcgccgcggcagcgagggagggccagggcctgccggggcacgtgttcgacgcgctggtgcagtacgcgtcggcgggcgggaactcgacggcgagcatgccgggcgccgacgtgcgcgccatcgccgccgtgctcaggcgccgcgcgccgtgcagcctgctcgtgttcgggctcggcgcggagacgccgctgtggcgcgcgctcaaccacggcggccgcaccgtgttcctcgacgagaaccagtactacgtgtcccacctggagggtcgccacccggggctggaggcctacgacgtcgcctacaccaccaccgtccgcgagttcccggacctgcttgactccgcccgcgccgcgcggggcgccgagtgccggcccgtccagaacctcctcttctccgactgccgcctcgccatcaacgacctccccaaccagctctacgacgtctcctgggacgtcatcctcgtcgacggcccgcgcgggtacacggcttcgtcgccgggcaggatgtcggcgatattcacggcgggggtgctggcgcggacgcgggccggggagggcgtgaagacggacgtcctggtgcacgactacgagcgggaggtggagcgggcgtgctccagggagttcctgtgcgaggagaaccgcgtcgtcgagaccagcacgcggtcgctcgcccacttcgtcgtgcgcggcggtagttctgcccgccgggacgccttctgctccggcacggcggcggcccactagcttcactcttccccgtcactcacctcacctcacctgttcttctactttttttttcttaaaaaaaacctctctcgatctcgatcacggttaatgatgatgatgcttgtcatgtgaatgggggaaaaaagatgaaaaagagagcggtgaagcctgtaaaaattgggtgtgacgaaaagaaagaagcagaggaatgtgtctctgtccttaaaaaaaaaaaaaaaa

SEQ ID NO: 2447 - DNA, 1346 bp, Zea mays
ccattccttcctcctttgccaatgcagctctgatctctcctacctgagaatgtcagtgtgagtggccattccatctgcacaacatcctcctccacgcacgcacgcaaaacatacaaaaaggcagaagcggaggagatgaaggcaatggccgggccaaagctgctcgtcgtccacgcgtcgtcgaacaaggccctgaacgggatggcgcccacgtcgccgccgtcgcccggctggtcccggtgcctgtggctggtggtgttcctggccttgttcacctgcgtgtccctcctgaccgtgctctccacggcgcgcgcctcggccggggcgccggcgtgccaggcggcgtcgctcacggccagcgctgccggcgccacggaggccggcctgccgcggcacgtgttcgacgcgctggtgcagtacgcggcggcggcagggaacttgtcgtcgagcatgccggagccggacgtgcgcgcgatcgcgtcggtgctccggcggcgcgcgccgtgcaacctgctggtgttcgggctgggcgcggagacgccgctgtggcgcgcgctcaaccacggcgggcgcacggtgttcctggacgagaacccgtactacgtggcccacctggagggcaagcacccggggctggaggcctacgacgtggcctacgccacggcggtgcgcgagctccccgacctcctcgacgccgcccgtgccgcgcgcgccgccgagtgccgccccgtccagaacctgctcttctccgagtgccgcctcgccatcaacgacctccccaaccagctctacgacgtcgcctgggacgtcatcctcgtcgacggcccgcgcgggttcatggagggatcgccggggaggatgtcggcgatctactcggctgcggtgatggcgcggaccaagggcgcggagacggaggtgatggtgcacgactacgagcgggaggtggagcgcgcgtgcggccgggagttcctgtgcgacgagaaccgggtcacggcgaccagcacgccgtcgctcggccacttcctcgtgcacggcggcgccgccgccaaccgggaagccttctgcgggccgcccgccggcgccgctgagaaatcgaaaccgagctaagcgagtcgtagtcgttacttctccttcccgggcaatgttggcgatctctctttgacaggggaaagtaatgaactcgcagaattgactcaagggagcataggtcagtggttcctcgtattcttttcgaacaaatcctgtgggtggtggtggtccaatgatttctcccttcaaacatactgtaatgcctgacgtgccaacacattcgacacgttaagagaaattttgcatttacaaccttt

SEQ ID NO: 2448 - DNA, 881 bp, Zea mays
  misc_feature (1)..(3): n is a, c, g, or t
nnncgagcccggccggggaaaaaaaaaaaaaaaaacttttcctcgcttacctcctcccacccaccttgcgagcctcaaatctgttgccggatttcgtcaagctttcccactctcgcaagataccgacaagaaattttcgagaaaatcagacaagatggttctcgccgttgatcttctgaacccttccccggccgccgaggccaagaagcacaagctcaagacccttgtgcccgcccctcgatccttcttcatggacgtcaagtgccccggttgcttcaccatcaccaccgtcttctctcacgcccagaccgttgtcatctgccagggatgcaccactgtcctctgccagcctaccggtggtaaggctcgtctgactgagggctgctctttccgaaggaagtaaacgcctcgcggcggtttatttccttgggcactcatgactcttacggttcatctcatggtggccatctcggatctgcaaaacacaacatcgacatggacggatagaacagccgacgttgcgaacattcaccaaaaaatctttgcagatagaagatggaacacccagaataggggcgtttggggtctccggatatcttgcatggcacatcatttctcttttgtttttccgttacgcgccttgtaccaaagagtcgtctggaggcaggaagggaaaaaaagcactgcatgggtggaaagctgagaaagccttcacacgagtgtccacgctggctctaataggttggctggacatgaggacgtggaaccgtttcttgatgatcgcttcatacccgagtgcagtgggtagcggaggatggtcactgtgcttttgcgaaattcacaatggtttccgcaaaaaaaaaaaaaaaaaacccgcggcc

SEQ ID NO: 2449 - DNA, 2216 bp, Zea mays
atagggcgtgttctaaaagacacaagatcttctctgggcacactagtgtatgaaaaaccacaagggtgattcagcttgccactgtcggctccttctatgcatgcagctgatccctgctgctcactcccatggcgcaaggtgaggagagctcgtggtgcatggcgagcagcgatcatgcatcattcgcccaagcagtcgcgtgtggaacccaaaggcgcgcttctgccgcacaacctgccaatttcttggagttgcaacctgcagcagctgctccttattactttggtgagttggaggaggcccttatccatggcacccgtacatctgttgatcacggcatgatcggaagtgatgtggacacagagcgtaagactgctggataccttgcagctaggccccccacactggagatcttcccttcatggccaatgagtcatctacagcagccatacagtggtaactcgcactcagtagggagcaccactgagtcgagctcaggtcagaacagtatgccacagaccgagctggtgtccccagggagcatgagggccgactctggacagcgtcaggagcttttgatggtgactgttgatgattacaactacgagcaaggactcggagccgcagcaaccacagctccaatctttcagcagcatgcagcaggccaagacaagggaaagcatggatccacaaggaaagacggcaggctgttagacgccaagaccgagaggcgattggcccagaacagagaagctgcaaggaagagcaggctgagaaaaaaggcctacgtacagcagctagagacgagtcggatcaggcttcagcaaatcgagcaggagctgcatggagcacgctcacagggtctgttcccgggaggaggtggtgcgcctggagacttgagttcaggcgctgtgattttcgacatggagtacgcccggtggctagaagacgacaccaagcacatgacggagctccaggccgtgctgcagccccagatcatcgacgcgaacctgggggccatcgtcgaggactgcatgcggcactacgacgagctgttccacctgagggccatgctcgcaagatccgacgtgttccacctgatgaccggcctgtgggcgaccacggccgagcgatgcttcctctggatgggagggttccgtccttctgaaatcctcaagatgctgataccgcagctcgaccctctcgcggagccgcagctgctagggatgtacaatctgcaacggtcgtcggagcagaccgaggaggcgctcgtgcaggggcttcagcagctgcaccagtcgctggcggacgccgtgggcgctagtcctctcagcgacggcgcgaatgtcgccaactacaccgctctcatggccctggcacttgacaggctcgacaccctcgagagcttttaccgccaggcggacagcctgaggcagcagaccttgcaccagatgcggcggatcctgacgatccgccagacggctcggtgcttcgtctccatcagcgagtaccaccgccgcctccgcgcccttagctccgtctgggcatcgtcccgccctccaactcctccaagcgagggcgtcgttgcggccgcagagaatgttagccctacagggacgacgagcgagcaagctctccctccgtaccaccatagccagccgttccctggcttctgatcgaaggttcgatgcatgcatgcatgctggttgtcgcggctagctagggtacagattccgtcgtcagtggtggcgagcggacgacgaggcccggccgagggggacagattgtagtgtataacgttcttctatatatcattcgtcgagaacggaaacatgcatcatcagtcggtattcagtcagtgcatcatcactatgaaaaaaaagaggacacacaaagggtctctgctctctttctctcaaaaaaaaaaaaaaaatgtctttgtgcctctggctcttcaactcatcaaccaaaaggttagcacccctaaaaaagttcggtgcgaagagaccagagagacacagacatgtatgatccaccccactaaagtttaattaggtagctataattataaagatcgatcttacattttagtcgaccaaaagtcctccctgctaaattttagatggagcgttctgattctctagctaataatggactcagttaaactttagctagattaaaatagttaagttcagttcaattctagcgggtctttc

SEQ ID NO: 2450 - DNA, 2288 bp, Zea mays
ggcttgaaggataattatgttcagttctctgagctgctggctaaacattgtaggccagttgatacaaaagatacaactagcagtaatgaagtgctttcttctgtgcaaccagagcaagaatctgactggaagctagcttttcgaatatttggaaatttcgcacttttgtcctcagtttttgcattcgtcggtcctcccgcgcgccccatccttgcaagccctagtataattcaaggtcttgagttcccgggcctggacctgccagattctgctggtgaagttgtagtttgtggagttcttgttctacaaggacagcgtgtgctaaatatgattgcacgatttatccaggcgaagaggcagagaggtgatcatggagtcaaagcacaaggggatggctggttgctgactgttgctctgatggagggaaccaacttggcagcaaccaaatcatctggttactctgatccatatgttgtatttacatgcaatgggaagacaaagacaagttcgattaactttcacacccttgaccctcagtggaatgaaatttttgaatttgacgccatggaagatcctccatcagtgatgaaaatacatgtgtatgatttcgatggaccctttgacgaagttgcatcccttggtcatgctgaagtgaatttcttgaaatataataatatatccgagcttgctgacatttggattcctttgaaaggaaagctggctcaagcatgccagtcaaaattgcatccccccccccccccccccaatacaaggggtactgaagtcgtgaaggattacctggataaagtggagaaagaagttggcaaaaagattgctatgaggtctcctcacacaaacttagcattccagaaaatcttttctttgccaccagaagaatttcttatcaatgattttacttgtcacttaaagaggaaaatgctaacacagggtcgtatttttctatctccaagaatatttgggttttacacaaatctttttggccacaaaacaaaattcttctttctttgggaagatattgaagacatcctactggtccctgcaaccctgtcttccatgggaagtccgtctctggttattattcttcgaaaggacagaggaatggatgcaaagcatggagcaaagcaactggacagtcaagggagactaaagttccatttccagtcttttgtttcattcaatgtggcacataaaacaattacagcactgtggaaggcaaggtccttaacccctgaacaaaaggtacagcttgtagaagaggaatctgtccctggaggcttccgatctgaggagggagagtctttgttagggatagaggatgccaaaatgtcaggagttttttcatgtacaaaaccttttgatgtatcaacactaatgggcatatttgagggtggtcctttggagtgccgggtgatggagaaagttggctgtatggactactctgttacagcatgggaacctgtcagagctgatatttaccagaggcaagttcattataagtttgacaagaaatcagcacggcacggaggagaagcaatgagcacccagcaaaagtcccctttgcctaataagaatggctggcttgttgaagaagtgatgacacttgaaggtatccctgttggcgaatgtttcaatctccatatccgataccaactggagagcaatgcatccaagcagaagacatgcacaatccaggtatttattggcatagtatggctaaagagctgcaagaaccgaaagaagatcacgcaggatgtagcaaccagtgcatcttctcgcctgaagaagatattcaaccaacttgagaaggaatctataccagcaaagtaggaaccttgtttttgtctgcgtcctacttttgctgctgcacatatgctggcactatgtttggccttgctggctgctgcccatgctgagcaaagatcagtgacctaatgaggaagttgcagcacaagccaaagccctcaggcagagttttataaagcaacacgaagcaaggaccgcattgcaagatttcagattagagaactaactgtagagcctggaacgtggtttagcttaaccatgtatacataacgttcaaacatcgttctgacttctacaaaaagttaagaggatctgaaattctaaatcttgcctacgcctttttagttagattggaagcaaagatagcttccatgaccacagaaaaataactattcttttcctggtgtaatttctagaagttttgagataaaataaataaaatttttttttattatttatttaat

SEQ ID NO: 2451 - DNA, 1636 bp, Zea mays
  misc_feature (1602)..(1603): n is a, c, g, or t
  misc_feature (1606)..(1610): n is a, c, g, or t
acctcaagctcctgcttttccattgctctgcgtctgcgtctgcgtctgcgtctgcactgcttcgcgtctccctccccccgcctccgcccccgccccggcaaaaaagcaaaacacggccatggaaggctacgaccgcgagttctaccagttcagcgaccagctgcgcctgcagacggccgccttctcgggcctctccctcggcgactccatctggtcccccgccggccggcgcaacaacagcaacgacgtcctcttcgccgcctccgcgtcgcccgccgacgccgccgccaagagcaacgccgtcgtcgggctcaagctcaacgacggagggcccggcctcatcggctccgggaagctggccttcggcggcggcgccggaggcggcggcaccaacaaggccgacccccaaaacacttgagcttctcacttttccaacaacaagaccgtgtacaacaccagcaacagcttcatgggcaacggcagcagctacgccaagaacaacaacaacaacgccgacatgctggcgttcgacaagatggggagctacggctacaacggcggcggtaataccaacaacaacagcaacggcgtggaggtgaagagctacttcaacaagtccgccgggagggcggcgagcaacaacaacaacaacaacagccacgccggcggcggcaacaagaagggcggcgccggggagtacggcaggaagaagcacgccaagagcgagggcgcggcggcggcggcggccacggacaagcagcggttcaagacgctgccggcgtcggaggcgctgccgcggggccaggccatcggcgggtacatcttcgtctgcaacaacgacaccatggacgagaacctcaggagggagctgttcgggctgccgtccaggtacagggactctgtgcgtgctatccgcccgggactgcccctcttcctctacaactactccacgcaccagctccacggcatcttcgaggccgcgagcttcggcgggaccaacatcgacccgacggcgtgggaggacaagaagtgccccggcgagtcgcgcttccctgcgcaggtgcgggtggcaacgcggaagatctacgacccgctggaggaggacgccttccgccccatcctgcaccactacgacgggcccaagttccggctcgagctctccgtcaccgaggccctcgcgctcctcgacatcttcgccgacaaggacgacgcctgatcgatccccatcggatctgtcgtcgggccactcgaagctcggatgcatgaaggaacaaacaataataacggatggatgggcatgtatatcgtcatgcgcatgtcaatcccacgacgagacgagaagagacgggagtatccgcatcaccacggtggtcggtggagtagtatattaataattaatatagtatgtccacctttgtttgatactactaagggctatgtattgaggcacgcgtcccattgttttgtttttataacacttgtgcgatggttgcagacgactagccctctttttttttggtaagatgtctgtattattattattatccgggttccactgacacggaccaaaaaccaaaaaaccaaaaaaaaaaaaaaaaaaannaannnnnggtcctcttgcgttgttaccactgct

SEQ ID NO: 2452 - DNA, 1104 bp, Zea mays
cccacgcgtccgcggacgcgtgggcaacagcaacggcgtggaggtgaagagctacttcaacaagtccgccgggagggcggcgagcaacaacaacaacaacaacaacagccacgccggcggcggcaacaagaagggcggcgccggggagtacggcaggaagaagcacgccaagagcgagggcgcggcggcggccacggacaagcagcggttcaagacgctgccggcgtcggaggcgctgccgcggggccaggccatcggcgggtacatcttcgtctgcaacaacgacaccatggacgagaacctcaggagggagctgttcgggctgccgtccaggtacagggactctgtgcgtgctatccgcccgggactgcccctcttcctctacaactactccacgcaccagctccacggcatcttcgaggccgcgagcttcggcgggaccaacatcgacccgacggcgtgggaggacaagaagtgccccggcgagtcgcgcttccctgcgcaggtgcgggtggcaacgcggaagatctacgacccgctggaggaggacgccttccgccccatcctgcaccactacgacgggcccaagttccggctcgagctctccgtcaccgaggccctcgcgctcctcgacatcttcgccgacaaggacgacgcctgatccccatcggatctgtcgtcgggccactcgaagctcggatgcatgaatgaatgaatgaatgaatgaacaaacaataataacggatggatgggcatgtatatcgtcatgcgcatgtcccacgacgagacgggagtataccacggtggagtagtatattaataattaatatagtatgtccacctttgtttgatactactaagggctatgtattgaggcacgcgtcccattgttttgtttttataacacttgtgcgatggttgcagacgactagccctcgtttatttttttggtaaaatgtctgtattattattatcgggttccactgacatggataaaaaccatctgtgaaatagtttgctcttgtgctgtactacaactcaaacgtaagaaatggattcgatctaagtctgttcacgcaccacaagatgcgtttccctagcgac

SEQ ID NO: 2453 - DNA, 945 bp, Zea mays
ttgcgttcctcgaggccggccgggggcgcacggcacctcaagctctgctcctccttttcactgctctgcgtctgcgtctgcgtctgcactgcttcgcgtctccctccccccgcctccgcccccgccccggcaaaaagcaaaacacggccatggaaggctacgaccgcgagttctaccagttcagcgaccagctgcgcctgcagacggccgccttctcgggcctctccctcggcgactccatctggtcccccgccggccggcgcaacaacagcaacgacgtcctcttcgccgcctccgcgtcgcccgccgacgccgccgccaagagcaacgccgtcgtcgggctcaagctcaacgacggagggcccggcctcatcggctccgggaagctggccttcggcggcggcgccggaggcggcggcaccaacaaggccgaccgctacaacaacaacaacctccccaacaccgacaacaagaccgtgtacaacaccagcagcagcagcttcatgggcaacggcagcagctacgccaagaacaacaacaacaacgccgacatgctggcgttcgacaagatggggagctacggctacaacggcggcggtaataccaacaacaacagcaacggcgtggaggtgaagagctacttcaacaagtccgccgggagggcggcgagcaacaacaacaacaacaacaacagccacgccggcggcggcaacaagaagggcggcgccggggagtacggcaggaagaagcacgccaagagcgagggcgcggcggcggccacggacaagcagcggttcaagacgctgccggcgtcggaggcgctgccgcggggccaggccatcggcgggtacatcttcgtctgcaacaacgacactatggacgaggaccctcaggagggagctgttcgggctgcactactatattattatctgctggataccttaa

SEQ ID NO: 2454 - DNA, 4840 bp, Zea mays
  misc_feature (3323)..(3323): n is a, c, g, or t
  misc_feature (3695)..(3695): n is a, c, g, or t
cgaaggtgtagtagacaggagcgcctgcgtggcgcgacatccacgtctcatcgcccgggcgcgacgcggtttggccaccttccctgaggcttccctccgctcaaatccacaatcagcaaccactacgggagcgagacgagacgcaccaccaaccgaagcggcgataacacctccccccttggccctcggcacacgcgtcggcaccttgcacacttgcacttggttggagctcctctaccttttccatcgctctgctctgctctgcttcgcgtctccgtccgccccggcaaaagcaaaacacagccatggaggggtacgaccgcgagttctggcagttcagcgaccagctgcgcctgcagacgaccgccttctccggcctctccctcggcgactccatctggtctccggccaccggcgccggcgggcggcgcaacaacaacaccgacctgctcgcggcctccgcgtcggcagccgacgccggcaagcacaacggcgtgggcctcagcctgaatgatggagggcccggactcattggctccgggaagctcgccttcggcggcagcaaggccggccgctacaacaacctcccatccgagaaggccgcgcccgtctacaaccacagcggcgccacgatcaacggcggctacgccaggagcgacaacgccggcctggcggcgttcaacaagatggggagctacttccacaacagtaacggcaacggcggcggcggcggggaggtgaagagctacttcaacaagtccgccggacgggcggcgagcaacaacagccacgggcacgccggcggcggcaagaagggcggcggcgggaagcacggcaagaacgagggcaacggcggcgcggtggcggccacggacaagcggttcaagacgctgccggcgtcggaggcgctgccgcggggcgaggccatcggcggctacatcttcgtctgcaacaacgacaccatggacgagaacctcaggagggagctgttcggtgagccactgaccgcgcgcgcaggcacaagaaccgtatcgtttcgtttctgtctgaaatagctagggcagcggaaaagaagcgatatttgttgattgattgatgatgaacaccggaataaaccagcagagctgattgattgtgttcggtcgcgtgggtgcagggctgccgtcgaggtacagggactcggtgcgggccatccgcccggggctgcccctcttcctctacaactactccacccaccagctgcacggcatcttcaaggtacggtacagtacattacagtagccagccaattcctgatttgccttttcatcttcatctgcatctatgctctcatggatccggttccgatcaccaggccgccagcttcggcgggaccaacatcgacccgacggcgtgggaggacaagaagtgccccggcgagtcgcgcttccctgcacaggtagtacgcttcaatccagtccccttcttccaattaatgcagctccagcctctcctctcctctcctctcccgtcatggcggacgatcgatcagctcaaccacaccactagcgtgacttttattacacttgtttgaacggttcaagttcaacaacaccaaacagtacgtgtgtcaccgacagacagacaaaatcacaaaaggctagcgtggcgacccattcccacatcacatgctgcgcctgcgacgacgtgtggagccggtaaagattagaggccccgggatcacaactcaagaaagaattatgacggaaaataaaataaaataaaacacacacacacacattcccacatcacatgttgcgacgacgtgtggagctggaaaagattagaggccccggatcacaactcaagaaacatttttttaaagaattgtctacaaacaccgtgtccgtgcgaaacaaccaatctgcctgcctctgcctgggtaggttgctagtgaccggctgaccgcctaacctttacgggacacgtcaggtctctcgtgggtgtaaaattacgaccaaacttagttctctaatggagtaattcctcgagtggcaacgggtcccgttgccatctttagacgagatggtgcaactgcaagaggcgtgaggatgcaacctgtagctgtagcatgttgtttcatcgcatctaggcctctagggagtatctagtactcgtagttgttacccaagtggtgacgcatgcatgatgtttgtgatgcgcaggtgcgagtgccaacgcggaagatctacgatccactggaggaggacgccttccgccccatccttcaccactacgacgggcccaagtttcggctcgagctctccgtcgccgagaccctcgccctcctcgacatcttcgctgacaaggatgacgcctgagccttccttgccgccccctcgccgccagtgcccatccattaatgcacagacaataaaatggctggagggacagaccaaactatccacctttgtttgatatgataaagggctatgtatgaggcacgcgtcccattatttttgtttttattataagactagacctcgttccgtaagatacatgtatcaatattatatacaaacaaaccatcagttcttgtgctgcactacagatgttgtgttggattggaattcgtccctcgcgacaatacctcggttataatactgcgtctgaatgctccagattcgacagcatcagctacctgccacttccacaccatgacttgagcttcgaccgattctggttctagaataaaactcaatcaactcgctggtagctgaactgcacgacacgacaaagcatgctgcacaaacggttggcaccagataaatcaaagtcagctgcggcccataaccttccattcacctaaaacatatttgtacaaaactgcggaacgaagctccagaggagcaatattaacaaacagaaccacaacggagaaaaagggtgggggtggggtggggggaatctcatctctcctcaactcaaatacatccgacaatctatctccggtcaagaaaacattcataccacatcaaattttcttcccaaaggttttctttgctttccttctccagcttcaaccaaacatattgtgcggagcagggtgagccatgagcgagctgtggtgatggaccatataccacctcccattacagagctcgtacacgttcgtcacatggaacaccaaagggtcaacatcaacattcgccttcatgttcacccatgccatctcaccgagcacacggacacggacatcccttatctggaacccaatgccctgccctccatcttggccccagttgaatagcaggccccagctctccatcactgagttgtatctnataaggaacagaaatgggtgggcgcattcacaccagtaaggcctgttagataacgctgcttcttcaacagttcgattcgaaaatcaatactgatgaggggaataatataaaaaggattcttacagtttaaatacaaaacgtttgtcccaaatagaacaccaacatactgaaggcgttctatactagaaaggaaactagattcacattgtgaaaatttcataagaatcagattaccatctgtcacctgacacaccaagcctagtcaatggaattagttgtatggttatctggttaatgacaaatggtcaagtacaacctactacaagacagcaaccaatggatcccgatcctgccaaagcatacaaactttanttctcatagaagacacggacatttcaatgagcaccatctttatttatgttcacaggtacaaaggtttcaaaggtgtactttataagatgaaaagcacaagtgtgcacactgtttgaaaaggcaacccccctaggccacctaataaacgaggtgctagataccccttcagttcccatgtagcatctagtcatttttcagacatttgtgtgcgtgcataactagaaactacaacttctgtccaaaaaaaaaattccaaccaatcttcagcatagttgcaagatctcaatagttggaaaaaactatgatgtgcgtgtttctgaaaaagctatgatgtgcgtgtttctgaaaaaactatcagcactcagcagagcttgaagtttgtaaaagaaacaaaattaatcactacagcaatgcattgatatgtgtctatatgctaaataatccaagtgttgactcaaaatgtctctgctccaccagtgcaatgcaacgatacatatccgaatctgaatcttagtaacaggtatcaaattgtatcaaacaaaattacttccctttgacctaaggctatggccaacagatcgtgcatatggctgtgcaaaacactattttgcactgtagactgtactgtttacagaatagagttggaaatatgagatgagaatgagtaagctgctagagatagcctaacatatgcaacgagttaaaattaatttgctaaaaaccctataacatactccatccatttcgcgatgtgtccatggccaccattgggcataaagcaaggaaacatattgttggagggaaggccgtcgctcggccacgtgtcagtgagttccaacacatatctatgcaaacgaagcaacagatcaaccacaactaggtgcacacccccttggagtacacaagtcaacaagtgtgtacatgcattggttactcccttcccaataaacacatcacatttaaagtcagcaacataggaatcatcaaatcaacagacttgtaaataaaccataggacacattgcaaagcagaaggattagaagccagggaaaaaatagaactttgaatcgatggcagtgaagtcaagatttcaagacatacccagggcagaactccccagtcgcatgaatacaccggacgcgtgg

SEQ ID NO: 2455 - DNA, 1644 bp, Zea mays
aagctcctgcttttccactgctctgcgtctgcgtctgcgtctgcgtctgcactgcttcgcgtctccctccccccgcctccgccccgggaaaaaaaaaagcaaaacacggccatggaaggctacgaccgcgagttctaccagttcagcgaccagctgcgcctgcagacggccgccttctcgggcctctccctcggcgactccatctggtcccccgccggccggcgcaacaacagcaacgacgtcctcttcgccgcctcggcgtcgcccgccgacgccgccgccaagaccaacgccgtcgtcggcctcaagctcaacgacggagggcccggcctcatcggctccgggaagctggccttcggcggcggcggcaccaaggccgaccgctacaacaacaacaacctctccaacaccgacaacaagaccgtgtacaacagcagcagcagcttcatgggcaacggcagcagctacgccaagaacaacaacaacgccgcgtggcatgctggcgttcgacgagatggggagctacggctacaacagcaacaacggcggcggtaataccaacaacaacagcaacggcgtggaggtgaagagctacttcaacaagtccgccgggagggcggcgagcaacaacaacaacaacaacaacagccacgccggcggcggcaacaagaagggcggcgccggggagtacggcaggaagaagcacgccaagagcgagggcgcggcggcggcggcggccacggacaagcagcggttcaagacgctgccggcgtcggaggcgctgccgcggggccaggccatcggcgggtacatcttcgtctgcaacaacgacaccatggacgagaacctcaggagggagctgttcgggctgccgtccaggtacagggactctgtgcgtgctatccgcccgggactgcccctcttcctctacaactactccacgcaccagctccacggcatcttcgaggccgcgagcttcggcgggaccaacatcgacccgacggcgtgggaggacaagaagtgccccggcgagtcgcgctttcctgcgcaggtgcgggtggcaacgcggaagatctacgacccgctggaggaggacgccttccgccccatcctgcaccactacgacgggcccaagttccggctcgagctctccgtcaccgaggccctcgccctcctcgacatcttcgccgacaaggacgacgcctgatccccatcggatctgtcgtcgggccactcgaagctcggatgcacgaatgaatgaacaaacaataataacggatggatgggcatgtatatcgtcatgcgcatgtcccacgacgagacgggagtataccacggtggagtagtattatattaataattaatatagtatgtccacctttgtttgatactactaagggctatgtattgaggcacgcgtcccattgttttgtttttataacacttgtgcgatggttgcagacgactagccctcgtttatttttttggtaaaatgtctgtattattattattcgggttccactgacatggataaaaaccatctgtgaaatagtttgctcttgtgctgtactacaactcaaacgtaagaaatggattcgatctaagtctgttcacgcaccacaacatgcgtttccctagcgacaa

SEQ ID NO: 2456 - DNA, 1413 bp, Zea mays
gccgcccgcccggcgcccgcgtcggcaccttgcacacttgcacttggttggagctcctctaccttttccatcgctctgctctgctccgcgtctccgtccgccccggcaaaagcaaaacacagccatggaggggtacgaccgcgagttctggcagttcagcgaccagctgcgcctgcagacgaccgccttctccggcctctccctcggcgactccatctggtctccggccaccggcgccggcgggcggcgcaacaacaacaccgacctactcgcggcctccgcgtcggcagccgacgccggcaagcacaacggcgtgggcctcagcctgaatgatggagggcccggactcattggctccgggaagctcgccttcggcggcagcaaggccggccgctacaacaacctcccatccgagaaggccgcgcccgtctacaaccacagcggcgccacgatcaacggcggctacgccaggagcgacaacgccggcctggcggcgttcaacaagatggggagctacttccacaacagtaacggcaacggcggcggcggcggggaggtgaagagctacttcaacaagtccgccggacgggcggcgagcaacaacagccacgggcacgccggcggcggcaagaagggcggcggcggcgggaagcacggcaagaacgagggcaacggcggcgcggtggcggccacggacaagcggttcaagacgctgccggcgtcggaggcgctgccgcggggcgaggccatcggcggctacatcttcgtctgcaacaacgacaccatggacgagaacctcaggagggagctgttcgggctgccgtcgaggtacagggactcggtgcgggccatccgcccggggctgcccctcttcctctacaactactccacccaccagctgcacggcatcttcaaggccgccagcttcggcgggaccaacatcgacccgacggcgtgggaggacaagaagtgccccggcgagtcgcgcttccctgcacaggtgcgagtggcaacgcggaagatctacgatccactggaggaggacgccttccgccccatccttcaccactacgacgggcccaagtttcggctcgagctctccgtcgccgagaccctcgccctcctcgacatcttcgctgacaaggatgacgcctgagccttccttgccgccccctcgccgccagtgccaatccattaatgcacagacaataaaatggctggagggacagaccaaactatccacctttgtttgatatgataaagggctatgtatgaggcacgcgtcccattatttttgtttttattataagactagacctcgttccgtaagatacatgtatcaatattatataaaaacaaaccatcagttcttgtgctgcactaaaaaaaaaaaaaaaaaagcgcccggaaaaa

SEQ ID NO: 2457 - DNA, 533 bp, Zea mays
  misc_feature (464)..(464): n is a, c, g, or t
  misc_feature (527)..(527): n is a, c, g, or t
ccgggtcgacccagcgtccgcgtcaagagagcttgattgcccaccatggccattacgccgacccagtttgctaagaagacggcgcagtcggccaattggtctgatgccaagcgacgagtgctatcctcctaccgagaatggattcgagctgcccccgaagttcaaaccatgtacaacatgcccatgcccgtctccgccatccgaacccgtatgcggcaagaattcgaacgacaacgatttgtgaataagctctctgtcgtggacgttcttctcttcaagtcccacgccgagtaccaggagacaatgaacttctggaagcagaccaatcatatcatggcctacttcaaggaggagaacttccgaggtgacaagcgactaccatccagctttatgactggcttcctcgagggtcgcaactagcaacaagggcttgtgtatatatctcattgaaagggattcctccnaaaaaaaaaaaaaaaaaaaaaaaaaaaaaaaaaaaaaaaaaaaaaaaaaaaaaaaaaaaaaanaagggc

SEQ ID NO: 2458 - DNA, 1757 bp, Zea mays
gcacgagaccattacctagaacatcctaatcgaaaaactcccgcagtcccgctccagctttctctgccccgaccccgatcgatgctaaattcccgcgccgagccgctcgcccgcctcccaccccatcaccgagccgcctcgcgcggccccccgtcattttcgcccgactctctcgcctcggaggacgtagagagaggagaagggagtcgtcgtcgtcctgcgcccggcgctcgggccactggatccaggggttgcggtggatttggagcccggagtggactgattgctgatggtattctccgagggaggaggcagggagagagcggggcaggacgatggcgtcggaggatctcggcgtcgccactaaggatacagaagttgtaaacacaaaaccagcaaagcgatacccacttgcgttatggatagccatattgggcctgataatgctagttggtgtgtacatattctcgttgtctctaaagcaaaatgggatgcttttcgggctcatgcagacaaatttgatagaaaaggaaagggagaaaccttgtcatgatcccggtattccagacacagaaatcccttacttgcactacccaatgccaaatacttatgataggaaagaatgtgcgtgcacgggggttaggttctttgctatattgtcaatgcagaggtcagggagtggatgggttgagacattgttgaatagccatcctaatattagctccaatggagagatcttctctgtcaaagaaagacgcagtaatttcactgcgattaagaaaacactggacaaattgtacaatttggattggtacagcagtgctgctaagaatgaatgtacagctgctgtggggctgaaatggatgctcaatcagggcttaatgaagcaccatcaagagatagttgaatacttcaaccgaaggggcgtttctgcaatttttctactaagaagaaatcttctcaggcgttatgtctctatattagcaaatgctcatgatagtgccatgaaacagctgaatggaactcataaagctcatgtgcactccaaacatgaggctgaaattcttgctcaatataagccaaccattgacaaaaaaacattgatcgctgaactaaaacggtctgataagtttgcagctgatgctttggtgaatttcaagaacaccaggcatgtcgttctgtactatgaggatgttgtcaggagtcggacgatgctcatggatgtcctggattttctaagactgcctaagaggaagctgttgagtcgacatgtgaaaatccacactaaacgattgcgtgatcatattgataactgggcagacgttaataattttttgaaggggacgccgttcgagagctttttgaatggctcaaggagatgacatcgctagctgatgtatatagggctatagtgtgctgcccttttgacgctttggtacccctttctaaggttaacagagttagcacagtaggcaaaaaaaatttgacatcatgatcgaataagtttgggtcagtgagagaaatagttaggaagcagaagtagatatgcttgatccaggttagtctcatagatatggacttcatgacagcagaatgaagaccagaaacaatacctttggggttatcaaatattcaatgcaagaacttgtaaaagctgtctggactcattcatgaatacatcgaagtttacacctaaaaaaaaaaaaaaaaaggccgctcgatataaagcaagctaacgtacgcgcgcatgcacgtca

SEQ ID NO: 2459 - DNA, 2491 bp, Zea mays
  misc_feature (187)..(187): n is a, c, g, or t
  misc_feature (211)..(211): n is a, c, g, or t
acagctgctgtggggctgaaatggatgctcaatcaggtaatccttatattcatcacacttgttggtggagcaaaaacttgctcacgtgataatttcacagaacatttttcatcttgattatttatactcttaatggatatccaatgtggaaatttataccattcttggagtagttttatattgtggnacaaattggtacttactattaccnttttttttccttctgaaacttaatctggacataccatgattatcttgcaattgcaacctagttccttttattatatcatactccctccgttcttttttatttgtcgcgttttagttcaaaaatgaactagcggacgacaaatatcgagaacggaggtagtacttatgtatttccttaagtggaaatttggttggattacttatggactatctgaaaaccaaggaaagaagactatcaaattttgatgcactaccttcatcaagattgataattttatttacatggaaaattgctttcctgcaagtgttaaacaaactgttaaaatactacaaggagcaaaattgttaaaataactaagattttatcatatctcctgatccttttccccctgtttcaaaactgcttgctttaactttacaaagatgattgatgtactgaatatgtttattctagacaatggcaactgatacatatggcccttttcattctatagaaacttttgccacagaattgtagatcagattgaaggattcattatctaagatgattcttggtatatattttaaaaaaagcaaaagatctattgagtttgtcttttgatttcatgatttgcacatagaactattctttgtatcaagattgtttgtgtggcaaatttccaaagatatattcagcttccttgatctgtcttatctagtgatatgcttattctagtgaaaattatagggcttaatgaagcaccatcaagagatagttgaatacttcaaccaaaggggcgtttctgcaatttttctactaagaagaaatcttctcaggcgttatgtctctatattagcaaatgctcatgatagtgccatgaaacagctgaatggaactcataaagctcatgtgcactccaaacatgaggtgcacatcttccccttatgttgcctaaactaagtgtcagattttattcaagcatgcatcttttggtatcataaatatatcaaacatatatgattacaacttgtttctgctaaaaacggtgcagatgtgtgtcgagtaaaagagaatcccgttgatcctttttccccctttgtgcaggctgaaattcttgctcaatataagccaaccattgacaaaaaaacattgatcgctgaactaaaacggtctgttaagtttgcagctgatgctttggtgaatttcaagaacaccaggcatgtcgttctgtactatgaggatgttgtcaggagtcggacggtgagttgctgttgcttcatgtcggtctgttgaggctaaatcaaacttccattttcctgaacaatgtgttgtttctgtcttcagatgctcatggatgtcctggattttctaagactgcctaagaggaagctgttgagtcgacatgtgaaaatccacactaaacgattgcgtgatcatattgacccacgggtccgcgttaataattttttgaaggggacgccgttcgagagctttttgaatggctcaaggagatgacatcgctagctgatgtatatagggctatagtgtgctgcccttttgacgctttggtacccctttctaaggttaacagagttagcacagtaggcaaaaaaaatttgacatcatgatcgaataagtttgggtcagtgagagaaatagttaggaagcagaagtagatatgcttgatccaggttagtctcatagatatggacttcatgacagcagaatgaagacgagaaacaatacctttggggttatcaaatattcaatgcaagaacttgtaaaagctgtctggactcattcatgaatacatcgaagtttacacttgaaaatgatagcccagccggattgccgccacaagtgctcaactgctcatactccttttgtgcacatgttggccccctcgaaagtatcttggggtgtgtttggctagtgggttgatacccgtgtttagttcaaaaggttttcgggttaggttggttccgagtcagaatctttcttaaaaatgcgggttctagtgattcctcgaaaacaaccgaaccacttcgacccagctcctccccaccccgcctgtcacctgcattatcctcacccgacaggacgacaccagcgcaggggtgtaggggcggaccactgtcggggtgttcttcggtcataggactccgccgccggcctacccttcggtgcgctgcgccctcgaccgcgcctgctccgtcttgagccagcccaacaccaggtgagaagcatcgtaatactttttaggatcaagatttctcctcctttctaggataaacggccggc

SEQ ID NO: 2460 - DNA, 1732 bp, Zea mays
acgtaaggacaaacgcgaacggaaccctccccagcagatgagcggagtaggtgggcggggttctcctccactcccgctccagctttctctggcccgatcgatgctacattcccgcggcgagccgctcgccttcctccgcgggccttgggctacccaacccatcgccgagccgcctcgcgcggtcccccctccatctttgcccggctctctcgcctcggaggacggacagagaaagagaggatgagaagggactcctcgacccgcgtcccgcgctcgggctattggaccgaggggttgcggtggatttggagcgcggggtggactcgtcgctgatggtattctccgatgcaagaggcagggagagagcgggacagggcggcggcggcggcggatctcggaggcgtcgccgctagcgtcaggccaacggatacagcagctgtaagcacaaagccggcaaagcgatacccactggccttatggataggcatattgggcctgataataaaaggaaagggagaagccttgtcatgatcccagtattccagacacagaaatcccttacttgcactacccgatgccaaatacttatgataggaaagaatgtgcgtgcacaggggttaggttctttgctatcttgtcaatgcagaggtccgggagtggatgggttgagacgttgttgaatagccatcctaatattagctccaatggagagatcttctctgtcaaagaaagacgcagcaatatcaccgcgatcacgaaaacactggacagattgtacaatctggattggtatagcagtgctgctaagaacgaatgtacggctgccgtggggctgaaatggatgctcaatcagtgaaaattatagggtctaatgaagcaccatcaagagatagttgaatacttcaaccgaaggggtgtttccgcaatttttctactaagaagaaatcttcttcggcgttacgtctctatattagcaaatgctcatgatagtgccatgaaacagttgaatggaactcataaagctcatgtgcactccaaacatgaggctgaaatccttgctcaatataagccaaccattgacaaaaaaacattgattactgaactaaaacggtctgataagttggcagctgatgctctggtgaatttcaagaacaccaggcacgttgtcctgtactacgaggatgttgtcagcaatcgcacgatgctcatggatgttctggattttctcagattgccaaagaggaagctgttcagtcgacatgtgaaaatccacacaaaacgattgtgcgatcatatagataactgggcagatgttactgattttttgaagggcacaccgttcgagagctttttgaatggctcaagaagatgacatggctagctgatgtatatagtgctatagtgagttgtccttctggcgcctcgtaggttttttttttttttgataccatgatgaaataagtatgggccactgagagaaatagttaggtagagatgcttgatccaggctattagagctgtagaataaagattaaaaacaatacctttgtgattatcagatatctaatgcaagaacttgcaaaactgtctggagtcattcgtgtatacatcaaagtttacacttacacttgaaaatgaataggccaagctccgtggcagaggaactgaggaaaaaggcagagtagcctatacaaaactgatgatttttactagcaaaaaaaaaaaaaaaaaa

SEQ ID NO: 2461 - DNA, 2152 bp, Zea mays
gcacgagcagcaggagacggccgccaggtttttttccttttagaccgcaacctcaaaaccctagcttgtccctcctgctcccagatctcttccactcggccactccctagcacatcaaaccctagctccgcccagcccccaaccatgtcggcgatgatgcaaccgcagatcatcctgctcaaggagggcacggacacgtcgcaggggcgcgctcaggtggtgagcaatatcaacgcgtgcacggcggtgggcgacaccgtgcggaccacgctggggcctcgggggatggacaagctcatccacgacgacaagggcggagtcaccatctccaacgacggcgccaccatcatgcgcctcctcgacatcgtgcaccccgccgccaagatccttgtcgacatcgccaagtcgcaggactccgaggtcggcgatgggacaactactgtggtgcttctagctgcagaattcttaaaggaagcaaaaccttatatcgaggacggggtgcacccccacagtctaattcgcagttatagaactgcaggcaatatggcaatccaaagggttaaagagctggcagttagcatagaaggaaaaagccttgaagagaagaaatcactgctagccaagtgcgctgctacaacactctcttcaaaacttataggtggtgaaaaagaattctttgcttctatggttgtggatgctgtccttgccattggcaatgatgacaggcttaatcttattgggattaaaaaggttcctggaggtaccatgagagactcttttttggtgaatggtgttgcgttcaagaagacgttttcatatgcaggatttgagcaacaaccaaagaagttccttaatccaaagattcttttgttaaacattgaactagaattgaaatctgagaaggaaaatgcagagatcagattgtctgaccctctgcaataccaatcaattgttgatgctgagtggaacattatttatgacaaactggataaatgtgtgaaaagtggagcaaagatagttctgtctcggctagctattggtgatcttggaacacagtattttgcagatcgagacattttctgtgctggccgtgtcactgaagaagatttgcaacgtgttgctgcagcaactggtggaactgttcaaacttctgtaaataatgtcatcaatgatgtactcggttcctgtgaggtattcgaggaaaagcaagtaggcaatgaaagattcaacatatttagtggctgcccttctggccagacagcgactattgttctccgtggtggtgcagaccagttcattgaggaagctgaacgaagtctccatgatgccatcatgattgtgaggagagcacttaagaactcgacagttgtgccgggtggtggtgctattgatatggaaataagcaagtatctcaggcagcatgcacgaacaattgctgggaagtctcagttctttgtaaattcatttgctaaagcccttgaggttattccacgccaactttgcgataatgctggatttgatgccactgacgttctcaataagctgaggcagaaacatgcatctggtgaaggtgctaattatggtgtagacataaacactggcggaattgctgattcctttgcaaactttgtttgggaacctgctgttgtaaagatcaatgctataaatgctgcaaccgaagcttcctgccttattcttagcgtcgacgagacagtgaaaaacccaaagtcggagagcgcacaaggtgaggctgctgccggtgcgatggctggtcgcggtcgaggtgcaatgcgaggacgtggtggcaggggcatgcgcaggcgataaactgggtcaagtagatcatggtgagatttttttgcatgtttgcgagtgcttttgtgccttactgcacatgtatggacgctgcacttactattgtgcgcttttggttgtgaagcagtcgtagactttttttttgtttcagaagagatgcaccaggcgtttatcagtgtaccgtccgctggatgtgttatagtagacctgagctttggattctaatttgtttgacatttatcttggtttattggcttgtcttttgaacaatgagaaaatcagtgttgtagtttgcgatcctcgtgcgctcaagcgtaaaacaaaaaaaaaaaaaaaa

SEQ ID NO: 2462 - DNA, 851 bp, Zea mays
  misc_feature (4)..(4): n is a, c, g, or t
  misc_feature (18)..(18): n is a, c, g, or t
ctgnaacgaatctccatnatgccatcatgattgtgaggagagcacttaagaactcgacagttgtgccgggtggtggtgctattgatatggaaataagcaagtatctcaggcagcatgcacgaacaattgctgggaagtctcagttctttgtaaattcatttgctaaagcccttgaggttattccacgccaactttgtgataatgctggatttgatgccactgacgttctcaataagctgaggcagaaacatgcatctggtgaaggtgctaattatggtgtagacataaacactggcggaattgctgattcctttgcaaactttgtttgggaacctgctgttgtaaagatcaatgctataaatgctgcaaccgaagcttcctgccttattcttagtgtggacgagacagtgaaaaacccaaagtcggagagcgcacaaggtgaagctgctgccggtgcgatggctggtcgcggtcgaggtgcaatgcgaggacgtggtggcaggggtatgcgcaggcgataaactgggtcacgtagaccatggtcagatttttttttgcctgtttgcgagtgcttttgtgccttactgcacatgtatggacgctgcacttactattgtgcccttttggttgtgaagcagtcgtagacttttttttttgtttcagaatagatgcaccaggcgtttatcagtgtaccttccgctggatgtgctatagtagacgtgagctttggattctaatttgcttggcatttatcttggtttattgtctttttgaacaatgagaaaatcagtgttgtcgtttgctaaaaaaaaaaaaaaaccctccccggggggccgcccaaaaccccaggg

SEQ ID NO: 2463 - DNA, 855 bp, Zea mays
tacccttcgaagggccggccccccgcctcccggggaacacacagaacatactcccgctgaagcgctgagaagtagataagaataatatggggttcagtgaggcacaggaagagctcgtcctccgttcatggaaagccatgaagagcgactccgagtcgactgctcttaagttcttcctcaggatctttgagatcgcgccgggtgccaagcagatgttctccttcctgcgcgacgccggcgacgcgccgctggagaaacaccccaagctcaaggcccacgccgtcaccgtcttcgttatggcatgcgagtcggcgacgcagctgaggagcaccggcgacgtgaaggtgagggaggccaccctgaagcggctgggcgcgacgcacgccagggcgggcgtcgccgacgcgcatttcgaggtcgtcaagacggcgctgctggacaccatcagggacgcggtcccggacatgtggacgccggagatgaaggcggcgtgggaagaggcctacgaccagctggccgccgtcatcaaggaggagatgaagaacgccgccgccgccgaggagcagacgaagaacgccgccaccgccgaggaggagattaagaacgccgccgccgccgaggaggagacgacgaacgccgccgcggctgttgatggttcctagctcccactacgctcctctgctagcgaccgtggcacgcgcaccgctgcgttgatgggtgcttttggactgctgctggcctgatacctacctacgaagctgttgctaatgctgctgcatttttgtttgtcgaccgcatcattgtgatgataaataaaatgttcagaaaatgcccgttaagccaaggggaaaaaag

SEQ ID NO: 2464 - DNA, 1033 bp, Zea mays
atggacagaagatgcttctgccccgttcgcacgttcaagggccacgcacctctccgaaaaatcaaagcacagcctcctgtagctagccctagcttgagtctctcccggtctcccctcacctcacgctggttgcctatataaacgaagatcagatctcgcaccggcgtagcatcacacggggaacacacaaaacatactcctgccgaagcgctgagaagtagctagacaagaataatggggttcagtgaggcacaggaagagctcgtcctccgttcatggaaagccatgaagagcgactctgagtcgactgctcttaagttcttcctcaggatctttgagatcgcgccgggtgccaagcagatgttctccttcctgcgcgacgccggcgacgcgccgctggagaaacaccccaagctcaaggcccacgccgtcaccgtcttcgttatggcatgcgagtcggcgacgcagctgaggagcaccggcgacgtgaaggtgagggaggccaccctgaagcggctgggcgcgacgcacgccagggcgggcgtcgccgacgcgcatttcgaggtcgtcaagacggcgctgctggacaccatcagggacgcggtcccggacatgtggacgccggagatgaaggcggcgtgggaggaggcctacgaccagctggccgccgtcatcaaggaggagatgaagaacgccgccgccgccgaggagcagacgaagaacgccgccaccgccgcggaggagacgacgaacgccgccgccgccgccgaggaggagacgacgaacgccgccgcggctgttgatgcttcctagctcctagcctagcctcctgctacgctcctctgctagcgaccgtggcacgcgcaccgctgcgttaatgggtgtttttggactgctgctggcctgatacctaactacggagctgtcgctaatgctgctgcatttttgtttgtcgaccgcatcatttttgtgatgatgaataaaatattcagaacccccccgccctgcgagtgaaatttgactgaacgtcgtg

SEQ ID NO: 2465 - DNA, 3006 bp, Zea mays
aaatacgggatacaggaactgggtaccctcctcctgatcgaaggcaatagccaggacaagggcatcccgacgggcatactgctacaggggctcaggcttgccacctctcaacattacgacaacccttgtactcctaggctccctccttgcggctataaaaggaggagtctatggtccctagaggagagaggaccacactccatcttttgccctccactttcgatattgacactagcctcaatcactcatagagacttgggatccattccctctctcgatcagcttgtaccccctactacgagcacctaggtgcaagataatagaagtttcatccccactcgctggaagtagagccttctattgcctgaaccaggataaatcgtgtgtcttcttgcatcacccatctgggccgtgacacgtagcacaaatacactagttggttaggacccttgggttaaaacaccgacaacaacattgttgcaaccatccctagtatctctgtcgtcgcccggattgccgacaacaccgaacgctacaagtgattcttcacaacgatgacaacaacattcaccaatagacctgagcatgggccaccttgaccaatgcgacaggcgaacatgagccatagtttttatttgtaacaatccacgagtcaagtacaaaccattatttttttatccaaaacccgacccaaccccaaaaaacttgatctaacacatctaagatggaggcacagatcaacccaacccgctatgcatgagtcatacgtggaccttaccaaccgatttataacccaaccttgatctgatctgacgagctcggcgagtacatccctattccctagggccatcaagctttttgagtcgtgtcgggccacgagcttgctcagattatctctagcagattttatatcccacgctttatctcactatttatttcaaatttcactctataaatattagagtatatactgtaaaatagtattttgtacgaccgtttacacgccttgagagtttcgggttgagatccggctgagattttttctccaggctctctacggcccagcccaaaacagaaaccctcccgaccccactaccctcgcccccccggcgttcccccccgttttcgttttccggtgccttgcttgttctagtagccggttctcaatcctcacccaagcgcctctaggccgaggctcggaggccacggcgaggaggagcagcagctgccagcaggggaggacacggatagtagccggcctcccgccgcccgaggcccaaccgcccccgcaattactgttgttgctgcgtgcagagcggttttgaattgccgtctcctacccaggaataatccatggccccgcctccgccatggcttgccgccctcctcttcctcctcctacccgcgctgctgccggcggtcggctccgtctccggcgcggcggctgccggcatcttccgggtgcggcgtaagttaccagccggagttggaggggacactggcgccaacatcagcgcccttcgtgcccacgacggtcgccgccacggccgccttctcgcggctgccgacctcccgctcggtggcctaggtctccccactgacaccgggctctacttcacggagatcaagctcgggacgccgcccaagcgctactacgtccaggtcgacactggcagcgacatcctgtgggttaactgcatctcctgctcaaaatgcccccgcaagagcggactcgggttagacttgacgttctatgaccccaaggcgtcctcgagcgggagcacggtgtcctgcgatcagggattctgcgcggccacctatggggggaagctgccagggtgcactgccaatgtgccctgcgagtacagcgtcatgtacggtgatggtagctcaacgactgggttcttcatcaccgatgcgctgcagtttgatcaggtgactggggatggacagacacagcctggcaatgctaccatcacattcgggtgtggtgctcagcaaggtggggatttgggcaactcaaaccaagctcttgatggaattcttggttttggtcaggcaaatacgtcaatgttatcacagctagctgctgctggtaaagcgaagaagatatttgctcattgcttggataccataaagggtggtggaatttttgctattggaaatgttgttcagccaaaagtaaaaacaacaccgttagtagctgacatgccgcactacaatgtgaaccttaagtcaattgatgttggtggcactacattacagctcccggctcatgtttttgaaacaggagagaaaaaaggcaccataatcgacagtggtactaccttgacataccttccagaattggttttcaaacaagtaatggatgtggtatttagcaagcatcgagatatagccttccataatttgcaagattttttgtgtttccaatattctggaagtgtagatgatggattcccgaccatcaccttccattttgaggatgatcttgcactgcatgtgtatccacatgagtactttttcccaaatgggaatgacatatactgtgtgggattccaaaatggtgcattacaatcaaaagatgggaaggacattgtgcttatgggagatcttgtgctttcaaacaagttggttgtctatgacttggaaaatcaagtcatcgggtggactgactataactgttcgtcgagcattaaaattaaggacgacaagacaggcacaacctatactgtcgaatcacatgacatatcctccggatggaaattccactggcacaagtccctggttctgttgttggtaacaatggtgtggagctatttatagtacactaactctattgtacaacacgaacacgcacttaccgaaattcatttgattcgtattcttttcacaaaaaagaatatctagggttttaacttgcgttctctgaccacggaaaacgatgaaaacaaaaacgttgtgtgccatacaatgagcctgtgtgtcacaaaaaaaaaaaaaaaa

SEQ ID NO: 2466 - DNA, 1752 bp, Zea mays
ggtcgttaaatcgcctatgggctcaccggccgatgacaacctccggcggcggcggccggccggccggttattaatgcactgtgcgaaagcaacgcctcgaggccaagcacatccggcgtgcatgctcgactataaatacccggccggttgcaccggccagtttcatccagccatcgattctcctccagttcataggcacagcagcagaaagcgccaggagcttaagaacatggcgaacaggggcttgcatctggctctgttcctcgtccttctcgggctgtcgtccaatttggcagccgggcagatcctgttccagggcttcaactgggagtcgtggaagcagaacgggggatggtacaacttcctgatgggcaaggtggacgacatcgccgaggccggcatcacgcacgtctggctccctccggcgtcacactctctcgccgagcaaggctacctgccggggcgcctgtacgaccttgacgcgtccaagtacggcaacgaggcgcagctcaagtccctgatcgaggcgttccacagcaagggcgtgaaggtcatcgccgacatcgtcatcaaccaccgcacggcggagcaccaggacggccgcggcatctactgcatcttcgagggcggcacgccggactcccgcctcgactggggcccccacatgatctgcagcgacgacagggcgtactccgacggcacggggaaccccgacaccggcgccgacttcggcggcgcgccggacatcgaccacctgaacccgcgcgtccagcaggagctcaccggctggctcaactggctcaagacggacgtcggcttcgacgcgtggcgcctcgacttcgccaagggctactccgccgacgtcgccaaggtctacatcgacggcacccagccctgcttcgccgtcgccgagatatggacctcgctggcctacggcggcgacggcaagcccttctacgaccagaacgcgcaccggcaggagctggtgagctggctggaccgcgtcggcggcaaggccagcccggccaccacgttcgacttcaccaccaagggcatcctcaacgtggccgtcgacggcgagctgtggcggctgcgcggcgctgacggcaaggcacccggtttgatcgggtggtggccggccaaggccgtcaccttcgtcgacaaccacgacactggctccacgcagcacatgtggccgttccccgccgacaaggtcatgcagggctacgcctacatcctcacgcaccccgggaacccatccatcttctacgatcacttcttcgactggggcctcaagaacgagatcgcgcacctggtgtccatcagggaccgccacgggatccaggcggacagtgagctgcgcatcatcgaggccgacgccgacctctacctcgctgagatcgacggcaaggtcatcgtgaagattggatcaagatacgactgcgggcacctcatcccagaaggcttccaggtcgtggcgcacggagatggctatgccgtctgggagaaaaactgagccaaatctgtgcctgatccgtccgtccggtccggcacgacgagttttagcggatttgacctgcattttccttagcttattattactccaaatacgggatatatatagcgacaacctgtattcgagatacatgcgtgcccccagggacgcggaaaaagaaagagaagcacgcgtgtcaggacagccgaaagaagaacttgtgaagattattttttcccctaaaaaaaaaaaaaaaa

SEQ ID NO: 2467 - DNA, 1594 bp, Zea mays
ggtacctgcagtacggtccgccggccgggtccccacgcctcccgccccggtctcattctcagtgtagagaggggaagaggaacaggagcaggaacagagagagagagagagcaatggggaacaggcacctctgctgcctgtgcttgctccttctcctgggactggcgtccggccaggtcctgttccaggcgttcaactgggagtcgtggaagcagagcggcggatggtataacctcctgatggggaaggtcgacgacatcgcctccgccggcgtcacgcacgtctggctcccgccgccgtcgcactccgtctccacccaaggttacatgcctggccgtctgtacgacctggacgcgtccaagtacgggacggcagcggagctcaagtccctgatcgccgcgttccacggcaagggcgtgcaggtggtggcggacatcgtcatcaaccaccggtgcgccgactacaaggacgcccgcggcatctactgcatcttcgagggcggcacgcccgacggccgcctggactggggcccccacatgatctgccgcgacgacaccatatactcggacggcacggccaacctcgacaccggcgccgacttcgccgcggcgcccgacatcgaccacctcaacgaccgcgtccagcgggagctcaccgactggctgctctggctcaagtcgtccgacctgggcttcgacgcctggcgcctcgacttcgccaagggctactcccccgaggtcgccaaggtctacgtcgacgccacggccccgaccttcgccgtcgccgaggtatggaacagcatggcgtacgacggggacaacaagcccgagtacgaccaggacccgcaccggcaggcgctggtggactgggtcgacagggtgggcggggcggcgtcgccggccaccgtcttcgacttcaccaccaagggcatcctcaacgccgccgtcgaaggcgagctgtggcggctcatcgacccgcaggggaaggcgccgggagtcatcggctggtggcctgccaaggccgtcacctttgtcgacaaccacgacaccggctccacgcaggccatgtggccgttcccctccgacaaggtcatgcagggctacgcctacatcctcacgcaccccggcaacccgtgcattttctacgaccacttcttcgactgggggtttaaggacgaaatcgccgccctggtggcggtgcgcaagcgcaatggcatcacgccgacgagcgagctcaccatcctcgagcacgacggtgactcctacgtggcggagattgacggcaaggtcatcgtaaagatcgggtccaggtacgacgtcggccatctcatcccggcgggttttgaggttgccgcccacggcaacgactacgccgtctgggagaaagccggcgccgaacaagtgactcgagcataatagagtgctcgagataccgatttgattctcagtacaatgtacacgggactgcattgataaaataagtggtttctcctctaataagtaagggagcgtaaaagggcaattggagccatgcatatgtaaccttaaaatattgttgagtaaaatataaaggtgatccctaaattctccttttc

SEQ ID NO: 2468 - DNA, 2232 bp, Zea mays
  misc_feature (5)..(5): n is a, c, g, or t
  misc_feature (8)..(8): n is a, c, g, or t
  misc_feature (15)..(16): n is a, c, g, or t
  misc_feature (30)..(30): n is a, c, g, or t
  misc_feature (38)..(38): n is a, c, g, or t
cgggnaancggccannaggccgggggggcngaggctancggaaaaccaattcggggtggttccttgtggccttcgtagaaggcgcaagtcagagacccttcgtgctcagtatattgatgtcagggagctcaggatttgtgctggaacatggaatgttgcaggcagacttccacctaatgatttggatatccaagaatggttggatatggaagagccagctgatatatatgttcttggatttcaagaaattgttccactaaatgctgggaatatatttggcgctgaagacaaccgccctgtagcaatgtgggagcatattattcgtgaaactttgaataagatcagcccagataaacccaaatataaatctcacagtgatcctccttctccgtcaagattcaagccatctgatgatgcttttgttatggaagatgaacttattagtgagtctgatagtgaaggtgatggggaggtgcacccattgaacgaacaagatttggtcgactctgttgatggcattcatggtaacaaatgtgaacctcaaacaattttacaagatgacgagttcagcaggttgccttcagtgaagacttttgacagatccaataacctaagttttaaagaatctaatttggaagagaagatctgccagaagatattaactaaaacattcagtcactcagagaggcttgggatgatttggcctgaaccaccattggatatgttggcccagtgtcttccagacagcacaaagtcatttgcttcaggaaaggttttaagatcatatttgtctttcaagtcggtaaatggagattctggtccatttgctgaggacaattcagttcctgattttcatatgagctgtgcagcagttaaaagaaaaaggccatactttgtaagaataataagcaagcagatggttggagtgtacctatcaatatgggtacgaagaagcctccgaaagcacattcagagtctgaaagtatcaactgtaggggttggtgctatgggctacattggtaataagggatcaatatcagtaagcatgtccatataccaaacacacttttgctttatatgttgtcacctgacctctggagaaaaggaaggagatgaactaaaaaggaatgctgatgttcaagaaatccaccgaaggacaatatttaatccagtttcgagagtcaacatgcctaaaacgatatatgaccatgaaaggattgtatggctaggtgatctcaactataggatcaacttaccatatgagaagacacacgaactcatatccaagcaggactggaacgaattgtttgggaaagaccagctgaaagtagagctgaagaaggggcatctgtttgaaggatggaccgaaggggtcatcaactttcctccaacgtataagtacaaggttaactcagaaaagtacataagtgatgataacaaatctggaaggagaacacctgcatggtgtgaccgaattctttcccatggtaagggtatgagattactgtcatataagacagttgatctcagactatcagatcaccgccctgtgactgctgtgtacatggcagatgttgaggttttctcttcaaaaaagctgcagagagctctgaccttcaccgatgcagaggctgaggaacagctctccttcgaggaagacagtgcttctggaatatacaaccttggactatatgaaagttcaaggtaatcttggacacacattgaaacagactttatgcttttctcaagtatccaaggaagaacaggcaagttggtagtaggtagtcctgtacaattttatccaaaatatggtcagagattacgacttagtcctgctgcccagcatgtgcctctctatttttctgagaccagcagttggtagtaggtagtcctgtacatttttatccatgctctgaccatattttgaaatcagatgacatgcatttgctgcttttgagtactgtgtacctcatatgtgcaaaaataatctctgaccatattttgaaatcagatgtcatgtattttgctgttttccccctccccctttttgaggtggtgtgcctcatatgtggaaaccttttagctgtaattaaaaatgttggatacagtaaatatttcacacagattgtgacattctgtaatttcacttccagtgtaatttttctttcctctttgacaccccttctccagccgtggcttccacctgtactgaatgatgcaaaatagtggacc

SEQ ID NO: 2469 - DNA, 4858 bp, Zea mays
atatatatatatatatatatatatatataatatggattttattttatcagcaaatttaagatgcaccttacatgtcagcaaaacatatgcattcgtttattttcctcagtctcagcaaaacactgtttctttacttctttctttttttttagtcttccttgtcacatgcagtatgctaagtaaatattcagcacgttctatcataatgatgttgcgttttagcttcctgcagctccttgtcagattcattggcatttgtttcactcacttcctatgctttagttccaataccaagagtagtgaggtatcaccgtatcagtgacagacaggattttcgtgttttcagacatagaatctctttaaaaaaaggattgggacttgatcgatcctgttattagtgtggtcaccacagtccattagatacggggagtcggcagaaaagaaaacggccgcagatcttaatttcccaagattcggatggcccacgtagatatggcatcagaaggcagagaaaagggtttagggagcttacaaacgccaaagaagttatagatgccccagtggtaaccatctttgttgacttcttatcgagaaaggtagaagatgagtacagaacggatgttgcttgaactgaacgttccaaagagggagaagggcagcctatgcgactttttttttggttctggaaaaatcacctcatatacatatacatcaaggaacaatgcgaaaggaaggcgtccagtgaagattcaggtcagaaagttttaggaaagttgtgtaaaacagtaaaagactcacacgagaccttctatgcgaccaaaaacaatacgacaaagttactaaaaatgtaacaaaagcaaacctaccgcttgaaccagcctatatatctccgatacaaatttgaaggccacgcggaacatggggtttagctagagttttttgggcctgtgtaatcttgtgagacctgtgaggccgctcgcgtgctcatatcctgcttcttttgctcgtaggcctccagcccagcctaggggaggctgcctcgctaggagcccatggcccatctccttccctagaaaaaatggtggggatagaatagaaacgatggatacggtactgttggatgattgtttttttttcgccctaaaatctgtattgggacgagatgctttatatacgtttcaagagtagacaccgtgctggcgaaccagcaaaatctgcaggccgcagccccccctcaattagtacttagtggcaatcaactgtatcaatcaaattgatcccatcttttccctagaaatagaataaagacaagaatggcccttaaaattgcggaggtgcttctgaattccaacgcttccacagagccgccggcgccgcgtgcgttgctaagctaacccaccctctccgccacggctgacctgctcaaccgcttgctctcgtggatcttggcgtacaccctcttcgtccggacgcagagcaggacgtcgaggccgaacccgacgacgcaggcgagcgccatgatcaggaagacgaggcggtagcagtgtgcgccgacgcaggtgttgccgccgccgggcaccgcgggggcttcccgcgtcgtagaggaggcccgccagcaggcccgagaagaggaaggagccgagcggcaggttgaggatgaggacgttgtagacgagaccgtagtacttgaggccgaacagctccgacgccgtgggcacggtgaccgccagccgcacgccgtagcagatgccgacgaccaccgagccgatgaagagggagcctggcatcgccagcgccatcacgatgtatccgacggccatcaggacctgcgaggctgcgttccacagcgggcggggaatacctcgtgtcctgggcactatatatgtcaacattttcttcttctggatttggagttatatgattccattccataccaattgccaattcgggtaataagtaacttacttgatgaagtgctcggagatggtgccggaggcgatgcgaccgaagaatccccagatgctggtcatggagacgaagagggagacgtcgacgtagcccatggccacgcccatctgccccaggttgttcatcacggccagccccgtgcccacgcccatcaggaacgacgcgaacatcagccagaagtccagcgacgtgagcgtctgcgcgatcgtgtgctcctccccgaggcgcggccgctctccgggagcacgcgcctccttcgcgacgagaagcagcggcgcggccgcggcggccaaggagtccgcctcctcgaggtcggcgttcgcggccttgcgggtctccgcccacgatttccacgccaggatcgccggcacggcagcgggggacgcgaggagcaccaggagcacggcgacgaagacgaccccgccccccgccgccgagccccgtgaggtccgcggcgaggaggtacagcgcgattgccacggcgagcgagttgatcgcggcgaagcagcgcccgtcgtcgtcctcgtccgcagcggcggcgccctcgcggaggaacaccatggcgagcgcgcagacggcggccggcacgacggcgagcatgacgaggaacgaggccgggtcgtcggcgaagagcgcggagcaggtgtcggtgaagatggcggtgctgaggccgacgtagcccttgagcaggccggagacggggcccctactccggcggaagttgcggatgcaggtgacgagcacggcggtgttcatccatgtggtgctgttcccgccgagacagaggaagacgcacatctgccagtacgggagcggcgcgacggccccggacacgaccatccactgcgcgccgtagccgaggaggccctcgagggagccgacggcgaggaggagccaggtggggacgcggtcggacgccagccccgcgaggaggccgaacgccttgccgacgtccttggcgacggagaggccgttgagctgcagctgcgtgaggcccatgagcgtcttgagcgcgtgcgagtagttggagaaggtgtagttgttgccggagatgcactgcacccacaccgccgtcaccagccccagccaccgcccccagcgcgtccccgccattagggcctttccttgcttgcttcgagttcaatcaaggtggcgcgcgtttggtcgcttggtgcttggccgtgtgtcccgaggaggaggaggaggaggtacggaaggggcggtggaggcgcgtcgctttccggtgcgtcgggcgggactcgaggattcgttcggtctggtcggccgtaggagcagggccggtggttttatcagcggctgagagagggagggtacggcttttcttggagtaatttattggtttttagaaagagtatacaagcgattattatatgattttgatggtttttgaattgttatggaaggaagtgtcatggttttgagttttgatgtttttttgtttgagcccttgaccctaggctgctggtaccatcaccggaagcgaagcgtgcaggctagttcccgtccgtcaagcatcggcaagcccgctcccaaacatctgcatgagtagcctacctacgcaaaagcaacacgcacgtctccatctgccctactgcggcctgcctgtcaacagcagcctaaattaataaacaataataataatatactgaaaccaaaacacacacggttcattgtgcggcacgaaaatggtttgctttagttcgtcagaaacccgtaagcatctcccaaaggtaatcgggttcaggacgtgccgccaagcatgtccaatcaaacctttcccccgcagcctttctctgctcgtgttactgttttttttttcatgccacttgccggttagtgtcatagaaaacatttcttgccccagacgatcttttgttgccccggccgccggcgaggtaagccaagttcgccagtgctaccactgatcatgaacgagagaaagcgacgtgacacactgtttctgacttctgactatgatctttgctgcggcgggaggagaagcaaagtgcggatggaattgtttgtaccgagctcagtttttaaaaactgttaatgttcagtctctacagttgtgtagccttttttttcagaagcagccgaaacagctatacaaaactgatagccgaaacaacggattcgtaaagaatcttttgaaggcccagccaaaaggtcaggtctgatcttttcattgtaatttgtagagatcactgtttgggcgtcaaatcgatacgcattcccgtaatctatttattagctgcaagctatttttttgttaagaaaggtgtttggttctaacgtatcagctaattataaaactaactataattttaactagcattcaaacattctatacggtaggtgataaactttatcttgaacacatcctgcaatgaaccttatcttgaacactgtcaggtttgcaggtttttttcccccgaaagaccgagagccaagggagacgaaatggtagtgatagggaccggtcgaagagagaagtcggcgctgcacgtcctgactgatggagtacgtgacgggacactccaaagatcacgtcggtcgtacaagacagcgacggtactcgttcagcatctcgctagctccccgcccgacgcggacatgtacgagtacgacttgagcctgggtgctgtttggttaaaaaaaatgtaacgcaaatggtaatggtaacggtttacgatcgattactagtggtaacaaatttgaatagactagtatcaatttttagtatggtatctgattacggttggactaaaacaaacatgatttaacgttatcagttacccattgcgttacaaatatgtgaaccaaacggcaccctggatcgttttataaatatatatatatatataac

SEQ ID NO: 2470 - DNA, 2436 bp, Zea mays
  misc_feature (2387)..(2387): n is a, c, g, or t
attaatcattcgaaagcccgtttaatcgagagcagcgaggagagcgagcgcaccaacgggatctgagcatctgaccagccgcttgctagggtttcgtcccccctctccctcggccagcaccacctcgcatccctagctctagccttgctcgccccgggatcctgtagcggccatggcggcggaagcgccaccgtcggcttcggcgtcttcttcctcggccccgcggccgcctgccgcggcggcctctgcctccggcggcggggcggccgggtccgcggagtcgtacatcgggagcctcattagcctgacttcgaagagcgagatcaggtacgagggcgtcctttacaaaatcaacaccgaggagtccagcatcggcctgcgcaatgtgcggtcctttgggaccgaaggtcggaagaaagatggaatgcagattcctgctagcgacaaagtatacgagtatatcctctttcggggaactgatatcaaggatttgcaagttaagtcatcaccaccgccgccgccaccacaagcagcttccctgcacaatgaccctgccataatccagtcacattattctcaaccagcatcaacatcgtcaaattttccttccgctgggggtgcagttttaccagacctcagctcccaggcagttcaatatgggcttcagaggccactttttcagagtaaccttcctctataccaaccagggaatgctccacggggctcttcagcggcacctccagcaggaaatgctccgtgggcctcttcagcagaacctccagcaggaaatgcttcgacactttcggttccctcaatgtactggcatggatactatgcgccttcaagtgggctgccacctcatttgcagcaacctctgctgcttcagccaacaccaggattgtcagttccccagaatcttcaatatccaggactaaatccttctttgccatctgggctgcaaaagctgtcagaactccaaccctcattgatgccacctattactagtcaaggttcttcaggtatcctgcctgctacaacagctcctgcttctgctaccttattagctccagaaagctcaaagcctcaggtgccaaacatgggatctttgtttactcctgcaacatctcttggtgcaacttttccttatccaagccagccaacaccggtggctgaaactagtgcaacagtgtcacagaacataacttcatttagtagcaacaaggctactgctcttccaggctcaacactgtcataccaaactgcatctcagtctgtttcttcgactattgccccatctagctcagcacaagtggagatggctgtgcctttgttggcatcatcaggtcaactattgcagaacacatcatccacgctttcatcatcacactccatgcaggcaccattacaggtggctagcaaagaagtcaagccggttgagccaaaggctaaggttgcagaaccattactgcctgatcctttgctaccagacccaccatcacagtctctgcctgaaaataaggagcctatattgccattgcccgagcagacacctcagaagtacaatggatctggtttgcacaaccatcacaactttaggggccgtggaaggggtagagggagtgcgttttcacagtcagtaacaacattcactgaagaatttgatttcacggccatgaatgagaagtttaacaaagatgaagtctggggtcatcttggaaagaaatcgcagtcaagggacaaggatggtgaggtgggagatgatgtgtttgatgaagacctggaggttgaggaaactgataacccagagctatctgttaagcctgtttatgtcaaggatgatttttttgattccctctctagtggaacatttggacgtggaggaccaaatggaaggggcagaccttctgaacggcgcagagtagatacagagacttttggcgaatttccacggcacaggcaaccctaccgtggtggcgcccgaggttaccgtggcggtggacgttcccgaggttcatattatggtggcagaggctatggaaacacagggaccggaggctatggaaacacagggacaggtggccctggaaattcttattctcaccggggctatgggagagattgattatagcagaaatgtgcaggcaaccatacttgtgggtgttgtagtcttttaccacatgtatgatgtatcccttactactggtgcagcggtgagaagtcgttttcccactgagccgagccaaaggtttaatgggctctaaattttacactataagatttaaggattggattaggatcggactctatttctattcatttttaactaaaatttatttagggccctaccaaaaaaaaaacaagaatacggctcctcaaaaaaaaaaaanaaaaaaaaaaaaaaataaaaaataaaaaaaaaaaaaaaagggcggccgt

SEQ ID NO: 2471 - DNA, 881 bp, Zea mays
  misc_feature (807)..(807): n is a, c, g, or t
agagagcagcaaggagagcgagcgcaccaacggggatctgagcatccgaccggccgcttgctagggtttcgtccgtccgcctccctgccacagcaccactccgcatctccagccctagcctcgctcagcccgggatcccgcgggggccatggcggctgaagcgccaccgtcggcgtcgtcgtcggcgtcggcgtcctcctcctcggctccgcggccgcctaccgcggccgcctccgcccccggcggcggcggcggcggggcgcccgcgtccgcggagtcgtacctcgggagcctcatcagcctgacatcgaagagcgagatcaggtacgagggcgtcctctacgacatcaacaccgaggagtccagcatcggcctgcgcaatgtgcggtcctttggaaccgaaggtcggaagaaagacggagtgcagattcctgctagcgacaaagtttacgagtatatcctcttccggggaactgatatcaaggatttgcaagttaagtcatcaccaccacagccgccaccaccacaagcagcttccctgcacaatgatcctgccataatacagtcacattattctcaacctgcatcaacgtcatcaagtttgccttcagctgggggtgcagttttaccagacttcagctcccaggcagttcaatatgggcttcagaggccaacctttcagagtaaccttcctctctaccaaccagggaatactccgtggggctcctcagtggcaccctccagcaggaaatgctccatggggctcttcagtggcgcctccagcaggaaatgctcaaacactttcanttccctcatggaactggcaaaggtacatggcaccctcaaagtgggctgccggcatcttttggcgcccccctcct

SEQ ID NO: 2472 - DNA, 1973 bp, Zea mays
  misc_feature (1908)..(1908): n is a, c, g, or t
cggcctggccggacctccgggatctgagcatccgaccggccgcttgctagggtttcgtccgtccgcctccctgccacagcaccactccgcatctccagccctagcctcgctcagcccgggatcccgcgggggccatggcggctgaagcgccaccgtcggcgtcggcgtcggcgtcctcctcaaagctggagctccccgcggtggcggccgcctccgcccccggcggcggcggcggcggggcgcccgcgtccgcggagtcgtacctcgggagcctcatcagcctgacatcgaagagcgagatcaggtacgagggcgtcctctacgacatcaacaccgaggagtccagcatcggcctgcgcaatgtgcggtcctttggaaccgaaggtcggaagaaagacggagtgcagattcctgctagcgacaaagtttacgagtatatcctcttccggggaactgatatcaaggatttgcaagttaagtcatcaccaccacagccgccaccaccacaagcagcttccctgcacaatgatcctgccataatacagtcacattattctcaacctgcatcaacgtcatcaagtttgccttcagctgggggtgcagttttaccagacttcagctcccaggcagttcaatatgggcttcagaggccaacctttcagagtaaccttcctctctaccaaccagggaatactccgtggggctcttcagtggcacctccagcaggaaatgctccatggggctcttcagtggcgcctccagcaggaaatgcttcaacactttcagttccctcaatgtactggcaagggtactatgcaccttcaagtgggctgccgcatcatttgcagccacctcctttgcttcatccaacaccaggattgtcggttccccagaatctccaatatccaggactaaatccttctttgcaatctgggccgcaaaagctgtcagaactccaaccctcattgatgccacctattactagtcaaggtccttcatcaggtatcctgcctgctacaacagctcctgcttctgctacattattagctccagaaagctcaaagcctctgttgccgaacatgggatcgttgtttgctccacgtgcaacatctcttggtgcaacttttcctttaccaagccagccaactgccgtcgctgaaactagtgcaacagtgtcacagaacttaacttcatttggtagcagcaaggttcctgctcttccaggctcaacactggcataccaaaccgtatctcagtctgtttcttctactattgccccatctagctcagcccaagcggagatgcctgtgcctttgctggcaccatcaggtcaactattgcagaacacatcatccatcctttcatcatcgcattccatgcaggcaccattacagctggctagcaaagaagtcaagccaattgagcctaaggctaaggttgcagaaccgttactacctgaccctttgctaccagatccaccatcacgggctatgcctgaaattaaggagcctatattaccattgccgaaacagacgcctcagaagtacaatggatctggttcacgcaaccaccacaactttaggggccgtggaaggggtagagggagtgcgttttcacagtctgtaacagcattcactgaagaatttgatttcacggccatgaatgagaagtttaacaaagatgaagtatggggccatcttggtaagaaatcccagtcaagggacaaggatggtgaggtgggagatgatgtgtttgatgaagaactggaggctgaggaaactgacaacccagactactgttaacctgtttatgtcaaggacactctttgatccctctctagtggaactttggactggaaggccaatggaagggaaactctgacgccaaataaccaaaacttggcattcnagccagcacctctgtgcgcagtcgtgcgtgctcctgtcttacgtgaagttgaccggagtgctgat

SEQ ID NO: 2473 - DNA, 1333 bp, Zea mays
ctcgaggccggccgagtaaggctattgttgcagaaccgttactacctgaccctttgctaccaggccctccttcccgcgctgtgcccggggttaaggagcctatattacctttgccgaaacagacgcctcagaagtacaatggatctggttcacgcaaccaccacaactttaggggccgtggaaggggtagagggagtgcgttttcacagtctgtaacagcattcactgaagaatttgatttcacggccatgaatgagaagtttaacaaagatgaagtatggggccatcttggtaagaaatcccagtcaagggacaaggatggtgaggtgggagatgatgtgtttgatgaagaactggaggctgaggaaactgacaacccagagctagctgttaagcctgtttatgtcaaggacgacttctttgattccctctctagtggaacgtttggacgtggagggccaaatggaaggggaagaccttctgaacggcgcagagtagacacagagacgtttggcgaatttccgaggcacaggcagccctaccgtggtggcggccgaggctaccgtggcggtgggcgttcccgtggttcatattacggtggcagaggctatggaaacacggggaggggtggccctgggaattcttatcctcactggggcaatgggagagattgattatagcagcagcagccatacttgcgggtgttgtagtcttttgccacatgcatgaagcgcatccattactattaaacaaataaatggaaccttaccaccatgtcactcgtcggtgtgccttgtccagacaaggcctgtagcgtttggtcattgatgtggtgcacccctgccctgtaggagagttaccagtagatgagcagatgagatgatgcttgataggtataagcttgtggcccttgatgtgcataccttgcacttgagatttagttgtataggccggtctcaatgcaggcatgcaacgtcggctctagctcagtaaccttttcctttcacaaagtttagccgtgttgtctgttttgtattggtgatagtgtaactttgaaaaatttactgcttattgtacgttgtttgggttgaggatgagtgggatggaatggctctattctagtcttttaggatgggattcgagtctggtgtttggttggaggggaggacttgtcccagtttctgtatttgaatggagggacgatgagaaggaatttatgttgtttgtgactggttaggatatctgttaagcttgttcggttaggggtggattgatgagagattaaagatgattaaatcccaaatttgtataggagtgggttaaattgcctccc

SEQ ID NO: 2474 - DNA, 2240 bp, Zea mays
aggacctgcagggacaccagcgacggagacacgcgtcgtacgcggtctccgatgcactccacactccccccttccctcacaactcgtgcccttcgtgcttctattctatacctgagtgaccacccgctaaccgccctcaccacccgctaaccacagtccacagcccaaagcggcggtcgctccccgcttaaacccttaagcccgcacaccgacgaggcgaacggaccagagtcggcgagcccccaggagccgactccgcctccggctctgaccggtctttagaccccccctgccccaggcgacgacgaaaccagcagcgctgcgcagcgccgaccactccgggaacctcacgatccaggggagatgctggtcgccgccgccgcctcgccgtcgcagccgtgaaccggtttccccagggcggagggacttgggctcagattcggcggatcttgggctggtctcgtgcattcgagccgcggcaggcgtctgggtaaccgcttctcccgaggaaaaggaaaccaaagctgctcggccaacttttggatcaaggatcggcgaaaaggaaaagaaaaaggagggatctttttgggagggtctgtttgagccttcggggttaccgtagcctcgggcaactccgtgctaatggatttcttcaagattaagaagctcgggaaggggaagaagagcgccgggggtggaggagaggcagttaaatccgacgacgacagcgccgggggtgtgaccccccggggcctggaggagctgaagccgggcatcggggagaggactaacgccgaggcggcggcagagggtacaggcgcgggcaatggggtggttgaagaagaggaggaggaggaggactatgaggacgacgacgatttcatcaccaatgaggtgaagcggaggctcaaggagctcaggaagaacagcttcatggtgctcatccctgaggaggagtgtgccgaggtcgaggatgacagcggagaggaggaagggggcagccccagggagtggctggagacgggtgtcggcgatggcttcccgctgtgtgggtttgattcactgtatgataagtactgcgagaggatgctggtgtttcataagatgatcgcgcagctcatgaaggatccagagtcactgaacacgccaaaaaagtctccaagatcagcatcaaaattggcatctaccctacgcagcctctcgttcaaaagaaaggatgagctcccagaagattgtgaacaacttcaacaacagcaaagtgcagatcatccacatcagacacttgagactgcatatgttgctcatgtttcattaagctgggaggctctgcattgcacctatgtgcacctgagtcttatcgttgcagcacaacctgataatcctacaacctacagctgtgctgctcaagcattccaacaattccaggtcctgttgcagagattcattgaaaatgagccatttgagcatggtacccgggttgagatatatgcacggtctcgcagcttgttgtcaaagttgcttcaggtccccacttttcaagtcacagataggaaaagcaacgctgaagatcaaacggagccagcgatttccgcacctgatctcattaaactgctggaggagtctatcctaactttccgccttttcctgaagaaggacaagagaaagagcggtgttcttacgagcgctagtcatggccacgctggtagctcgattcaacaagtgcagtcttcactcgataagaaagaggcgaaggtgaaggagctgctgaagaagaggaaagggtggaagagcaaggcctggccaggcacgatggaggaggtccagctgctgttcgccctgatcgacatcaaggtcgtgtcgcgggtgctccggatggggaagctgagcaaggagcagctgctatggtgcgaggagaagatgagcaaggtggacctcaccgagaaccggctacgccgcgacgggtcccccatccttttcccctgttagaccgacgcccccttcctgcctgcctccgggggcgtaagccgagaacaacctccccttcggctatcttatcagactatatatgtacatgcctttaggttggatctgaatttaaaatgtccatactaaagtagggcttaaacaaaaaaaaaaaaaaaagggcgttcgtagctgggttttatgcaatgcaacgcaacataggcagcgtgcttcgtttaaaaaaaaaaaaaaaaaaaactcgagagtacttctagaac

SEQ ID NO: 2475 - DNA, 864 bp, Zea mays
tagcgtggtcgcggccgaggtacgcggggtgcggcaggtgtatgaaagatttgatgcatcttctattgctgaagctgacggtgctcgttttgattatttctgcaacaaggtatatccaaagatccaggacttggatgagggtgggctgctgctattcgtcagttcgtattttgagtacattcgaataagcaatttcttaaaatccaaggaagcgtccttttgtcgaatcggagaggctacgtctcagcaggatatatcccgtgcaaggctctggtttttcgagggcaagaaaaagatcttgctttacagcgaaagatctcacttctaccaccgatacaagatcaggggaacaaagcatctactagtctattcgttgcctgggagaaaagaattttatccggagcttgtaaatatgctgggcgaatcagaaaaccgcaagtgcaacgtcctcttctctcgtctagaccttctcaagttggagcggatcgttgggacgtcttcggcgcgaaggttgatttcctcggagaagggcatgtttgtcttctgctgatgtagcagcctagcccgtactgtagagcaggcgaatggttttatacattgatccctagcaaatgtacccacagcagggggtcacgttgttgtttgcctgtcaggcaagaatctggaccatgttatgtaggcaaaaaaaaaaaaataaataaataaaaaatctgaatcccgtttgtacggctaacattatacttttatgcccctatttgtttccatcaaacttatagattatatagtcacctaatgacttgcttatttgttatcatagtctaggtatgtaaattatatattccatctaataatttgtgttataat

SEQ ID NO: 2476 - DNA, 1873 bp, Zea mays
cctgcaggcaacggtccggaattcccgggtcgacccacgcgtccgagctgatgaaactgaccgagaaaccgcccgcccgcggcaaatatctactgtccctatccatttaagcatattttctccccatgttgtgaatcttactcttattgatcttcctgggcttactaaagtagcagttgatggccaaccggagagtattgtacatgacattgaaaacatggttcgctcatatattgaaaagccaaattgtatcattctggctgtgtccccagccaatcaggaccttgctacttctgatgcaatcaagatttcacgggaagttgatcccaaaggtgaaaggacctttggtgtgctcacaaaaattgatctgatggataagggtaccgatgctgttgatatactggaaggaagatcttaccgtctccaaacaccatgggttggtgttgttaatcgatcccaacaagatatcaacaagaatgtggacatgattgctgctaggcgtagagagcgagagtattttgcatctacaccagaatataagcacatggcttctaggatgggatctgaatatttaggaaagatgctttcaaagcatttggaacaagtgatcaaatcaaggattccggggatccaatctcttataacaaagacaattgcagagctggaaactgaacttaatcggcttggaaaacccattgctaatgatgctggggggaagctgtacacgatcatggaaatatgccgtatgtttgatggtatttacaaagagcatctggatggagtgcgccctggcggagagaaagtttaccatgtcttcgacaatcaatttcctgtagctattaaacgattgcagtttgataaacaactctctatggaaaatgtgaggaagcttataacagaggctgatggataccagcctcacttgatagctccagaacaaggatatagacgccttatagaatcttgtcttattagtatcagaggtcctgctgaggcggctgttgacgcggtccatgcaattctcaaggaccttgtccgcaaggctatcaatgaaacacatgaactgaagcagtttcccacccttcgtgtggaagtaggcaatgcagcttttgagtcattggatagaatgagggatgaaagcaagaaaaatacattaaagctagttgacatggaatgcagctacttgacagtagatttcttcaggaagcttccccaggatgttgagaggggtggaaatccaagccactctatttttgatagatataatgactcttatcttagacgaattggacaaactgttctgtcatatgttaatatggtgtgttcgaccttgaggaactccatcccaaaatctattgtttattgccaagtgcgagaggccaagcgctcgctgctcgatcacttcttcactgaactgggagcaagagagatgaagcaactttccaagcttctcgacgaagatccagcagtcatggaacgcagaactaaccttgcaaagaggctggagctgtaccggagtgcccaatcggaaatcgatgcagtcgcatggtccaaatagccctgatggctaagatatctgttcttacatgttctttatccctcgtctggcgattgtctcccctattctggggcatatatagctgatttttgtctgttgtaggtcaggtcattctatagattaccgcagctgtacggtgtcgtttagttgtgcttttgttccttgtacttgagggtctaggggacaccaggctgctgtacgcttgcatcacggacaagttcataaattgtgtttttgttaccatgcattcttttattccatctatgtgcagctatatgaagcatgttcttcggccaaaaaaaaaaaaaaaaaaaa

SEQ ID NO: 2477 - DNA, 1374 bp, Zea mays
ttttttttttttttttatccgcggtttgttctggtattcgattcgatgatcgactatattttgtacagagttatgatcaaagctaaaaatgaatacacaagaacacacttgaggtatgctctacgttgttgtctggtaatacttgtctaccagcctttctgagtactccccgaaagtcagcgttccgtttggtggaatcaactcttggtgataggggatttcgcttggaaacttcagcttctcattccaatctggttgcatgaacaaggcaaaagtagagcggtcaacatttgaagcattttcgctgctgggtgcctgcacacagtgtggggttgcacatagataacctcttgacagtatttcagtagtttccccgatttggtaagccagctgatcctcgtcgaacacaaccttaacaacttggttatcacgagtccgaatgtatagtccagctgcactgtctggacatggtacctccatagaattcttcgtaaacaagccacatgtaagccctgttagagatccatgatcagtgtgccatccacaccatgatgaaaccgacttgaagtctgtctgcttgctaaactgtcgtgggaaatagtacaacagacgacccttgtgacaccttgaacgagcaattgtctgctcaagactgtcaccatcatacgaccctactccttgcctcattacatagcgatcacaatgatgagccaacatcaaaccaacttccatcatcagcttcccaagagctttaaatgctatctcaagctcaggaagattatcgtttggccatatatttggtcggcaatatgatggatacctacttacaagcacatcatcagtagtagggacatccaaaacagggttcgcataaaaggaacctttaaatgtgtcaagtttcccggactcgagtttctccttcccatgactccacccaaagttatatctgctatctggatcttcaagctgtttcttcacctcttcaggaaggtttgcaatccttggtgccaagcgcagcagcctttttcttagctctggaaactcaggtacatcggcaatggtgacgatgccgagcccatggggacccagaccttcctcgatcttgtcgccaaggtccctgtccggcaccctgaggtcggcgaaggggatggtgaccgcgcggacggtcggcggccgctcctgctcctcctcgtgctgctgcatcgcgcggcaacggagccggacccggcgggacgacgcgggagcgagggcgaaggagacgacctggccccgtgatctgcgccgggcggctggacctgcagccgaagtggaggtggttcgtgttcccgcggcggtgccccccgcgcgcactcaaacgtcccctcgtgccgaatt

SEQ ID NO: 2478 - DNA, 665 bp, Zea mays
cttctgataactccagaaaacgactgttctgcaggatgtatattagattagcatctaatcattatcttcttagtcgtcgtagtatacgtaaattcagccaaagcaataggcgtgatacattactgtgcgctgtattcgattcgatgatcgactatattttgtacagagttatgatcaaagctaaaaatgaatacacaagaacacacttgatggtacgaacgtatggacggtagcttttcttgaggtatgctctacgttgttgtctggtaatacttgtctaccagcctttctgagtactccccgaaagtcagcgttccgtttggtggaatcaactcttggtgataggggatttcgcttggaaacttcagcttctcattccaatctggttgcatgaacaaggcaaaagtagagcggtcaacatttgaagcattttcgctgctgggtgcctgcacacagtgtggggttgcacatagataacctcttgacagtatttcagtagtttccccgatttggtaagccagttgatcctcgtcgaaaacaaccttaacaacttggttatcacgagtccgaatgtatagtccagccgcactgtctggacatggtacctccatagaattcttcgtaaacaagccacatgtaagccctgttagagatccatgatcagt

SEQ ID NO: 2479 - DNA, 947 bp, Zea mays
  misc_feature (14)..(14): n is a, c, g, or t
  misc_feature (28)..(28): n is a, c, g, or t
gggtccggtgaggnaagcttataacagnaggctgatggataccagcctcacttgatagctccagaacaaggatatagacgccttatagaatcttgtcttattagtatcagaggtcctgctgaggcggctgttgacgcggtccatgcaattctcaaggaccttgtccgcaaggctatcaatgaaacacatgaactgaagcagtttcccacccttcgtgtggaagtaggcaatgcagcttttgagtcattggatagaatgagggatgaaagcaagaaaaatacattaaagctagttgacatggaatgcagctacttgacagtagatttcttcaggaagcttcctcaggatgttgagaagggtggaaatccaagccactctatttttgatagatataatgactcttatcttagacgaattggacaaactgttctgtcatatgttaatatggtgtgttcgaccttgaggaactccatcccaaaatctattgtttattgtcaagtgcgagaggccaagcgctcgctgctcgatcacttcttcactgaactgggagcaagagagatgaagcagctttccaaacttcttgacgaagacccagcagtcatggaacgcagaactaaccttgcaaagaggctcgagctgtaccggagtgcccaatccgaaattgatgccgttgcatggtccaaatagtcctgatggccaagatatctgttcttaccccttgtctggcgattctctctcctattctggggcatatatagctgatttttcgtgttgtaggtcaggtcattttatatatcaccggagctgtacggtgtcatgttccttgtgcttgaggatctaggggggcacttgtatctcgaacaagttcgtacatcgcgctttcgttccatctatgtgcagctgcatgaaaaccatgtttttctgtcacgcaaaaagtttgtcctatt

SEQ ID NO: 2480 - DNA, 4593 bp, Zea mays
ggggccttatactttaatagttttgcccattgttttcaaacagtttcattaaagcggacacattctgtttatcatgtatgattttattgggttgtggggttgttgttgcacacatttatatttatttgaactgaggtgccattacatttgagaataaataagggtcgttttgtctttaatcatgttgtgttattaggctgaatttacccacacgacatatcaaacaatttgcttaactatgcattgattaattaggtgttatttcactcatagatgagggctgactagtcatatatgacatgttacaacaaatgaggattttgtggagatcattctttgcacaaatatgcactgtgacctcagcttctgttttaacaaacagtggaccaaactattggcatgagactcttaatttgtagtcatagtgcaaagtgtatattgcatagttcgtcattattatttagttacttggcacttgtcttcactatccatgtaaggtcttgttcggttaatcccgttacccatggattgaatgagattggaaaaaattaagaagtttgacttgtttgggatttaaacccacccaatcccaatcaatccatatggattgagagctaaccgaacaagccctaatagttgctgaatatgtattgacatgtcacattggcaggtccatgcaattctcaaggaccttgtccgcttggctttcttcgaaacacatgtaagttttcctcttttctactattataccatgcaaacccccgacaaaataatgtctataggatgcttatttaaactgtttgattacctttctgcaggaactgaagcagtttcccacccttcgtgtggaagtaggcaatgcagcttttgagtcattggatagaatgagggatgaaagcaagaaaaatacattaaagctagttgacatggaatgcagctacttgacagtagatttcttcaggaagcttcctcaggatgttgagaagggtggaaatccaagccactctatttttgatagatataatgactcttatcttagacgaattggtaaggcctatatgatctctgcatttttgcttgatagttgattatttactgcttaacatctcactgtactaaacgatcaacaggacaaactgttctgtcatatgttaatatggtgtgttcgaccttgaggaactccatcccaaaatctattgtttattgtcaagtgcgagaggccaagcgctcgctgctcgatcacttcttcactgaactgggagcaagagaggtgagatttgtcatcatttgaaaggaattattggtcatggctttgtattactatacctttaatttcattatattgtagcgcttgccttgtttgttcgatcattcaatatactgtagcttccttgttggtcgttgtttgtgggctgatgatagcctttaccacatctccaatatgtaaatatttcaatgctgcaagcactggaagccatcaacaccttgttgaaggaatgtcgccttatgagaggccaagcgctcgctgctcgatcacttcttcactgaactgggagcaagagagatgaagcagctttccaaacttcttgacgaagacccagcagtcatggaacgcagaactaaccttgcaaagaggctcgagctgtaccggagtgcccaatccgaaattgatgccgttgcatggtccaaatagtcctgatggccaagatatctgttcttaccccttgtctggcgattctctctcctattctggggcatatatagctgatttttcgtgttgtaggtcaggtcattttatatatcaccggagctgtacggtgtcatgttccttgtgcttgaggatctaggggggcacttgtatctcgaacaagttcgtacatcgcgctttcgttccatctatgtgcagctgcatgaaaaccatgtttttctgtcacgcaaaaaatttgtcctattaaaaccctaggcctgggggttccaaccaaaacagacactaatgatgtgcagtaatcgtaagtaatgcggcgggaacctctgataactccagaaaacgactgttctgcaggatgtatattacattagcatctaaacattagcttcttagtcgtcgcagtatacgtaaattcacccaaaacaataggtgtgatacattactgtgcgctgtggtcggtgtgatacagttgatcttgattccgcggtttgttctggtattcgattcgatgatcgactatattttgtacagagttatgatcaaagctaaaaatgaatacacaagaacacacttgaggtatgctctacgttgttgtctggtaatacttgtctaccagcctttctgagtactccccgaaagtcagcgttccgtttggtggaatcaactggtcaaggtcaacacacaagcttaatcatttgaggggagggaattacgagttccgacctcaagagtatagagatcagtagatcacacgaacctcttggtgataggggatttcgcttggaaacttcagcttctcattcctgccaaacggttgaacagagaaaaaaaaaatgaatttgaaagcccgtgatcagcaatatttgcagaacgacggaccagctagcctcactagttcccagatggaaatagcatgctcaatactcaatacaatacggccagcaaattatttggtacacgaaaggaaagcaaaagtgggctaaatggctaatatgacacatataatataagaagaacaaagcttggacgtaccaatctggttgcatgaacaaggcaaaagtagagcggtcaacatttgaagcattttcgctgctgggtgcctagaaacaatagcattaaaaaaactgtaggacattagttatcacatcacaaaaccagtaaaacgtatgcgaaaaacacatgcttagttatcgagatgaattttggtttcaacaatacctgcacacagtgtggggttgcacatagataccctcttgacagtatttcagtagtttccccgatttggtaagccagctgatcctcgtcgaacacaacctatggcatccaaacaaacaaaatcagcacaaaactgcgattttcaatggcaacgagttattattgtgtcaagggcatcaatagtttcggtgcagcatgaatcatgtgctacaatagccacgagccgacgatctccccacatgatttatcatctataactgatagaaactctcatataaagaaatcgatgagaaatttacactctgcaggaagttaccttaacaacttggttatcacgagtcccgatgcatagtccagctgcactgtctggacatggtacctccatagatttcttcgttaacaagccacaggtaagccctgcattaatcagattaccgcacattaactataaaaatgtcgcttgtttgatggtaactgaaccatatttttacatattatgccacaaaactaattaaatatttcattcaaccataatggtaaaagatttttctgtggtatcttagggaggtaacaacaaaaggcaatttaattatgcgtaactagcatggaagccaaacttgatgcttttgtcattttgtcatgaagaggggtaattcaacacttgttttttactatcgttttgtgtgatattgatggacctttctcaagttgcacatatgtttggagttggaggctagttaaatggagtggcaaaacaattaagatcactagtactacttggggcagcagtggcatgttggtctatcagggttgcgcacgaatgatattattttttagaagaaaaagaatactctccattgcaggttatctatgcaatttctcacaggctccattcgtgagctatccttcaacagccggagttctgggatacggttgcaacggcattgcgacaattggagcaggtggcgaaggatatcattatccggggcatattggcggcgatctattattacgattgaatgtcactagagcatgctcaaaatacttttaaacttaacctatgtgtctatcacttaggcagaggttgtgaggttgtttcaaggccgtgtatcaactcgatgtactgatcttagaaggaaatgaaatcttccttccaaaaaacaccatagtggtaaaatgggtcacctgttagagatccatgatcagtgtgccatccacaccatgatgaaaccgactcgaagtctgtctgcttgctgccataagagacaaatacatcaattcccaaactaactgaaaaccctgcatctaaaatacatcattaatattatgattcattaaaaaatgaagttgcaaggggggaccttttccctcttgtctttaatataatgatacacgtctcccatgttaccctgatacggcgatacgaatacagaatcgtgatacggcgataccctgatacgctatttctcgaaaaacaccgatacggcgatacgcaagtatatattataaaaaaactaaatcctggaatagtggaccacacaagttcacaaccagtgcatagataataaagttcaggccatcaagctatcagacctaggaactttattctttaggttctaacagaccataatactccatcaagtcagagaagcaaggagtttaagaaccaa

SEQ ID NO: 2481 - DNA, 535 bp, Zea mays
cattttgagcacgatcgcaagctctcaccccctcagacactcattccccaccaccgacatacgtacatgaagcaccagagagacgccggcgccgtgccgctttccctcgcgctgtccctgggcggcggcggcggcggcgtggcccccaagcacggcatcagcaagaagccccgccgcccgtcctcctccagctttttgtgtagagttagttttgctgcccgtgcacggccggaaagatcgaaaggccagcccatcgccgccgggctttgtactttagagtagactacctatactagctagtacagtagtagagcaattctttgcgtttctgtcgtcactcgtcagcctgcacattgttgttgtagactcacagtactaattcgttggcatattggccagttgattcattcattcattcatacattcatttaatttagttgtacatgtaaataactgattattgtttagtaatctactacctgtgccttcgtttggtttaaaaaaaaaaaaaaaaaaaaaaaaaaaaaaaaaaaaa

SEQ ID NO: 2482 - DNA, 1670 bp, Zea mays
tgttttttttttttttgtatacaaaggctagatgaagggggaaaacagtacaaaggctgcttggcagtgtgcgcatgtctagcagttgcaaggtgcataggaaaacccagggtctttatagccattacactgtatattatttcatccaggatccagctacaaggaactaacgcggaactcttgcactcaaccatctgaaatgtctacaatttcacctctaattggtgaatccgttggagaagacatatgttcatgaccagcttgatttccagcaactccgttgctactcacaggatgacttgagcaggatctttcttcaggttgagaagatggtacaatttcacctttgttattgtccttgggagccagtgagcaagaaccaaccgtatgagaagttgagctgccaaactcaacatcattggattccctggctagatacatttcatgtaatctttgtcggcgccttctttctgttcgcttattgatcaatggcacctcatcttcatcggactcactaagacaatagtagttcaaccattcaattattaccgaataggaaccacaccgattgctttgtttccttttcttccgtctgctgcactcttggttatctagtacagctgttcttctgcgttttggtgcttcctgaacagtttctgtccttccaaggtcagagttaacatcctttgaaattttgattttcttattggacctgtcttttgaagaggaatccagtcctgaacagacaactgcattatctgcaacatgaaggaactccacagaggcatcttcccgctcgtttttattgcttcttctgctcttatttgatgtatgtgtggtgtgccaacttgtacaggcaggttcttcaaccttgccctcattgtatgcttctacagcttccaaacattttagttctggacctcctggtgatgattcttgaactctacaataattacccgaacactgttgcttgtgtctatgccagtgacagttagaattatgacatgggtcatctacaccttttctctcaatgcagtcatcaccagaaggtcctctcatattggttgacttgataaaatctgcacagctttgacatttgtagtgataatatttcttatggatctcatggagcagagttatgctgtagccatcaactggtcgatggggatcagctacagaactcaaattgattgtattcatcagtttctgaaattttgcaccatgatcactatggttactgttattgtctttgatgcaaatataggcatgaatcatctcatgaagcaaagcattcttcagatcagatccattatgagacccgcataatgatttggaaagcagtattatacagccaccacctcccggataatagtcacatgtgcttacatcacaatcaggtagtgggtcctcggtccatgagacagcgcacgaaccgagggaatcgcggaagtagagggagttgtagtggcagaaaagctcggagacgtccggcgcgcctccgttcccgtccggatccgaggtcaccatggccgggttagggcgaggttaaggggccagcaacgagagggtttaggcaaagcctccaccctccgacgtcacggggttagtccggtaagcaggttctaggtaatggtctcgtgctttcccggccggcctcgagggtcccaatg

SEQ ID NO: 2483 - DNA, 1446 bp, Zea mays
attggatctctactgcctatcccatcatcatcgtttccctaccgcaatcgaagaaagggccgggctcaaccgagccctcaaatcgccgcatcgcgcccctagctctctccgtctccctcatcctgacctcgattagagctagtttcgggaagcaaaggtatcggatcaacccccttgatcacccatggtgcccagggatagggcgcacagcgccgctgctgccaccgcgcccccgacggagaagcccgttcaagggcctatccagaacaacaagtgcgaaaagaaggctccaaagaaggtgcataaatctgagagagagaaacgtaagcgggacaagcagaatgatctctttggtgagctgggaaacatgctagaacctgatagacagaacaatggaaaggcatgcatattaagtgacactacacgaatacttaaagatctactttcacaagtagaatctcttcgaaaggagaacaacacgctgaagaatgagtctcattatgtcgctttggagagaaatgaactactggatgaaaccaatatgatccgtggcgaaatatcagaccttcaaaacgagatgaggatgcggctagaaggcaactctatctggagtcatgacacttctagaccaaatcttacagcaccccatccagcgaccacagtatttacattgcagcattcaccacatccacaagtcattgcaacaatgacacttcctctgcaacagccagcagtcgttgagcaatcttacgctgccccacggcgggagctacagctattccctgaagctgcacccactgaagatactgagccaccacaaaacgaggggacctctaatcatgtgatgcggccgcaggcgaggtacccaccagcaacgaccactttgcctgggcatgtatatccagtccttccaagagtggaagatgagcaacgcagcagcggcactactggtagcagagaggaaggcggggtaggcaaccgttaacagctcgagtacaaaacgagagatctggctcacagtttgaaaagctctcgtagtttcaactttaatgtttccattctagctgatgtgctaaagaaaccttaaaacctatgcggctgtgcctgcacatgtaaatatcattccactctgtattacccgaacttaatcttcaactagttacttcgatgggtgcaatctatctttgttagttcgtacacttcgtagtttatctgtagtacttgtaccaagcagaagttcaaggagtacctgattcgagaaaacatgttaatcactctttgtcaaaaaaaataacaaaatgcttggataactccgagcaaacgctagtctgcctgatgtaccactgtacagttacaatttttctcactggaaatcccaccttgagtatggttgcttaaattcagcaagtctggatacatcagcaagcaacaataacggagctgcag

SEQ ID NO: 2484 - DNA, 1284 bp, Zea mays
  misc_feature (1225)..(1225): n is a, c, g, or t
  misc_feature (1231)..(1231): n is a, c, g, or t
  misc_feature (1237)..(1237): n is a, c, g, or t
  misc_feature (1279)..(1280): n is a, c, g, or t
tgccgtaccggtccggaattcccgggtcgacccacgcgtacggccttggagacgtttccacttcttctctctgtctcggcatctgtttgagcagtacaaaccctatttttggaattttatagcattgtttcgtgatcagtcagttatatttaacatatgatctaattatcccaagcacgcttcctcgacttcctatctcgactctcccaagtcacaaccctcgacctcccccctactccaactactggaagcgccgatccatcaggttctgatcgattcttctgccccgatccgcagcggcaagcggagatgaactgcgagacctgtcagctgaaagaactggagctggaactgacggagatcagggatgttctgcgctgtattttgcacaccatattcttccatagaaccctcagcctggttcgccccaaagatgttgactgtgatttcctcgatattacttatgtacaatgtggtctaccggaactagaaaaggaagttgacgaaaagatagaccagttcagtgcatgggtggagaaacacccaaaccgcagaagccagatctgcctctcctttttcgacgagaaacacagacaccctggttggtttgtcaacaaaacagagcgcatctattgggagcaatggttcatcaatttgcaagtcatgttccccaaaagatacagcaagtcaaacagctccaaagggctgacaaacatccaagcaaatgccgtggaggagaccagcacaaggcgtgctgcattggaggcgtcgattaacgaagtgctgttccagatcataaagttcgccaacgagaaaaaggaccacattcctgctatccctgacaggattttcaatcacgagatcatgatcccaagctcggattctgtatttggatggaacacggacgtcattcgcagagttctgaatagcgggcacccatactcgctttaactgaagacgacatctcagtgggcgcccgtattcagtttattagcgtgctgccgccctgtttggaagacggctctgttaaccatcgtggtgaaccatataatatgcttaaggaaaaacctagttctgtgtacatcaccctgctcatctggcatgtacatactgtgttgggatcttgctcatcggtcaaacattcttaagttcgattaagtttataaataacaatattatgattctaaataagtttatcatgtaaaaaaaaaaaaaaaaaattaanaaaaanaaaganaaaaaaaagggggggccccccaaagggggcccagtttaacgnncggg

SEQ ID NO: 2485 - DNA, 943 bp, Zea mays
ccgggcggccacacgcgtccaaaataagtctatcttattagcttaacgagtagaaccgagagcctaaactaatgcagcctggctgtgcctatacgcttgccttatcttctcccgttcaccccgccgtgcgcgcgcgcccccgcggcgacaaccgggcgaccgccgccgacctacgccaggtgccaagccgttcctcagtcccatcacgaggccttcaacgaacccttcgccggcgacgagaaaatctaattttcccaaacccgcttcctcgacttcctgtctcgactctcccaagtcacaaccctcgacctcccccctactccaactactggaagcgccgacccatcaggttctgatcgattcttctgccccgatccgcagcggcaagcggagatgaactgcgagacctgtcagctgaaagagctggagctggaactgacggagatcagggatgtgctgcgctgtgagtgctctaaattttagttttttcacatctcttctcatctctctatgttcgttgaaagggggcttctgttcggctcaataaattgctctctattgacaatttgacatgatacgggagctatactgtactgtattcgttcacatgcttattcgttgttatggtttcagtaaattttggaatagagtaatttcaagttgcagttttgaaatcataattgtggttagctagtgggattcaccttggtttcgctcatggggaaatgtaaatgctgtatggatgtacggcagtggaagcttaactaaaaattgggctaatagtgaagctagtctgcagcagatcatattatatcacacagttggtggatattgttcattgctttgttgtgcttatctcgttccagagtccttgctgttgtgagttcttaacctttctctatgtgcttgagctcttccactctacagatagttgaaatttata

SEQ ID NO: 2486 - DNA, 1299 bp, Zea mays
gattggttggtcttcgagtcggcttggactcttctcttcctcgccaactcctccgtggcgccgccgtcttgcctgcagctttttgagccttcgtcatatccacccttctctctgtctcggaatctgtttgagcagtacaaaccctatttttggaattttatagcattgtttcgtgatcagtcagttatatttaacatatgatctaattatcccaagcacgcttcctcgacttcctatctcgactctcccaagtcacaaccctcgacctcccccctactccaactactggaagcgccgatccatcaggttctgatcgattcttctgccccgatccgcagcggcaagcggagatgaactgcgagacctgtcagctgaaagaactggagctggaactgacggagatcagggatgttctgcgctgtattttgcacaccatattcttccatagaaccctcagcctggttcgccccaaagatgttgactgtgatttcctcgatattacttatgtacaatgtggtctaccggaactagaaaaggaagttgacgaaaagatagaccagttcagtgcatgggtggagaaacacccaaaccgcagaagccagatctgcctctcctttttcgacgagaaacacagacaccctggttggtttgtcaacaaaacagagcgcatctattgggagcaatggttcatcaatttgcaagtcatgttccccaaaagatacagcaagtcaaacagctccaaagggctgacaaacatccaagcaaatgccgtggaggagaccagcacaaggcgtgctgcattggaggcgtcgattaacgaagtgctgttccagatcataaagttcgccaacgagaaaaaggaccacattcctgctatccctgacaggattttcaatcacgagatcatgatcccaaggtgaccccttttccttggacgtgttgacagctcggattctgtatttggatggaacacggacgtcattcgcagagttctgaatagcgggcacccatactcgctttaactgaagacgacatctcagtgggcgcccgtattcagtttattagcgtgctgccgccctgtttggaagacggctctgttaaccatcgtggtgaaccatataatatgcctaaggaaaaacctagttctgtgtacatcaccctgctcatctggcatgtacatactgtgttgggatcttgctcatcggtcaaacattcttaagttcgattaagtttataaataacaatattatgattctaaataaaaaaaaaaaaaaaaaaaaaagtcgacgcggccgcgat

SEQ ID NO: 2487 - DNA, 1172 bp, Zea mays
gccggccgggccggccgcgagccccgccgggaaactaaagccgtctggctgtgcctacacgcttgccttatcttctcccgttcaccccgccgtgcgcgcgcgcccccgcggcgacaaccgggcgaccgccgccgacctacgccaggtgccaagccgttcctcagtcccatcacgaggccttcaacgaacccttcgccggcgacgagaaaatctaattttcccaaacccgcttcctcgacttcctgtctcgactctcccaagtcacaaccctcgacctcccccctactccaactactggaagcgccgacccatcaggttctgatcgattcttctgccccgatccgcagcggcaagcggagatgaactgcgagacctgtcagctgaaagagctggagctggaactgacggagatcagggatgtgctgcgctgtattttgcacaccatatttttccatagaaccctcagcctggttcgccccaaagatgttgactgtgatttcctcgatattacttatgtacaatgtggtctaccggaactagaaaaggaagttgacgaaaagatagaccagttcagtgcatgggtggagaaacacccaaaccgcagaagccagatctgcctctcctttttcgacgagaaacacagacaccctggttggtttgtcaacaaaacagagcgcatctattgggagcaatggttcatcaatttgcaagtcatgttccccaaaagatacagcaagtcaaacagctccaaagggctgacaaacatccaagcaaatgccgtggaggagaccagcacaaggcgtgctgcattggaggcgtcgattaacgaagtgctgttccagatcataaagttcgccaacgagaaaaaggaccacattcctgctatccctgacaggattttcaatcacgagatcatgatcccaagctcggattctgtatttggatggaacacggacgtcattcgcagagttctgaatagcgggcacccatactcgctttaactgaagacgacatctcagtgggcgcccgtattcagtttattagcgtgctgccgccctcaaagaaagacggctctgttaaccatcgtgggtgaaaaaccatataatatgcttagggaaaacctagtctgtgtacaaccctgtattggcttgtcatctgtgtggtcttgtctc

SEQ ID NO: 2488 - DNA, 1208 bp, Zea mays
cattggtacctcgaggcggcgggaaaaaaaaaaaaagactaattatcccagacgcttcctcgacttcctatctcgactctcccagtcacaaccctcgacctcccccctactccaactactggaagcgccgatccatcaggttctgatcgattcttctgccccgatccgcagcggcaagcggagatgaactgcgagacctgtcagctgaaagaactggagctggaactgacggagatcagggatgttctgcgctgtattttgcacaccatattcttccatagaaccctcagcctggttcgccccaaagatgttgactgtgatttcctcgatattacttatgtacaatgtggtctaccggaactagaaaaggaagttgacgaaaagatagaccagttcagtgcatgggtggagaaacacccaaaccgcagaagccagatctgcctctcctttttcgacgagaaacacagacaccctggttggtttgtcaacaaaacagagcgcatctattgggagcaatggttcatcaatttgcaagtcatgttccccaaaagatacagcaagtcaaacagctccaaagggctgacaaacatccaagcaaatgccgtggaggagaccagcacaaggcgtgctgcattggaggcgtcgattaacgaagtgctgttccagatcataaagttcgccaacgagaaaaaggaccacattcctgctatccctgacaggattttcaatcacgagatcatgatcccaagctcggattctgtatttggatggaacacggacgtcattcgcagagttctgaatagcgggcacccatactcgctttaactgaagacgacatctcagtgggcgcccgtattcagtttattagcgtgctgccgccctctctggaagacggctctgttaaccatcgtggtgaaccatataatatgcttagggaaaacctagttctgtgtacataaccctgctcatctggcttgtacatactgtgttgggatcttgctcatcggtcaaacattcttaagttcgattaagtttataaagaacaatattatgattctaaataagtttatcatgtaaaagtatttttcatgattgatacttattgcgaagcatctcaagagtgagttaggtggttcgagtaacattccttaagtcgcggcctcgaattttagactagggttagcaaaaaaaaaaaaaaaaaagcggcc

SEQ ID NO: 2489 - DNA, 1868 bp, Zea mays
ggtacctcgaggccggcacgagaccattacctagaacatccagacaatctttcttgtatcactaagctagtggccacaactcgttggcaacgaggaagcagcaagccgagaagctacgccgccgccatatatggcacaggctgccggcaccgccgatgccactgatgaggctccactgctgctggcctcgtcggcggcggggtcgacgccgtcgccgccagctgcagcaccgcgccggaacaggttcgccttcgtctgcgccacgctcgcctccgtcaccaccatgctacatggctacaacctgacgctgatgagcggcgcggagctgttcatgcgggaggacgtggggctcaccgacggcgaggtcgaggtgctggcggggtccatgaacgtgttcatgctcgcgtccatcctcgccgccggctgggtggccgaccacctgggacgccgccgcaccctcgtgctcgccaacgccttcctcatggccggcgcgctcgccatgtcgctcggcaccagcttcgccgcgctcatggcggcgcgcttcgtcaccagcgtcggctccgggttcgcgcgcgtcgtcgcccccgtctacaacgccgagatatcgcaggcggctacgcgtggcgtcctctcatccatgctcgatatattcatcaacgtcggcatcctgctcagctacgtgtccaactacgcgttcgcgggcctcccggtgcacatcgggtggcgtctcatgtacgccgtcggcgtcatcccgcccgtgctcatcgccgccggggtgctcgtcatcatgccagagtcaccgcggtggctcgcgatgcagggccgccacgccgacgcgcgcgcggtgctgctgcgcacgtcggacagcccggcagacgccgacttccggctcggggagatcaagcgagccgccgacgcgccgtcgcccgctgctgcggcgcgccacggtggcggcggtgtctggagggagctcttcgtccggccatccaccacaaccacgagcgtgcggcgcatcctcggctgcgtcctcggcctgcagttcttcgtgcaggcgtccggcgtcgacgccatcctcctctacagcccgctggtcttcaaggcggtcggcgtggcgtccacctccgccgtgctcggcgccaccgtgtccatcggagccgtcaagacgtgcttcatcctcgtcgccatgctcttcaccgaccgcctcggccggcgcccgctcctcctcgccagcaccgccggcgtcgccgtgaccgcgaccgccctcgccgtgacgctgtgcgtgggcacggcgtcgccggcgacggccgcggcgtgcctggcgtccgtgctggccttcgtggccgcgtactccatcggctacgggtccgtggtgtcgacgtacagcgcggaggtcttgccgctacggctgcgcgcgcagggctccagcctgggcgtggccgtgaacaggctcacgtgcggggtggtcagcatgacgttcatctcgctcgccgacgccatcaccatgcccgggtgcttcttcctctacgctgcggtgacggcggctgcgtttgtgttcgtgtacacgcggctgccggagaccaagggccggagcctagaagacatggaagtgctcttccgcaagtgagggtggccggtggccacgtatagttgccattagcacaaggtcgcgtttggcagagttagtagaaattatccacaattaccagcagatttggaactccggtaccgcgcgctcgtcggtcgcaccgtcgcagtcgcagctacccccacggtcccacctagagatctcaacatcagatttaaacaccatatactacccatacctatgaagttatatctatctctatctccgaaaaaaaaaaaaaaaa

SEQ ID NO: 2490 - DNA, 954 bp, Zea mays
  misc_feature (893)..(893): n is a, c, g, or t
acccatcgtgcacatgatcctactgttgtgcacactgattgatgagaactgtagtggctttgtcctctacccaccaccaccaccaccaatagcaggcccttttatacattggcccgggccccgccgggcccgcccaacagcagctgcaagatcaccctggattcctggagcacggagagagagccgagcgagcagctgtcggcacttgggagtggcactgtggaatctggagaacctaggtagaaaatcaagcaaagcatctcccactccaagcagtagcaccaacacccccctgcattcagcgctgccagctttcacataaacaagttggggaagcagttgaggttttctaattcttcttcttggaaggattgagatctccagttctgataatgggttcttttgggatgaactggaatcagaaggaccccatggtgtgggattgggaacatctagtaccgtctgtctcgaatgcagttacaaggcacggatctgctaattcatctggtggtactcttacttctaactcagagctaggacatggttcatccaagagctctatttcagcgtccattgattcaccctctggagtagggaacagcttagagttcaacttcgccgctgtcgagaggcatgttaagaacacgggcacgaacggcagagtcgatgactcggggaattctccatcgtcaatgatagctttcaaccaaggagagccattaatcagcctgaaacttgggaagagggcttacttcgaaaacgcctgcggaggacaggatgccaaggtttctgcagcttcagacgttacttctgcagccaccgtggtcaagaaagactaaggtgtctcagcagaatgcaaagaactggtactgtcaggttgaagggtgcaaagntgacctgtcttctgctaaagatacaatcgcaagcacaaggtctgtgtagtccatcaaagct

SEQ ID NO: 2491 - DNA, 1884 bp, Zea mays
aggagaaaggttgccatctcgtgtgtgtgtgtctgttggatggatctctgtgagccatgccctctttgtcttcttgcttttgctttcttggtcccttcccttctcttttctagcagagctctcgtggttcttggccttccgtgtgtctgccaggtagaaattttaaccgaaaaaaagattcttccgagcaaaggagcgctgccagctttcacataaacaagttggggaagcagttgaggttttctaattcttcttggaaggattgagatctccagttctgataatgggttcttttgggatgaactggaatcagaaggaccccatggtgtgggattgggaacatctagtaccgtctgtctcaaatgcagttacaaggcacggatctgctaattcatctggtggtactcttacttctaactcagagctagggcatggttcatccaagagctctatttcagcgtccattgattcaccctctggagtagggaacagcttagagttcaacttcgccgctgttgagaggcatgttaagaacacgggcacgaacggcagagtcgatgactcggggaattctccatcgtcaatgatagctttcaaccaaggagagccattaatcagcctgaaacttgggaagagggcttacttcgaaaacgcctgcggaggacaggatgccaaggtttctgcagcttcagacgttacttctgcagccagcgtggtcaagaagactaaggtgtctcagcagaatgcaaagaactggtactgtcaggttgaagggtgcaaagttgacctgtcttctgctaaagattacaatcgcaagcacaaggtctgtgtagtccattctaaagctaccaaggtggttgttgctggtctagagcgtcggttttgtcaacagtgtagccgttttcatggtttagcggagtttgatcagaacaaacgaagctgtcgtaggcgtctgatgcatcataatgcacggaggaggaaacctcaggcagacacaatttcattcaattcatcgacaatgttttatgatacaaggcagcggacaaatcttttctttagtcaaccactttatggccaagtgaggagcaatgcagggtcttcatgggataacttgggaggcttaaaattcatggagacgaaacatccgccagtgcatccaacaaaaacagcatcccctgatgaactgcatttctcagccctccagataactagtgctgcggctcacaccggacatcatcatgatctcgatgggttcatggcgttcaagggaaccagcacaaaggtccttaaccaaggcgtggaggcttgggcggccgcttccagctcgaacaacggaggcccagaaggtgggcgtgctctctctcttctgtcagacggctcgtggggctcgagttcagccgtcatccagcagcccacatctcacgcggacgccggtgcattgctgccgcccctcgccaccgttgccgtctccaacgccgccgccgccgccgggcatcctctggacccgtccccgggaaggttctggccgcaagacgatcatcccccgctcgtcgacggacccgccacgcagattccggagctggcgcacctccggatatggtgaaaggaaacgcatgtgatgcggtgactggtgacatgccagttcgagggcctggctgggaacacatctggttggttagcctgccgctctggcttgaatttgccggcgacgacagtctttgtttgtatcttttgatcagaacggacacagacatgtttgcacaatataatgtgacgagtccctctttggggttgaggagttaaaaaaaaaaaaaaaataggaggcaaaaaaaatatatatttgtttcgcgcgttttcccggaagtatttaaaatatttaggatc

SEQ ID NO: 2492 - DNA, 1817 bp, Zea mays
gcacgagaggtccgtctccggctttccgtcggccctccgccctccgccccaaaacttcgtggtaaaacctccgcgatttcccttccccacccaccgcggcagttgcctcccctcctactggtaccccccgcccgcccgccgggaagtaccttctgcagcaagtagtgaccaggagcgagcagccaaggaaaggagtcaagcaatggagaaggccgtcgacaggcagcgggtcctgctgcggcacctgaaccccgccgcggcggcgagccccgccccgcccgccatctccgcaagcgcgtgcgcggcgggggacagcgcggcgtaccaccggaggccggccttcgccgacgacgtcgtcatcgtcgctgcttacaggacggcaatttgcaaggccaagagagggggtttcaaggatacctttgctgaggacctcttggttcctgtcttcaaggctttggtagacaagacgaagctggacccaagtgaagttggcgacattgttgttggtactgtcttagctcctggttcccagagggcaatcgaatgcagaatggctgcactgtatgctggtttccctgacactgttcctcttaagactgtaaacaggcagtgctcttctggccttcaggcagttgcagatgttgccactgctattaaagcagggctctatgacattggtattgctgctggtttggagtccatgacagtgaacaaagttagtcttgatggccaagcgaatcccaaagttgagctattttctcaagcacgtgattgtcttctcccaatgggcctcacatctgagaatgttgcacaccgttttggcataacacgactggagcaagatcaagctgctgttgagtcacatagaaaggctgctgccgcagcagctgctggtaaattcaaagaggaaattgtgccagttcatacaaagattgttgatccaaaaactggtgaggaaaagaagatcgtaatctctgcagatgatggaatccgagtggatacttctcttgcagtcctgtcaaaactcaaaccagcattttcaaaggatggcagcactactgctgggaatgcaagccaagtgagcgatggcgctggggccgtcttgctaatgagacgggatgttgctatgaaaaagggtcttccagttcttggtgtctttaggacctttgccgctgttggagttgatccagctgtaatgggtattggtcctgccgttgcaatccctgcagcagtgaaagctgctggccttcagatggatgatatcgatcttttcgaaatcaacgaggcttttgcatctcagtatgtctactgctgcaagaagttggaacttgatcctgctaaagtcaatgttaatggcggtgcaatggctcttggacatcctttgggtgctacaggtgcacggtgcgtcagtactcttctcaatgagatgaagcgccgcggcaaggattgccggttcggagtgatttctatgtgcataggttctgggatgggtgctgctgctgtgttcgagcggggagacggcgttgatgagctcaccaatgctcggggaatctcgacccacaactggctttccaaggacgccatgtaaagctacacccaccaaaatttgccggaactggtagcattgtttccagatcgctgtagggagcgaattggggaataaaatgattttgtatttgtcgcccctgctggggatttaggaagatttttacgccactggtatttgaacttgcttacctggaaagatgcgtgaataactcaaaaaaaaaaaaaaaaaaccagacgggcgcccgcttaattttaaaaaaaaaaaaaaa

SEQ ID NO: 2493 - DNA, 1802 bp, Zea mays
tccaaagaattcggcacgaccggctttccgtcggccctccgccccaaaacttcgtggtaaaacctccgcgatttcccttccccccggccccacccaccgcggcagtcgcctcccctcctacaaataacccccgaccctccacgaggacgggagtaccttctgcagcaagtagtgaccaggagcgagcagccaaggaaaggagtcaagcaatggagaaggccgtcgacaggcagcgggtcctgctgcggcacctgaaccccgccgcggcggccagccccgccccgcacgccatctccgcaagcgcgtgcgcggcgggggacagcgcggcgtaccaccggaggccggccttcgccgacgacgtcgtcatcgtcgctgcttacaggacggcaatttgcaaggccaagagagggggtttcaaggatacctttgctgaggacctcttggttcctgtcttcaaggctttggtagacaagacgaagctggacccaagtgaagttggcgacattgttgttggtactgtcttagctcctggttcccagagggcaatcgaatgcagaatggctgcactgtatgctggtttccctgacactgttcctcttaagactgtaaacaggcagtgctcttctggccttcaggcagttgcagatgttgccactgctattaaagcagggctctatgacattggtattgctgctggtttggagtccatgacagtgaacaaagttagtcttgatggccaagcgaatcccaaagttgagctattttctcaagcacgtgattgtcttctcccaatgggcctcacatctgagaatgttgcacaccgttttggcataacacgactggagcaagatcaagctgctgttgagtcacatagaaaggctgctgccgcagcagctgctggtaaattcaaagaggaaattgtgccagttcatacaaagattgttgatccaaaaactggtgaggaaaagaagatcgtaatctcagcagatgatggaatccgagtggatacttctcttgcagtcctgtcaaaactcaaaccagcattttcaaaggatggcagcactactgctgggaatgcaagccaagtgagcgatggcgctggggccgtcttgctaatgagacgggatgttgctatgaagaagggtcttccagttcttggtgtctttaggacctttgccgctgttggagttgatccagctgtaatgggtattggtcctgccgttgcaatccctgcagcagtgaaagctgctggccttcagatggatgatatcgatcttttcgaaatcaacgaggcttttgcatctcagtatgtctactgctgcaagaagttggaacttgatcctgctaaagtcaatgttaatggcggtgcaatggctcttggacatcctttgggtgctacaggtgcacggtgcgtcagtactcttctcaatgagatgaagcgccgcggcaaggattgccggttcggagtgatttctatgtgcataggttctgggatgggtgctgctgctgtgttcgagcggggagacggcgttgatgagctcaccaatgctcggggaatctcgacccacaactggctttccaaggacgccatgtaaagctacacccaccaaaatttgccggaactggtagcattgtttccagatcgctgtagggagcgaattggggaataaaatgattttgtatctgtcgcccctgctggggatttaggaagatttttacgccactggtattggaacttgcttacctggaaaaaaaaaaaaaaaaaaaaaaaaaaaaaaaactcgagaaaaggcgcgggtacc

SEQ ID NO: 2494 - DNA, 1892 bp, Zea mays
cctcgaggccggccaccctttttcgtctctcctctgcctttccccatcgtctctccgtctacacctcatcataatcacagattcacagagcgctagggaggagagagggctagggtttcgtgctccctcacgcaacgaatccgagccggatcggggggtgcgcggagtcaccggcggcccggcgttgcctgggctgtgatacagttgcaatggcatctgtaactgatgagacagctaagattgagggtttgacatctgctgcagcctttgtggagggtggcattcaggacgcatgtgatgatgcatgcagcatttgccttgaggctttctgtgagagtgacccttctgcattgactggctgcaaacatgagttccatctccaatgcattcttgaatggtgccagagaagttcacagtgcccaatgtgttggcagcctattactatgaaggatcctaccagtcaggagctgcttgaggcagtagagcgtgagaggaatataagaactaatcaaactcggaacacaactatatttcatcatcctgctcttggggattttgagctgcagcatctgcctgttggtaatgatgctgagcttgaagagcgtatactgcagcatctagctgctgctgctgcaatgggaagggcacaccatcttggaagaagggaggggcacaggggacgatctggctctcatggtcgtccacatttcctagttttctctacacaaccaaattcaccttctgctggcacaatctcttcatcttctgctcatatggagggagaaaatgattcaaatcctgccacacctagagctagcgagtcatctccacgagctattcgcattggagaagtgggaaaccaaagtcctgggatgcttacctacgatgctgaacaggatgctgtcgtttcttccggaaatagcactcctgtatcgagtcctaggttttttaacaggagacactccactggacagtcaactccagacagggctgggccatcggatattcagtctttctcagactccctgaagtcccgcttaaatgccgtctctatgaagtacaaagaatctattacaaagagtactcgagggtggaaggagagattgttttcacgtaattcatccgtggcggatcttggttctgaagtgagaagagaagttaatgctggaattgcgtccgtatcacggatgatggagcgtctggaaactagaggaaatagcagaacaagtgatagcccggcagcatccacttctgaagttccccctgctacagaatcaagcaatgaaagggttacagagagcaactctgctgctgctgctgctggtggtggtactaccactacgggtaccagcgctagcaacgcctccgccccttgtgttgcgacatccggttcaaattaggacatgtaagggtctcagaaagaaggcttacacctgcaattcttcatcttcaaaggtttgtgagcctggcggcagagcagaagtgcagtaacatgatgccgtcatttttttctcaaccactgcataaacggctgcaaggggaaaaaaaccaaacggtgatttgatgtattggctcgataaaatggtggtgcgtgtggcctaggagaagtcggatttcatcttctgttttcgtctctttgtaaaaaaaatcgtctgagggcagatgtttaccggtataaataacggatatgtcatcttcatagtacgtggatcagttataaatatgattggaacagcaaagcttgctgctgttataaagttgtaccgtggcacgatttcctgttctgttctgtgtgggtgaattgatggattttgctgtacacaagatatgcatctttccaggtctcatgcctatgtatacatatacatattacacgaacctaccttgaatcc

SEQ ID NO: 2495 - DNA, 1867 bp, Zea mays
  misc_feature (1849)..(1849): n is a, c, g, or t
cctcggggccggcccgcgcgcctcgcgcgcggctccccgttttcgtctctcctctgcctttccccatcgtctctccgtctacacctcatcataatcacagagcgctagggaggagagagggggaagagagagggctagggtttcgtgctccctcacgcaacgaatccgagccggatcggggggtgcgcggagtcaccggcggcccggcgttgcctgggctgtgatacagttgcaatggcatctgtaactgatgagacagctaagattgagggtttgacatctgctgcagcctttgtggagggtggcattcaggacgcatgtgatgatgcatgcagcatttgccttgaggctttctgtgagagtgacccttctgcattgactggctgcaaacatgagttccatctccaatgcattcttgaatggtgccagagaagttcacagtgcccaatgtgttggcagcctattactatgaaggatcctaccagtcaggagctgcttgaggcagtagagcgtgagaggaatataagaactaatcaaactcggaacacaactatatttcatcatcctgctcttggggattttgagctgcagcatctgcctgttggtaatgatgctgagcttgaagagcgtatactgcagcatctagctgctgctgctgcaatgggaagggcacaccatcttggaagaagggaggggcacaggggacgatctggctctcatggtcgtccacatttcctagttttctctacacaaccaaattcaccttctgctggcacaatctcttcatcttctgctcatatggagggagaaaatgattcaaatcctgccacacctagagctagcgagtcatctccacgagctattcgcattggagaagtgggaaaccaaagtcctgggatgcttacctacgatgctgaacaggatgctgtcgtttcttccggaaatagcactcctgtatcgagtcctaggttttttaacaggagacactccactggacagtcaactccagacagggctgggccatcggatattcagtctttctcagactccctgaagtcccgcttaaatgccgtctctatgaagtacaaagaatctattacaaagagtactcgagggtggaaggagagattgttttcacgtaattcatccgtggcggatcttggttctgaagtgagaagagaagttaatgctggaattgcgtccgtatcacggatgatggagcgtctggaaactagaggaaatagcagaacaagtgatagcccggcagcatccacttctgaagttccccctgctacagaatcaagcaatgaaagggttacagagagcaactctgctgctgctgctgctggtggtggtggtactaccactacgggtaccagcgctagcaacgcctccgccccttgtgttgcgacatccggttcaaattaggacatgtttgtgagcctggcggcagagcagaagtgcagtaacatgatgccgtcatttttttctcaaccactgcataaacggctgcaaggggaaaaaaaccaaacggtgatttgatgtattggctcgataaaatggtggtgcgtgtggcctaggagaagtcggatttcatcttctgttttcgtctctttgtaaaaaaaatcgtctgagggcagatgtttaccggtataaataacggatatgtcatcttcatagtacgtggatcagttataaatatgattggaacagcaaagcttgctgctgttataaagttgtaccgtggcacgatttcctgttctgttctgtgtgggtgaattgatggattttgctgtacacagaatgcatctttccagatctcatgccttggctatacatatacatattncccaaaaagaatagatgt

SEQ ID NO: 2496 - DNA, 2155 bp, Zea mays
gggtacctcgaggccggccgggccgggacgtgcggccggccggccggcgacacggaaccacgcgctcacggagtcacggctcatcttcggaccttccccagttccccgcgatatcgctagggtttccgcgatggcgacacttcgctccccgagcccccgcggagacgttctcctcgactcggcgccgctcctcggtggtgtcgggcggcgccgcgcgggcgcgctgcgccggccgtctctccggggcgcggcgcggctgctgcggcgtggcgggcgccgagcgatgcgggagccgtcactgctggtgcgggaggccgcggcggagcagctggaggaacggcaggcggattgggcctactcccgccccgtggtggcgctcgacttcctttggaacctcgccttcatcctcgtctccgccgtcgtgctcgtgctcagccaccacgagagcccctccatgccgcttcgtttctggatcgctgggtacaccgcccagtgcgtcgtccacatggtctgcgttgccatcgagtatcgtttgcgatacggccagctcggcgggtcgccaattcctgtcgacgaggagagcggaagtggtagtgcatcatcgtcctccagcgacgacgacagagagcacggctcccatagtcgaagtggtgactgcctcagtatagctaaacatctggagtctgctaacacaatgttctcatttgtgtggtggataattggattttattgggtatctgctggtggagaagttcttacccgtgatgcgcctcaactttactggctttgcatcgtatttttggcgtttgatgttttctttgtcgtcttctgtgtggctttggcctgcatcattggtattgctgtttgttgctgccttccttgtatcatagcaattttatatgcagtgtcggatcaggagggagcatctgaagatgacattcgtcaaattccaaaatacaaatttcggaagatggaagagcctgaaaagcagtctgttggtgtgcctggatcttctggtggaataatgatagaatgtggaaccaatcaacctattgaaaaagtacttgcagctgaagatgcggagtgctgcatttgcctctcagcttatgatgatggcgcagagctccgtgaactcccttgtggccaccattttcattgtgtttgcatcgataaatggctgcacatcaatgccacgtgccccctatgcaagtacaatgttcgaaaaaacagcagcagcagtggcagcgaagaagtataaatctctatatgagaatattgagaattcatacccaacagttctggcttctcgcagcaaattttttatcccataatcccatgagttcgcattcgtatctgtggcagtgtgatgaagaaaatgatccatgtaaattctcttgttcgtaatacggctatagcaataattctgtgtcaactttgctcgtgctgttctcggtgtgtttagatttttatagtatgtgtacttgttatagaatttctgtagagcagcttgtttgtgtagtctaatgttttataataatcatactagcagtacatgttcttgctcaggtcaggttttccatgatgccgctggcacccacttgactggtgatggagtagagcctgtcagcctgcaaagattaccaacaataaactcacgtcacgagtcacgtctaggacatgtgcgagtagattagtgtatatgggaaattatgattttaacacctatagaaagggtctgatactagtgctggcagacggtgaacgagtgaaagctgtggccggcaggcctactgcacgcctttcgcaggtctggtgatacgaacttcaactcctacatgaacatctattctgtaggatagattttgaattctaagaacagttcatctatatgatcatttaaaacactattttgctgtagacactgtttgaagagtgtagtttgaatataggttgaagagtgtagtttgaatataggtatgagatggataagttgctgaagatagcttgaagatgcaattattctgggactgggggagtgcctaaattgaggcataagccatccatgatagtacgtcgccattcgagatgccctaagtacgcacgctgacaaaaaaattcgcatatgggatatcccaagcagtagttagccaacctc

SEQ ID NO: 2497 - DNA, 1607 bp, Zea mays
ccggcccgcgttctcattccactctccaacgcgcaccgggcggtttttcgttcctttcttttttttcccctcttccccttccccttctccttccagcggcgctcagggcaccgccggccaatcccatcacccgccggatagggatcgacccgtccgttgattggcgcgcgcctgcgatcgatcgattggattgcaggggtagggcggccgcgtcgagatagatcgatccatccatcgatcgaattggttttgttggtggatcggagatattcattcgggtccatgggtcggctgctgctgctgagcctcccggcgacgggcgccgtcatctaccgctgcaagcactgcgacacccacctcgcctacgacaccgacatcatcgcaagggtaagggtggatgtggattgggttccttgctgcgcttcgcttttcatttcaatcgatcgatcgattgattattccttgcatatatctgtctaactatcttatttgtcattcttctcctgatgttggattggatgcatggaaatcgaccagacgttccgctgcaagaacggcaaggcctacctcttcaacaggatgtaactgccttctctctctttctctcttcaatattaatatttatattatattattggtagatataaacatacttgtgatatatatacatctgcagcgtgaatgtgaatgttggtacgaaggaggaggaccggatgatgacgacgggcctgcacaccgtgtgcgacatcttctgcgtcgcctgcggagccatactcggctggaaatacctcgtcgccttcgacaagagccagaggtacaaggaaggcaagttcatcctcgacaggtccaccgccttggcagccgctcctggtgatgccgctgctgaccaccaccaccaccacgctcgcgtagcaagctccgatgacgaagatgaccatatgtgaatgatgatgatgatgaatgtcatctgcattgcattcaccataatcccttgctatctgtaaatactctactccgcttgttgtagtcgttcgtcgtaaagcacctatatgtttccatttgttcaacctatcagactatgatatgatcagcaagtaaggtccatttgtttggatgaaaaaaaaaaaaaaaaaaaaaatccattgcctgcttgcgctgttgattgctctgctctgttctcttatgttgctaaccgactctgctcttcaaccagccgagttcggctgcttctgcctcgagctgctgacacaagaatactgtaacataatgtttgggacagctttatatttggtgaaactagttagacttcaatttttcttttttgtagccaaacatctctagctctaccagctccatctgtaaatctctgctcccagattcaccaatttgatggaggggtgttccaccaaatccaattcggtaaagttgaaaaaaattatggtttcccagaatttaccggtgctagacttcaatatttttttagccaaacatctctagcaaattgattcccagaatggatacgattttccgatttcaacgttgctttttaaccaattgatctcacttcgttattctttcgaaatcaacgaaaatcactaaaacaagac

SEQ ID NO: 2498 - DNA, 933 bp, Zea mays
gcacgagaacaaaccccgcacgactcgttctcattccactctccaacgcgcaccgggcggtttttcgttcctttctttttttttcccctcttccccttccccttctccttccagcggcgctcaggccaccgccggccaatcccatcacccgccggatagggatcgacccgttcgttgattggcgcgcgcctgcgatcgatcgattggattgcagggttagggcggccgccgtcgagatagatcgatccatccatcgatcgaattggttttgttggtggatcggagatattcattcgggtccatgggtcggctgctgctggtgagcctcccggcgacgggcgccgtcatctaccgctgcaagcactgcgacacccacctcgcctacgacaccgacatcatcgcaaggacgttccgctgcaagaacggcaaggcctacctcttcaacaggatcgtgaatgtgaatgttggtacgaaggaggaggaccggatgatgacgacgggcctgcacaccgtgtgcgacatcttctgcgtcgcctgcggagccatactcggctggaaatacctcgtcgccttcgacaagagccagaggtacaaggaaggcaagttcatcctcgacaggtccaccgccttggcagccgctcctggtgatgccgctgctgaccaccaccaccaccacgctcgcgtagcaagctccgatgacgaagatgaccatatgtgaatgatgatgatgatgaatgtcatctgcattgcattcaccataatcccttgctatctgtaaatactctactccgcttgttgtagtcgttcgtcgtaaagcacctatatgtttccatttgttcaacctatcagactatgatatgatcagcaagtaaggtccatttgtttggatgcagcgacagttacaaacaaaaaaattaaaaaaaaaaagcggcc

SEQ ID NO: 2499 - DNA, 2056 bp, Zea mays
gattcccgcggaccgccccccccgcgccagccctagtgacttagtcccacctgtcagctgcaccagcaagcaaattgacagcaccccgcatctcttctcctggacgcgacgccgtccccaacctctccgtcccgcgccgccgccgcgcgtcactgtgctcgcgatctcgccggcggccccagaggacttgtcgcgtgctcggccatggcatcgccaccgccggccctcgagatcctagttcgcgagcccgacggagtcacggtgtggtccggacccccctacccgccgggcaccaccagcccgccgcagagactccccaagacggcgtgcagcgccacctctttctccaccgacggtgcccgcctgctcgcgacggtggcatcggcctcggccaccgtctacgactgccgcacactcgctgtagtcaagtgcttcgagctcccgggtctcctcgccgctgcgctatcgcccacgggggcgtatctgcagaccttccagaagtcatcctcgccgcaggagaagaatgtcacggtctggcacgtcgacacagctgccgctctttaccaacactatcagaagagcatgtctaaaaccacctggccaatggttcagttttctgcggatgaatcggtcgcttgccggatgatgcctaatgagatacaattctttgatccaaaagattttgcaaaaggaattttgtataggataagaatgcctggcatagctacgatgaagctagcaactgcaccaggatctcatgttgctggattcgtcccagaggctaagggtgttccagctagcgttcagatattttcttgcaacaaggatgcacaaaatcaagttgttgctcgcaggagcttttttcgctgttccaccgttcaattacagtggaacaaagggtccactggccttctaattcttgctcaagctgacgtggataaaaccaatcagagttactatggtgaaaccaagttgaactacttgacaactgacagggccttcgaaggaattgttccactcaaaaaggacgggccagtccacgatgtgcagtggtcttcctctggctctgaatttgctgtggtttatggtgttatgccgcccaaggcaacaatattcaacaagaagtgcaaccctcttgttgagtttggtgagggaccttacaatacgataagatggaaccccaaaggacgatttgttgtattagcaggttttggcaatttgcctggtgatatggcattctgggattattcagaaaaaaaattggtagcgaaaacaaaggcagaatgttctgtcacaagtgaatggtcccctgatggtcgtcattttatgactgctacaacagctccgaggcttcaaatagacaattgtataaaaatatttgaccacaacggatctctgcagtttaagaagatgtttgaaaggctgtatcaggctgattggaaacctgaagcagctgaaagattcactgacattgctgacctgacaacatccttgagtaccttaaagattgaagaaacaaaaaaacaagtttcagcacaaggttccaagtcagcacaaacatcaagcaaggcccctgcaattacagcgccaaaacctacagcataccgcccacctcatgctaagggttctgcagaacttcaggacaagctctttggtggactagctcctgctgggggggagatgagcaaaaatgcattgcgaaacaagaagcgcagagagaaacagaaggaaaagaaagctgctgaagcgtcaggctctcctgctgatgaaagttgatctgtgccggattactttcagcattgccaaccaccgagtataacagcgacaaatgatttctttcaatctggggaaacggccatgcaccgattcacgtttacaatatgaaactttttggtagtttggtgcagacactcggttattttttcagaactatactgagtttgtataaccatagcgaagaaacataaaaagtgagctatttcatattttcaaaaaaaaaaaaaaaaaatcgatggattggtgtttactgtgctagcaatatcgctaccccaagccc

SEQ ID NO: 2500 - DNA, 2092 bp, Zea mays
ccgtgggacatttggccatgtatatgctggttttaacagtgacaaaggtgaaatgtgtgcgatgaaggaggttactcttttctcagatgatcctaaatcaaaagaaagtgcaaaacagctgtgccaggaaatatcacttctgagccgactgcagcacccaaacattgtgcgatactatggatctgaaactgttgatgataagctttacatatacctggagtatgtttctggtggatctatacataagcttctccaagagtatggtcagtttggtgaacaggccattcgcagttatactaaacaaatacttttgggcctagcttttttgcatgcaaagaatacagtacacagagacatcaaaggtgcaaacatattggtagaccctaatggccgtgtaaaacttgcggactttgggatggcaaaacatatcaatgggcagcagtgccctttctcatttaagggtagcccatactggatggctcctgaggttataaaaaatgctagtggatgtaaccttgcagttgatatatggagtttaggatgcacagtcctagagatggctacttcaaaaccaccatggagccaatatgaagggattgccgcaatgtttaagataggaaacagtaaggagcttccgccaataccggatcacctctcagaagagggtaaagacttcataagacagtgcttacaacgtgatccatccagccgtccaacagcagtggatcttttgcagcacccatttgtaggaaatgcaccaccacttgaaaaatcatctgcctctcatccactggaacagttgacgactatatcatgcagaacaaattggaaggtggttgagcatgccagaaatatgtcctcgcttggtttggaaggccgataccaatcaattttgcagagaagagctgccaaattttctttgccaaatagtgatatccgtatacagagtaatatatcttgtcctgtatctccatgtggaagtcctcttctaagatcaagatctccacaacatcaaaatggtagaatgtcaccttctccaatttctagccccagaactacttcgggtgcttcaactcctctgactggtggtagtggagctgttcctttaaaccacctgaggcaaccagcttacagaaacgagggcttcacagtcacatcaaggggttttgatgaccacatacctagccggcttgtcgatccagtacatggacgttttattcgggtgcagcaactttctgcgggtcgtcaggagagggtggtctctgaagctgacattctgagctctcaatttggaaagattagacatgcaaacgtgtgggatccgcatgatagaccgttgccttctgagagatcctctcagcagtgttttggggatcatgcgaagctaaaaccttcgctggacttgaggtctggccctctgcaccctgggcgcaaccatggccattgattctctaagcaaaagttaatggagtcgtgtctatgtgatagctagtggtcctaagctggttcactgaaacctttaattgtatcatagcagaagacatgttcgttaattatttcagttgctgacagttggcagtggataaagattctccaatgtcaatcccatattcccattactctaaaaaagatgagacatgccctaccaggaagaggggatgttgtatactagactgtccagataccgaagggaccccaaagcagtgactcttgaacctgtatactcttttactctcgtcgtgccgacaacaatttagttctcgttttcttcttatgggtttggaaggccattgtacagaggggggggggggactctcaacaagaaaaatccagattagaaggcacaggagaaagcaagtgagccattcaccaacctttttttcctttttttttcttttcaagtcttagcagatacatatatgccggctgctcgctgtaaagtgctgattcagctgtggctgtgataccggttcaatccgttaaacgtgtccgttactctgggaaaaatcatgtgaagagtctaatcgttgaaaaaaaaaaaaaaaacagttcgaacccaaaaaaaaaaaaaaaaaaaagtcgacgcggccgc

SEQ ID NO: 2501 - DNA, 1689 bp, Zea mays
gcctttcctcgttgcaacccgcgtctggcgtatagctgtatcttttgcagacgcttccttctatatagctgtcgctgagcttgagctgctccattcccgcaacccccttgtgtcccgacaacgctgggagcccattctcgcaccgcacttcgttaggttggtttagatcacatcattctcaggtttgttttaggcttttagtctacacctgtcgcctcaattaattcgctgtggagggggagattcggaggcattagcagaatcaaaatccatggtgttgtacgccgatctcgacgcgctccgggcgtcggcggccgacgtgcggatcgtcacgtcggacggccagaccatcgccgcacactcctacgttcttgcctcggcgtcgccggtgctggagaggatgatccacagggcgcgccgcgggtggggcgccgccgactgcacagtcgctgtcttcggcgtcccctccgacgccgtcctcgccttcctccacctactctactcatccagggtggcgcccggaacggaggaggagctggtggccgcgcacgggccgcagctgctggcgctggcgcacgcgtaccgcgtcgggtggctgaagcgcgccaccgaggccgccgtgtcggcgcggctgaccgcggaccgcgccgtggacatgctcaagctggccaggctctgcgacgcgccgctgctgtacgcgcggtgcgcgcgcctggccgccaaggacttcgccgccgtcgaggcgaccgatgggtggcgcttcgcgcggcgccacgacccggcgctggagctggagctcctccagctgctggagggcgcggaccagcggcgggcgcggtgggcgcgggcgcgggcgtcgcaggaggcgtaccggcagctcggcgaggccatgggctccctcgactgcatcttcgacgcggcgtccgcaggcccgggaacgtgccgggacggcgacgccacgtgccagggcctgcggctgctgatgcggcatttcgccgcgtgcgcgcgcaaggccgcgccgggcggctgcgcgcggtgcaagcgcatgctgcagctcttccgcctccacgcctccatctgcgaccgggcggagctgcaggaccagccgtgccgcgtgccgttctgcagccatttcacggtgaagatgcagactgagaaggcggacaagacatggcggctattggtgaagaaggtgaggagggctagagcgatggccagcttggccgacaggcaggtgccggaggttgtggctatatcgtgggtgaagtataacagcagcagcaaatgggcgcgaaactgagacgaagatacactccttgtctggcatgtatggtgtagccttctgcaatttttttttgcgctgttggactccttgtccggcatgtatggtgtagccttctgcaattttttttgcgctgttggattatgattatgaatgcaatccgacgctgccatgcaaacgtgaggcctatgtctgaaacaaaaatgtaggcagagtcgattcttaccagatagatttagtgtttatttttttggagagatataaggagaatatagtactgttgtaaatccctgtatattatgcaatcaacttggacttgtgtatcagaaaaaaaaaaaaaaaaaaaaaaaaaaaaaaaaaaaaaaaaaaaaaaaaaaaaaaaaaaaaaaaaaaaaaaaaagggcggc

SEQ ID NO: 2502 - DNA, 3720 bp, Zea mays
cgcttgcaggcggccgactgcagtagggcaggtctgcttccacagacgtcttcgccgtttgagaggtggcgcccacctccaccgtctcgtctgctgcctgctctagtggtgccggacctggggtggagcggagatccacaagggcttggattgctttcgttgtcttgctggctttgaggtggagatgacactaagttgaaatttttatcacacgaggaagcaagaacaggaaaaaaaatcacatttcagtgttgcactctgtggagggttcattgttggtccaccaaactactgcagtgctggagggtttttgttgaagtgctcttcatgttcaccatttctaaattgtcataggctcatagcattgtagctgatcagtcttcaagatcttcctatgagtacatagaaaaatcatcatcgtatctgtgttaagtatgccaccatggtggggaaaatcttcatccaaagaagtgaaaaagtctgccaaagaaaacctcatcgacacatttcagcgtctcataagttcaaatgagcaaaagggaagcagaaaatcacgaagtagtcgtagacatggtaaagacacagctggtgacaaaggttgctggtccactgctcaatcccgctcaacatccccttcaaaagaggtctctcgatgtcagagctttgcagcagatagaccacatgcacagccacttcctcttcccaaatcacgtgctaaggtgacacgtacttcttctgatattaccaactcaaagtccactttggaaaagcatggcaaaggacaactgcttccactccctccaattcagcctaaaaaaagacctgaagctactgaacctgttactgaagtagctactgcttcggtctccagcaactgttctattgacagtgatgatcctggtgattctcagcttcagagtcctgtgggaaatgaggctgaaaatgcgactagaattactgcaacaagtagttcaagtgttgtgcgcaaagaatgttctagtgctattaccagaaagaacacaaaggaagttgcaaagccaaacagtgctattctcagtaaccaaattctgtcaacatctccaagaggtacctttgctgatggttatcaatccaatttacaaagcccccgacagattgccctggagagtgctccgaatagtttgatgtcaagtccttctcgaagcccaagaaatatatgtcctgttcagattccaacttcagctttttgggcaataaaacctcatactgatgtaactttccttgggtctggtcagtgctccagtccaggttctggtcagacatctgggcataattcagtgggaggtgatatgctaggcccaatcttttggcagcctagccgaggtagtccagagtgttcaccaattccaagcccaagaatgacgagtcctggtccaagttctcgggtgcatagtggaagtgtctctcctttgcatccaagagctggtggggtcactcctgaatccccaacaaatcgacatgctgaagggaacaagaagcaaacccacagattgccgcttccgccattaagcattgctaatagttctacctttttgccaaacagctctaacccaactagtcctatatctcgtagtcctggtagaacagagaatccaccgagtcctggttcacggtggaagaagggaaaattgattggccgtgggacatttggccatgtatatgttggttttaacagtgacagaggtgaaatgtgtgcgatgaaggaggttacccttttctcagatgatcctaaatcaaaagaaagtgcaaaacagctctgccaggaaatatcacttctgagccgactgcagcacccaaacattgtgcgatactatggatctgaaactgttgatgataagctttacatatacctggagtatgtttctggtggatctatacataagcttctccaagagtatggacagtttggtgaacaggccatttgcagttatactaagcaaatacttttgggcctagcttatttgcacgcaaagaatacagtacacagagacatcaaaggcgcaaacatattggtagaccctaatggccgcgtgaagctcgctgactttgggatggcaaaacatatcaatgggcagcagtgccctttctcatttaagggtagcccgtactggatggctcctgaggttataaaaaatgctagcggatgtaaccttgcagttgatatatggagtttaggatgcacagtcctagagatggctacttcaaaaccaccatggagccaatatgaagggattgccgcaatgtttaagataggaaacagtaaggagcttccaccaataccggatcacctctcagaagaagggaaagacttcataaggcagtgcttgcaacgtgatccatccagccgtccaacagcagtggatcttctgcagcatccattcgtacaaaatgcaccgccacttgaaaaatcatctgcctctcatccactggaacagttgacggctatatcatgcagaacaaattcgaaggtggttgagcatgccagaaatatgtcctcgcttggtttggaaggccaatcaattttgcagagaagagctgccaaattttctttgccaaatagtgatatccatatacggagtaatatatcttgtcctgtatctccatgtggaagtcctcttctaagatcaagatctccacagcatcaaaatggtagaatgtcaccttctccaatttgcagccccaggactacttcgggtgcttcaactcctctgactggtggtagtggagctgttcctttaaaccatgtgaggcaaccagcttacagaaatgagggcttcacggtcacatcaagaggttttgatgaccacatgcctagccggcctgttgatccagtacatggacgttttattcgagtgcagcaatttcccgtgggtcggcaggagagggtagtctctgaagttgacattctgagctctcaatatggaaagatgagacatgcaaatgtgtgggatccgcatgataggccattaccttctgagcgttcctctcaacagtgctttgggaatcatgcgaagctaaaaccttcactggacttgagatctggtcctcggcaccctgggcgcaatcatggccattgattctgtagcaaaagttaatggataagctttcagtcgtgtctatgtgatagctagtggtcctaagctggttcactgaaacctttaattgtatcatagtagaagagatgttcattaattatttcagatgctgacagttggcagtggataaagattctcaaatgtcaatctcatattcccattactctaaagaagatgagacatgccctatcaggaaggggatgttgtatactcaaggacccaaaacagtgactctgaacctgtatactcttactctcgtatctacaacaatttagttttcgttttcttctatgggtttggaggccattgtacagaagggaactctcaacaagaaatccagattacatggcacaggcgaaagcaagtgagccgttcaccaatctttccctttttttttctttttaatcctatataacagatacacatatgccgactgctcactgtaaagtgttgatcgaactgtggttgtaataccggttcgatccattaaacgtatctgttactctgaatatcatgtgaagagtctaatcgttaatcaaaactggtccagttctacaacaaaaaaaaaaaaaaagaaaaaaaaaaa

SEQ ID NO: 2503 - DNA, 1388 bp, Zea mays
  misc_feature (1366)..(1366): n is a, c, g, or t
ttttcctcccataaaagcctctccctccgctagtccgctctcaagtaaaaagctcccgaaatcccctcacctactcctctccctctccctctggcagcgccgcctcgccggcggttgcctgcctgcaccttcgccccccgtctcgacctcgacgcggcctccgttcctccgcgagacgcagcatggatgtgcgccctgcgaatgcggccgacgactcgtctctcggagacctgttcccgcaccagcccgccggtttggagagtgacgagagcaacacagaatggctctctggttacgtagaggactgcttttcgagctccacgtcgtacacaaatcccgtctctgcaatggcaagcgagggtgtcggaaaaccaaagctacctccaccaccatcctccaacggcaggagaaagaaacggagcttggcctccgtcatgaccaacggcgactaccaacaattcgtcctcccgctgtacgtcgagccaccgctgatcctgatcgaccagaaacactggatggcagagagcgagctgatccaccccaagaaggacgacgacgaccgagaggtttgccagcaacaagggcaggagcaagagaagggcgtgccgcggctggtgaagatgtgcagcaactgtctgtcaagccaaacgccacggtggagggacgggccgtcggggcgccagatgatgtgcagcgcatgcggcatgaggctcaagccagagaccaggttgtcagccgagcagcagtgcggccaggaagaacccaccaggaaggagcaagagccagacaggaagaggaagaaggcggccaagaagacgtgctacgagagcagcgacgccccgccgtcgtcggaccagcaagagaagcggtgcgcccactgcctgtcctccaagaccccgcagtggagggcggggcctctggggcccaagaccctgtgcaacgcctgcggcgtcaggttcaagtccggcaggctgctgcccgagtaccggcccgccaacagccccaccttcgtgagctgcttgcactccaactcccacaagaaggtcatgcagatgcggcaggccgtcgcgcagcagcagtgaggccgacgtctcccggaatctatcgttggaagcgcgttaggggatctcttagatcgtagcttagtcgatgctcagagaggatgagaacagagactttggttatagtagtagtaggcaatcgtcgttagctctagcggtgttctagctcagactgatttgctcggtgtttttagacgtcggattcaatacaatctcgatgttgtcctgaattgtgctatgggttttcggtccattagatgttcaaggtttcaattgggaactcggtgtttaaagagaattgctantgaaaaggcatcagttcctggg

SEQ ID NO: 2504 - DNA, 3066 bp, Zea mays
  misc_feature (435)..(435): n is a, c, g, or t
tgtatctataatggtaaagacttaaaactagctgtcaattttcctttttagtatataggaccatctatttcccgttttggcttccaaatcttctcaccactctccctaagtgacacacaaacacttgtgtgcaatctttaatagcaataaatacttggaattaatttacctttcccttctcctttcctcctcaccctctcgcctcaccttagcgcatggtgccacaggtggtagtgctacaggcacgacggaccatggaaactcttcatgaaatcgatgaagagccgatccacgacaataacatgaagtaggttatagttagatggtttggggttgagtttttaaaggccgacgagcataaaagaatgtagcggcttactcgatgatagagacgaatgatgaatagtaagttgaggtagtgggaacactagcgantaaatagtgggggtgacttatgggagggtttatggtggaagcgatctatattagcattgtgcgagatagaaagcaattgatcgtgtattttttttctttgtttaggggggtgcatggggctgtccttatattagtcggacccatctttagcccctattcattctccatcgggaatgtatctgtgcacatggtgtacatgttaaatcatgtacattcacttcggatctaatgtgtcttagtgtcttatctattttataaagatcatatttcgagcaaagtagaaatggaagatagtgttggaaggtgtttcttttttaaaatacatatgacaataggtaccgttagatctagaataggtattgttatatctataatagaagaacaccgtttaatatgtgcatcatatgtaccaaaataccatatataccggatacgttcctttctttttcaaaccatatcttatactacctccgttttcaaatattttttgtctgctagtttatttttaaactaaaacgtgacaaataaaaaagaaaggagaaatatttgtctgaacactcccccatctcccggtcctcgcccacatagaccaacatcgcaagcgttgcaccaaaacccccaggcatgagatgctccaatctgtgctgcccatatataggccactacagagcaacaagggaagtgcaaacaaaaagcctcaaaagggcagacagccaaatgccccaccacagcgtagcccctcctcactgactcgcctgcaaaaaccacttgcaaaccacacaaaccgaaaacgccagctcccctgcctccatttttagcaacttttcccttctgtcttcccatcacagtcacccttcttgcccccacgcagccgagcgtgcctacccctcctcgacccttctctggggccgccgttggacgctcatggagaggagtcgtccgggcgccgcgccgaaaccatcgccagaggaggaggtggcggcggagggccatgcgcatggtgacgatgtgacggggcaggaggaggaggaggaggcgacgccagtggtgctcaagaagggcccgtggacggcctcggaggatgccatgctcatggaccacgtccggcaccacggcgaggggaactggaacgcagtacagaggatgaccggcctgctgcgctgcggcaagagctgccgcctgcgctggaccaaccacctccgccccaacctcaagaagggctccttctcccccgacgaggagctcctcatcgcccagctccacgcgcagctcggcaacaagtgggcgcgcatggccgcgcacgtaagcaccctatcctttgccctggataacaaatttatttatggcgagtggcggcgacctgctgatgtgactgacgtttgcgagttcgttcctcgagcgaattccggccggtcggttgcattggttggcttggtgcgcgcccgcagctgcccgggaggacggacaacgagatcaagaactactggaacacgaggaccaagcgccgccagcgcgccggcctgcccgtgtacccgccggaggtgcagctccaccttgccctctccaagcgctgccactacgacgactacgacttcccgccgctcgcgtcgtccccgcagctgtcggcgacgacgacgaccgatgtccaggcgctgggcgccgggcccgggtacgccagctcgcgcccggcgccgctcgacctggctcgcagccagctcgccgcgacgacgacccagcagacggcgcagttcctctcgccgccgcccttctcggcgccgtcgtccccgtgggccaagccgttcgcgcggaacgcgcagtacttccagctcgcgcactcgtcgcccgtgtccccgtcgacgccgaccgggccggtgcacccggccatgccggacctgtctctcggcggccacggcgcgcgcgccgccgccgctgccgaccagagcaggctcccaccgctctcgccgtcccccggccccagagtggagctcccttcaaaccaatacggccagccggcgccgccgacctcggccgccgccgtcgccgccggacttgcgctgccggatcatcagaacgcggcgagcctcgaacagatgctgcaggagctgcacgacgtcatcaaggtcgaaccgcaggcgctggtcccggccagcggcggcggcgctgcactggagcggcatgattgcggaggtgcgtagtgcatgccgtgtgtgaaccatctctcttcacatcttcgccttttctggatgcgctcggtgtccgatttgttgctttgcgggggaagagaacaaatgctcatgatcacgatgtgaactgggcagattagcgtgaaccttttccgtccgtgcttccaaaatctacatttgttttcacttactatgtgccaccaacctgttcagaggctaaacaactctgatctttatcgcggtgtcaccatctggttaatcaaagtacacttactcgggcattagtggtaggaataaatgtgccttggtgaaagtatttctggtattagtatattattatgctaggattttggacaaaatctgaaccatggacagcacactgtttggaatctttctctctcttttttgtctttcttttgatagttttaaggttggagaagcttctgca

SEQ ID NO: 2505 - DNA, 605 bp, Zea mays
gctgcttataaaagcaaaaaaaaatctactcctaggtcggtcaagactcaagaccagggcggcggccgcgttccattctgcgcaaggcgacgactgcggttgggaagggaagacgcctacaaacccctctctacctctcctctgcgaaccacctgccgccggaagccctagagggctcgacccatggatccgccgcagcagccggagcctgtcacctacgtctgcggagattgcggagctgagaacaccgtgaagctagtagacgtcgtccagtgccgtgaatgtggccaccgcatcctctacaagaagcggacccgccggattgtccaatttgaagcacgctgaggagtgacgacaggggaaaaacactggagatggttgatctattactcgccactcacctatgtaaagagtcttgtgagggaaatgaaagtgtcagacataatgtttgaatgaatgtcgtgtgcctcttttgggcttgaaaactttaatatgtaaggcttgaactagggtcggatttgagcattgagatactgcagtaatatgttgatgggtcctcctaagtaccgaatctaaaaaaaaaatgtcatgcctgcgttattatt

SEQ ID NO: 2506 - DNA, 796 bp, Zea mays
  misc_feature (597)..(597): n is a, c, g, or t
  misc_feature (613)..(613): n is a, c, g, or t
  misc_feature (625)..(625): n is a, c, g, or t
  misc_feature (642)..(642): n is a, c, g, or t
  misc_feature (644)..(645): n is a, c, g, or t
  misc_feature (660)..(660): n is a, c, g, or t
  misc_feature (662)..(662): n is a, c, g, or t
  misc_feature (665)..(666): n is a, c, g, or t
  misc_feature (669)..(669): n is a, c, g, or t
  misc_feature (673)..(673): n is a, c, g, or t
  misc_feature (676)..(676): n is a, c, g, or t
  misc_feature (681)..(681): n is a, c, g, or t
  misc_feature (692)..(692): n is a, c, g, or t
  misc_feature (698)..(698): n is a, c, g, or t
  misc_feature (704)..(704): n is a, c, g, or t
  misc_feature (706)..(706): n is a, c, g, or t
  misc_feature (713)..(713): n is a, c, g, or t
  misc_feature (717)..(720): n is a, c, g, or t
  misc_feature (737)..(737): n is a, c, g, or t
  misc_feature (739)..(739): n is a, c, g, or t
  misc_feature (742)..(742): n is a, c, g, or t
  misc_feature (744)..(744): n is a, c, g, or t
  misc_feature (748)..(748): n is a, c, g, or t
  misc_feature (750)..(750): n is a, c, g, or t
  misc_feature (760)..(760): n is a, c, g, or t
  misc_feature (764)..(764): n is a, c, g, or t
  misc_feature (767)..(767): n is a, c, g, or t
  misc_feature (777)..(777): n is a, c, g, or t
  misc_feature (785)..(785): n is a, c, g, or t
  misc_feature (787)..(789): n is a, c, g, or t
  misc_feature (794)..(794): n is a, c, g, or t
gcacgagcgcgttccggccttccgggccactccttacgtcgagcgttccgtgcccggccggggccgactgggactgagaagaaacctccaaacacctacctctctacgaactacctgccgccggaaaaccctagagcgctcgaccatggatccgcagcagccggagcctgtcagttacctctgcggagattgcggagctgagaacaccctgaagcccggagatgtcatccagtgccgtgaatgtggctaccgcatcctctacaagaagcggacccgccggattgtccaatatgaagcgcgctgaagagtgaagacaagggaaaacactgaagatggttgatctattactcgccacattacctatgtaaacagtcttctgggggaaatgaaaatgtcagacttaacgtttgtatgtcgtgtgcctcctttgaacctgagctgtataatttgtaacgcttgaactggggactgatttgagaactgagacactgcagcaatatgttgatggatcctaagtggcgaatctaatgcatgcgtgttatgccagcgttaaaaaaaaaaaaaaaaccaaaaaaaaaagtgaggccccggggatcnctattttaagcggccncccgtggggagnttcaacttagtcctttntnnggtaattccacttgngnatnnggnattnctngtctngggaaatggtncgctanatgccncntttcganccgnnnntaattgaactggggtcnantangngcantnaatatagggngccnccngccttctttngaaactgntnnngtttntt

SEQ ID NO: 2507 - DNA, 493 bp, Zea mays
agacatcgagagagagagagggtgagtgcgtcggtccaggacgatgaagaacaagtaggaccgccgctgcgattcttcgttccaggaggaacttgggcacgaatgcagacacgggggcttggcgtggtgggagggaaccgtacctggtgaggccttagcgtggggggcgggtcgtttggaggttgggatttctcaccggaggtgtgtcgccgccgcggagccacggagctaatgggtgggatcccctgctgcgccactagcaggaagccacaagctaggcattgtctgccattctactgattttgggggcatttagctaaagtgtggcagtgaatttcaatttcaatggcaacaaatagctaaagtgtggttgaacttgtgttgttgaacttgatctgtttctttttatgctaatgctatttggtttgtgaactcaacttatgtatgaacttattctatatttgaaattcttggacaaaaaaaaaaaaaaaaa

SEQ ID NO: 2508 - DNA, 1723 bp, Zea mays
atggaatgggcttgaaatttggcatccatttgatgaaagggataagtgtgcaggctgttaatgctgacacacctatcttggacataaagacgggaaaaccatatctagaggatggtcgtcagtggacagcacgagacataggtctcagtcacagaacttgtgcgtggatgactcatggatttatgagtgttaatacaaatattggagctggaagggccttcttaagatctctttatcgacaatatgctgattggggtgttgattttgtaaaggtcgattgtatcttcggcacagattatagcccagaagaaatcatcactatttcagagctattgcaagaaattgatcgtccgatcatcctgtcaatctcaccaggaactgcagttactccagcattagctgagaatattagtgatcatgttaacatgtataggataactggagatgattgggacaactggaaggatgtgagctcgcattttggtgtatcaagttccttcgctgctgctaagaagattggggccactgggttgcgaggaagatcttggccagacttagacatgcttccatttggatggcttactgatccaagtgtaaatcagggccctcacaggaaatgtaaccttactcttgatgaacagaaagcacagatggcactttggtcaatgactaaatcacctctcatgtatggaggagatttgaggaatcttgacgatagtacattaaacataattaccaattctggtttgttgaagataaaccactatagtagaaataacatggagttccattatgtgcacagtgaaaggacatcaaatggagaacattctggtcactttaggtctccttatcctgttcgtgttaccaagaatgatggcatatttgtcagtctcactgcttgcagcgacgatgcagctaaaggatggtatatgtttccacaagatgggaaaccagatcatatatgcaggaactatgaaatactgaatgataaaaatgtctcattttgcctcggaaaaacaaaacgttttcttgcatcggatgtccttaccatggacaccaaggaacaccaatcaaagtttcatatttcagttacaaacactgatgatacttgtttggatgcatctgctggtcgaaggcagactgcctcagagatcaggcttcctatgttctctgcatgcaggtggcatgcaaaacagatgtgggagttaaatgcgaatggaaatcttgtgagcagctattcaagattatgtgccacagtggaatcaagggacgaaggaggtaccagtggaggtcgggcatggattgcaactggaagtgaaggagaaatctatctcgcgttcttcaatctcgactccatgagcaggaagatgaccgttgaaatatcagaccttggaaaggttctcggaagaaaccttttggagaaaaacccatgtagctacactgaagtttggagcgggaagaatttcggccccgtgaaggaagagatttcagcggtggttcattcgcatggctccatggtgttcgaaatcatatgttgagattgcagtactgggcaagttgttcgagaagtttgcagtgataatttagttgtaagctccattcctgttgatcctttttaacgtgtagtccggagatggaagagatacgttgatgaaccattaactagatgcctgctggatttgacttgaatgaataacaaaaaaaaacaaacaaacaggaggtg

SEQ ID NO: 2509 - DNA, 2157 bp, Zea mays
ttttgtgcttcttctgtgttacaaaaggtctttttttaggataacaaaaggtcttattggtagactgatattcttagactgatcacatgacacacaaatcataccaagactgcaggatagagattttagaagagtggataatagaaaccttaagaggttgcctggaaaccaaattgcaaaattttggattttttttccaccaccgaaactactgatattcgcaaaaaaaatcactgaaattttgaaccctgcctttaataaattttagcagtctgatatatgttccttatcgagatagtttcagcttcaaatgatgaccatttcatcttgtttctatttcggggtaatgcatgagatttttttttctgaacctgtcttccatggtgcaggagaaatctatctcgcattcttcaatctcgactccatgagcaggaagatgaccgttcaaatatcagaccttggaaaggttctcggaagaaaccttttggagaaaaacccatgtagctacactgaagtttggagcgggaagaatttcggccccgtgaaggaagagatttcagcggtggttcattcgcatggctccatggtgttcgaaatcatatgttgagattgcagtactgggcaagttgttcgagaagtttgcagtgataatttagttgtaagctccattcctgttgatcctttttaacgtgtagtccggagatggaagagatacgttgatgaaccattaactagatgcctgctggatttgacttgaatgaataacaaaacaaacaaacaaacaaacaaacagggggtgaactgatctgtattattttgcttcatgtcctattggactcgacgacttctatttagtggtacaaagttaagctattcataattaacagaggaacatctaacacgatttggaggttcagatgacaaatccctaagacatggctgtctgttcagccaacaaaagaactgaatcatttgcctattaaatactaggaacaaaattatctggtgatcctgattaacagacataaacaactactgggctgggctggctgtgacgggacgagcatacttcacaagcagtagcatccctgaatggtgtgatccgtttgttatgtacgctagagatggaatggacaagttttcacttcttcactgacacaaaactgtggctatggagcaggagatgaatgccgtagccagtctttcgcgcagaacagtgcctccaaggtttcagggtgcagtgagctctggtagtcgtcaagcatcttggcttcagtcccagctgcgaacacagagctgccgcgaccaacggtggacaccggtatagcaagaacatctcgggccatcctcgagagtgttgggtacctgacggcattaagcttccaccagttcagaatgtcaaactccaagatgcgtggaaccagggcttcttccaagtactgatctagctccgacttgacaatggagacctcgaagcctgattgtagattgccaatggaagtaggatctcttggaatgttcttatccccaacatggtttggcatcaacggaagtgtcagtgtaacatactctttgtaaagctcatgtacaacaccatccaccaacttgacatacttagcgcccttcgtcggaccgtagattttggagtaactgaactcaacaatcttcatcttgaaacggggatccatcacaacagcaatggctagcacaacattgcaatctttccagtacttgccaaacgtctcatgcacgccttttgcgatgctgctggaaacagaattaggatcttgatgatctgtggcatttgaaatctctctctgaattgtccaggcatcatggaaaaatatgttggcagttggattttccactgccataatgttgtttgcagagtcatacaacagcttcagatacctgcaagcaacctcgactttctcccagtccactgccgaaggtgcttggctgtagttaccatcacatttctccagcatggtgaacgcctccttatagtccagagctgcctgcagcatgagataggttgtgttccactgggttttaatgtctagacatagaatctggttactaggaatttgcagttgcaaaatgatatcagcgaacatctcctcatggccaatgcgacattcgcggtccgtgatactt

SEQ ID NO: 2510 - DNA, 881 bp, Zea mays
ttttttttttttttttttttttttttttttttaatccgatacaaacgaacaaggccttaacgaaaacatttttgaacattcgacacggtaattggcacaggtaattgcccaggtagtctagtttgagtacgattacatgccggacaactgtggtaggagttagttcagataatgtctgaaaactgcaacgcagcaaccagcaaagcggaaatcactcgtcgacgacttggatcagcgttggctcatagtgatcgggtgcctgaaacccatgaaggttcatgaccgtcgccgcaacattggcgaggccggcacttgcgaggtctgtacggaacctgacgccaggcgcaagcccggggcctcctatcgcgattgggaccggattcagcgtgtgcgaagtcagggtctgcaccttgccgtccttgtcccggagtggttctccagacttgtctcttttcgccatgtcctcggcgttgccgtggtcggcagtcaccacgaaaacgccgcccacttgctcaacggcgtcgaggatgatcttaacagcctcatcagctgccttgcacccaacaatggttgcctcaatgtctcctgtatggccaaccatatctccgttcgcaatgttgacccttacctgatcgaatttttggctcaggatggcgtccctcgccttctgcgcgatttccaaggccttcatcttcggctgaacattgaaggggatgccggcatcgctgggaatctcctcgtatttttccaggttctggtcgaagtaaccagaccgattcccgttccagaaaaaggtgacgtgcccaaacttgaccgtctcgctgcaagcgtagatgcgtacgccgttgcgcgccaagtactcgccggacgtcctctggatc

SEQ ID NO: 2511 - DNA, 4411 bp, Zea mays
  misc_feature (3696)..(3696): n is a, c, g, or t
ccggccgggccgggaggaaaaaacccccaacaccacccgacctcggggccgcccgccccccctccccccccccaccttgcggcgctccacctccgtcccctcgccgccgcttctcacttcgcctcccctctcaaacaccccaagccgcagcgcaggcacgcgcgccgacgtctatccacccagcggcactcctcatgccctgcatcctccaccgcctgcagacgagtcccccacgccaccgcggccacgcctcgccgtccatgtccatggccgccgccccggcttcctgattcgtcccgtacccgcgcgtcgctcctcccgattccatccccgtccgcgccatgccgccgctgcgcggagccaagcgccgccggaaggcggcgttggagaagaaggcggcagcggtcgcaatggcgtctgccgccgcgggcgaccctcctggcgactggtgggaagccttctgcatccgtatgtcaggaaccttatcttctatcgaggatgcacaaagatttgagtctatattcaaaatgccaagaagagccttcgactatgtctgcaatttggtgagagatgaaatgatggtgaggtcctgcagctataccttccttgatggcacagtgctgtgtttggaagaccgagtggccattgctctgcgaaggctgaactctggtgggtcactggtgaccgtaggatcctctgttggagtgaaccactcaaccgtgtcgctgataacctggaggttcatcgaggctatggaggagcgagcgagccaccacctgcgctggccagactctattgaaatggagaagatcaagtccaagttcgagaagatccatggtctgccaaactgctgcggcgttgtggatacaacacacatcacaatgtgcctttcatcagccgagccgaactgcaaggtctggcttgatcaggagaagaactacagcatggtgttgcaagccgttgttgatctggacaccaagttcacagacatcgtgactggctggcctggtagcatgaaagagtcgagcattttgcacagctctggccttttcaagctctgcgagaaaggcgagcggctgaatggcagcaagctgaaggtatcagatgggtcagagatcggggaatacttgatcggcgactccggctacccccttctcccctggctgctcacaccttaccaagagaaggacctcacagagtccagtgctgagttcaacattaggcactcttctgcgagaacagtcgctccgagaacactggccaagttcaaggacacatggaagttcctgcaaggggagatgtggcgtccggacaagcacaagctgccccggataatccatgtctgctgcttgctgcacaacataatcatagaccttcaggaaacagcagtggacgaggcacaggcgtggccgagcgatcatgacgctaagtacaggcagcaagtgtgccagctagctgatgagaatggagtcagggtgagggacaaactgtcccagcacctgattagcaagtgaccaccaccaagcgtaaagcttattggacgagagagtagtgccattttcatctgtttcaggcagctctaaatcccttttgatgtccagttttgcagagttgtaaatgaggcaggtgagggcatctgttcaaactcactgtaaccctcttaaaattaaaattaaggctgttgcaaacttgtcaaaaatcaatgtggcattgtggctcctttggtttataatgtttgtgctttggtgggcttgaaaagtttcatgatagttttttcttcttctctttttataattgcgatcatgtaggcttcaatgtcagacctctactggttttcgtctacagcttgatctttgaaacacccagaggctagagctctattaccggtggcgaagctagagtaaatcttagggtgcaaatgttttgacggtgcgtgcataattataatttgtaggtggtgtatatatagtaaaagtttagtgtaaatcatcggttttgcaagtttccgttggtgcatgtgtaccctaataccctctaatttatactctcttggttctaaaatattagttgttttagcttttaatttttatgtttatgtttgaatgcatgacatatatataagttaaatagattgattattgtatgaatcaataaaaagataaaccaaattttattttaagacggagagagtatataaatttgtctatgttactggttcaaacatgcatctagctacttcttcaccttctatgaatcctggtttctagagatttctagaagcatgttaagaggtgacgcgatgccgttgttgtgtccctacgactctgacgacgagtgggcccggtgtcccgtcgatggcacaagcagctcgtttgggttctactccttcaggctgcagctaatgcaagccaagtgcatgagcgatgatggaagttagcggcgccatgcgtgccgatgagatgcaaatgcatgcgtctcccgcgacctaaccaccagtccaccaccattccagatccacctcctccttccctctcttataccagccgacgcaccatctccacaaatgtcgtcgaccacagaagctctggctccgatgatgatcttggcgctcgccgctgtgctgctggccaccgctgcacgtcagccgtcgccggttatgtccacgaccaccaccaacctgaccctccacaacctgtgcccgtacccggtgtggccgctggtgaccgccaacgcgggcaatccgtccatccccaccgacgccgacggcgagccggcggggcggctggacggcaacggcgagggcctggcgacgctagcgttcccgccgggcgcgtggtcgggccgcgtggtggcgcggacgggctgcactggcggggacgacaacgacgaggcggacgcgtacgacccgctgcttccgacccctcctctccgttgcacgactggcgacgcgccgccggtgacggtggcgcaggtgagcgtgggcgggacgggcggggccgcggcgtacagcgtgagcctggtggacggcttcaacgtggcggtcgtggtgacgccgcacgggatgccaccagagggcaccgggccgcgccggcggtgccccacgctggggtgcgccgtggacctcggcgccgagtgccccccgcgcgcccgcgcgcccggaggagggtgcggcgccggcgcgaccgaggcggcgttgttcaagcacctgtgccccgacacgcggaccaacgccactgacatcgaggacacgccccaggactgcgtcgaccccggcgagatcaaggtcgtcttctgccccaagcccggcagcgtgtcccgccagctctaggctctagctagcgttcgtccgcatgcaccatgcatccatccttcggtcacagaataagagctgtaaccaatcagtcgtgtcagctactgtagcagtagtattagcttggtagtatcgtgtcccttggcacgcacgaagatgattcgcaatgcaacagagagcaggagaccgagttgtttagctcaaaaaaaaaaaaaaaaacagctcagctcaccagggaaacaaagaaagatcctcctcgtaaccatcgctgcggccctgtcaaatcgaccatgcgccatgcatgcctcaggacctgtagatcgccatgtcctggtcgtcgctgattagcggcgacgcgtataagtcgccggcgttcatcgcgctgnccagcgcgctgtgcgtggcggtggcggtgctgctgcaccactgcgtcctcgccgcctgctgccacggcggcgacaggcgccgccgcaggcagcagcaccaccaccggcatgtcgtcagtgccgtcaccaccagcttctcggccggcgcgcggcggcaccagcaccagcaccagccggaggaggaggaagcggacgtcagcgtggaggtgagcgcgacgtcgcggacgcaccttgtggccgcggcggtggtgtgccggtaccgcaaggaggagccctggaacgagtcgacgtgcccggtgtgcctggccgacttcgacgacggcgaggcggtgcgggtgctgcccgagtgcatgcactacttccacgccgagtgcatcgacacctggctgcgcgggagcaccagctgcccgatgtgccgcgccgagaccacgcccacgcccacgcccagcccggcctccgtgcgccaccacctcgagctctccttctccctcgaggagatccttgtcagggcgtagcacatctccttggatacgtacttggcagctgagcacaacggagcagcggagtgctggctgctctgctcttcatagttttttcttgatcaaaattcatctgaacgattgattcatagtttttttcagcaagatttagaagttgttgccactattccggctatatcaaccgcttgtgtaaaccattcctattgaaataccgc

SEQ ID NO: 2512 - DNA, 3907 bp, Zea mays
ccggccggctccttccagtccccccatctctgtccctgtcccccctcctcctcgccttttaccccgcatcgcctcgccgcctcctgcccgtctcgctgaaaccctcttggtcaccgccgtggtcgatccgacccggcagtagccgcagcatcctacgagggccgttggcggggtcgtcgtcgtcgtcgtgttcggcggcgggaattggatgcgccacggagcgggcgaggggacctagttgagttgaatacggcagcgacgggaggacgtgatgccgggggtggcgtcagcagcgggatcggggatctggtcgcgccggcgggacgagatcacgttcgatcgccttcagaagttctgggatgacttgcctcctcaagcacggcaggaactcctcaaattggataagcaaactctcattgaacaagcacgcaagaatttctactgctcaaagtgcaatgggttgcttctggaaagttttgcaaaaattgttatatatgggaagtcattgcagcaagaagcttcagatatttgtcgcctgaggacagctattgaatcaagagttacgcaaggagagcaagatggggctcaggacccatcaattcatccctggggaggcctttcaaccacaaaagatggcttccttacacttcttgactgctttataaaagcagaatcattatgtgtgcttcagaatgtatttgacaatgcacgggcaagagaaagggaacgggaaatgctttatcctgatgcctgtggtgcaggtggcagaggatggatcagccaagggatggctaactataggggtcatggaataagggaaatgtgtgctctacacactgcccacctttcatgtgatacactcgtggatttctggtcagcgcttggtgaagaaactaggtcatctcttctgcggatgaaggaggaggatttcattgaaaaacttatgtacaggtttgatagcaagagattttgccgagagtgtcgaaggaacgttatccgcgaattcaaggagctgaaggaactaaagcgcatgcgaagggaacctcactgcaccagttggttttgtgttgcagatactgcgtttcagtgtgaggtgtttgaggatgcagtcatagttgattggcgccagtgtttatcagagccagatgaatcttatgaccactttgaatgggctattgggacagatgaaggagaatccgatatttttggctttgaaaatgttggaatgaatgcacaagtccacagaaatggaatcgatcttgatccagtttgaggactacttcataacactgcgagcttggaggcttgatggccagttcacagagctgtgtgtaaaagcacatgcattgaagggtcaatcatgtgtccaccacaggctagtggttggtgatggctttgtgactatgacaaagggtgaaagtattagaagtttctttgagcatgctgatgaggccgaggaagaggatgaagatgatgacatggacagggatggaaatgattttgatggtgatggtgcccatccacagaagcatgccaagagccctgaactggcaagagaatttcttttggatgctgctgctgtgatattcaaagaacaggttgagaaggccttcagggaaggtacggcacagcaaaatgcacatagtatttttgtgtcccttgctctaaaacttttggaacagcgagttcatgtcgcatgcaaagaaattattacgttggaaaaacagaacaaacttcttgaggaagaggagaaagaaaagcgtgaagaacaagagcgcaggttgaagaggagaacaagagagagagaaaagaagaacaggagaaaagaaaggctgaaagaaaaggaaaataataaagggaaaaaactagttgaatcaaagtcacgaaatgatattccatcttcagctccaagcaactccacaacatctatcaatgattattcgacaaatactctggactcaagagattcagttaaggaagatgaagatagtgctgaagttgtgaatctgtgctctcctgacagcttagtgacctttgtacatcagatcaatccaaccgggtcttcgagacggggtccaaggtcaagggaggattttcctcaagatcagtcctgttggtatgatgactgcggagatgagtctggaagaattggtgaattacaatggaagtcaagggaaaggacaagaagtattaatagaagtcgcaacgcagcatccacctcaaacaacaggacaagagagaggcaatcatacaattcttgcagctgcggccatctggaagactatggagtcatggacagctgtttcttgccaacagctagatctggcaaagagacgaagatagcaagaaaatcaggagttgagaaacctagggtgcagtaccacagatgctatacattggatagctttatagtgtcaaaaggaaaccgtgctggttctacacagaaaaatgctatcccaaagcaaatatgggagcctatggatgctcgaaggaagactaaattacacaatacagttcatgattcaggttcagttaacgatgttgattcactgaaacatgtggtttttgataacagtggatctcaaaattttggagtaggatgtgaatcacagcctcaggcttctgaaagttccagggatgaatgtaattcagatcaaccatgtgcaaatggtgggagaaatcaaactatttcatgtgctagtagtactcttatggtgaaccaacaaaactgttgcgcaggaaatgatgaaggctccaggcatgatgaagagctgatgatgaactctgctggctctgatagctcctcgtcatgcatgagcgagggagatagggaaagcagctccagcagtacaacctcttcaagcgctcaaaatccggaatcatcttctgagtctgaggaatcacccgagagaataaatagcacagtaggtacacaatcatcaagagctgctgcttcacggtctttgcttgaagcatgtgcaggtaatggtttcagagaataccaacccaaggcaaccggcctagctcacaatgacatgtttgggtacaatgtatcccctgtccaggaccagctgctgcattaccaaagcatgtatccacctcaacatcggccaataacaatggggtttcatgacggttcttgggctgcaccaacgaatggaaactttcagtatgctcgaccatcccacttatattctagtccactcgtattcggaatacctgggaaccattttattgattatccttacatggctcccgccttcagccatatacctccagagcctattcacaaggccgcatccagctttagagccatgcctctgtcactgccttttcaaaacggacatcggcaggctgctagtcttactcagagagacatgaatctagaaaggcgccctgcaaagttgactaagccgacaggcaaggatcccccagaaaacaagaacaagtcgggcctaaaggatctcccagaagacaagagcaaatcatgggatgcggatgcatccttctcgttgttccaattcaacttgccaatagcttcgcctgtaacaccatcatcaaaagataagagcggagagctggccgcaaggacgccactggctcaggtgcaagctcagctttgctcgagggaacaagcagatgtcaaggagtatagcctgttctcctcgaaagataatggcatattttcgtttatgtagataaaagaaaaactgtgacaaacctgctacccttcgtttctggtgtctcttgctgcacttcgtgaatgctttgtgttctccggagcaaaataaaggatgttgccattttcttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2513 - DNA, 2406 bp, Zea mays
  misc_feature (907)..(907): n is a, c, g, or t
gagtcacagaagatacagaggattctgagggcatttctgagagatattatgaacagtcaccacacatgtttgttaatagagatgcagctttggtattatcatattctgtaatcttgctcaatactgatcagcacaatgtaagggttaagaagaagatgactgaggaagactttattaggaacaatcgccatataaatggaggaaatgatctgcctagagaattcttgtcagagctttactattctatttgccggaatgaaatcagaactattcctgagcagggagctgggtgttctgagatgtctttcagtcgttgggttgatctaatgtggaggtcaaagagaacatcaatgtatattgcttgtagctcttacccatttcttgatcatgacatgttttctgttatggccggaccaacagttgctgctgtttctgtggtttttgataacgttgagcatgaagaggttcttacaggatgcattgacagctttctgtcagtggcgaaactggctgcattctatcatcttggtgatgttctgaatgatcttgttgtggcactatctaaattcaccactttgttgaccacttcctacattgacgatcctgtaacagcgtttggggaggataccaaggctagaatggcaacagaagctgttttcactatagcaactgtttatggtgatcacatacgcagcggatggaggaacataatagattgtattttaagattgcataagataggacttcttcctggtcccctcactggcgatacagctgatgatcaggactcctcttcaaagtcattacctggtaaacttgcttcatctgctcctcaagttttgccaattagcacttctcgaaaaacttatgggttgatggggagattcagccaactactgtacttagnatgctgatgaaccaaggtcgcaaccaactgaggagcaacttgctgcccagaggaatgcttcagagactgtaaagaagtgccaaataggtaccatcttcactgagagcaaattcttgcaagctgattcactttcaaatctggcaagagccctcattcaggcagcaggcagacctcagaaaatcagcagctcacttgatgatgaaggcatagctgtcttctgcttagagcttctaattactgtcacattaaacaacagagacaggattgtccttttgtggcaggatgtttttgagcacataacccatattgtccagtccacggtaatgccctgcaacctagtggagaaggctgtttttgggctcctccacatctgtcagaggttgcttccctataaggcgaacttagtagatgatttgctgaggtcattgcagctgattttgaaacttgatgcccgtgtagctgatgcttactgtgagaacattaccttggaggtcacactgcttgtcaaggccaatgcaacccatataaaatcccagatgggctggcggactatcatatccttgctctgcatcacggcacgccatcctgatgcttctgatgcaggatttgaagccctggtttttatcatgtcagaaggagcgcacctctcacctgccaacttcatcctttcagtggaggcatcaaggcagtttgcagaatctcggcttgggtctgcagaaaggtctatccatgctttgaacctaatggcagactcagttaactgccttgtgcgatggtcacaggaggttagagaagctggtggagaggcagatagaatattggaaggaattgcagagatgtggctgcggctagtgcaggctctacgcaaggtgtgcatggatcaaagagaagaagtgaggaaccatgcattgttatcgttgcatagatgcttggtagttgatggaatatcagttaagtcttcaacatggttgatggcatttgacattattttccagttgcttgacgaactgttggagattgctcagagctactcaccaaaggatttcagaaacatggaggtatctctcttgcatgctgtaaaactgttatgcaaggtgttcttgcagtcacttaaagacctctcaggacagcgcagttttgataagctgtggtgggaagtccttgacatgatagagaagttcatgaaaagtcaaagtgagagggaggaggactgagaagctaaaagaggctatcccagaggtagtcaagaacattctgatggtgatgaaagcgagtggggtcctgtcaaagacaggtgccagtgaaaacagtttctgggaagcaacatggcttcaagttaacaagattgcaccctctctacaatcagaattttttcctgacaatgaggatggcagcacaactcaaattgaagaaaacaaattggatacacaagcacaatctgaccagaacaatgatcaataggacattatacttcccccatccaatcaagttagttgcag

SEQ ID NO: 2514 - DNA, 1620 bp, Zea mays
  misc_feature (45)..(45): n is a, c, g, or t
  misc_feature (52)..(52): n is a, c, g, or t
ctcacatgcatatgcatgcattagcttttccccaccagcatgcantagctgnctagcatactgtgtaatcggtgaccgctcttgacttgttagctccccgctcccacggtagctaaagctagctaggtgggtggtagcaccaccatggcctcgcccaagcattcccatcgccatcatcgtgcggcggcgacgaagcatcgtcggccgctggcgctgcggcgtgcgatgctgcattcgtgcgtgtgcttcctggtgggtctcgtgaccggcctggccccttccgactggacggacgccgcctcgcgcgcggccgtgcacgcgaacggcgcggccacggcgcaggtgttccgcgcgctgcacgccatgaaccagacggcggcggcgggggcactgggccagctgctggcgctgcagcactaccagcagcagccagtggtggagaaggagaaggagaaggagaagaacctctggatctggtggtggtggtgacgactacgacgacgtcgacggggttgtcggagcgcgagcggcggtcggcgggtctgacgcgcacggcgcacgcgctgcgtctggtgtcccctcccctggtgtggctggtggtggaggcggcccgggaggctggtcccacggcacggctgctgcggcgcacgggggtggtgtaccggcacctgacctacgcggagaacttcacatcggaggcctgggaggaggagcggcaccaccagaggaaccaggcgctagcgcacatcgagcggcaccgcctgcgcggcgtcgtcctcttcgcggggctcgccgacgtgtacgacggccgcctcctggagcagctcaggcggcacatcaggacaaggagtgtgggcgcgtgggcagtggcgacagtatgggagcaggagaagagggtggccgtggaagggcccgtcgtcgtctgcaacaccaacaccaccaccaccaccagcgcagcatccacagcatgtgcatggttctccgcctccgactccacattattggcggcagcggcagcagcagcgcccccagtgacggccgacgactccgtccacggctttgccttcgccagcgacctcctctgggacccttccaggtgggaccgcttccccacatccgagcccgaccagtcgcaggattcgatcaagttcgtgcaaaggttggtgatggcggagtacaacaaaacgagggccatcatccctgcagacgacgattactcctccaaccgttctcaaatcatggtgtggcgtgtcgacacaacgctgctctagctagccctcttgccacgctaagagcgatagataaagatgcatgcatgcttaaaataaacattccatgacttattacatagtaatgccatacacgtacgtatgtatatgtaaacttttgctgcattagaattatatatatagggaaaagaatggcaagcagcagtctgcatcagtcgttgtcgtcgaaatgctcaaggcaacgcatcgcatcgcatcatcctcttgcttgcctgcgtgcaatccttttcttgtccgccctgcattgcatgtcccttgcgccctttcttcttgtttgccttgtgcggctatctgtcttgcaacccggcctgaagaaaaggaattcgattcc

SEQ ID NO: 2515 - DNA, 1653 bp, Zea mays
atcgacatgtgtcccctcagtttcaggtactagctggtggcgctagctggtctcacactctcactagatctctctcacatgcatatgcatgcattagcttttccccaccagcatgcactagctgactagcatctgtgtaatcggtgaccgctcttgacttgttagctccccgctcccacggtagctaaagctagctaggtgggtggtagcaccaccatggcctcgcccaagcattctcatcgccatcatcgtgcggcggcgacgaagcatcgtcggccgctggcgctgcggcgtgcgatgctgcattcgtgcgtgtgcttcctggtgggtctcgtgaccggcctggccccttccgactggacggacgccgcctcgcgcgcggccgtgcacgcgaacggcgcggccacggcgcaggtgttccgcgcgctgcacgccatgaaccagacggcggcggcgggggcactgggccagctgctggcgctgcagcactaccagcagcagccagtggtggagaaggagaaggagaaggagaagcctctggatctggtggtggtggtgacgactacgacgacgtcgacggggttgtcggagcgcgagcggcggtcggcgggtctgacgcgcacggcgcacgcgctgcgtctggtgtcccctcccctggtgtggctggtggtggaggcggcccgggaggctggtcccacggcacggctgctgcggcgcacgggggtggtgtaccggcacctgacctacgcggagaacttcacatcggaggcctgggaggaggagcggcaccaccagaggaaccaggcgctagcgcacatcgagcggcaccgcctgcgcggcgtcgtcctcttcgcggggctcgccgacgtgtacgacggccgcctcctggagcagctcaggcggcacatcaggacaaggagtgtgggcgcgtgggcagtggcgacagtatgggagcaggagaagagggtggccgtggaagggcccgtcgtcgtctgcaacaccaccaccagcaccagcgcagcatccacagcatgtgcatggttctccgcctccgactccacattattggcggcagcggcagcggcagcgcccccagtgacggtcgacgactccgtccacggctttgccttcgccagtgacctcctctgggacccttccaggtgggaccgcttccccacatccgagcccgaccagtcgcaggattcgatcaagttcgtgcaaaggttggtgatggcggagtacaacaaaacgagggccatcatccctgcagacgacgattactcctccaaccgttctcaaatcatggtgtggcgtgtcgacacaacgctgctctagctagccctcttgccacgctaagagcgatagataaagatgcatgcatgcttaaaataaacattccatgacttattacatagtaatgccatacacgtacgtatgtatatgtataaagggaaaagaatggcaagcagcagtctgcatcagtcgttgtcgtcgaaaaaaaaaaaaaaaagcatcgcatcatcctcttgctcgcctgcgcgcaatccttttcttgtccgccctgcattgcatgtccctttttctttttcttcttgtttgccttgtgcggctgtctgtcttgcaaccccggcatgaagaaaaggaattcgattt

SEQ ID NO: 2516 - DNA, 2138 bp, Zea mays
aaacacgctattagtttattctgatatcattgtttgtttttccttacagctgaagaaggttggaaactttaagcggcaactgctagtggaaaagcgggtagcttgcatcactctgtcatgtgtttccttcgttaatatatttggaaatctgttatgaaatacttaatctttagttctacgatgaggtgggtttgaactacatgagtgcaggttgaaaaaatatatttattctatgtgatatatgccttctttgtaatttagattaagtctacctaattctattaatacgttgattaattcacggttgagaagggcaagcttggcgtagtggtgagagctatcttaccgagtgggtcgtgagttttggtgagagctatcttttactgagtcactgggtcatgagttttaaatcgcttctccctatttgcaggagaaaggcttgtcctctgtttttcctttctccaaccgcgaccagtgcaagtggccaagtgtcatggcaaatacgagtattgggccagagattgccgtagaaaccccaaggcccaagggcgaggcccatgttgcgcaagctctgctaactctgttaaaatcgtggtaaaataatactctgctaactctgaattgggtagcgaaacaagactcagaaagtcagaaacagcaacaaaaatacttcggcatactaccacaaaaaccaactgtaaactctgaattgggtaccggtggattaacatgttcctaagcaaaagtcatcatcaggtacaggataactgtaaactatgctataatccaattctcatgaatccatttacatcaaaatggccctggcaaccatgcaaaccaatatgttcgaaacaggctggaaccaccgagacacctgcaaattgcggttcacgtccatcaacagataatctgccccactaaccagctgacaataccgatcaatagtggatgacccaagaaagcaccagtagagaatggaatccactatatcatacagcaaggcaacctccagtactttaagtaccgatgtcagttgcaacaattcttcctcatagactaagctgaagccttaaggcaaaatcaagatgctgatgaaagcaagaacaaggttgccgcgtcaagatatcaggagttcaagaagttgtagaagaaaacaagacctgcacaattcagtgcctaggacccaccatgtgaacccatacgaggagagcgagagaactgcaggttcaaaatgcgtgagtgagggtcctgctcatcaaacttgtagcctgcaaaacgaagtgcataatttgttcaaagatgcagtcgatgaagcaatgaccccatgctacaaaactggcatgtttggaaatacaatatgtgacaaattcacacaaatgtgaagtatgaaagggtaccaaaaaaatcagtggattatgctatcgtagagatttaaactgattcatcaattagacagatattggcactgaagtggataaaatgaacaagtgttggcaaatcaagtataagtgttgtattttcttatattatcagaatctaacttactgatcaagctactatagaatcatttctatacttaacattttttcccttttgtgctacatcaaaattatcagatataataactgatgtcttatatcttaagcaaatgagatagaccaaccaaaatcaagactcaagaagttaaaactattgctcagtcttaatgtagaaatactgcttagcaccattcataatcaccagagttggaaaataccatccagcaccacatgttctagtttaaacagtttcatattgtactgagatagttttatccaagtaaaggacaaaatggctcagtagcctcacaaatacagctaaagatagaaaactgtataagaaaaaagggttatattcaccttgaagatttctcatggcaaaaaaagcttgtgctggggttgcaaaatcaacaaagcacaaatgtttattagatcctttgttgaccagtctcatttcaaggaaccccatatattggcgaaatatatctaagcaaaagttaatgggcccaaagacctcaacgttgatggatggaacacaaaaaaaaacatatggattgacagcacctgaatgtagattatagttcagcggtggaaaaagac

SEQ ID NO: 2517 - DNA, 1427 bp, Zea mays
tattctcatcactttgctaatagaaacgagatcggaagtagtcaagcttcttgaggacaccctttggaacaggaaaagaggacatcatatacatggggagactatttaaaaatgagttgattaaggtttgtcttcccccaattgataattttttcctttccagctactaagcctttttttcaaatttttcctctacctccctccaaccagtatttttcaactttctataatgaataggaatacccaaataccttagagggatctctgcttttttacacccaaaaatatctctatacaattgctcatgatcttgtgttgcaccaaagcaccatatttcgctcttatgaaagttgatttttagttccaagatttgttcaaagacaaaaacaattattttatattgcgagccttttccagagggaaacaaggaaacaattattttttacacccaaaaatatctctatacaattgctcatgatcttgtgttgcaccaaagcaccatatttcgctcttatgaaagttgatttttagttccaagatttgttcaaagacaaagccgtacgtattatctaacaaaggttgctgtttgtttgcatgctaacaacaggtaaggtataaactccaggaagtttgtagtaaaggtttgcacagcacgcacaaacgcgcagccatgccaatccgggacagggacttggcaaaagggagcgtgcggcttctctgtttcttcggactgcgtgtttgggcgtgtgtggcggatggccgagacgagactcctgcaggagtcccctaaaaatagccacacggccccgtgggccgattgggacccgccacgcccggccgcggccctcatcgcagatcgcaacacacggaaccagaaagcaaacgcaaacaagaagcaaaccagcaatggcccgcgcctgcgtcttcctcgtcgtgctcctcctagccgccgtcgccatggcgccgttcgcgggcgcggcgcgcatcgacgtcgtcgagggcaggtccatggcgtccgcggacgcaccggaggccgccgccgacgctcccgctcctgctcctggccccgactcctcctcgaccccgtcgccggcaccctccagcagcagctcttccgactagccgcccggcagagatatctacggcgtccgatcagtctttggcgccacctatgacctatcggatcctgcaaagctatgtatgattctatggtataatgtgtggttgcggcaaacgcgcggaaataatgtgcttgcgtgattgtttttctctctctttttttgtttaataatgtaaaacaggcatacggcgatgttttaacatgtaaactgagatgttgttactctttctcaaaaaaaaaaaaaaaaaccagtttccatcatggcgcgcccctcgttctgaaaaaaaaaaaaaaaaaaggggcggcc

SEQ ID NO: 2518 - DNA, 1703 bp, Zea mays
caaaagcttatgcatatgcgccattagatgattctctaacattacaggggcctctttgtgccggccgggcggcggggaatgaatctgaaagcaagagcagcagttgtgaaggaaaagctgtaggttttatgtacagttctgctggcaaagattcagttcttgtgactgcctggggtagtgggctgcttcaggttgatgctcttgcagatgaaattcaaccgcggtggaacattggggttccttcgcgtcttaatgtcgattcacatggacaaataaataatgttgccatgatatgtgactccaattcgcaagatccattggcgttgagatcgcatcgaccatctagtacaggatcaaacgtgaagagcaacatagaagctgtttggatgggacactctcctcctttgctaaggctcgcaattgtggatttggcattaccaaaaactcctaatgataactctctgtcattgtttgctgatccccttgttccagagagattttattgtgcgcatggtggggggcttgacatggtcacactgcacttcctaccattttcataccctgaaatgtcttcgacaccaccctctgtgcatcctgtcctcactacagggaacagcgaaacaagctcaccttttctttctggatttgttaccatagctgatgcatatggtcatgtacagttagctggcatcacatgcttgggtgagtgctttgtggtggagatgaagggttggaaggaaccggcacctcttcagcttgacttagaaagcaaaatcgtcaaggatgtggagcctcctgcaactggaatgatcagcaaagaacttattgctggtccagacccacccatacttccatcatcttcaagcctgaaatcgttgaccccagactctattgaaggaaaatctacacttcaccactatattaaggtcttccatgagtactatgtggagtacggacacaaggtgttcattgaactcaaggagcatgcggactatttgaagacagaaatggaagataaacagaaacgcttggaagcagtgaagaaatcacttatatccgtagaagccaaagatggagacatcaacaagaggatagatcgggccttcaaggtgtatgaactgttggagaagcgaatagatagcttcaagatgcttcctgctgcaaacaagaaaccattaacccaggcagagcaggagttcaaatcacagcttgatcggttcgcagatgtggagctggatgctttgcgttcctccattgccgccctgagtgctaggatgaaacgttttgctcagcaatccacgggcagtgcggctagcacaggaatggtgccatggcaggcacaaagggctggacggagccatatctcagaatcccagatgtcacttctgaaatcttcgcttgagaagctctccctcctcaacgaagagaacagtctgaagctccggcttattgatcatgaactcaagaaccaggaacgataggttggcaggtccatgtgcgacttattgccatattggtattttgttgttcggacactaagtacaggatccataggagcctgtttgctgtcactttctgtggggggctcgcgaactgcatttgcatgtcagcgtgttgtaagttgtaactagcaatacagaaccaagtgcaaaccgctacaccttttcccccaaaaaaaagcaaaaaaaaaaaaaaaaaaaaaa

SEQ ID NO: 2519 - DNA, 838 bp, Zea mays
cattgggtacctcgaggccggccgcagtgggccccgcggccccgccgggggtcccccattcctccgttcttcctccacgtacgcgtgcatactctgcgagtccaggagatattttcccccttcttcacgatactctcgacgagagcgtctccatggccggaaaaggagacgggccggcgatcggcatcgacctcggtacgacctactcgtgcgtcggggtgtggcagcatgaccgagtcgagatcatcgccaacgaccagggcaaccgtacaacgccgtcttatgtcgcgttcaccgattcggagaggctcgtcggcgacgccgccaagaaccaggtcgccatgaaccccatcaacaccgtcttcgacgcgaagcggctcatcggccggcgcttctctgacgcgtcggtgcagagtgacgccaagctatggcctttcaaggtgatcccgggctccggcgacaagcccatgatcggggtgcagttcaggggcgaggagaaacagttctcggccgaggagatcagctccatgatcctgaacaagatggagggagacggccgaggcttacctcggcaccaccatcaagaacgctgtcgtcaccgtcccggcctacttcaacgactcccagcgccaggccaccaagggacgccgggcgtcatctcccggcctcaacgtcatgcgcatcatcaacgagcccaccgccgcggctatcgcatacgggctcgacaagaagtcgagcagcgacggcgagaagaacgtcctcatcttcgacctcggcggcgggtacctttgacgtctcgctcctcaccatccgaggagggcatctttgaggtcaaggc

SEQ ID NO: 2520 - DNA, 2318 bp, Zea mays
ctgggggtccctcgaggccggccggggtcccccattcctccgttcttccttaattcctcatttcctccacgtacgcgtgcatactctgcgagatatttttccccttcttcacgatactctcgacgagagcgtctccatggccggaaaaggagacgggccggcgatcggcatcgacctcggtacgacctactcgtgcgtcggggtgtggcagcatgaccgagtcgagatcattgccaacgaccagggcaaccgcacaacgccgtcttatgtcgcgttcaccgattcggagaggctcgtcggcgacgccgccaagaaccaggtcgccatgaaccccatcaacaccgtcttcgacgcgaagcggctcatcggccggcgcttctctgacacgtcggtgcagagtgacgccaagctatggcctttcaaggtgatcccgggctccggcgacaagcccatgatcggggtgcagttcaggggcgaggagaaacagttctcggccgaggagatcagctccatgatcctgaacaagatgaaggagacggccgaggcttacctcggcaccaccatcaagaacgctgtcgtcaccgtcccggcctacttcaacgactcccagcgccaggccaccaaggacgccggcgtcatctccggcctcaacgtcatgcgcatcatcaacgagcccaccgccgcggccatcgcatacgggctcgacaagaagtcgagcagcgacggcgagaagaacgtcctcatcttcgacctcggcggcggtacctttgacgtctcgctcctcaccatcgaggagggcatctttgaggtcaaggccaccgccggcgatacccatctgggaggcgaggatttcgacaaccggctcgtgaaccacttcgtccaggagttcaagaggaagaacaagaaggatatcactggcaaccccagggcgctccggcgactgaggaccgcctgcgagagggctaagaggacgctctcctccaccgcccaaaccaccatcgagatcgactcgctctatgagggcatcgacttctacacgaccatcacccgtgctcggttcgaggagctcaacatggacctcttccgcaagtgcatggagcccgtggagaagtgcctccgcgacgccaagatggacaagagcagcgtgcacgacgtcgttctcgtgggcggctccactcgcatcccccgcgtgcagcagctgctccaggacttcttcaacggcaaggagctgtgcaagagcatcaacccagacgaggctgtcgcgtacggcgcggccgtccaggccgccatcctcactggcgagggcaacgagaaggttcaggatctgctcctgctcgacgtctcgccgctctcgctcggcctggagacggccggaggcgtcatgactgtgctcatccccaggaacaccaccatcccgacaaagaaggagcaggtcttctccacttactccgacaaccagcccggcgtgctcatccaggtgtacgaaggtgagagggccaggaccaaagacaacaatctgctcggcaagttcgagctctctggcatccctccggcgcccaggggcgtcccccagatcaccgtgtgtttcgacatggacgcgaacggcatcctcaacgtgtcagcggaggacaagaccaccggccagaagaataagatcacgatccccaacgataagggccggctaagtaaggaggagatcgagaagatggtgcaggaggcagagaagtacaaggccgaggacgaggaacaccagaagaaggtgaacgccaagaacacgctcgagaactatgcctacaatatgcgcaacaccatcagagacgacaagatcgcctccaagctaccggtggacgacaagaaaaagatcgatgacgccgtcgagggggccatcaattggctcgaccacaaccagctcgccgaggttgatgagtttgaggacaagatgaaggagctggagggcatttgcaaccccatcatcgcgaaaatgtatcagggcgccgctggtcctgacatggccggtggcatggatcgggatgcttcgccggctggtggcagcggtgctggacccaagatcgaagaagtcgactaaatgaggaaattcttatatatgtagttttgcttaaataattgcgtcaattacaaagtggatcttattattatttttatgcaattttttttggccatacacagggcccccaagttcatgtttaagttcatttttactagtaccctggctataaacagtgattagccctgccaaaaaaaaaaaaaaaaaaaaaaaacaagaaaggagaaaaagaaaaaaaaaacggccctcgagc

SEQ ID NO: 2521 - DNA, 858 bp, Zea mays
attgggtacctcgaggcccattgggtacctcgaggccggccggggtcccccattcctcgttcttccttaattcctcatttcctccacgtacgcgtgcatactctgcgagtccaggaggtattttcccccttcttcacgatactctcgacgagagcgtctccatggccggaaaaggagacgggccggcgatcggcatcgacctcggtacgacctactcgtgcgtcggggtgtggcagcatgaccgagtcgagatcatcgccaacgaccagggcaaccgtacaacgccgtcttatgtcgcgttcaccgattcggagaggctcgtcggcgacgccgccaagaaccaggtcgccatgaaccccatcaacaccgtcttcgacgcgaagcggctcatcggccggcgcttctctgacgcgtcggtgcagagtgacgccaagctatggcctttcaaggtgatcccgggctccggcgacaagcccatgatcggggtgcagttcaggggcgaggagaaacagttctcggccgaggagatcagctccatgatcctgaacaagatgaaggagacggccgaggcttacctcggcaccaccatcaagaacgctgtcgtcaccgtcccggcctacttcaacgactcccagcgccaggccaccaaggacgccggcgtcatctccggcctcaacgtcatgcgcatcatcaacgagcccaccgccgcggccatcgcatacgggctcgacaagaagtcgagcagcgacggcgagaagaacgtcctcatcttcgacctcggcggcggtacctttgacgtctcgctcctcaccatcgaggagggcatctttggaggtcaaggccaccgccggcgatacc

SEQ ID NO: 2522 - DNA, 813 bp, Zea mays
gttacccacctattctccctcccttacccgcgtgctccgctccaagatccaaccaatcccgcaattcccttcgaggttgtttcttccgctcgacttgtcgacgagatcatggccggaaaaggagacgggccggcgatcggcatcgatctcggcacgacctactcctgcgtcggcgtctggcagcatgaccgggtggagatcatcgccaacgaccagggcaaccgcaccacgccgtcctatgtcgccttcaccgacaccgagcggctcatcggcgacgccgcgaagaaccaggtcgccatgaacccgatcaacaccgtcttcgatgcgaagcggctcatcggccggcgtttctcggactcgtcggtccagagcgacgccaagctgtggccgttcaaggtgatccccggccccgctgacaagccgatgatcggggtacagtacagaggcgaggacaagcagttctcggccgaggagatctcctccatggtgctcaacaagatgaaggagacggccgaggcctacctcggtacaaccatcaagaacgcagtcgtcaccgtccctgcctacttcaacgactcccagcgccaggccaccaaggatgcaggcgtcatctctggcctcaacgtcatgcggatcatcaacgagcctaccgccgccgccatcgcctatggtctcgacaagaagtccaccagcgtcggcgagaagaacgtgctcatctttgatctcggcggcggtaccttcgatgtctccctcctcaccattgaggagggtatcttcgaggtcaaggccactgccggagacccccacctggga

SEQ ID NO: 2523 - DNA, 1316 bp, Zea mays
agctccaccggcggctgtcggaccgctgctacgaactacgtggatcccccgggctgcaggctcagtacttcggcaacgaggcaaggagctgtgcaagagcatcaacccagacgaggctgtcgcgtacggagcggccgtccaggccgccatcctcactggcgagggcaacgagaaggttcaggatctgctcctgctcgacgtctcgccgctctcgctcggcctggagacggccggaggcgtcatgactgtgctcatccccaggaacaccaccatcccgacaaagaaggagcaggtcttctccacttactccgacaaccagcccggcgtgctcatccaggtgtacgaaggtgagagggccaggaccaaagacaacaatctgctcggcaagttcgagctctctggcatccctccggcgcccaggggcgtcccccagatcaccgtgtgtttcgacatggacgcgaacggcatcctcaacgtgtcagcggaggacaagaccaccggccagaagaataagatcacgatcaccaacgataagggacggctaagtaaggaggagatcgagaagatggtgcaggaggcagagaagtacaaggccgaggacgaggaacaccagaagaaggtgaacgccaagaacacgctcgagaactacgcctacaatatgcgcaacaccatcagagacgacaagatcgcctccaagctaccggaggacgacaagaaaaagatcgatgacgccgtcgagggggccatcaattggctcgacaacaaccagctcgccgaggttgatgagtttgaggacaagatgaaggagctggagggcatttgcaaccccatcatcgcgaagatgtatcagggcgccgctggtcctgacatggccggtggcatggatcaggatgcttcgccggctggtggcagcggtgctggacccaagatcgaagaagtcgactaaatgaggaaattctgatatatgtagttttgcttaaataattgcgtcaattacaaagtggatcttattattatttttatgcagttttttttggccatacacagggcccccaagttcatgtttaagttcatttttactagtaccctggctataaacagtgattagccctgcatatgtattggcggtatttatatatcttcgaaagctattttagatggctaaaaacctttattaacctatatgcaatacaatgaatagctaagtttaaaggaaccctcccttgggagggcggccgccgtctagagggaggtcggccgggaattaaaaccggaccggataccggcaggcggcccggctttcaataaaatagaga

SEQ ID NO: 2524 - DNA, 1542 bp, Zea mays
cggacgcgtgggcagcagctcaccgtcgtgcctcctccatcggcatccacccggccgagagcacaacgtgtaccgtctctccccagcgtgcgcgcgcgcgtggtcggaggctgccgtcgctcgcgtcggccgcccccgccggccagcgagagcgagggacaacgaccgaccgaccgaccagctcgaggtgaatgaacagccgcataccgttcctccagaaaatgcaccgctggatcatccctagctgcggcgacacccgccagccgcgcccttcctcccgccatcgagatgcgttcccgaggccggcgtcggcgtcggcgtcggcgtcggcggccccgtcccctcagaagctgaggaaggtggggtcggaggggacgctggtgctgtccgtgcccaaggacgtagaggagatccggaccatgtcggcgtacggccgcctcaagctcttcacctaccacgagctcaggaaggccaccggcaacttcaacccggggcagatcgtcggcgagggcggcttcggcgtcgtgtacagaggggtcatcgacggctccgtgcggaagggctacccgtccaccgcggtcgccgtcaaggtgctcaacccccgcgcgcgccagggtgacagggagtggctgacggaggtgagctacctcggacagtacagccacccgaacctggtggagctcatcggctactgctggcacgaggaccaccggctgctggtgtacgagttcatggccaagggcagcctggagcaccacctgttccgccgctcctgcagactctcgtggacgacgcgggtggccatcgcgctcgacgtcgccaggggcctcgccttcctccacgggcccgaccgccccatcatctaccgggacttcaagagctccaacatcttgctcgacgcgaaattcaacgccaagctgtcggacttcgggctcgccaaggaagggccgatgggcggtgagacgcacgtgtccaccagggtcatgggcacctacggctacgccgcgccggagtacgtagccaccgggcacctgacggtgatgagcgacgtgtacggcttcggcgtggtgctgctggagatgctggtgggacggcgcgcgctggagccgagccgggcgggaggccgcgacggcagcctggtggactgggcgcggcccatccttatccggcccaaaaagttggagcggatcctggaccggcggatgggcgaggtctgctcggagatgggcctgcagcgcgtggcccgcctcgcgtacgactgcctcagccagaaccccaaggtccggccctccatggccagggtcgtcaccacgctcgaggcagtcctcgccgccggtgccggtgccgccgacgccccgccgcggtgagaccggaggttgatgtaggtagtagggtcggcatacggattaattaggtgcgtacgggtatatgcttgggcggaggaggcatgtttaatttggtgtaatcatttgatcgaatcgattattcatggagtttaaatatattaaatttgtaaaagaatagaaaaacaattctgcagct

SEQ ID NO: 2525 - DNA, 1946 bp, Zea mays
ttttttttttttttttttttttttttaaaaaaaaacttttttttttttttttcgatttttttttaaattgctgttaacataaaaaaaaatcatacccaccatgaagagaagtccgaatctacttgagtttcttgacaccagatagaggagacgccatgcaatgcccagaaacatacatatgtatgaaaatgagacttgagacaatactggtgttcagatcagatgccatgcctagggtaccacactaccacctgataatgcttcagtcctttgccaccatcttcataattacatcgttccacgcatcaataggcccaggcaagcaccagtggaggcagtcattctggactttggctgtcacgcccttctcgtaaggatggtatgctctataaggccctggatgaccatcaggcctgaggagagagagctcaaatgtatcgagcagtttcagacggtcaccaccgataggcaccgcgttgtgaaactcttctctctcaatcctccacatactattgtcccattctctgtcaccggcctcccctggcttgaatggggccgtcctgttgcaagtcccgccgctgaaccactcgccgttctcaaaatgcgagggagcccacgttctgtagaagactactggcttgtgaggtgaggatgtgatgaactggaaggccaccctgagtgccctgcggaaggagtactccggaggcctctcttccagggttttgttctggcaggagtggcagccaatcgcagctccattctcccagtacactgcagtcttgaagaaccattggcccgtggatatcaccgcgtaatcgaacttctcccattgactagtccagtctgtctcgagaacgtcaaggtgcagctggagatcagcagtagaaactccatcgtcgtcctcaaatattttagctttgaccaggaatggtgcccagacaagggagatcgtaaaattgtacgaagggaagtgccatcttctggatctgaatgtatcgtcgtggtaaacctcagtagcatcttcgaccttggaaagaagacaaagcaatgactggacgtggttgcgaaggatggaatcaccaatgagtgcccaatgcttgcctttcatgccatccaaaaacttcttgccgtcaaatggtgatacctcacaaccatatggcttccatctccaattgagataatctgtgtcaggtcttccatttgtcatacagttctgaggagactcaatgaagcggcagcttgcattagtataagctggtcctgatgaattgggaacccactcgccatggaaaagatcacaactttcttctggttttgtggaaccttccttcttgcctaaagctgttagaggttctgaatcggtcaaagtaaaaaccgcatcatccgtttcgacggaaggtatcccgccgccgccgccgccggcggttctttccctctccggcaccgcgaaaagacgagcggccccctctggcgcggcggtgggcggcaggaggtaggctgggggccccaccagcagccgcagtgcgaggcccgcgagaatcacgaacagtaccagcttcagcgccgacccggcgctcaccaccgctttcctctgctgcgcaggcgtcggcggccattccgtccccatccccatccctgccgagtgccgagtccaaatgatctcggagccgggaacagcgccagcagggattggcagccgtgctggcactgcaggtctgcagctacgtgtgtcgtgtcggtgccaccgcgctcggcggtggcggtggaagtggttggcaggttagactatggaattatgtggggtcccgcctggccgcctggtagtgaaggcgagccgaagctgccaacaaggagcggcaggctttgccccgcccggcctccaggggctttcaccgtgttgaagtactcggtggtaaagagagttcagagaaagacacatgacagtt

SEQ ID NO: 2526 - DNA, 1191 bp, Zea mays
gaggtcgacggtatcggtacccggccccccctctttttttgttgtttttttttttttggattaaattgctgctgaaattgcttaacttgataacaaaaggtacaaggtttagatcttcaaggtctcaatcattcttattcctttagagaagtgttctttgaccccctccaagaagtccgcctctgtaatcctcctgtaccttgccggacgcttctcatccagtaaaccggccgccggctgaagcacattgtcgcgttccaccgcatagagcatggccaacgagatcctctccttctctgcattcgtcacaaccctgtgcactgggctcttgaatatcccgttgctcattatctccaaggagtctcccaggttgatgaccagagtgtgaggaacggatgggacattgaaccacgtgttctctctctgaacctgcagtccaccgacctcacgatcgaccaggagaaccgtgagaacggggccgtcagagtgagccttgatgcccaagacgagctccggccttggacaaggagggtagtagttgaatctggcataggcttgaggactagcaccaagctgcttgatgaaatcttcctcatcaagctccaagatcttggccatcgctcgcaagattctgtccctcataatcttggtttttgatgcgtactcgtgcagaagatccctgaaggattcaggatgttcgggccactgagcaaggcttctttcgtcttcaggctccaccttcagctgcagacggtcgttccagtcaaggatatggtcctgcgccaccactgggtcactgccgtacccttcgagctggaagcgcgtgccttccctcaggttgctgtacttctgcctctcctggagcggctggtggaagaactcccgtgacgcctccatcagatcctccattagagacgcgtctatgccgtggttggtagccagaaaaagcccccaggtctgtagcgccgagcggagcttggctgcctcgtcggcggtcgacagcttgttgaggtcgacgatagggaggggatccggcatgtcagccgcgagcatcaggctgccagggcggtgctcctcccgctgcacgaaccggctcggcggctcgtccacgagggcggccagatctttcactggagtcggcaccgtccatgattcaacagccatcggtgcttgcttattactaccacacac

SEQ ID NO: 2527 - DNA, 1641 bp, Zea mays
ccatgcgtgggcgtggcacagtcattatcaacgtagcgttgcgccatacttgttgtatcagacccactccactatggctagtccgctagtaccagcccatttggccgtcaccgcgcacccaagttcagcaaaccacatccgaaacccttcgatcctcccaaattctccactgccatggctctctcctccctcttcatcaccctccccatccccaatgtcccttcccccaaaccccgccgcatgctcacctcccgggcatcctccgatgctcccgccgcctctgcttcctttgacctgcgccgctactggacctctctgatcgccgatgtggagtccgaactcgacgcggcgatgcccatgcaacctccggaaagcatccactacgccatgcgctacgcggtgctcccgggcgccggcaaggagggagccgccaagcgggcgccccccgtgctctgcgtcgccgcgtgcgagctcctcggcgccccgcgagcggccgcactcccggccgccgcggcgctggagatgctccacgcggcgtcgctcgtgcacgacgacctgccctgcttcgacgcagcacccacgcgacgcggacgcccatccacgcacgcggcgtacggcaccgacatggccgtcctcgcgggcgacgctctcttcccgctggcctacacccacgtcatctcccacaccccgtccccggacccggtcccccacgccgtcctcctgcgcgtcctcgccgagctcgcgcgcgctgtcggatccaccggcatggcggccggtcagttcctcgatctggccggtgctaccgcccttggcgaggccgaggtcatgcaggtcctgacgaagaagttcggggagatggccgaatgttccgcggcctgtggcgccatgctcggtggggccgggccagacgaggaggccgagctgcgacgctacggccgcaccatcggcgtcctgtacgagcttgtcgacgacatccggagcgcatcgggaaacggcaagatgaggagcaacgctagcgtcctgcgctccctggggatggaccgcgcgcttggcattgtggaggagctcaaggctcaggccaagacaacggctgacaggttcgcggaaaaatacggcgatcgggtgctgcccttgtacagcttcgtggactacgcggtggagagggcgtttgagctacaggatgcagcggcaactccatactccgtacagtgggagatggccgatgctactgaacattggagttggaggcttcgaactaatgagatagtgtatggtccaggaatttggtgagagctttgtctggcataggtctaatccctccttttatctaggtgttcctgaagctcgaattcgggaggagattcatatggagaatttttatcccggcaatagatgtttagaacttcgaaattgggttggcgtttgcagcgggttaataaaacaaaatgggactagatggacggaaaaggtctcacttcaagcttatacaaatactcttggcgttctgctgtttaagtttggatgaattcaccacaacggtggatagatagatagataggttaatctcttaggatgaacttaaaacgatgataaataaatgtggggggtcacgtttcactcgacaacctatttcctgaatat

SEQ ID NO: 2528 - DNA, 2508 bp, Zea mays
attctttttaacattgggtttataaagattcataaaaaagtaaatataaaatatattctatgtgctctcaaataattcagtatggattcagaaataaattcagtaaaattttcaaactttttattataaagggcaaataatatataaagcaattttttctttttttttttatttttgtaataatatttttataacataaaattgtatacatatgcattttacaatattaaatctgtcctcacagtttgcatttccactttcatccgtcagactcagacatcgcagtcaccggctcaccgcgcacccaagtgctgcaaaccacatctaaccccaatcctcccaaattctccaccgccatggctctctcctccctcttcatcatcctccccgtccccaaggtcccctactccaactactcccgccgcttgctcactgcccgggcgtcctctgacgctcccgctgcctctgcgtcattcgacctgcgccgctattggacctctctgatcgccgatgtggagtccgaactcgacgccgcgatgcccatgcagcctccggagagcatccactccgccatgcggtacgcggtgctcccgggcgccggcaaggagggagccgccaagcgggcgccccccgtgctctgcgtcgccgcgtgcgagctcctcggcgccccgcgcgcggccgcactccccgccgccgccgcgctggagatgctccacgcggcgtcgctcgtgcacgacgacctgccctgcttcgacgcagcccccacgcgacgtgggcgcccatccacgcacgcggcgtacggcaccgacatggccgtcctcgcgggcgacgctctcttcccgctcgcctacacccacgtcatctcccacaccccgtgcccggacccggtcccccacgccgtcctcctgcgcgtcctcgcggagctcgctcgtgcggtcggatccacgggcatggcggccggtcagttcctcgatctggccggcgctaccgcccttggtgaggccgaggtcatgcaggtcctgacgaagaagttcggcgagatggccgagtgctccgccgcctgcggcgccatgctcggtggggccgggcccgacgaggaggccgcgttgcggcgctacggccgcaccatcggcgtcctgtacgagctcgtggacgacatccggagcgcatcgggaaacggcaagatgaggagcaacgccagcgtcctgcgctcgctggggatggaccgcgcgctcggcattgtggaggagctcaaggctcaggccaagacagaggctgacaggttctcggataagtacggcgatcgggtgctgcctttatacagctttgtggactacgcggtggagagagggtttgagctccaggatgcagcggcaactctgtagagtggacgatcgctgttgctactgaacattggaggcttcgagctagtgagatgtacatggcccaggaatttggtgagagctttatctggcatagatctaatccctattttatctagatgttctgaagctcgtaattcgggggatggttcataatggagaattgttatcccggcattagatgtttagaacttgaaattgggtttgatacttgtagtaagctaataaaactaagtggtaaatgctcatgcaaccactcggttcttctgctgtttaagtttggatgagttcaccaccatggtggatagacagattaagctcttagatgaaactgaaaaacatctgttttttttaggttttcgaatgagaagtgtaaggttcacctcgccaaacctacttttctgaattttgattgtgcaagaagttcagattttcgtatacaatacaaggtatttcgtcacattacattaaatgcgtacccagtaccgtaggcttcccgcactgtacgtgggcccggcttttgtatcttcttctgtcaagccttacccgcataatatgcagaggccgcataatatgcagaggctggagaatctgtaatacattgccaatttgaattctgcaagttcaggacctccgtatacaacaggtttctcgtcacaactcacagatacaagtatacaacagatcaacagagcactacattattgccatccgcccaccatcttcgttgccgctgtcgcatccggcatgcgttccatcccatccattctgcacaagtgacgagtgcaggcacaactaacagctctctacatgctaatatagtaatatgctaatctctagctcgatttgctaccaagatcaccaccatcacgccatttgcgctgccaacaagatcttgcagcttaaacccaccaaatccatggaggaacgtagcaagtcctcatccggaatgccacggccaaatggtccggttcctggtcactggcttcacgaataactccatgttgtacgcatccttgtggactggattggaggcccactgtgaacgtatacataaagtggaagcttccattctcaacctcgaggggcttcaagactttgatcatctcctggagcacttagcttt

SEQ ID NO: 2529 - DNA, 1940 bp, Zea mays
cattgggaccctcgaggccggccgggaatccacgacgccaatggcatcgatcactttttaaccactcccacacccacactcgatgggccgctcctgctcctgctcccgcgtcaggtggttgcattgcatatatacgcacacgcggtgggagtgggagggggagactctgccctgaccacagcaaacaacctcctctttcctttccatccatcggaccatcgatcacaattttcatggcggtcaaggactgcggcgggcacaagggctgcgagtgcgagcgggagcggctgtaccggcggtgctgcgcggcggtcgtggctctgatcctcctggtcctcttcatcgtgctcgtcgtgtggctggtgctgcgcccccacaagccccggttctacctgcaggacctgtcggtgctgtgcctgaacgtgacgccgccggcgtccacgtacctgttcacgacgatgcaggcgacggtggcggcgcgcaacccgaacgagcgcgtgggcgtgtactacgaccaggcggacgcgtacgcggagtacaagggcgtggcgatcacggtgccgacgcggctgcccgtgcagtaccaggggccccgggacgcgtccgtgtggtccccgttcctgcgcgccccggacggcggcgtgcagctcccgccgcagctggccgtggcgctggcgcaggacgagacggcgggctacgtgctcgtcgacgtccgcgtcgacggctgggtccgctggaaggtcggtaccagctggatctcgggtcactaccacctccgcgtcaactgccccgcgctgctcaccgtcaacgacggcaggggcagctacggcgccaacaccggcggcggcaccggatacttccgcttccagcaggcagcggcatgcgccgtagacgtctagcagtgctctctctctctctgtaccagctagctgtgtttgccaattcgtcgatcgaatcaaaggacgatgcttccttcgtcggtgttcatcactcacgcactaaaaaaaacataacagagactgccgacttttcgtccggttggttggttggttggttggttgattgattgatatcactactatatcagctagcttttcgatcgatcgattcgtgtaaaagcaaagcaaaggaaaggaaatgaaaaaggctatctttttttttgtccccgctgtggacgtttgaaagaaactgaagcagcgtaagcaaactagctagagtcgtcttccccggctttgcttgtggcggaaatgttggacctttctcttggatcgcagtcgcagcccagccccagcgtgctcttctcatgagcatgtggcgggcgggcgaggatgagctgttggattgaattggatggccaatcaactagcatggcatgccggggaacccgggcacgtcactcgcacatggcgatggtgatgctgccgctgccgcttacgacgccaagaattcgtgcacgtcgtcatcagctcaaccgttggcttgtcgcccctcgccaattaagcactaagatggcatggcactgctccaaattaaacacctgtgcacctgcagcttggtagcatcgatcatggcaaaggaaggtacactacaaagtggctttcaggtcggttgtggttttacttgctgcacacaccaactgcagctgggggcgctttatttttcagaccagctgcgcgccgctcttgcgcactctgccatatgatgatggattttaattctgagagaagagaagagccccgctgaaaccatcgatgcagtcatgacctgaactcaagctactacatgcgcactagtcacaacacaagaaagatgcttaaaaaaaagagtagggtagggtagggtaggagagcaggaactgaagcggaaacctttgcgttagtttttttttagataatggaacagaaataaggtcccagccaacctttgcgttagtagttgct

SEQ ID NO: 2530 - DNA, 1519 bp, Zea mays
cattgggtacctcgaggccggccggggactctgccctgaccacagaaaaacctcctctttcctttccatccatcggaccatcgatcacaattttcatggcggtcaaggactgcggcgggcacaagggctgcgagtgcgagcgggagcggctgtaccggcggtgctgcgcggcggtcgtggctctgatcctcctggtcctcttcatcgtgctcgtcgtgtggctggtgctgcgcccccacaagccccggttctacctgcaggacctgtcggtgctgtgcctgaacgtgacgccgccggcgtccacgtacctgttcacgacgatgcaggcgacggtggcggcgcgcaacccgaacgagcgcgtgggcgtgtactacgaccaggcggacgcgtacgcggagtacaagggcgtggcgatcacggtgccgacgcggctgcccgtgcagtaccaggggccccgggacgcgtccgtgtggtccccgttcctgcgcgccccggacggcggcgtgcagctcccgccgcagctggccgtggcgctggcgcaggacgagacggcgggctacgtgctcgtcgacgtccgcgtcgacggctgggtccgctggaaggtcggtaccagctggatctccggacactaccacctccgcgtcaactgccccgcgctgctcaccgtcaacgacggcaggggcagctacggcgccaacaccggcggcggcaccggatacttccgcttccagcaggcagcggcatgcgccgtagacgtctagcagtgctctctctctctctgtaccagctagctgtgtttgccaattcgtcgatcgaatcaaaggacgatgcttccttcgtcggtgttcatcactcacgcactagctatcttctttctgcgactgacgacttttcgtccggttggttggttggttgattgattgatatcgctactatatcagctagcttttcgatcgatcgattcgtgtaaaagcaaagcaaaggaaaggaaatgaaaaaggctatctttttttttgtccccgctgtggacgattgaaagaaactgaagcagcgtaagcaaactggctagagtcgtcttccccggctttgcttgtggcggaaatgttggacctttctcttggatcgcagtcgcagagcccagccccagcgtgctcttctcatgagcatgtggcgggcgagcggggatgagctgttggattgaattggatggccaatcaactagcatggcatgccggggaacccgggcacgtcactcgcacatggcgatggtgatgctgccgctgccgcttacgacgccaagaattcgtgcacgtcgtcatcagctcaaccgttggcttgtcgcccctcgccaattaagcactaagatggcatggcactgctccaaattaaacacctgtgcacctgcagcttggtagcatcgatcatggcaaaggaaggtacactacaaagtggctttcaggtcggttgtggttttacttgttgcacacatgaaccagaagcgcatcatctagagtcggcc

SEQ ID NO: 2531 - DNA, 1551 bp, Zea mays
cggccgggaacaatctccttctgctcctgctcctgctcccgcgtcaggtggttgtattgcattgcatatatacacacccgcggggcccgcggggcagggagactctaccctgaccacagcaaccaacctcctctttcctttccatccatcggaccatcgatcacaattcacacagccctagcccctaggtagtggcatcatggcggtgaaggactgcggcgggcacaagggctgcgagtgcgagcgggagcggctgtaccggcggtgctgcgcggcggtcgtggctctgatcctcctggtcctcttcatcgtgctcgtcgtgtggctggtgctgcgcccccacaagccccggttctacctgcaggacctgtcggtgctgtgcctgaacgtgacgccgccggcgtccacgtacctgttcacgacgatgcaggcgacggtggcggcgcgcaacccgaacgagcgcgtgggcgtgtactacgaccaggcggacgcgtacgcggagtacaagggcgtggcgatcacggtgccgacgcggctgcccgtgcagtaccaggggccccgggacgcgtccgtgtggtccccgttcctgcgcgccccggacggcggcgtgcagctcccgccgcagctggccgtggcgctggcgcaggacgagacggcgggctacgtgctcgtcgacgtccgcgtcgacggctgggtccgctggaaggtcggcaccagctggatctcgggacactaccacctccgcgtcaactgccccgcgctgctcaccgtcaacgacggcaggggcagctacggcgccaacaccggcggcggcaccggatacttccgcttccagcaggcagcggcctgcgccgtagacgtctagcagtgctctctctctctctctctctatctgtaccagctagctgtgtttgccaattcgtcgatcgaatcaaaggacgatgcttccttcgtcggtgttcatcagaaaaaaaaaaaaaaaattctttctgcgactgccgacgactgccgacttttcgtccggttggttggttggttggttggttgattgattgatatcactactatatcagctagcttttcgatcgatcgattcgtgtaaaagcaaagcaaaggaaaggaaatgaaaaaggctatctttttttttgtccccgctgtggacgattgaaagaaactgaagcagcagcgtaagcaaactagctagagtcgtcttccccggctttgcttgtggcggaaatgttggacctttctcttggatcgcagtcgcagcccagccccagcgtgctcttctcatgagcacgcatgtggcgggcgggcgaggatgagctgttggattgaattggatggccaatcaactagcatggcatgccggggaacccgggcacgtcactcgcacatggcgatggtgatgctgccgctgccgcttacgacgccaagaattcgtgcacgtcgtcatcagctcaaccgttggcttgtcgcccctcgccaattaagcactaagatggcatggcactgctccaaattaaacacatgtgcacctgcaggcatgca

SEQ ID NO: 2532 - DNA, 1069 bp, Zea mays
acccccgggccggcccgggtctcggtgcctttctctatcgtcccgatccgtcgttcatcagagtcgtaaccgtacgccctcgttcccctcgtcgctctcccaagtcccaaccccggttcctttggtctgcgcgagcgagcatggcgtcgccgtcgcccgccgtctcgtctctggagacggaggcgccccaggctaccgtcacgagggagcgcaggctcaaccccgacctgcaggagcaccttcccaagccatatctcgcgagggctatggtggcggtggacccggaccatccgaccgggaccgaggggcgcgacccccgcggcatgagcgtgcttcagcagcacgtggctttcttcgaccgcaacggcgacggcgtcgtctacccctgggagactttcaaaggcatgcgagcaatagggtgtgggttctttacatccctcgtcatctcgttcctcatcaacctcgtcatgagttatcccactcagccgggatggctaccctcccttttgctctccgttcatgtaaagaacattcataaggctaaacacgggagtgactccgaaacgtatgacactgaagggaggtttgatccatcaaaattcgacgctatatttagcaagtatggtcgtactcatccagatgcgttgacaaaagatgagatgaactcgatgcttaaggcaaaccgcaatatatatgatttcctcggctggatcgctgctatcggtgaatggcatctactctacagtgtggcaaaggacaaagatggcctgttgcagcgagaaactgtccggggcctgttcgatgcgagtctatttgagcgactgcaggacagcaaaaaatcctcctgatgaatgggccagagaggagttcccaccttaagaagaccgacagtagaaaaatagcatgttataattattgtcctacgtaatttctttaaaaaatgtaatttgagtcgttttcgaataagaaatgtttccatgatgtagtcaatacatattattgtagaactataatggtcatcttgtttatttaatactctcttcgtttcaaaaaaaaaaaaaaaaaacta

SEQ ID NO: 2533 - DNA, 1368 bp, Zea mays
cattgggacctcgaggcggccgggaaaagccctggcttccctttcacggccgccctagcttccccacattcagctccttcgccgccgccctagctttcccgcgagcgggacggcagccgccgtatcctccttcctccaataacgagcgggtccaggcaggtagcatcctcgcgcccctgtcgtgtcgcctccgcctctgagttcagctcgccggcagccgccgctcgcaatggaggccctccggaaagcggaggcggagctcacggtgtacgtgcacccctccaacgccaagcgcgtccggcacgccgtctcccgccagctcagcgcgcttctcttcacgtatgtggaccgttttgatggcgtgttgctgatgcatgaagtttcattccttattggcaaagacaaagagggcaaacccatatatgaaaggagtgaccgtaatgatcaaattgctgaacccgtttcttatggcaaaatcatgaatggcttggtgccatatttcagcgtccaagtgcatgccaccctgctgctcttctctccccagccggacatgatcctggaagggatggttgaaatgcttgggaaggagtcaattcatgccattgtattaggggttttctcagtggcaattatgtctgaagatattaagttcaaattcaaatggaaaagtgatggaggaaaatttgtgagcctcacagataaaaaacatgtgattgaaagaggaacaatgataaggttttctgtcaaaagggtggatacagaaatgagttgtcatattactggatctttaatcccacctcacactggatgcatgcgttggttgtcagtacatgatcctaaatatgcatcagaactcaaaagtggtgaaagtagatcaagggatacaagcatcaaaattgagcagaatgaacaagaacatagaatactcaagaatgaagatggtatggtgaaatctgaacggccatataaatcccgaaagagggggcggcacattgagaaatgacatttcattgaggccgtgaagatacaagaatgtgaaagtcatgttcgcttcaatggttctgctacctgtttatgtttcttgtggggggagaaggtgcctccagttggagatcccggtagcttcatagaaatgtacgatgattttgtaaaacgaattgagggttgcatttgcaaattatcaccttttttgacaagatagtagtaattgatctcatcgaaggggtttagtggcaaatggcaagtcccatgtttcaactatagcccaggcttatgttgggttctgttgtgtcctatatcctgtaaaaggcctttccttttgaagcataactgaaagagttgcacacccattaaaaaaaaaaaaaaaaa

SEQ ID NO: 2534 - DNA, 1258 bp, Zea mays
gtaccctcggagcgggccgggacggccgccctagcttccccacattcagagctccttcgccgccgccctaggcccctagctttcccgcgagcgggacggcagccgccgtatcctccttcctccaataccgagcgggtccaggcaggtagcatcctcgcgccctgtcgtgtcgcctccgcctctgagttcagctcgccggcagccgccgcccgcaatggaggccctccggaaagcggaggcggagctcacggtgtacgtgcacccctccaacgccaagcgcgtccggcacgccgtatcccgccagcttagcgcgcttctcttcacgtatgtggaccgttttgatggcgtgttgctgatgcatgaagtttcattccttattggcaaagacaaagagggcaaacccatatatgaaaggagtgaccgtaatgatcaaattgctgaacccgtttcttatggcaaaatcatgaatggcttggtgccatatttcagcgtccaagtgcatgccaccctgctgctcttctctccccagccggacatgatcctggaagggatggttgaaatgcttgggaaggagtcaattcatgccattgtattaggggttttctcagtggcaattatgtctgaagatattaagttcaaattcaaatggaaaagtgatggagggaaatttgtgagcctcacagataaaaaacatgtgattgaaagaggaacaatgataaggttttctgtcaaaagggtggatacagaaatgagttgtcatattactggatctttaatcccacctcacactggatgcatgcgttggttgtcagtacatgatcctaaatatgcatcagaactcaaaagtggtgaaagtagatcaagggatacaagcatcaaaattgagcagaatgaacaagaacatagaatactcaagaatgaagatggcatggtgaaatctgaacggccatataaatcccgaaagagggtgcggcacattgagaaatgacatttcattgaggccgtgaagatacaagttggagatcccggtagcttcatagaaatgtacgatgattttgtaaaacgaattgagggttgcatttgcaaattatcaccttttttgacaagatagtagtaactgatctcatcgaaggggtttagtggcaaatgacaagtcccatgtttcaattatagcccgggcttatgttgggttctgttgcgtcctatatcctgtaaaaggcctttccttttgaagcataactgaaagagttgcacaccc

SEQ ID NO: 2535 - DNA, 1613 bp, Zea mays
tcggttcccctgagtgctgctcgcggcacggctagcaatagcaagaacaagagaatgatggatagctcacgccaagcgtgagggaacgacataaattcgccgaaaaggtttaaacgttttcttcatgtgctgcctctgcctgcctgcctttttctctcatccacgcatcttccttctattctatccgggtgaaggtctatctaaatatctactaaagctacaaccaccgtacatgctgggcctagctagcttcttgattttacttgctataaatacacgtacagacagataccagcgtcgatctgagatcgacatcgatccaccgaggtttcttgtgcgtgccgccatggccatggcagtagctcaccttcttcctcagctctccgccgaaggcaatggagctagcaggaacagaatggccattctcttgattcttcagctttttctcttgacgggtgcggtggcattctttttcattcccacgttgtttgtgtgtttctctgtttggtgctatttttttaatcttaaactggttcagcgtctctgctgagaaatctgattaattcatcatcggttctggacttgtggtctgtgtggcaaattggatacacatcaagttctttgttccataactgattcagcgctaggcgtggatggagcggcgtcgttcatcttcaccaacgcctgcaagcacgcggtgtgggtgggcgcgctccacggcgccagctcgccgccgctcgcgcggtcgggcttctacctggcgccgtccgccacgtccagcatggacgcgccgtcgtcggggacatggtccggcacgttgtgggcgcgcacgggctgcgtggccgaccccgccaccgggcgcttctcctgcgccacggccgactgcggcacgggcgacgtcgcgtgccagggccgcgggccggcgcctccggtctcgctcgtcgaggtcacgctcgccgcgccgggcagcggcaggccggacttctacgacgtcagcctcgtcgacggcttcaacgtgccggtgcgcgtggcgccctcgggcggcggcggcgactgccgccccgcggcttgcgcgggcgacgtaaacgccgtgtgccccggggacctccgcgtcgtcgcatcgtccggcggcggcgtcgtagcgtgcaagagcgcgtgcatcgcctacggcagcgcgcgctactgctgcaccgggcagtacggcacgccggcgatgtgcggcccgaccaactactcgcaggtgttcaagagcgcatgcccgtcggcctacagctacgcctacgacgacgccaccagcaccttcacctgctccggaccttccagctatggcgtcaccttctgccctgcgaactaatgaacgccctgatatcatatagtagctagggaattacgatattacatctagactaggtatttcttcaaaaaaaattatagagagatcaagtagaagcaatatgttgatgttgtcatccacgacacaacacacaaatgcataaaattaatttgaaaaaaaaaaaaaaaaatatgctaatcacaattcacacatggaaactggaaaatagggtggttcacccctataaagaaatgttccaatgccaaaaaaaaaaaaaaaa

SEQ ID NO: 2536 - DNA, 1075 bp, Zea mays
  misc_feature (1073)..(1073): n is a, c, g, or t
atatatatagcagcgtagaagtcctgtggttgcccgattatctgattctgtgatcgagatcgaggccgatcggccaggtttcttgtgcgtgcgctctgctactgccatggcggtagctcaccttcttctccaactctctgccggagtcaatggagctagcaggaacaggatgctcattccagccattctttcgattcttcagcttattcacctcgcagcgctaggcgtggacggagcggcgtcgttcaggttcaccaacgcttgccagcacccggtgtgggtgggcgcgctccacggcgccagctcgccgccgctcgcaagctcgggcttctacctggcgcggtccgccacgtcccgcctggacgcgccgtcgtcagggacatggtccggcacgttctgggcgcgcacgggctgcgcggtcgattccgcaaccggccgcttctcctgcgccacggccgactgcggcacgggcgacgtcgccttgccagggccgcgggccggcgccgccggtctcgctcgtcgaggtcacgctcgcagcgcccggggagcggcgggcaggacttctacgatgttagcctcgtcgacggcttcaacgtgccggtgcgcgtggcgccctcgggcggcggtggcgactgtcgtcccgcggcgtgcgcgggcgacgtgaacgcgatgtgccccgcggacctccgcgtcgtcgcctcgtccggcagcggcggcgtcgtggcgtgcaagagcgcgtgcagcgccgtacggcagcgcgcgctactgctgcaccggccagtacggcacgccggagacgtgccgaccgaccaactactcgcaggtgttcaagagcgcatgcccgtcggcgtacagctacgcctacgacgacaccagcagcaccttcacctgttccggcgcttccagctatgacgtcaccttctgccctgggaccgggagctagttgtgaaaatccatcacgggaagggttaataaaagagcgcaccagactagatatttttcttcaaaactttataaggaaagatcaagccattgtttgttacaaaaaaaaaaaaaaaaaatatcgataccgncg

SEQ ID NO: 2537 - DNA, 1077 bp, Zea mays
agctagcttcttgattttacttgctataaatacacgtacagacagataccagcatagatctgagatcgacatcgatccaccgaggtttcttgtgcgtgccgccatggccatggcagtagctcaccttcttcctcagctctccgccgaaggcaatggagctagcaggaacagaatggccattctcttgattcttcagctttttctcttgacggcgctaggcgtggatggagcggcgtcgttcatcttcaccaacgcctgcaagcacgcggtgtgggtgggcgcgctccacggcgccagctcgccgccgctcgcgcggtcgggcttctacctggcgccgtccgccacgtccagcatggacgcgccgtcgtcggggacatggtccggcacgttgtgggcgcgcacgggctgcgtggccgaccccgccaccgggcgcttctcctgcgccacggccgactgcggcacgggcgacgtcgcgtgccagggccgcgggccggcgcctccggtctcgctcgtcgaggtcacgctcgccgcgccgggcagcggcaggccggacttctacgacgtcagcctcgtcgacggcttcaacgtgccggtgcgcgtggcgccctcgggcggcggcggcgactgccgccccgcggcttgcgcgggcgacgtaaacgccgtgtgccccggggacctccgcgtcgtcgcatcgtccggcggcggcgtcgtagcgtgcaagagcgcgtgcatcgcctacggcagcgcgcgctactgctgcaccgggcagtacggcacgccggcgatgtgcggcccgaccaactactcgcaggtgttcaagagcgcatgcccgtcggcctacagctacgcctacgacgacgccaccagcaccttcacctgctccggaccttccagctatggcgtcaccttctgccctgcgaactaatgaacgccctgatatcatatagtagctagggaattacgatattacatctagactaggtatttcttcaaaaaaaattatagagagatcaagtagaagcaatatgttgatgttgtcatccacgacacaacacacaaatgcataaaattaatttg

SEQ ID NO: 2538 - DNA, 714 bp, Zea mays
  misc_feature (450)..(450): n is a, c, g, or t
  misc_feature (589)..(589): n is a, c, g, or t
  misc_feature (592)..(592): n is a, c, g, or t
  misc_feature (606)..(606): n is a, c, g, or t
  misc_feature (649)..(650): n is a, c, g, or t
  misc_feature (659)..(659): n is a, c, g, or t
  misc_feature (663)..(666): n is a, c, g, or t
  misc_feature (674)..(674): n is a, c, g, or t
  misc_feature (678)..(678): n is a, c, g, or t
  misc_feature (685)..(686): n is a, c, g, or t
  misc_feature (693)..(693): n is a, c, g, or t
  misc_feature (714)..(714): n is a, c, g, or t
agatctgagatcgacatcgatccaccgaggtttcttgtgcgtgccgccatggccatggcagtagctcaccttcttcctcagctctccgccgaaggcaatggagctagcaggaacagaatggccattctcttgattcttcagctttttctcttgacggttctttgttccataactgattcagcgctaggcgtggatggagcggcgtcgttcatcttcaccaacgcctgcaagcacgcggtgtgggtgggcgcgctccacggcgccagctcgccgccgctcgcgcggtcgggcttctacctggcgccgtccgccacgtccagcatggacgcgccgtcgtcggggacatggtccggcacgttgtgggcgcgcacgggctgcgtggccgaccccgccaccgggcgcttctcctgcgccacggccgactgcggcacgggcgacgtcgcgtgccanggccgcgggccggcgcctccggtactcgctcgtcgaggtcacgctcgccgcgccgggcagcggcaggccggacttctacgacgtcagcctcgtcgacggcttcaacgtgccggtgcgcgtggcgccctcgggcggcggnggngactgccgccccgnggcttgcgcgggcgacgtaaacgccgtgtgccccggggacctnngcgtcgtcncatnnnnccggcggnggcngtcgtanngtgcaanagcgcgtgcatcgcctacggn

SEQ ID NO: 2539 - DNA, 8702 bp, Zea mays
  misc_feature (1968)..(1968): n is a, c, g, or t
cacatgtactagccattttaatgtgatcggtgttgtccaaatgacactcagccctaatcactagcgtatgattcgacaccgagagtccaacggtcattagactaaagagtagtattgattgactctttggccccatgtagagaggttctagagacacttttttcccattggactaggtcaacaccatttgtgagaccaacacataggaaccaataatgtagtttgaactcgtccacatgcttggcagtgggccatataggtagggctgaaaaataagtttgaggctcatgaaacggcttaagctcggctcggctcggagtggctcgcgagcctcgagcgagccaagccgagtcgagccgagctaactcgttccagctcgcgaactggctcgcgggctacaccaactgtgcagaattaatcaatctatagaatcataataggttatttcttagtctttaatgatggatatatgacaattcaaattttagattgctcctaatattggataatggttctatatttcatgtttaaatactattaatttaataaatcatccaatctatagaatcataatgggtttatttcttagtctttgatgacgaataggtgaatattgcacctggtctgccactaccttgttaatatagtgcacctcgggttaaccgttggaaggtccgatgcttgtgcagttagggtccaacgcgctgtttctcttttttctctcaaatatgtcaactccaaaagtgttccaaacacttgtgcatgtgaattttatattcacaaacattgtaaatgtttttttacattctcactatgtacaatacatatgcatagagtaaatccacccaatggcaaaagttttcctctttatagtatgattatctattctaaactgaatctacactctattgttttttactggcaaataaaaaatgcccctagctagattctaaaccgaatctacactcagataacatatgtttgtgaatttgcaaacccatacatgttgaccgtttgtcaacctttttttttctatgttataccccgaagagaagaaaagacaagaatgtttccttccatcgttcttacaacaaatgaaaggcacttttctggtccatctgtttgtttggagccagcaaagagtttcatcatttgccaactttctcttatttgcgccctccgaaaagaatcctcagcctttatcagttcaccagtcaattgacttatgcagagacaaggttcaggcacggacagtaagttcaggcctccagggcagagcgccaccaaacccgcaccaaatcgaaaagggagcgagatctagaccaatttaatactcctgtatgtgatcggtggattaaagcgatgacgatccgtgcatgaagtcatcgatccagttcgtacagctagctaagctggcaaattagctgctgcatgatgcagagcgcagctatagaatgatagatagctcacgccaagcgtgagggaccgacataaattcgccgaaaaggtgcaaactttttcttcatctgtcgcctgcctgcccttttctctcttcaacgcatcttctttctattctacaaccaccgtacctgcttggggctagcttcttgattttgcttgagatgcagtatatacgtgcaagacagatatcagcagattatatatatagcagcgtagaagtcctgtggttgcccgattatctgattctgtgatcgagatcgaggccgatcggcaggtttcttgtgcgtgcgctctgctactgccatggcggtagctcaccttcttctccaactctctgccggagtcaatggagctagcaggaacaggatgctcattccagccattctttcgattcttcagcttattcacctcgcaggtgctgtgcggtgggattctttttcattcccatatgttgttgctctttgtttgtgtgtcatttttttttgtttggtgctatttttttaattnaattattttgattcagcattgccgcggagaaaaacctgatttcatcattggttctggacttctggtctgtgcgttgaaattggattcacatcaagtttttgtttcctataatctgcacttctgatcaactctttttcttttcttttctttgattagctcgtttaattgtattctttcatgattatgattctgttccttctatagaaagttagaaacaacccttccatgatttctctgttctctctgcgttcatttttgaatatgtagcgctaggcgtggacggagcggcgtcgttcaggttcaccaacgcttgccagcacccggtgtgggtgggcgcgctccacggcgccagctcgccgccgctcgcaagctcgggcttctacctggcgcggtccgccacgtcccgcctggacgcgccgtcgtcagggacatggtccggcacgttctgggcgcgcacgggctgcgcggtcgattccgcaaccggccgcttctcctgcgccacggccgactgcggcacgggcgacgtcgcctgccagggccgcgggccggcgccgccggtctcgctcgtcgaggtcacgctcgcagcgccggggagcggcgggcaggacttctacgatgttagcctcgtcgacggcttcaacgtgccggtgcgcgtggcgccctcgggcggcggtggcgactgtcgtcccgcggcgtgcgcgggcgacgtgaacgcgatgtgccccgcggacctccgcgtcgtcgcctcgtccggcagcggcggcgtcgtggcgtgcaagagcgcgtgcagcgcctacggcagcgcgcgctactgctgcaccggccagtacggcacgccggagacgtgccgaccgaccaactactcgcaggtgttcaagagcgcatgcccgtcggcgtacagctacgcctacgacgacaccagcagcaccttcacctgttccggcgcttccagctatgacgtcaccttctgccctgggaccgggagctagttgtgaaaatccatcacgggaagggttaataaaagagcgcaccagactagatatttttcttcaaaactttatagggaaagatcaagtagaattgacacacggatgaatgtggttcatatccttcaaaactttatgtttagaattctatgtatgtgttgtttgattctagttaatttgcgtccaggcgtatttctgagcgaaggaacgtgtccgtgggtaaaactgagcaagaagaaaaacataagataaaattgagtacttaggtacaactaagggcaccaatataaaaatccctaaaaaataatagaattgaaatagccgtgtcacttcctactatacttatgcattcatggctttctatattttgaattgggaacaaaacatacccgaaaattgctcatcagcagtaatagtattcattcgtacaacagtaatctttcacacaacaaatgtctaggcaaacatcaggatcttcgttgcagttctttttctttttttctttgccgagcttttcacatggacaatcgtcgtcgtcgtcgtggttgttgttgttgttgttgttgttgttgttgttgttgttgttgttgttgttgttgttgttgttgttgttgttgttgttgtcgccgtcaaatggtggaggatcactgatgctggtttccccaatttgaaacgggccagcgtgctcggccacaatccacaggatggttgtgagctcaccaccccgggcaagctgcttggcatgggagtccttgctgcagcgggtggccgcatacaagatcttatccacccacacgtcaaacatgagatccagtagttcctccatctgatcctttttcacttttaacagctcagtggcaagctgacatgcgacaaagataagacgccgattagcgtcgaccgaggcttggttgtggccagacatctctttctgcactagttcagcaagcttcgcctttctagctgcgtgacaggggacacatttctcaccagcctttcgacgaacccctgaccctgagtccttcaaagctttgcaggtgacctcgaacagcttccggagctctagtcccggcagcatgctcgggcgtacagcaagcagaaacatgaggtagtccgacagcgcctcgactgctcccagatacttgttggccttgtccttgagcagctgtcgatcgctgcgggcgaggaagatggtggtgccgatgtgccacaagaggacgtcctcttggaactcacggccgaaaatacccagcttgatgcctttgagcttgtcccgctttcttcttctcttgaccgcctcctggccccagagtgtggtgatgtcctccatggagtagcggcggtcagcactgccggacagtctctgctgaatccgctcgaacagcaccttctgggctcttcgctcgagctcagagcctcagagatgcacctcgagtgctggtattccttccagatgtcctccaatctgaggttgctggccagccaggtgcacaggcgctccaccatggatggacgccgggtgcactcagccagcaagtcgtacctcccaactcttccagaccacatcctgcggctgctcggatccttccgaatccctaatagccacaacagatctagcccgacaaggatgcggcggagcctgagccagcatccgctgcacagcagtttatggtgaagccacatgtttgccctagcattcaggaacgagtatgcccaggtggagcctagggccctcactagccataccacgtccaggaagaaggcagccgccagcaagatgtaggtgatgacgacgtcaggagtctcctcgctgtccttggggtagagccagaacaaggaggaagccgtcgccgtgccgaccggcgagacgagacggaggaggtagcctccccaggtgtgcaccacggtgaccttggtgtagaggacgtcgtacatgagggaggactccatcccggccaccttgcgtacaccatctgggtcctgctgggagaagatgttccgggcgatggcatagttgggcgaatccgtgtcgacggaggaatcggccatggcacggcggccacaagccaggaactgagtgtgggaatagagcagggtggtcagttctttttcatttttatcggcggcggcagcagccccgtactcgccggtgctttgcggcggcttgcgctcgtcgtcgccggcggaggcggagccccataggttgtccatgttgcctcgcaaaagggcgaccacgctctcggagtacctggctacaccgagggtgaccatgatggaggacgcggagcgcaggaccccgctgtcgcaaaggtatatgtacttgagcatgacatacagggcctgtattattttccatatggcgtcgaggagcttgcgccaggagagcttgccgtcctccagggtgaaggcgacgatgttgtccggtcctgccagatggagcaggaggagtggcgcccagaacgccactagctgctgctcgcgcgctgatgaggtcgtcgtggttgttgttgttgttgcgctgctgatggtgaggtgggtgagggcgtagcccccgacctgtggctgcacctggtacgccgcccaaactaacaacacaagcaaggggtacttgttgtgccggcgggtgtcggccaagagcatgaggactagggtgcaggccaagctggcaagagtcgccaaccgaagagcccagtcattgaagaaaccaatgatcttgcaagccagtgagacttccgccgccgttatcaaagtaccagctgaggacgtcgacatatccgcgacgcaagctccaataataacaagctagctagctctgtagtctgtacagacatgcacatcaatctgatcagattcaacagttaatttgaacgttcatggatttgaaaacttgattatatccgcgcctgtgcaaatttaaacgaatgaattgaacggtacctcaatgtaccagcggcagatccggaaatcgacgtaccatgcatcgtcattcgctacaaatcgatcctttgtgctgccagatctgctctgccgactagaatcgatgcagcagattcctcgtatggatttcttcctgcaggtcttggctatatatatatatatatatatacacacacacactagatgatccgtctcaccaaccaatcatgtgcatgcgctggtagttggtttgcttactttgctataaagcctatgattagcagctcagtgacagtagatgataaattacggttgcagacacaaatatatgaccctactttaatttccagtgttatactattattaatgcgtcacacatcggaacccactgcgtggtaaagcgctagctcagaacacttgtgctatttatatctccggccggccgccagagctttggactatagcacgcaccgtatggcacagtttagtgtggtttctgttatatatatggcggcctcctgcgtacagaactacagatcgagcaccgctaactaacgatcatgcattattgcccacgccacgtgcgacaggatgtcaacttttacgaacgtggatgtctatgttcgttctccgagattccatgttatatacggcactcacaaaacaataccaaaaccttaaaaagtaagatcacctagtttagtgacgcaaaaaccaaacacgtacgtcaccaaattaattaatagcgtctaattaaccaaaacatgtctatgttatatatttttagataatgagaaattgaaagttcccggcctttgtctcaaagagactatagccgaattattacatacttaggaacatcactatctaaaaactcagaaaaaacaaaacatagtgcgccgaaatgagactaaagacaaagtctaaatgcagatctccatccatgatgtctaaaaatctgcttcaccaactcctctaatctatgacatgtcttgattattagttcttgacatcctatctaagttgtagttgagcctacaagtggagccaatgcgtaccccgaaaaaccacctgcaaaagaagattttattggagcattatcaaacaccgcatcattcctgctcaaccagattgcccaacatatagccgaggctcctagaataaagtgacttttcattctattatccagactagttaaccaagaaccaaagatatgtctaatattatttagtggacgaacaccacatctgattcgaactaaacgccaaataaatttagcaagacatataacatagatgcgccataggaaaaaaaaaattatataatgtacaagttgttgcaaaacgtgtctgtatagcatagatacttacctctcaaatgcataaaccaaatccatgtccaccaaagaccccaaaaaaatagttgtcgacttaatttagcattgccgacgatgtctcacacaacgattacatttttgttttgcatttttcgaataccgttttgttgaccacagtttggctttcatatctttgaattctaaaccaaaattcactaaaaaccagaccagttttcgtttctcggtcggtagcgagaatgggaaactttaccgaaaaatggtaaatctcaagcgagaaattcatctctggtctcacaatggttgtcttgctcctattcatagtctctccttgcccgggttaaaaaccctaggccaatggggagctgaggcccgacatgcccaggcacgtgcccgagcttcatggcccagcgacccaggtcggcgggctagatccaacgctccagccttgaaatttgaaacagagaggcttcatgtagttcatttaacctaaaaaattaggtgggtattgtttgattgcttatacattatgcaatttggttgtacaatttatggcacgcaatctgcatatctagctccaatatgcaacacccacacaacaaacaaggtaataatcctatttggtttgcatggattagtttattacgaattaatcttttcatggtgcctaggctttaactttgggctggctccaccactaccctaggccccttggcccatgggtcataggggataaaaacattctaaaaagtcaaagtcggctctctaaaggcatgcccgaactaacccttacgtccactgagcacaccattcgggcctaaaatgcgcatacacaaatttactcgacgatgcaagttcgaaccaccgacaaatggagggtttcttagaaaactgcaatgccaagaaaactaccagtataaatcatatttgtattgacagttctttacgaaaaccggcaatacaaatccatgatttctactggtgttttttaagaatccgccaatacaaatatgatttctacttattgttttcttaagaaattgcttatagaaaccatttaaaatccattttttgagttttgaaatgacctcgtttgaaaaaaccacaaaataaaagttatagatctctaaaagttatcaaactttacagttgacaacttgtttatttataaccttttgggctctcaaaattgcatctgaatttgtcaaattaaaaatgcaaattttgcaaacaacctcggatggaaaaaacaccaaactaaaagttgtggaacttaaaaagttattcaattctatagttgataactttttagtttgaattcgtttatagcttcaaataatcaatttacactcggtttgttctaatatgtgggcaacaaaactataatctagacacaagtgatgaatggattggtagaggaagctacacatgatagtgaggttgggggttcgattcgattgacaccaactgtgttactt

SEQ ID NO: 2540 - DNA, 1154 bp, Zea mays
gcctcaaggaaatggccttgcttttacggtatcttcccttacaataacattggtggttcacagctaatttggattgcaccgagtggtggtagagatcgcccaaatccttcaacaggagagtggtacccgggcaggcgccttttgattcatccacagtggacaatatgaggaggcttctggagcatgctggtgttcctgggcacatatatccactattattactgtgctacgaggttatgcctccaccacaacaggtcgagaaagagattggtgaacagagggtgatatccttccatggagtaggcttgtcagcaactgaagaaacaaagtatggggatattacttgtcataccaagaatgctgatgagggaagggagctattcacaaatactttgtacaactcagttgttaatcagtacaatgtcctcaaatctgctatctttagagatcgtggagcagctgtatcaaacaatgccatctcactgtcacaaccatggcgatgaatgttagctttcccagtccagattcgatactgaagttaccttttcagaagaacaggtgaactgcaattgtgcaaattttctgggaaaaactcttgaagtttaatctttctgatatcactggactttaccaatcatggtggagcttattactctaatgcagatcctcgttaagatgtctggctggtcaagggtgattcgtgattctgcagatagggatcctcgtaacattgcatgccgtcgtccgcaaattactgctccctcaggttgttcagtaatgtgctggttgggcactgaggaatccatcaggttgcatccttttgtctagacgtcgatttgtgttgttgaagtggtaaacattttcatcctgggctgtatcgtcatcatgtatagataggctcgagtctctctctttttttttggctccacaattttttggagatataaaagcggcaggagttatgacatgcccacagtcggccctccttgtagaaatcctttggatgtaacctgtctctttcttatacatactgaaagtcaaggcagatataaaaaaaaaaaaaagcggcccgtgtttcgagtacgtggctccgtgactacccgcgtctgcgtctcctgtctagctggagctgtagcgtaaagaatctatctgca

SEQ ID NO: 2541 - DNA, 1796 bp, Zea mays
tcagctacgtaggcccccccccccccaggagcaccacgtgatttatcttcacatgagcaagcactgaagacacataaggacaatctcctgaggatggtcagttactgtgaaaatgacgtggactgcagacgcctacttcaactgatccactttggagagaagtttgacccttcgctttgtgcaagaacatgtgataattgcttgaaagagtcaggatgggtcgaaaaagatgttaccaacattgccaggcaattggttgagctagtcacaaggacagggcactcacattcatctacttacattcttgaagtttacagagggtctatgagccaaaatgtcaagaagcagcgtcatgatgctttagctcttcatggagctgggaggcatctagctaaaggtgaggcagcaaggataatgcgacatttagtaactgaggaaatacttaatgaggatgtgaaaaagagcgatatgtatggatcaatatcatctgtcctcaaggtaaatcatttgaaagctagtgatcttctctctggcaagcacaacatcgtcctgaagtttcctgcttctgacaaggcctccaagatgaggaatcttgatgcctcgttgcttccgcaaaccaacaagaatgttcagcagcaaagtgaagtcgatgtgaagcttgcatcaatgctctatgaagctttacttagccttagagaacagataatggaggagtgtaacgaaggattcaatgcgtatcacatattcaaaacagacacgttgaaggaaatgagtatccgagtaccgagaacaaaagaagagcttttggatataaacggcctcggcaagacaaaggtcaagaagtacggggaccgcttgcttgcaaccatcgaggacttcctcagcaaacacccaaatccaaggagaaacagcggcggaggtggcggcggcaacgagcactccgatgcggcaaagaagcgaaggggctccaccgccatctctgcagcgagttacggcgacgatgacttcgacgaacgcacgggccagcagtccaagaagcgcgcggccaagacgcgaactgtctctgcccacggcccccgctgcacggacgccgatctcgatgggcctgaggtggtggaggtggacggcgagctgcgcagcgtccggaagcccgtggcgtatggcaatggcagggttcttcccaagtgggcacccctctaacttattccaggaatttgggtacgtcaagtagagtagagtaccgctagggaataggaatgtaggcttgcacatatgtaatctcccaggttggctcgtgcacatgcagcgatgcagtgatgtcaagggttttctgtgatgcagttgtacattggaactgtggcgtcgaatgtacgtccagctggtacacgcgtcaaggacatacgagaccaggagcaagagttccgttgcttgcttccgtgggcagcatcgcgatcgcagtgtcggccacctgttgcccgaaacatcttggatgcaggtacatcttcgcacgcgtgtaccatcaagcgaccaaacttgaattaacatcatcgccatcatcatccgatggccactgtagtaatgtatgcatgtatgctgacgttggactgaccttaaacatttctcttgcatccagttgtcctaggttgtgtgtatgggtctagcaagtcttaagggtccgtttgtttcctcgcgtgcttatataattcagcttactttatatagattatgtattctgaattgtatagtctattttgtataatcttatgagatgtttatttaaaaaaaaaaaaaaaaaa

SEQ ID NO: 2542 - DNA, 857 bp, Zea mays
ttttttttttttttttatcccgcaactgatcggatcagaaattttagcgtggccgtttttttttttttttttgggcaatgaactagcacacttcattacttgtgcattgcagcttagtagtttaaaaccccggtgggcgatgaactagcagccaggttcagaatggcacacacgccttaggtaataaattaataatcgacacaagtcaaaacgatattgatctcattcacgagaaaccatctgctaaactactcgttcttcttagccttcatgttccccttgggaatcttgctcaagacgccgtggtcgagcttctgatattgatctcgcagcagaccaagaaggctgtagaggaaatcgtccacttggtcttcgtacttctcatagagcaccggaagcgtgtgaacacaaacaaacccgacatatatgacagtcaggaaattgcaccaacttccaatcaccgcagcagcccacagtcctgcgatcgccactacaaaatgcttcaagtttctttcacaagaaacatcctgaaggaagcacaggaacttgtttacttgggcaccgattgcaacggcaatgttcacaaataactcatcaggcaattcaactcggggcacctgagaacgggatccgctgcttagcatgtttgagaagttggaccaaacaaactggacaaccattccaagaacaagggcaaatgaaacaattgtcagaaagtggtagtcgagccactcaaagaaaacccaaatagctgttgcaagagccagaacactcgatgatatttttttgttcctccataacagcacatcagcaggttttccaccacccagaactccatgcaagcccgggatattccg

SEQ ID NO: 2543 - DNA, 1314 bp, Zea mays
cctcgtgcgccgccccgccaacccggcctagccaccagccagcgccccccaccgccgcctttttatttcatccacgctgctcgtgctcgctgcctgcttcttgcgcgatcgtctcggcctctcgggactctagagtggcggccggctctccgcctgttcttgtcgtcgctgctcctttccctgtgagcttaaaatatacacaggatgtcggaacgttctgagagtgcaactgaaaagattatgagcagcatcatggataccattgctgacaaccttcctaagcagaagtctgggaaatttgatccaggttcagtctctgacaaagtgaagaacaagctgtttggtcgtcagaagaccttgcatggagttctgggtggtggaaaacctgctgatgtgctgttatggaggaacaaaaaaatatcatcgagtgttctggctcttgcaacagctatttgggttttctttgagtggctcgactaccactttctgacaattgtttcatttgcccttgttcttggaatggttgtccagtttgtttggtccaacttctcaaacatgctaagcagcggatcccgttctcaggtgccccgagttgaattgcctgatgagttatttgtgaacattgccgttgcaatcggtgcccaagtaaacaagttcctgtgcttccttcaggatgtttcttgtgaaagaaacttgaagcattttgtagtggcgatcgcaggactgtgggctgctgcggtgattggaagttggtgcaatttcctgactgtcatatatgtcgggtttgtttgtgttcacacgcttccggtgctctatgagaagtacgaagaccaagtggacgatttcctctacagccttcttggtctgctgcgagatcaatatcagaagctcgaccacggcgtcttgagcaagattcccaaggggaacatgaaggctaagaagaacgagtagtttagcagatggtttctcgtgaatgagatcaatatcgttttgacttgtgtcgattattaatttattacctaaggcgtgtgtgccattctgaacctggctgctagttcatcgcccaccggggttttaaactactaagctgcaatgcacaagtaatgaagtgtgctagttcattgcccacacgtggtcctccgccgcgtccacccactcatttaaattaataatcgacacaagtcaaaacgatattgatctcattcacgagaaaccatctgctaaactactcgttcttcttagccttcatgttccccttgggaatcttgctcaagacgccgtggtcgagcttctgatattgatctcgcctcgtgc

SEQ ID NO: 2544 - DNA, 1281 bp, Zea mays
gaggttctgccgttgagaatcaattgctagtacgatttcttctctcctccaaaccggccaagccaccaaccagcgccccccaccgccgcctttttatttcatccacgctgctcgtgctcgctgcctgcttctcgcgcgatcgtctcggcctctcgggattctagagtggcggccggctctccgcctgttcttgtcgtcgctgctcctttcccaggatgtcggaacgttctgagagcgcaactgaaaagattatgagcagcatcatggataccattgctgacaaccttcctaagcagaagtctgggaaatttgatccaggttcagtctctgacaaagtgaagaataagctgtttggtcgtcagaagaccttgcatggagttctgggtggtggaaaacctgctgatgtgctgttatggaggaacaaaaagatatcatcgagtgttctggctcttgcaacagctatttgggttttctttgagtggctcgactaccacttactgacaattgtttcatttgcccttgttcttggaatggttgtccagtttgtttggtccaacttctcaaacatgctaagcagcggatcccgttctcaggtgccccgagttgaattgcctgatgagttatttgtgaacattgccgttgcaatcggtgcccaaataaacaagttcctgtgcttccttcaggatgtttcttgtgaaagaaacttgaagcattttgtagtggcgatcgcaggactgtgggctgctgcggtgattggaagttggtgcaatttcctgactgtcatatatgtcgggtttgtttgtgttcacacgcttccggtgctctatgagaagtacgaagaccaagtggacgatttcctctacagccttcttggtctgctgcgagatcaatatcagaagctcgaccaaggcgtcttgagcaagattcccaaggggaacatgaaggctaagaagaacgagtagtttagcaggtggtttctcgtgaatgagatcaatatcgttttgacttgtgtcgattattacctaaggcgtgtgtgccattctgaacctggctgctagttcatcgcccgccgggggtttaaactactaagctgcaatgcacaagtaatgaagtgtgctagttcattgcccacacgggtactagttcttcgactcatttaaatttctgatccgatcatttgcgggatattgataaaaaaaaaaaaaaaaaaaaaaaaaaaaaaaaaaaaaaaaaaaaaaaaaaaaaaaaaaaaaaaaaaaaaaccaaaaaaaaaaaaaaaaa

SEQ ID NO: 2545 - DNA, 573 bp, Zea mays
aacaagaacttttattttttatttttccctcttcgactgaagttcgacatgttcaccaccctcacccacttctttgcctgggtccccacccagtttcgtcgcttggtctttgccctccagtgtgataatggttgcgagttcgacaacgccactcactccttcctcacccatggcatccagttgcgtcgctcgtgcccctacacttctcccagaacggccgagccgaacgcatcattcgcagcaccaccaaacagaatgtgcttgaaaatgcattcatcatcccagctacctagaagtggccatcaacaggcttcatatatacagtttcaaaacatttagggcctgtttggttcgatgcataacttgcaacactttgcctaacttttctttctaaggttagttattcaattcaaacaactaaacttaggcaaagtttggcgcagttagccgcgaaccaaatagacccttagtcctgcaaaattgttgtgtgctgaggcatattttgtggatgccacgtgtttgctgttttacacgactgtatattttgcagacctcaaacatgcttatttcaat

SEQ ID NO: 2546 - DNA, 696 bp, Zea mays
ggcggcggcgtacgaggtgctcgtagcaggcggggaggggctgttcctcaagaccaagcccccggccgccagatccgccgtcgaggcgctcccgtccgccgtcgtcgcggccggccaggaagtccagggggatgagtgcgctgtgtgcaaggacggggtcgcggtcggccagcgcgtcaagcggctgccgtgctcgcaccgctaccacgacggctgcatcgtgccctggctccaggtgcgcaactcgtgcccgctctgccgcttcgagctgcccaccgacgacccggagtacgagtcctggaaagccggccggaccgacgccgcgtgaaccggccaaccaggcagtggccgcatgctcttatggtatggttttattgatagtgttgtatgtatgggttgggtttgaatcgggtgctttggttataaggttgctactcagccgtatcaaaggcaaagtatagaggcagtagatgcagagatggtttttgatcggtttcctttttctccttaaagagggactcatgaagtttttccaagtgaccgaggttggcatatacttgttagttgttactacgtattcctgctgtatttattctaaaaatccagagaggttagctggatatcttggtgcagggcagctgtatatcctgatgcaatgggccgatccacttgctcgatattatgatgtcacatttt

SEQ ID NO: 2547 - DNA, 2604 bp, Zea mays
  misc_feature (2192)..(2192): n is a, c, g, or t
  misc_feature (2489)..(2489): n is a, c, g, or t
caattggaccctttaactctaaccagtatgcagcggatacatcacctccgtactgggcctgggcctggaaggtaggaagccaggaaggcccgtatggcctagttagtcaacgccggccggagtggaatagcaacagcggcttccgtgacgctgctgcgacgagcagcatcccaagattcccagcccagcgtcgctgtcgcactcgttcccgcagcccaaagcaaccgccgggccacctttgctccgcttccacactacacagccaatgggcccctgaatcgtccactgacatgccgcttgtcgtcttgcgcacacggcacccatcccatctcaccactgacaggtgggtctggcagcgcgtaccccacttgccatgagaccgcgtgatcaccaaccacgcgcctcgcgtgctccgcccccaccccactgttagcggggctccacaacatgtgtccccacacgtcatggaggaagcacgcggtcgcacggaatgcgtagaattgcagggctctagttttatgtaaaaaaaaggggaaaaaaatgcctcccgaaacgaaaacacttccacagaggagagaggcccaggtcgaacaagattttttttcgattcccctctccagcatcgcaatcgcatccatggcttcctcgtctatccacatccaccatccccggcttgccggcgacgagatccaccggaccctggaggcctcctactcccccagcgcgtcctactgctccgacgatgccttcgtccccgtcttccgcccggatccgtccgccccctccgtatccgcgtccgcatcggccgaccgcgtccgcagccttttccgctccgtcgacgtagccctcttccgagatacgctcttcgcgcccggtcgcggcggcgacggcgacggcgacgacctcgggttcacggacgcggacgcggaggcggcggagtacgacggcgatctcacctccatcttctgggactgcctccagatcgaggacgccgacgatccgctcgctgcctcccccgccgaggagttcgagtgggaggaggtcgcgtctccatcgggcgccgccggggaagccccggagcccgagtgggagatgctcgccgacgtgccgcccgccgccgccgaggaggggttcgtgtacacctcccaccacagaggcagagatgaggaggaggaggaggcggcggcgtacgaggtgctcgtagcaggcggggaggggctgttcctcaagaccaagcccccggccgccagatccgccgtcgaggcgctcccgtccgccgtcgtcgcggccggccaggaaggccagggggatgagtgcgctgtgtgcaaggacggggtcgcggtcggccagcgcgtcaagcggctgccgtgctcgcaccgctaccacgacggctgcatcgtgccctggctccaggtgcgcaactcgtgcccgctctgccgcttcgagctgcccaccgacgacccggagtacgagtcctggaaagccggccggaccgacgccgcgtgaaccggccaaccaggcagtgactgcatgctcttatggtatggttttattgataatgttgtatgtatgggttgggtttgaatcgggtgctttggttacaaggttgctactcagccgtatcaaaggcaaagtatagaggcagtagatgcagagatggtttttgatcggtttcaaaaaaaaaaaaaaaaccttaaagagagggactcatgaagtttttccaaatgaccgaggttggcatatacttgttagttgttactacgtattcctgctgtatttattctaaaaatccagagaggttagctggatatcttggtgcagggcagctgtatatcctgatgcaatgggacgatctacttgctagatattatgatgttacattttaactgatcgttgtttggtgactctctaatattatgtctagtttattagagcatcaaattacatttccacatcttgtttatagtggcacaggtgatacccattgattcccttctcaagctgctgattcatattgtgttcagtcttgtgtgcaattggtaacttttcttgattcatagcaacgcaaatatttcaggagaacaaaaaacttctgtggccctatttatagttaaagaaaattgaaaaggattaagttggcgtgaccaccacaaaagatgtaaggccattatgacttaacctgtagtcaattnaccttgacattcgctaggtgggctgttgtgtgtagtatttggactttatcgccatatattttacgagagcctgacaaggctgtaaacaacactcactgactctttacatgatattgtcatgtgttcttacttccttcacatacaaagggatggttcgttttgctaagctattgaaacttctctatatgattttactgctgaatccatagtacaactgcgcatagtttggcgacaaattgatcaggttcctgcaagcaaccactgagacattgatgccacagctaagcagttacgganacgttagtgttttggtatctatgtaagattggatttgcagttttatgtttgctatttcgatgctgggcttggacttgatttggatgagattgttctcttcacttacaaatcaaag

SEQ ID NO: 2548 - DNA, 1947 bp, Zea mays
  misc_feature (12)..(12): n is a, c, g, or t
ctcgaggcttgnccgggactgcacgacacggaggagttaaagagacggcagcgcaccgccacccccgcccacacaggcagtccccccctcccccacccacccagcgtgcgaggcgatcaaaccgtgtgcgggcatggtggccgcgctgctcctgacctcggcgaccgcgctcctggcgctggcggcggcgtggctctgggactacgtcgtggtgcgcctcctttggcggccccgcgccgtggccggcatgttcagggcgcagggggtccgcgggccgccctacagcttcctcagcggctgcaaccgcgagatgaggaggatgaaggcggaggccgacgacgggctccggctggacgtccgcgaccacaactacctccccagggtgatgccccacttcctcgcctggaagcagctgtacggggagccattcctgtactggatgggtccgcggccccgggtctgcctcttcgactacgagtcggtaaggcaagttcttttcaacaagtccggtcatttcttcaaggacgacgcccacccgactatcctggcaatgatgggcaaagggctggtcctggtggaaggcaccgactgggtgcgccatcggagggtggtcaacccagccttcgccatggacaagctcaagatgatgacggagacgatggtcagctgtgctgagccactgatcaagcggtgggaacagctcgcagcagccagcagatccagcgaggacggtgggaggggagaagtgcaagtggagttcagcaagcagttccaggacctgacggcggacgttatcgcccacaccggtttcggaagcagctacaaggagggcaaagaggtgttccatacgcagaagcagctcctggcgctcgccatggcgactctcctcaacgtgcagctgccaggattcaagtatctccctaccaagaacaacaggctcaagtgggcgctagaaaagaagatgaagacgacgctcacggcgatcatacagtcgcgggtggcatccaatgggaggagtagtggatacggagacgacctgctcggcctgatgctcgaggcctggctcacagcggaacgaggaggaggggaacgggacgagtcgagcctgaccatggacgagatcatagacgagtgcaagacattcttcttcgcaggccacgagaccacgtcccatttgctcacctggacaatgttcttgctcagcgtgtacccggaatggcagcaacggctaagggacgaggtcctgagagagtgcggacaggcaaaccctactgcagacacgcttaacaaattcaatgagatgacgatggtgctcctcgagacactgagactctacggccctgtcatgctcatgctaaggaagcctacctccgacataaggctgggcagcctcagcataccgaaaggcaacgggatcgccatacccgtcccgttcctccaccgagacagagaggtctggggcgacaacgccaatgacttcgatccgttgaggtttcagaacggggtcacgaacgcggccaagaccccgcaggctcttctgtcgttctcgatcgggccgagggcatgcatcggccagaacttcgcgatgctggaagcgaagtcggtgatggccatgatcatgaagaagttctccttcacgctttcctcgagctacgtgcacgcgcctgtggattatatcacgctccagcctaagttcggccttcccatagttttgaggccactcccggatgtatgatgtgaaatggatctgtagcctgatagctgattttttttggggggtctaagtatgcataagaggtcagtattcaggacttggtttcatccgccaaacagtaaggctaaagaaccaaaacttgttgaaaactggtaactttctgggattttatgcccgtattatgtatataaatatataatgctacatagaactttgtaaaaaaaaaaaaaaaa

SEQ ID NO: 2549 - DNA, 950 bp, Zea mays
cggacgcgtgggcggactcgtggggaacggttcttgtttagcctgaccatggacgagatcatggacgagtgcatgacattcttcttcgcaggccacgagaccacgtcccatctgctcacctggacaatgttcttgctcagcgtgtacccggattggcagcaacccccgaggcacgaggtcctgagagagtgcggacaggcaaaccctactgcagacacgcttaacaaattcaatgagatgacgatggtgctcctcgagacactgagactctacggccctgtcatgctcatgctaagaaagcctacctccgacataaggctgggcagcctcagcataccgaaaggcaacgggatcgccatacctgtcccgttcctccaccgagacagagaggtctggggcgacaacgccaatgacttcgatccgttgaggtttcagaacggggtcacgaacgcggccaagaccccgcaggctcttctgtcgttctcgatcgggccgagggcatgcatcggccagaacttcgcgatgctggaagcgaagtcggtgatggccatgatcctgaagaagttctccttcacgctttcctcgagctacgtgcacgcgcctgtggattatatcacgctccagcctaagttcggccttcccatagttttgaggccactcccggatgtatgatgatgtgaaatggatgtgtgtatgtgtgtagcctgatagctgatttttttttggggtctaagtatacataagaggtcagtattcaggacttggtttcatccgccaaacagtaaggctaaagaaccaaaacttgttgaaaactggtaactttctgggattttatgcccgtattatgtatataaatatataatgctacatagaactttgtattcggagttggttctgagttgaattacccgagctgccaaactcttgcaaaggcagctaagctgaattac

SEQ ID NO: 2550 - DNA, 3680 bp, Zea mays
  misc_feature (400)..(400): n is a, c, g, or t
  misc_feature (2808)..(2808): n is a, c, g, or t
attgtcttaaacttcataaatatcaaagtgcatgaacggaaacgtaactaattaacgaccctgactggaagattatgctaacgatgatgatttctgcaggggaaagcatacaattttcggcggaaacagtcctcattcgttatttaatttggagcagttctttcttatctcgacactgcacggcacggaggagttaaagggacggcagcgcaccggcacctcctctcacacaggcagtccccccacccacccagcgtgcgaggcgatcaaaccgtgtgcggccgtgcgggcatggcggccacgctgctcctggcctcggcgaccgcgctcctggcgctggcggcggcgtggttctgggactacgtcgtggtgcgcctcctttggcggccccgcgccgtgnccggcatgttcagggcgcagggggtccgcgggccgccctacagcttcctcagcggctgcaaccgcgagatgaggaggatgaaggcggaggccgacgacgggctccggctggacgtccgcgaccacaactacctccccagggtgatgccccacttcctcgcctggaagcagcagtacggtaggtatgcctgtctgtctgttcgtccagtcatccaggatgtatcatctatttctatgcgtctcctgtatccgtagctccttcctgatttgatgttattaatcatctatgctctgttgatctgttcctgctatgcttgatatatttttcactacttccacgctagcactacttttctgtactgtagttgagttgctcaggcaaaacgaacactgaaattaaactcatggctgggtaccagttttaactctctccggcttggcatggaattgaactgaaggttttcgttccaacgtcgcgcaggggagccattcctgtactggatgggtccgcggccccgggtctgcctcttcgactacgagtcggtaaggcaagttcttttcaacaagtccggccatttcttcaaggacgacgcccacccgactatcctggcaatgatgggcaaagggctggtcctggtggaaggcaccgactgggtgcgccatcggagggtggtcaacccagccttcgccatggacaagctcaaggtgacaattaattaataatctcctggattcgtctcagtgctcatctcagatctccccaccggtgggcgacacgttctctgaaatgcattcgttcatggccggtttcgtaagatgatgacggagacgatggtcagctgtgctgagccactgatcaagcggtgggaacagctcgcagccagcagatccagcgaggacggtgggaggggagaagtgcaagtggagttcagcaagcagttccaggacctgacggcggacgttatcgcccacaccggtttcggaagcagctacaaggagggcaaagaggtgttccatacgcagaagcagctcctggcgctcgccatggcgactctcctcaacgtgcagctgccaggattcaagcaagtcgatctctatttcttttcttgcctcttcttggtcaccagtaatcggtctttgccttttctgtacatccaaacgacggtttggttgattgagttctttactacttccaggtatctccctaccaagaacaacaggctcaagtgggcgctagaaaagaagatgaagacgacgctcacggcgatcatacagtcgcgggtggcatccaatgggaggagtagtggatacggagacgacctgctcggcctgatgctcgaggcctggctcacagcggaacgaggaggaggggaacgggacgagtcgagcctgaccatggacgagatcatagacgagtgcaagacattcttcttcgcaggccacgagaccacgtcccatctgctcacctggacaatgttcttgctcagcgtgtacccggaatggcagcaacggctaagggacgaggtcctgagagagtgtggacaggcaaaccctactgcagacacgcttaacaaattcaatgaggtaccgcatctacttgtgactactgcatgaatcttaaatgtcttgaccgcgatctttagctgctgctgacatcgaaggttgttgccattacattgcagatgacgatggtgctcctcgagacactgagactctacggccctgtcatgctcatgctaagaaagcctacctccgacataaggctgggcagcctcagcataccgaaaggcaacgggatcgccatacctgtcccgttcctccaccgagacagagaggtctggggcgacaacgccaatgacttcgatccgttgaggtttcagaacggggtcacgaacgcggccaagaccccgcaggctcttctgtcgttctcgatcgggccgagggcatgcatcggccagaacttcgcgatgctggaagccaagtcggtgatggccatgatcctgaagaagttctccttcacgctttcctcgagctacgtgcacgcgcctgtggattatatcacgctccagcctaagttcggccttcccatagttttgaggccactcccggatgtatgatgtgaaatggatctgtagcctgatagctgatttttttggggggtctaactgtctaagtatgcataagaggtcagtattcaggacttggtttcatccgccaaacagtaaggctaaagaaccaaaacttgttgaaaactggtaactttctgggattttatgcccgtattatgtatataaatatataatgctacatagaactttgtattcggagttggttctgagttgaattacccgagctgacaaaatcttgcaaaggcagctagctaagctgagttacaaagctttttacagncttgatttggcccgtcggattcggatggttgcaaattgcgatgattgcacatgtagagaagcacgggatgtcctgttattgttaaggtcttgttcgtttatatcggattgcatccggaatcgttctagttaatcaaaatttatataaattagagaagcaatccagttaggaatcgttccgacccaccaatccaacacaaacaaacaaagcctaagcctgtaccaaattaaaaataatattacaatattccatggaacttatatgaaattaaaatataaccttgataattttactctcttactagtgtataagcatgtaaacatgtagacataaatatctcataaatttaatttcaaacctagagttaaaaattgagttctgtgacttgcgaggatggtggcaacagggccctcttcgcctcctcagacatcacaggcgtgacggacgatggtgccacaaaggatatccgcgctagcgtctctccctttctcaatcaaataactacgttctcgaattgaacctaatattcctaaatttaccaaattgaaaactcatgtacctcaatcgatgacctaacaattctattacactaacatctggtagctccgcctgcacaagtgtatcactagtgtacatggcagacgagtcgagatcaagcaaatgggtcgggcctgttgagcggcccatcacctagcatggctcaacccattgtccatagggcccatacctggtagtgttgtgcctggaccttaggtgcgatacgacaggttaagtggccaaatatggtttagcttggctcgagtatggctcccgttgtccatagggctataacggtcgtgatgtgcctgtgccttaagtgcgacacgataggg

SEQ ID NO: 2551 - DNA, 819 bp, Zea mays
  misc_feature (792)..(792): n is a, c, g, or t
gattcgatgttattgatcatttatgctttgttgatctgttcctctgttcctgctatgcttgatatatttttcactacttccacgctaacactacttttttgtactgtagttgagttgctcaggcaaaacgaacactgaaattaaactcatggatgggtaccagttttaactctctccgacttgacatggaattgaactgaaggttttcgttccaacgtcacgcaggggagccattcctgtactggatgggtccgcggccccggggtctgcctcttcgactacgagtcgtgctcatctcagatctccccaccggtgggcgatacgttctctgaaatgcattcgttcatggccggtttcgtaacatgatgacggagacgatggtcagctgtgctgagccacctgatcaagcggtgggaacagctcgcagccagcagatccagcgaggacggtgggaggggagaagtgcaagtggagttcagcaagcagttccaggacccgatggcagacattatctcccacaccggtttcggaagcagctacaaggagggcaaagaggtgttccatacgcagaagcagctcctgccgctcgccatggcgactctcctcaacgtgcagctgccaggattcaagcaagtcgatctatttcttttcttgcctcttctaggtcaccactcaccagtaatcggtcttgcctttttatgtacatccaaatgacagtttggttgattgagttctgtacattaccttattccttaatttttatgtatggggatgaagctggagacatgaaantgctctgctacaaaaaaaaaaaaaaaa

SEQ ID NO: 2552 - DNA, 4954 bp, Zea mays
  misc_feature (1029)..(1029): n is a, c, g, or t
  misc_feature (2109)..(2109): n is a, c, g, or t
cccctgccacgtatgaaaatgttggcgccaaagaaggtggcgccactatatattacctcggcaccaatgatgatgacgccgaactaatggtctattttttgaaatgaaactgctaagggtatagttgtgaaaaaaaacaccaaaaaggctaaaatgcaaaaaagttggccagagaggtgtcttctgcaacacaggattttcacgagagccgcacaaaattttttacaaaaatatccagtctaaattcataggcaacaagattttaaaaacttccccacattccaaaggatcatccaatactcgggctgtatcgcgtgaacgaaattacaatattgatttgctggctgggtgaagctattgcatcgaacactataaaatcattattcagataactataaaatattctcagaaaaataaaaagttcgcaaacaagatggaaaaagaaaagaaaacaggcgtagaaagaagacaaacgagagccagccaggtgttctctcgttctccggatgactctccagtggcacatagaaaacactagtactgtcccctcccggacatcagagacagacacagtagagacgaggcagaggcttctagatctactgccagctcggcagcaacaaagccgaagcgtctcgcgtgcgcggccgccaccggggattagggatggcggcgaagaaggtgctcatgctctgcggcgactacatggaggactacgaggtctcttcctctctccccctcttctcgcgtcgcctcctgctgaattacatgtattttggatcgggaatcagccctcctgaaacaaaatcggttcttgaattgatgctgggttaggtcatggtcccgttccaagcgctgcaagcgtatggggtgtccgtggacgccgtctgccctagcaagaaggccggcgacatctgccgcaccgccgtccatcagcgggcccctctccaggtaccttggattgatatccctgtgctctctttttattttttgcgtggaagcgttccgttggttagggttagttatgcngtcttgcttctggtgagatcagttggaccaaatgaagttgtgtagaaaacttgttaggtgttcattagattgacagtgaagagtagaggcttgcataaactagttggacactgcatctgattagaaaacttgttaggtgttcattagattgacagtgaagagtggaggctttaatccataccggcttctactacttcttcagtgtttttgtcgatatgaattgtagctgcagcagtccaaacagtcgtctttaatccgaagcgaacaacactttcgcagtaaaaaaacttgtgtttacttgcctgaaagaagcaaactgtcatgatccatgactctgcagagattgaaaccaacaaggcaatcaccatggcatctcaaagcataatgccaaagtatatacagacaaactactcgtgcataaatgcatcatacagagatttgtttcattgcaggcacaaattgatcaatgaatatcatgttgttagtaaggaaactaatactccctccgtcccaaaatggtatttgttttagggtattaatggattcatacaatatttgatgcatgtgtattatatttgtgtctagattcattgttattcatttcaatatggacaaaaaaagataggaattctcaatgtaaatagaaataatagatgtatgagtacaaatgtgtttaattgagtttgcttatcctgttaacaaaaagtgaactgtaaatattagtctatatgtaagcgtatgtttcaaaaatatatataactgtctctgtacagcggtgaagaggtataaagtaatcaataccacagtagcaatattaatggttgacgtagaaagaatacgtaagcctacaaatatttatccgtcggtcaaaatccattttggctttccccacccggtttccagaaagcgcgaggacacgcccgtcatggctcctacatcaacagttcagcagccgccgaatgcagatccaacggttgctatttaaaaggtgacgtggctgcgtttggttgtgcagaggctttactatgtaaataattatccttgaggccatggtggtattgtagatcaataacacttccntgtcatgcttctcttgcttacttcttgtggcatctacactgatatggtttggattaacagctgcaagaataaacattctctcattcgcatatttcatgcagacatactctgagacaaaaggccataatttcacactgaatgcttcatttgatgagattactgctagtgaatatgatggattggtaattcctggagggcgtgcaccagaataccttgcgatggatgaaaaggtgcttgacctagtcagaatgttctctggtgctaagaagcctattgcatcagtttgtcatggacagttgattttagcggcagcaagagtagtcgagaaccgtacctgcacagcatttccggctgttaaaccagttttggttgctgctggtgccaagtgggaagagcctgacacaatggcaaaatgcactgttgatggcaatctcatcacagcagcgacttataattctcatcccgaattcatcagcctatttgtcaaagcactcggaggttcagtggcaggctcagataagagaatactgttcctatgtggggtatgtattgagaaaaaaaaagatgtgtttcttaagtgtttcacattcttatacacattttaatcacacactgcacgatttggatgttgttttttttctaagacattgtgtgattaagtgttgccacattctactgacattgtttttttcttaattgcatgattaataggactacatggaggattatgaggtcatggtcccattccaggctctccaagctcttggctgccatgtcgatgccgtttgccccgacaagggagctggggagacgtgcccgacagccattcatgatttcgaaggtgaccagacctacagcgagaagcctggccacgattttactctgacagcgtcgtttggaagtgtggatgcttcgagctacgacgcgcttgtggttcctggcggacgggctccagagtacctggctctgaacgataaggtcatcagcttggtgaaggccttcgcggagagcggaaagccaatcgcgtcgatctgccacggccagcagatattatccgctgccggagtcctcaaggtatagctctatcattgtttctgcggaatcctgtttctgttggtaattcgatgtgccctttgatctgctggtgtttcttttggtccatgtgtttctactgtgtggcctagcagactttgctgtgaacataacaaaaacaaatcttgctagttttctgccgtccaggaaggatggtagtcagtgcagattaatggctgccccatctgtccgccgtcggatgatcctccttagtcattggggttattactagcaaatgtagtatctggttttctcggaacatctgacaactttggtcgactgacgtgcgctgacgctcccttggttggtcggtcgacacgcaggggaagaagtgcaccgcatacccagccgtgaagctgaacgtgttgctcggtggcgggacctggctggagcctgacccgatccaccgctgcttcaccgatggcaaccttgtgaccggcgcagcctggccaggccacccagagttcgtgtcccagctcatggcgttgctcggcgtcaaggtttccttctgaagtccaaactgaaagggcaaggcagaaagagctctggctcaacctggggaggggcgtgatagcatagctttggatttccagatagaagagaacagactcaaaacgacaccttatagcgatcgctgcacttaatccttgttccatgcgcagcaagcctcaggcttattacccttgtttgtcagcgttgtgtaaaaactgtaacccggatgctgtttcttcttcttcttcttggttccttcttttttctgagtcgtcctttgtggattcaaataataaataaagtcttgtatactgctgtttgttgatctggtactgtgcttcgagcagctagatggccaacaaagaaaatagtggctctgttatgttactgctacagtgagaaggtcggagacagaaagaatgccgcaacttggccccaccaccaggccatggcagcagtgcagcacagagcgcgaaagcgaactgactggacccgatctttgcactccctctcgcaaaagcgaggagaatctggatgcggatgggggccgtcgccgcctcgctttttcaaaaggccatcacggttgccacttggaaaacgacggcggcggccagtgggaccggaccgccccggaagcgattcagatttttttctttgtttgtttttttttttttttgtaaaaaaagcaaagaacaacaaaagctaacgaacgcagaaaaaagagggatcgaaaggaaagcgagaagacagcgcggaatggcagaaacgaagaacgaacttggcaagagcaaattcagatcagatcgcgttcacctgtcctgcgttgtgccaagcgcgatgatcgacataggattttagataatcttccgtgcctttttttttctcggtgcatgaatggcttcagacaatgtccggtcccgtgtgttccgtggatgttgggtgttggccaaatgcatgagccacaccgaaaatcggaatatatcttagctactgtcatcaacagagatggtcacatgcaacgctagtagcaagatgtgtgtaggtccatggccgtatccgtacagccgtactaggggtgtataacgacctcagctcgttaagttaacgaccacagagtcagcacgagctcgagctagcagaaaaaataatatatatatatatataataattaattttagttaattttaaactaatttaacaatagaaaataatgattatactcatagtttcacaaaccatgtcaatataacatcaaattagc

SEQ ID NO: 2553 - DNA, 1677 bp, Zea mays
  misc_feature (1672)..(1672): n is a, c, g, or t
atagaaaacactagtactgtcccctcccggacatcagagacagacacagtagagacgaggcagaggcttctagatctactgccagctcggcagcaacaaagccgaagcgtctcgcgtgcgcggccgccaccggggattagggatggcggcgaagaaggtgctcatgctctgcggcgactacatggaggactacgaggtcatggtcccgttccaagcgctgcaagcgtatggggtgtccgtggacgccgtctgccctagcaagaaggccggcgacatctgccgcaccgccgtccatcagctgaccggtcaccagacatactctgagacaaaaggccataatttcacactgaatgcttcatttgatgagattactgctagtgaatatgatggattggtaattcctggagggcgtgcaccagaataccttgcgatggatgaaaaggtgcttgacctagtcagaatgttctctggtgctaagaagcctattgcatcagtttgtcatggacagttgattttagcggcagcaagagtagtcgagaaccgtacctgcacagcatttccggctgttaaaccagttttggttgctgctggtgccaagtgggaagagcctgacacaatggcaaaatgcactgttgatggcaatctcatcacagcagcgacttataattctcatcccgaattcatcagcctatttgtcaaagcactcggaggttcagtggcaggctcagataagagaatactgttcctatgtggggactacatggaggattatgaggtcatggtcccattccaggctctccaagctcttggctgccatgtcgatgccgtttgccccgacaagggagctggggagacgtgcccgacagccattcatgatttcgaaggtgaccagacctacagcgagaagcctggccacgattttactctgacagcgtcgtttggaagtgtggatgcttcgagctacgacgcgcttgtggttcctggcggacgggctccagagtacctggctctgaacgataaggtcatcagcttggtgaaggccttcgcggagagcggaaagccaatcgcgtcgatctgccacggccagcagatattatccgctgccggagtcctcaaggggaagaagtgcaccgcatacccagccgtgaagctgaacgtgttgctcggtggcgggacctggctggagcctgacccgatccaccgctgcttcaccgatggcaaccttgtgaccggcgcagcctggccaggccacccagagttcgtgtcccagctcatggcgttgctcggcgtcaaggtttccttctgaagtccaaactgaaagggcaaggcagaaagagctctggctcaacctggggaggggcgtgatagcatagctttggatttccagatagaagagaacagactcaaaacgacaccttatagcgatcgctgcacttaatccttgttccatgcgcagcaagcctcaggcttattacccttgtttgtcagcgttgtgtaaaaactgtaacccggatgctgtttcttcttcttcttcttggttccttcttttttctgagtcgtcctttgtggattcaaataataaataaagtcttgtatactgctgtttgttgaaaaaaaaaaaaaaaaagagcccctagatggccaacaaagaaaaaaaaaaaaaaaaaccccngaggg

SEQ ID NO: 2554 - DNA, 1301 bp, Zea mays
cgggagtgttagttagcgctgccccggggccggccgggaaaggcattggccccctcgaggcccgcccgcgtgtacctggagccgtcggcttccgccagcgcccagctggaggtctcgctgttcccttcacgatacgcccccccaaagcggatcaaaccctagatctcgtcttgtcgccccgttcctccgatcccatcctatccgatcctcatggattcctcctcgtccagcctcagccagcagcccgagttcgactacctcttcaagctactccttatcggcgactccggcgtcggcaagagcagcctcctcctccgcttcaccgccgactccttcgatgacctctcccctaccataggtgttgacttcaaggtgaagatggttagcattggtggcaaaaaactcaagcttgccatctgggacacagctggacaagagaggtttaggaccttgaccagctcttactacagaggggcacaggggatcattatggtgtatgatgtcagtcgacgagagacgttcaccaatctttctgatatatgggccaaggaaattgacctgtattcaaccaaccaggactgtgtaaagatgcttgttggaaataaagtagacaaggaaagtgagagggctgtcacgaaaaaggagggaattgaatttgccagggaatacggttgtttgtttctagaatgcagtgcgaaaacaaaagtaaacgtagaacagtgttttgaggaactggttctaaagatcttagacacgccaagcctcctggcggatgcttcctcagcaggggtcagcaagaagaacatcttcaagcagaaggctccagaagctgacgccgccacaggcagctgctgttaacatggttttggtcctgtatattgctatatgtggtgaagacaattggcagcagctatataatgatgtatcaagttaaacttacctgacaatatgtagtcttgcctcccaaccgcagctaagtagcagaggcacgggtgggtggcatcaataccggcatgatacagtatcagacactgtcatctatataagaaacagccatacttcggttcgttggttgcctaaaaaaaaaaaaacaaaaagccccctggggccccttgcgcttctactggtggacagcaatatcaacatgtctatatgtgacagaaaacagcctcacttctatttatttgtgccgtgcagtcgtgcagatgatatttcatctcaatgcacggtaacacatcttgtggaagcagattacgtttgagctaattgtggacgaataaagattaatggactctaaccat

SEQ ID NO: 2555 - DNA, 1055 bp, Zea mays
tacctcgaggccgccggccagcagagcaggtttgccttcgccttcacaattcgcaccacattattgtcttgtgttgcccgcaacccaaagcggatcaaaccctagatctcgtccccgttcctccgatcctcatggattcctcctcctcctcgtccagcctgagccagcagcccgagttcgattacctcttcaagctgctgcttatcggcgactccggcgtcggcaagagcagcctcctcctccgtttcaccgccgactcctttgaggacctttcccccaccataggtgttgacttcaaggtgaagatggttaccattggtggcaaaaaactcaagcttgccatctgggacacagccggacaagagagatttaggaccttgaccagctcttactacagaggggcacagggggttattatggtgtatgatgtcactcggcgggaaacgtttactaatctttctgatatatgggcgaaggaaattgacctgtattcaaccaaccaggactgtataaagatgcttgttggaaataaagtagataaggaaagtgagagagctgtgacaaaaaaggaggggattgaatttgctagggaatacggttgtttgtttctagaatgcagtgcgaaaacaaaagtaaatgtagaacagtgctttgaggaacttgtgctaaagatattagacacgccaagcctcctcgctgatgcttcgtctggggccaagaagaacatcttcaagcagaagcctccggaagccgatgccgctgcaagcagctgctgttaacatgcttttgccatgctaattccgcgtcctcccgtggatgatgacgatgatatctttgtttggtgtgtcggtttattgtttcttcttcttttggtcctgtatatgctgaatttattacacccacacataactgtacgttggcagcagctatataatatatcgttttttgttgtttaaaaaaaaaaaaacaaaaaaaaaaaataaaaaaaaaaaaaaaaaaaataaaaatgtaaaacaatgaaactcacaaaaaagaagtaaaaaaaaaggggcggc

SEQ ID NO: 2556 - DNA, 2197 bp, Zea mays
tgacgaaacgaggcgaaaagtacgttctcctggacatcaaccgcagacctagagacaaggcttttgcccacttccccaacatggccgtcgattgcctgctgggcggactgcacatcacccggcagcctatcctggcggttgctgcggcgcactacatgtacggaggcctcctgtcagggctgcagggggagaccaacgtgaagggcctctacgtggccggcgaggtcgcgtgcacggggctgcacggtgccaaccggctagcaagcaactcgctgctggaagcgctggtgttcgccaggagggcggtgcagccgtccatcgacctcatggtggatgccgacggagatgccagaccgtcgctggtggcgaggtgggcacggccgacgctgccgcggtcggtgctgggcgacagcgtgctgtcggacatcgtggggcggacgaggcaggccaggatggagctgcaatcagtgatgtgggagtatgtcggcatcgtgcgctcgacggggcggctgaagcaggccgagtggaggatcggtgacctggagtcggagtgggaggagttcctgttccggcgggggtggaagccgaccacggtgggcgtcgaggtctgcgagatgcgcaacctcttctgctgcgccaagctcgtcgtcaggagcgcgctggccaggcgcgagagccgcggcctgcacttcaccgaggacttcccgtacctggaggagagcaggaggaagcctacggtcatcttcccggccgccgtgcaggagctcacgtggagctccaagccgttgcagaggcagctgcaagcagatgacaatgcatgcagttcatccggctgggccttggggattcgttaattcattcattaatttttaagaactctcagtcgacagcatacacaaaatccagacagttaggctgtagtagcctgcgtatctttgcaattcttgccagttccagctgttgcaacttgtaaacggtgttgttggagctgcattatggtttatgaaccttgatccgtagtatatgtatgtggtgattggctgattgcacaccaactgatgaccattgtgatgtcatgcagaaaaaattgcgagaacttctgaatttcatttaccacacaagtgagttgccatttgacatgtagatacatcatcgctagaagttcagagttcccatcacatttatacacatgaagcctgcaccgaaaactttgttcagaaatgaagttgtcaggatcagctacatgtcacggcggaacagattgtatgcggagatgagggagcagatggcaaaaacaacaaatgccacgaaagatatggcaatggagccgttcgccatgttcgggaaggaatcgctcccccagttctcagtcaaatcacttgctcgagcagttgctgatgacgatgacgatatcagaaggtatgctagcacctgaaacggcaaaagaagttaccatcatgagagcaagctcgtccctggaaattgggagtacacatctatattcacaatagttggggatcaggggcggactcaccacccaggcaccgcaggcggtggcctgggctggctcgccagctgcaatggagggcaaggcgcgagcacagtgcacggaagcaagcagcacgtggcacgagcacaggcgtggggatcacaccgtattctcgcctaggctgtcatcagttcctgggtccgccactgttggggatagacgggggagaaacgagctactccaatgcacagtttggttatctagtcgattctattccctaagagacagaccaggtgaccaattgtgattagtcatcgaccagggcgactaaacaacactagtagtcccctatatgtcaggacaaatatatatcatatactatgtatacaagtgcagaaccaaatctacacaagtgcagcagccaagacacaagccagcacccaccagcagcagtagacatacacatcagtaaatggcagaaaagcagaacaaacaggaattgctacaccgctactgcagcagtcaagattcaggaataagatctcaagaaaatggaggaatggaggaagtaccatgatcgtgagctcatcctcgcagaccagcagcagttaggatgggaagggttgcaaattggtccaaaaaaattaatcccaaaaacttaaaccgaagtggctccagccatagtagatgcacccaatgtctcagggg

SEQ ID NO: 2557 - DNA, 1386 bp, Zea mays
cgaggccggccgggcttgctctgctcgcggcccctcgcggccggccgggattcaccgcattacctggcggcgcctgtcctcctcactatccctaccatggacgaagaaggcgcccccccgcccgccccagcctccccttcccgcaccccaccgcagcaggagccgaagcccgcggtcctacgctggcgcccacccgtccgcgtgacctcggagtttgacagcgaacgacggctcttctcccaccgcctctcctgccgcgtcctcgacggcctcgccaagctccgcctccgcattagccatggtgctgggggaggagggattctctggggcccgactgatgtggggctcctggcgcggaacttctccgtcgtcgtcgaccctgcaacccgaggcgccgtgctgcgcggcgccgccgacctcgccggctcgctgcgactgcgcgcctcgcacaacaccaaagagcaacaaggagaagtggcaattactgcaaatttgagggattcaccatgcaagattgaactgtcatctctggttcctcctaatggaccgccaagagcaacttttttctttccaaatggtgaagtctcaattaaagagaagattttggatgagcgtgacagaattttgtcagtaaatggcctagtgaagtcacgtgttctgcatggagtttgcacagctgtgtacaatgataatgtaatgagcattaaataccgctacaaggatgatgaggtatcgtttatccccagcatctcattaccatccaattctctgtcatttgcattcaagcgccaattaacgcctttggacaagttgagctattggtacaattttgacacaaactactggggcgccatctacaaacacaaggctcacaagcatctcaagtggaaagctggctatgagtcagacaacaggcttggatgggcatcgctttgggttggagatgctggcggcagtacaaaggaggcgcctttgaaagccaaaattcacctcacgcttaaagtcccccaggacaatatacagaattcagttgtagtgttccatgttaagaaaagatgggatttttagtttctatttgtgagctcagatggtgttacgtcatgcgcacataagcaagcgtgtacagatggagagccaataagagatggatgcaaatttgtgatgtggtctgcaaaattgtttcatgcaaatgctagggagaaatcatgtaatgttagtcctcttttataggttccgtttggttcaaggtcttgttaagggaatgctaaagagctcaaccaaacaaaagtattggtaactactagaggtgtaatccgatcgaatacagatgaatatcactgaaattaaatttgttattcggatccaaaaaaaaaaaaaaaaaacaag

SEQ ID NO: 2558 - DNA, 1418 bp, Zea mays
acgcggggggctcgctcacccacccttggccgccgtttacggtttagccgcgtgctctctctgtctccctccctccctctcggggacaattcggctaccgctgccgccctacgccaggttcccagctcttcgccaggcccttctccggcgacgagcacccaccaggccaccagctttactttgtgcaacacatattctccatctaatcaactacaaggaggttgtactcaaagaatggatttatggattacttcttgttcacaagcagcgagacatcatgcaaggacaggttcagttgattttcctgttaagaagaacgtgaagtcatctcaactgcaaaacacgacatgttttgttggtttagtgcggcagttgcagtgcagacggtcagcaaaaagccatatcctgaatgtaaagtctgatacagtatcccaccaaaaggtttctggtgtaagctggagtttggaaaatacgccacgaagaataggatgtgtagtctctggactaggttttgcagcgtatgggctggcgagtgctgagggtcctgtcaacaacaacatagatagcactgaatctgccatgtcttcaacaaatttatctcatgggaaagaagttcacacagactattctgttactggcattcctggtgatggaagatgtctgtttcgttctgtggttcacggtgcctacattaggtcaaggaagcccgtacctaatggggatcatcaaagaaggctagctgatgagttgagaacaaaggtcgcagatgaatttatcaagaggcgggcagagactgaatggtttgttgagggggacttcgacacgtacgtatctcagattaggaagccacatgtctggggaggcgagccagagctgttgatggcttcacatgttcttcagatgccaatcaccgtctacatgcatgataaagccgctggtggtctaatagcgatcgcgaaatacggccaagagcatgggacggaagctcccgtccaagttctttaccatggttatggccattatgatgcgctgcagataccaggagagggtggtccgaggtcaaggctgtaacattagtagctctgaatctaaatggcagcgacatccgctttggtggcaaagagcagatggtccttcgacgcgcctggaggtcggaggtggaccgacatccgctgatgagctctcacgatcttcagactcctgattccttccagagcttattcttctgtatatctccgcgtggctctgtttctcctagccaacaaacaagccgtgacagaagaacgacgatgagaatatgagatcatgctcggtcgtcctcgatcgctcaaacaaacaagcaggagaaaaaaaaaaccctccatgcccggggaaaaaaaaaaaaaggggggggcccacaattgggttcttttaagccc

SEQ ID NO: 2559 - DNA, 1311 bp, Zea mays
gggtacctcgaggccggccgcgacggcccttattttatcccaggagaggtcgcggccggcgagctggctcgctcacccacccttggccgccgtttacggtttagccgcgtgctctctctgtctccctccctccctctcggggacaattcggctaccgctgccgccctacgccaggttcccagctcttcgccaggcccttctccggcgacgagcacccaccaggccaccagttgacacttaatactacctgaatctaatgcttatcaatatgcctaatatttgctggcggagctttactttgtgcaacacatattctccatctaatcaactacaaggaggttgtactcaaagaatggatttatggattacttcttgctcacaagcagcgagacatcatgcaaggataggttcagttgattttcctgttaagaagaacgtgaagtcatctcaactgcaaaacacgacatgttttgttggtttagtgcggcagttgcagtgcagacggtcagcaaaaagccatatcctgaatgtaaagtctgatacagtatcccaccaaaaggtttctggtgtaagctggagtttggaaaatacgccacgaagaataggctgtgtagtctctggactaggttttgcagcgtatgggctggcgagtgctgagggtcctgttaacaacaacatagatagcactgaatctgccatgtcatcaacaaatttatctcatgggaaagaagttcacacagactattctgttactggcattcctggtgatggaagatgcctgtttcgttctgtggttcacggtgcctacattaggtcaaggaagcccatacctaatgaggatcatcaaagaaggctagctgatgagttgagaacaaaggtcgcagatgaatttatcaagaggcgggcagagactgaatggtttgttgagggggacttcgacacgtacgtatctcagattaggaagccacatgtctggggaggcgagccagagctgttgatggcttcacatgttcttcagatgccaatcaccgtctacatgcacgataaagccgctggtggtctaatagcgatcgcggaatacggccaagagcacgggacggaagctcccgtccaagttctttaccatggctatggccattatgatgcgctgcagataccaggagagggtggtccgaggccaagactgtaacgttagtagctctgaatctaaatggcaagttccggttcgatactttcttcctttgtacatgtacgtgcatgcatacatcgatcagagttttgggggggttaaaaagcaggtcgtagtttgcc

SEQ ID NO: 2560 - DNA, 3414 bp, Zea mays
ctgcagtgcgctcacattgcaacacattccaatatatatcctttttagctttaacaacaaaatagcgacacttatgtagtatgttgcctatgcttggcatggtaactttttatattgaattaattgcaatcaagaagcactgccaatagagtggtggtagatatgtggtgacctgatgcattttatgcatcattcattatttaatcttgactcaacgtaaaataagctcagcttaacatctattggttctaccataggttcaggttactaacataacagcaggggacaggcacccaaatagtggcacatgcattaatttgcaaccggttgagctcgtctaaagcaagtaatttgtacaatactaaaatagaactttaaaatatgtaactccagagactagtttttttagggtttcatcctgtaaggtcatttgaaagcaaatttaatataataatatacacagtacttgaggtcaagtaacagcggttaacagtattcagacatgcatactcgcaccaaggtggaccagttcatgggcttgcttgtttgttacatttgtgaacttaagtgtgcatgcttccatttcactaagatctgcctcattaaggtacctcatataaaggggttatattttgctattgcaaattaggctgtgtacttatgggttgcatcaatctctcttgcagcaaaaccagccataaccagtcatatgtaaattgcacctgtcaggctgtctcacgggctctgtatcttgtaaagttgtaattgcatgttgtagtcagtataccaatgcatcttgtaagttgtaattgcatcttgtagttagtataccaatggacaaacaatagtcctttaggaatgcaaacctgctggtggtcttttattgaaacacctgtttttgtgacaggtttgcagttgcagcttaactcttctacatatgaactagcccaatggaacttctatcttacggtcttttacacctcagattagtagattctctagtttatgcaatttctacagtttcctaggaattacaccatttgagaatattgtcaattttaaaaacatcattaggcttcacaaggtatctttggtgcactgtgcactttttcctgctcatttactatggaatttgtatgattctgttaaataattgatgaatcagttgatgtgcgcaaaattagacatacttaagtagatacaggaataaactattatccatgtttctgggagaagttgttggacatggcaaaagatagaatcattgtagatcaacatcttgtgggaatgggcacataggcaaacattatttgataatttttagtggctgtttggagatcttgcccatgtgggctcgtcaaactatgtgcacaggaaacctgtgagttctatgcccccccccccccctctttctaccaggcaatctgaacaaactgttgagtaactatgtatctacaaaataaaaaccatctgcacacaattctggtatagctgatgcatagaagtaaatttactacattcaaaattgtaagttgttgtggcttttctagatttgtagcttagacagtgtgtatatctagatgcatagcaaaagctatgtgcctagaaaagccaaaacaacttacaatttggaatggagtaccttttggtttagtacttttggagaacactcttttggtcatatttttccctcagcagttacaataattttgtatataggttgaaacaaaagaagtgaatgaacaagagagtagtagaggtcatgcagcattatccaagaagggccagaatcctcagccagataattcattggtgaatgaagtggaagaagatgccatatcagatgacgaaaaccacgaggattctagaaggggtcgctctaagttggagcgatggacaagccacaaagagatagaatatagtaatatggatgatgatagtacacaaacatttccgaccatcaaagctgatgttgaagccgatgaggtaggtaaatctcaagtttctgctgcagctggcaactcggacatcaatagcaatgttgatactgggcagacatctgataagatgactgaagaatgtgagcgtgaccgacatctagacacagttgagaggctcaagagacgaagtgagcgtttcaaacttcccatgcccggcgagaaggatgcacctcaaggcaaaaaggtagataccgaagtgcagcctccccaaaatgaatcgtcagctgctgatatggaagtgaagccagagcggccagctcgcaagaggagatggactgggagttagttgaactggaacatttccacttcatcaagaaatttcagcagattccatggcagttgcttgcacttcggcatgtttcttccttacagttgaaagttgggttgatgtatggttttactgtttaacttgtaccagcaaagtgtaaaacttagttgttttgtggctgggaactggatactgtactaaaattacatccattttcccaccatgattcgggattccggtgaccattgtgtggcacaggtgccactgtactcaggatagttctgaggctgttacgagaagcagtggcctcggagcccagttgaatatctgggttcggaatgagctgcattttgaagctggagtgcccctgctgcaagttgattttgtttgaagtgcaggtggcctggaagcactgggtcttgtaacacgcttgtgctggtgggagatacttgcaagctgtggtggctgaatgcttgccatgtgatgctgttttatggagcaataggtgatagaaacaaaggactagagatttcagaactgatgatataatcactaatttgtatgcttaatactatattagccatgtacattctgataaacatataactgtcgtgcatgagttgttgatggagtaaaggtagactgtagtgtagagctgcagggtgcactggaccatttggatggatcaatacatatatatatatacctgtaggcagtgctaggtaagaagaatatgattgtttgcttgttgtagatttgcgatgtatataactggttcatgtggagttttgctaatcatacagagttctgaatggcactatgtaaatttattgaaatttagcatttcagattacttgcttgctatatctgtactgtttgagaagttaaccctcacgcccacgacttgtggtacacgttagcgcggcatcatgatcaccacaccagaaatgtaaggtcatgtttggtttctttagttagggactaaagtttagttaggtactaaagtttagtccataacatgtttggttctaaaggctaaaaatagtaataatatattaaatgactcataataagactaaaatgacctttaacattctcctactattagtacaatagggggtgtttggtttatgtggactaaacatt

SEQ ID NO: 2561 - DNA, 2097 bp, Zea mays
cccacttttccgcccacgcgtccgcggcgcgggcgctcggcaaagagagcgtggtgatgtggttttgaatcgccgtgaaagtttggacgattctcatatcaagagaaataaggacgatgagaacttgcggaggttgaagcctgaaaatgaagacatggtcatggcgcatggtcatgggggaggaggggattcccgcggcggctcacgcgtccggggcgatgaaattgatcaaaaaagacgagatgatagtggtagactgcaggggaaggtggatgaccgttatcatgccaaacaaaaggatgacaactggagacatagagaaagggacgatagacagaggcccaagcatgaaaatgtgttaacccttccgaaggaagaaggaagaggaactggtcggcgtagtcggatgatggatgataagttggtcagtggtggtaggaacaagggtgaaccaagatcttctgtattaagcaaagacactcgagaacgtacaaggcaaaatgaatcttcgaggagaggtcagggtgtggaagaaaacaacatgcagaataaagggcgttctgatgtacatccacgtgatgacagtttaaacagtgagaggaactccaggcaagaaaaacaaaacaataatcgtctatctggcagttctgatggtcgccatgcaggtagagataggcatagggagagcacaaggaagggcagaggttctgagcttggtgagcatgatctccacagatcaagcaaaaggcgacgtgaagaccatgaaagccatcacagtgggaaggttgaaacaaaagaagtgaatgaacaagagagcagtagaggtcatgcaacattatccaagaagagccagaatcctcagccagataattcattggtgaatcaagtggaagaagacgcctcagatgatgaaaatcacgaggattctagaaggggacgctctaaattggagcgatggcctcgccgccggccgggtggatatagtaatatcgatgatgataatacagagacatttccgaccatcaaagctgatgttgaagccgatgaggtgggtaaatctgaagtttctgctgcagttggcaattcagacatcaatagcaatgttgatactgggcaaacatctgataagagtgaccgacatctagacacagttgagaggctcaagagacgaagtgagcgtttcaaacttcccatgcctggcgagaaggatacgcctcaaagcaaaaaggtggataccgaagtgcagcctccccaaaatgaatctactgctgctgatacggaagtgaagcctgagcggccagctcggaagcggagatggactgggagttagttgaactagcacaacgtttccacttttcagcagatttcatggcagatgcttgcgctttgccacgtttttcctcgtacagttgaaagttgaattgatgtatggttttactgtctagcatacacatgtacgtgtaaacttagttttttttttgtggctgggaactggatactgtactaaaaccccatccattttcccactatgattctggtgacctcaatgtgtggcacaggagccactgtactccgggtaagttccgaggctgttatgggaagcagtggcctcggagtttcccagttgaatatctgggttcggcatgaactacattttgatgaagctggagtgcccctgctgcaaggttcttttgtttgaagtgcaggtggcctgaagcaccgggtcttgtaacaatcttgtgttggtgggagatacttgcaagatgtgatggttgaatgtttggcacgtgatgctgatgctgttttaggaaccaccaataggtgatagaaaccaagggctagagatttcagaactgacataatcacagatttgtatgcttaatactatattagtcatgtacattctgataaacgtataaatgtcgtgcatgatttactggagtaaggtgtctaagactagtgtgtagagctccacggtgcacttttttgggtcgagcaatacatatatatgtacctgtagagtgttaggtagaaagaacatgattgtttgcttgttgtaggtttgcggtgtatgtaactggttcgtgtagaatttag

SEQ ID NO: 2562 - DNA, 1321 bp, Zea mays
cgagatcgatctctctcaagggaccttgtttgcttgccgccacccccaccgcagttacagttatagctagggatctgagggctagctgatggacagcaggagggagtcctcggagaccttgaggaacaaatgcgcggcctgcttcaggcagtacaacaggatggagcacctggtggagcacatgaaggtctcgtaccactcggtgcacgagcccaggtgcggcgtctgcgggaagcactgccgctccttggagtcgctcagggagcatctcatcgggccgttgcccaaggtggagtgcgcgcgggtcttcggcgtccgcggctgcagcatctgcctcaacgttttcgacagcagcgccgccgtcagataccaccgtgcggcctgccagtactctcgtgctgctccgatgcccaggggcggtggcatgactggccgcgcggtcgccttggcttgcaagatggtagggggagggagcgacggctccatggacctttgtgcgagggtgtgcctcgttggagaagatgagcacgtcatcttccagacctatgtcaaacctacactccctgtcaccaactacaggtacgaagtgactgggataaggccagagtacctgagggacgcaatgccgctcaaggttgcgcagagaagaatccaggaaatcctgtgcaacggggagccactgtggaagttacgcccaaggagctatggtagggcaaaggtcctcgttggtcatggccttgaccatgaccttgagcgcctagggttagagtacccggcattcatgatcagggatactgcaaaatacccaccactaatgaagactagcaagctgagtaactccctcaagtaccttacacaagcatacctcgggtatgacatccatactggcattcaggacccctacgaggactgcgtcgcagcaatgaggctgtacatcaggatgagatcacaggctcaccagagagattacaactccggctctggcgaggcccagaacaactatccagcctggaggcagagggagctcgacaggatgagcccagaagaactcctggcactttcagcatcagactactactgctggtgcctggattactaaaccgatcggcttataaggaaaataaggcaggcgaacgttgtcggttgacatgttccgtctatggcgatcatctttagatgtacaagtagcttgcggctttgctatattgggggttaattaaagcgtataaacaaaggattctatataaatgtattgatgccttagatctgtataagaagcaatatcatgattcatgatgcatgtggaaagaggaaaaaaaaa

SEQ ID NO: 2563 - DNA, 869 bp, Zea mays
caagaacaacctcctccgcacctccatcccagtgggggtatgccaccataccctatgcatcctttcagacctgatgctcctatgggccactttgaaatgggtgatcatcggccacctcctgtacattcgatggaatatatgggtgctgatagaatgccatacttgtatggtgttgaacaaggaggtcctcgcccttttctagaacagccttcgccaagaacctgccctcctgaggcaccaaggacaaacagtgaagttcccagaaacatgtctgatgcagtgccagctacagatttcagaaagggaccagtggcaattgaaaaccaagtggctacaccaacaggcacaactgaagttatcattccttgcaattatataggctttgtctgtggaaacaatggcagtgaaattgaagaaatagagaagatgtcaggtgcttcaattacagttcatgatcctaaagctggcgacgcaaactcaaaagttgttatatgcggggatcccgaagaaacaaagaaggcacagagcctgattcatgccttcatattctgtggtctgtatcaaacataattgatgacttgatcactgtgcagtaccatcgtcgtttatgttcttgaatctagagtagttcccatgggcagatttcagcccttgattggatgtacatgtaccgtcgctaccggggtggatgtaggtagggctgatgcatgccttgtacaaacaacgccgatgtacatttctgtagtcctgtgttttagtttgggggaatggcaccatggaatgtgatgggttggctgcacggacctctgtggaatgtttaaccccatgccatcattggttttcatgatttcatctcttgtttgggaggc

SEQ ID NO: 2564 - DNA, 1638 bp, Zea mays
gttcggtgcacttgcatctgtctctatttcactctctcacttatctgcttttttatgcttctctttcggatatactattgaacacatagataacgagacattttgtccaatattttgtattgcgttgcaacgcacggacacctaactagatgggcttccgagcaaactttctccagacccacaagaaaatatacgatccgatcagatatgtatcgtgctcatcccagcgtactcccgttgcaatgcacggacacacatctaataatttctatgatgctcagatttttctaacaaccagtttttttttcacagtcagatttttaaaaaaaactcgtacaaaaatttgagacaaacaggtgatgaagatcctgctgtgaacatcctgttgttattgtttgagagaaacggaagaaaaagaaaaaaaatagagagtaattaaaccccggcctccccgagccccggaaagccccaaaacctaaacctagcttttcgtcagtacaacgcctccgccgctccttccattagctcagacatggttctcggcctctacaccttcgccgacatcgacgccgacggagcaccccgcctcgaggttgccgatggcgaggagttcgtccgtgtcgatcgcgttgtcgagcttgccctcggtccccgggtgctgaaggcccctggaaccctttacctcaccaccaggagggtgatttgggtcagcgatggcggcgagggctacgctgtggacttcgttgccatctcgctccacgccgtgtcgcgtgatcccgaggcgtatccatacccctgcatctacacacagatcgagacggaagctatttctgacgaggagtctgatgtgtcagattctgaaacaaatggagaactcgagctctcaaaagttatggaaatgcgcatcataccttcagatcctggtcaattggatgaactctttgaagcattctgcaattgcgctgagcttaaccctgatcctagtgctgagagtgatgaagaacatggctgggttcatggtgatgagggttatgaagatacggtagatggaagcgacactgagttttcagatgtcaacccaattggtcaaactggtgagcaggatattaaccatgctgtaatcgagctccagatcaatgaccaacgttttgaggacgcggtagatgaggagagtcacaggaacgggaactagggaccatgtgaattggtcgtcgtcgatgcagcatacttgtctgtaaagacttcacttttctcatgttgtcagatcatgtggaccaacttgaatggcaacaatgggggataacgagctttattatatgagttgtgcctgtaccatacgtgcatgaccatctatggtcatatgactactgactagtattttagagggcgagggggtgcaaatcgatacccggccttgtgcaacacattttccttagcaaaagaaaaaaaatgttgtttggccaagtaaaattgtagtgttgaagggtcgaaagtggagaggtgtaaagttggttagttccacatcgcactatttctgtctgagtgtctctcttgaaacagtaaacaacaccactcctgtctggttttgtaaacaacattccagcagtaaaaagcaaaaaaaaaaagcggccaaaaaaa

SEQ ID NO: 2565 - DNA, 2129 bp, Zea mays
caaaaatgtctgcctctgtaccaataggtataatacctgctgggtctgataactcacttatttggacagtcctcactagtccccccccccccccttgagccacctgttggttgcagggaggtcttacacctattgatgttttttctgttgaatggattcaaagtgggacaatgcattatggtacaaccgtatcatattttggttttgttagcgatgttcttgagctctcagagaagtatcagaagcattttggtcctttacgatactttgtagctggttttctcaaattcctgtgtttgccaaagtacagttttgaattggaatatcttccagtatcagatgttaatggcgccgagcataaaattttggtaggacaagaaaaggttgacacatctgatctatatgatgatgtaattcggagatcaagagcagaatgtttaccacgcgcctcaagtttatctagcattgattcaataatgtctacaggcatcatgtctggggcagagctggaggtttgtagtcctcgtgcaaataatgaaccttctgaggttgttcgtggacttgatccgaaatcaaagcgcttatcgttaggaagagctagtacatttaaagaaccagaagaagtgctccatccccactcccatggtacatctactcccagctggcgtagatctaagtcaaaatcaaggactgaaaaggcaaggccaggcttgtctgctacacacgatgcaaaatcttctaaggttaatgcagcagacaaagaggacacgtcatccacaatttctgatcctggacctgtggctgtatgggattcaggaccaaagtgggacgatgaacctaaatgggataatcaacctaactgggaacccgagacttcaattgagctccatagccctcgcgaggatattgagcttggtctgactaaggagctggtacctagtttagatgaaaggtggactgttaggaaaggacgctatcttggtgtactggtgtgcaaccattcatgcaagactgtgcagagtctgagctctcaggttgttgctcctaaggctgaatatgatgacaattgtttggacctgctgttagttggtggtagtggaagactgagattactgaggtttttggtgcttttgcagtttggaaagcacatatctcttccaaatgtagaatatgtaaaggtgaaatctgtgaggctcaaagcaggcccaaatacacacgacggatgtggtatcgatggcgaactactccatgtcaaggggcaagttcgctgtagtttgttgcctcaacaatgtcaattgatgggcaggccagtgaaaaaccctgtacagtagctgtaaatacactatgcggactgtctgcagctctgaggtcagcccagaatcttgcacctgtggtgtgtacaagcggcgaaccatggattttcgtctgcatccacatgtcagtaaattatattcagaagtgagaacatgaacatcctagctggcactcagctacagagatgtacatttgtggttgacgagcagaaggtgctgagtgggtgctatttcatcccatatgtaaagccaaagcctatctcggacagcagcttgttgcgcacctcttgcttttgcctttttctcgtccgatagaatgcatctactatacagccatcctgatgagtgtacttggttgctccagaacatagtgtccacctccaccagccgggtgtctttggaggttccctgatgccggccacttgatactcattgtagggacaacaccccagtgcccgtgtccttgatcagtctgttgtgtttgcgaagtgtgaataagatataggactgtttgattcccggtacagcgcagggtttcagcagaaagggctggatggatgatgttttgtggcgatgctgcctcgttgagtctttaaaacgggtgtaactcttcttcttttgtgagtcgtgatgatgtatgaaccgtgtactgatttgtaaaccttgcctggcaggcatacaactgtttctgaggtgtggtattctctgccggggaataagcagcgtagcttctcctttcgttcgctgccagcaaagcagcgctcgtgcttgtatgaacaacttacaccaggcaaattttgtgatgggttttgtgag

SEQ ID NO: 2566 - DNA, 1734 bp, Zea mays
gcacgagaccattacctagaacatcctaatcgaaaaatttcctctcgtcgtctcgtggccgctggtgcccgcgcgtcagatttggcctgctccgctccgcctccgcagtgtgaatttctgagagataggtttctgtgctgcagacagcccggcggcgacgcggtggcagtttgcggcgaggtccggcgtcgcgccggcgttcatgtcgttcaggacggaggcgacgggcgagggctctgaggcgttctcggtctccgagctccggccggccggagacgccttcgacggcatcaagaagcagagctccatgctttcgatctaccagcagcagaggcagtttggccacaacagcagccaggccacggcacagcagcagtaccctgcagcggcgcacaggcagcgctcgcaggtggcggattacggcgcggcggcaccgcatcgtctccctggtggtggtggtggtggatgcaggctagtgcagccggtgtcggtgcgccaccctgtgccgttccatcaggccaacctgatggtcaggtcatcagtgtcgcagagcttccacaaccagcagcctttcaccatgagcaacaacgggtttggcggctctacggccggcgtgtacggggcgaggaacccacggaaccaggcctcgacgcagctcacgatattctacaacggctcggtgaatgttttcgacaacgtcccggtcgacaaggctaaagagctcatgatgctggccagcagggcgtctgttcctggtgctaccccgtcaagtgagccggactcgccgcctgttcctgcccctgcccctgccaaggtcaacgtggccgaggtcttccctggtgctagacagatcgcagttcagaaaccggagccctgcgtgccgcatctatcaagcgcggcaactgcaagcccagtccgcatcgtcgtgccgcaagccgtggctccctccaggagcacgtctcactgcgctacagaggcctgcggttccaagcctgctgctgctcctaccagccagacagtctcgtcgtcccggcagttggcagctgcaagtgctgctgcagctgttacgccaagagctgtccctcaagctcggaaagcgtcgctcgcccggttcttggagaagcgaaaggaaagagtggctagcgtcgagccatacctgacgtccaactccaagagcccgctagagagcagtgacgccgtcggcagcgctagcgctccaacgaaatcgtcatccacagacgtcgccccggcgagcagccacaacggcggcggcgcagagcttgtgcgccatggcggatatcccaggagcatcagcttcagcacaaatttgcagatctgactctggtgttgctgtccatagactaccactaccactacgactccgtgtccgtgagcgcgcccctccctacccatcgacacgaaagctggatagctgtcttgctttgcatccggatgaggcgggaggtataggaagatacgatgagatgagagtataaagatgctgagtgctagcctagccgcccgctgtatagcttttgcagcgcgctgctgacaagatcgagggccgtgacctactcgtttcaggctcttcttgaatggtttttttgtcgtggtccattgttgtatattattcaacttgagaaacagagagtgctgctctgtctctgataaaagtttatatgaaattgataaaaagtttctgctttttccaaaaaaaaaaaaaaaaaagtacct

SEQ ID NO: 2567 - DNA, 879 bp, Zea mays
  misc_feature (1)..(3): n is a, c, g, or t
  misc_feature (852)..(852): n is a, c, g, or t
nnncgaggccggcccgggaaaaaaaaaaaaaaaaaaaaaaaaaaaaaaaaaaaaaaagccaacccacgacgccgacctccacacattcaagcacctcctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcgccaccgccgccgagaccacgacgacggtggaggcgaagaagaacgccgaggaggccgggaaggagaagctggcgcagcaaagctgatcgactgtccgtgcatgcgtgccaattaatataattggctgatgatgcctgatgttcagtgtgtgatactgtgatcaagcaaggagacgacacttgaattctctacagtttggcataggtcgggagagacactctcgaccggccacaccatgtaacaaactaaccttcttcgttgtctcccattattttcctccacggagttcttctgatgaaacaacatgttctaattgggcttactgtggatgttgtctccattattaattaatcgctttgccccgaattattattgcatcaaaaaatcactgncttattggtattattttttgtcagaaa

SEQ ID NO: 2568 - DNA, 843 bp, Zea mays
  misc_feature (841)..(841): n is a, c, g, or t
cactccttagggcgattgggttcctcgagcccggccgggacctccacacattcaagcacctcctcctcccccgccggccaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtggtcgctccagaggcggccgtcgccgagcccgatcacaaggaggaggaagccgtggagaagaccgtcgtcgaggaggagaagccagcggcagccgccaatgcagaggaaaaggtcgccaccgccgccgagaccacgacgacggtggaggcgaagaagaaggacgtcgaggaggccaggaaggagaagcaggcgcagcaaagctgaccgactgtccgtgcatgcgcgtgccaactaatataattattggctgatgatacctgatgatcagtgtgtgatcgagcaaggagacgacacttgaattctctacagttggcatagcggcataggtcgggagagacactctcgactggccacaccatgtaacaaactaaccttcttcgatgtctcccattattttcctccacggagttcttctgatgaaacaacatgttctaattgggcttaaaaaaaaaaaaaaaatccattgccaattaatcgctttgccatgaattattattcacccacgcaaaaaaaaattttgcggcttgcggncc

SEQ ID NO: 2569 - DNA, 833 bp, Zea mays
cactcctatgggcgattgggttcctcgaggccggccgggacctccacacattcaagcacctcctcctcccccgccggccaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtggtcgctccagaggcggccgtcgccgagcccgatcacaaggaggaggaagccgtggagaagaccgtcgtcgaggaggagaagccagcggcagccgcccatgcagaggaaaaggtcgccaccgccgccgagaccacgacgacggtggaggcgaagaagaacgccgaggaggccgggaaggagaagctggcgcagcaaagctgatcgactgtccgtgcatgcgtgccaattaatataattggctgatgatgcctgatgttcagtgtgtgatactgtgatcaagcaaggagacgacacttgaattctctacagtttgccggagagacactctcgaccggccacaccatgtaacaaactaaccttcgatgtctcccattattttcctccacggagttcttctgatgaaacaacatgttctaattgggcttactgtggatgttgtctccattattaattaatcgctttgccatgaattattattcatcaaaaaaaaaaaaaaaaggggcggccaaaaaaaaaagcggcc

SEQ ID NO: 2570 - DNA, 847 bp, Zea mays
cactcctatgggcgattgggaccctccggccgggccggacctccacacattcaagcacctcctcctcccccgccggccaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtggtcgctccagaggcggccgtcgccgagcccgatcacaaggaggaggaagccgtggagaagaccgtcgtcgaggaggagaagccagcggcagccgccaatgcagaggaaaaggtcgccaccgccgccgagaccacgacgacggtggaggcgaagaagaaggacgtcgaggaggccaggaaggagaagcaggcgcagcaaagctgaccgactgtccgtgcatgcgcgtgccaactaatataattattggctgatgatacctgatgatcagtgtgtgatcgagcaaggagacgacacttgaattctctacagttggcatagcggcataggtcgggagagacactctcgactggccacaccatgtaacaaactaaccttcttcgatgtctcccattattttcctccacggagttcttctgatgaaacaacatgttctaattgggcttactgtggatgttgtctccattattaattaatcgctttgccatgaattattattcatcaaaaaaaaaaaaaatttgcccccccgccctcagctttg

SEQ ID NO: 2571 - DNA, 1667 bp, Zea mays
ggctcgcccggagccgacacacacaccgcaaaaggcccacgagaagaccccgccggcccgccctctccctccccacctctactccacctccaatcctccccgttgctgtcccgccggcgtcgaagctcgagagaagggtgagcaccttgccgcgaggtgtgtccggtgagctagctagggacgcgccagctcgtgctgatctgacctggaagctctggaggcgatgaaagcgctcggacgggcgatgagggatgaaccaggtaggaggaagaaggacgcatcgtggcggatcttttcactgaaggagcttcagtcagcaacgaacaatttcaattacgataacaaggtcggcgagggtgggtttggcagtgtctattggggccagctctgggatgggtcacaggttgctgtgaagaggctcaagagttggagcaacaaagctgaaacagaatttgctgtcgaggtggagattctggcacgggtgaggcacaagagccttttaagcttgcgcggatattgtgctgaaggccaggaacgcttgatagtctatgattatatgccaaacctgagcatacacgcccaacttcatggacagcacgcagcagagtgcaatctcagttgggaaagaaggatgaagatcgccgtcgattccgcagaagggatcgcttatctgcatcaccatgcgacgccacacatcattcatagagatgtcaaggcgagcaacgttctcctggattcgaatttccaagctcgggttgctgactttgggttcgccaagctagttccagacggcgcgacgcatgtcaccacaagggtgaaaggcacactcggttatctcgcaccagagtacgcgatgcttgggaaggcctctgaaagctgcgatgtcttcagtctcggagtcatgctcctagagcttgccagcgggaaaaagccagtggagaagcttaaccccaccacgaagcgaaccatagctgagtgggctcttcctctagctcgggacaggaagttcaaggaaattgccgatccaaagctcaatggtagcttcgtcgaggacgagctgaagcgaatggtgctcgttgggctcgcctgttcccaggacaagccagagcagagacccgtaatgtctgaagtcgtcgagctgctcagaggagaatctaccgagaggctttccaggctggagaatggtgatctgttcaagcctgatatctcgttccatggctcatccggacctgatagctcggactgcgtcacggaggagaggagtcccaaggcagatgcgacagaggaggctgttgattcaagtgagacggttccctcagcaaggtagtgtgatgcacggtggtgtactgtcagtaggtgccctgagctccttgcctgggggaaatgtgtttatcagttcatttttgtggttattccttgctatttagcaagttaatctgggagcctccttgcccggttctcttgtgtggtgtcattccttcgtgttggcatggttctatggcttgtaaaattctgtatgtaaatctgggcctggttccatcccttcgtgtagcaagcagttcactgcactgtggttagcgttttagctacttcagtccattaatgatttgtgtgtaagtctgtaatatgtatttttttaggtttttatgatggaacttcgtttttct

SEQ ID NO: 2572 - DNA, 1524 bp, Zea mays
gtttacggcagtggaaagtggtgatgcgctcagccgacacacacaccgcaaaaggcccacgagaagaccccgccggcccgccctctccctccccacctctactccacctccaatcctccccgttgctgtcccgccggcgtcgaagctcgagagaagggtgagcaccttgccgcgaggtgtgtccggtgagctagctagggacgcgccagtcgtgctgatctgacctggaagctctggaggcgatgaaagcgctcggacgggcgatgaggtgggcttcctgctgcaagctctcggacggggatgaaccaggtaggaggaagaaggacgcatcgtggcggatcttttcactgaaggagcttcagtcagcaacgaacaatttcaattacgataacaaggtcggcgagggtgggtttggcagtgtctattggggccagctctgggatgggtcacaggttgctgtgaagaggctcaagagttggagcaacaaagctgaaacagaatttgctgtcgaggtggagattctggcacgggtgaggcacaagagccttttaagcttgcgcggatattgtgctgaaggccaggaacgcttgatagtctatgattatatgccaaacctgagcatacacgcccaacttcatggacagcacgcagcagagtgcaatctcagttgggaaagaaggatgaagatcgccgtcgattccgcagaagggatcgcttatctgcatcaccatgcgacgccacacatcattcatagagatgtcaaggcgagcaacgttctcctggattcgaatttccaagctcgggttgctgactttgggttcgccaagctagttccagacggcgcgacgcatgtcaccacaagggtgaaaggcacactcggttatctcgcaccagagtacgcgatgcttgggaaggcctctgaaagctgcgatgtcttcagtctcggagtcatgctcctagagcttgccagcgggaaaaagccagtggagaagcttaaccccaccacgaagcgaaccatagctgagtgggctcttcctctagctcgggacaggaagttcaaggaaattgccgatccaaagctcaatggtagcttcgtcgaggacgagctgaagcgaatggtgctcgttgggctcgcctgttcccaggacaagccagagcagagacccgtaatgtctgaagtcgtcgagctgctcagaggagaatctaccgagaggctttccaggctggagaatggtgatctgttcaagcctgatatctcgttccatggctcatccggacctgatagctcggactgcgtcacggaggagaggagtcccaaggcagatgcgacagaggaggctgttgattcaagtgagacggttccctcagcaaggtagtgtgatgcacggtggtgtactgtcagtaggtgccctgagctccttgcctgggggaaatgtgtttatcagttcatttttgtggttattccttgctatttagcaagttaatctgggagcctccttgcccggttcaaaaaaaaaaaaaaaa

SEQ ID NO: 2573 - DNA, 2837 bp, Zea mays
acacctccggttttggtccggattcccgggtcgaccacgcgtccgcatctcctttgcctgtgcagtgcccaactgaagtcagacatgcggcatgtggcaggaactaatgaggttaaaagttcgatgcccaatggaagcttgcgagagtcggtaattgtcctgcagcgtcctcaatctgcaggtaccaagcaaagcctaccatccactagccatagcatgtttgcgtcagagccatctgcaagggattggtacttaaatggcgcatcaggtgtcaatatgatgttgaatgggggcttaggtcatggactaaggaatatgagcttggacagtgttagttctggcaggtcgtttgggcatgcaaaccatcaacaaagttttgtttctaatcctatagagttggctgccaatggttggggtggcacatggagttctggaggtacatcatcttcccgtcctgtggtgtcatcatttggggcgtttagagggtggagttcatccgagtcgtcccctgcattgcctcattctgattggagagccaatggggcagcaccttatgactacacctcagtagactggagcctggacacaacgttattgaacccagcagcaaagagcgagcggctgtcggacacatggtcaaccatgttcatgggtggcagatcaacaaggacacctgggaacctcagtggcgcaggcatagctgggttgcatgacagtaaccatccaatggatcctgctccatcacctcgtccatatgagtggcctactttctgcaggggaggatcttcctagttccccctaccatgtaggtaagaggacattgaataaaaaaagtaaaagctgccatttgtttcttttcttgttttggtctcaggtgcagttggttgaaaaagttttactttgtgtatcgaactgagcttgtgtaccttgactgttggctgagataagtcatctttctgtgaaatcgttgtgcatgaaaaatgaaggaagagaactgaatctatcttggctgaaatgcaggtaattgtttttattttacttgctataatagtaacttactaattctttctcacagttcggcttagctgccatgtgcattcttgcttcacggacagtgtttttactgcggtccttctgaaaaaaggcacacacgtttttctcttcttttctttacttggttgcttattaccaccgaaacttgtatatgtgtttcatcaaccttcaagagaagaggttaaaagaatattatcatgttttacattggcgtagtgtaacctgtgttttatccagaaaatgcaggagttttcctatatgttggcaatgtgtattttcttcacagtgatttatgcacatgagaccaattgtgactccaaaccatttgaagcctcttttcttcttcctggtttattcaacgagaacatcgaatttagctttctcggtctgttgggctggccaatttcctcgtgatgactgatgggatcagtgtttgaaactaggtagcataaaatggcatgttcattcagattatatgatcctattatgaccctcaggggttctcggtacaatatgcataccagagtatatggtgtttgtaccgcaacttaaatatttgtctcacaattgaagtggtgctttcatgctgactaaagcaggagtggttaagcgttttttactgttcgaatttgtcatctttgtgcatacctgctcgtggttccaatttgtgcatgtgcaatatcgaagaatgctgccgattctgttttttatttaaaaaatataatatatagtagaattatccatcctgcttgcttgtctttctgagttgtgcatgcgcaacgatttggcttgggtggtggtgctgaattcatcatgggataagctaagcttgatggacacgattctttgttggctatgatgggtccgtttatttgtttttttttgctccgccctgtgctgtgattcatggtgcaaatcgagttttcttaaaaaatgactgacctaataagcttctgaaggggtgcgttaacgctcattgggttgctaaccgatagttcttttgttatgagattgttcatctttttctatttagattaaagttgttgtgatcttggtttaacgctcatatataatgttgaggaagtgttggagggtggaaaagtgctcccagcaggatttcatatttcgttacaagaccaggatcgagcttttggtgcaagtttgtgatcggtctttgatggccgctgcgctgaggtgcgcgaaatcagggcaaatttggtttggctggcacacctacagcttggtacggagtacgctggacaaaaaaagaagtcgggggacattgccgcatccacttcacctcgtggtcaagttggcggcgaagcaagcgaatgcgacccgctgccggagccagctgcccatttttctagtcatacgcgtctgagtcagaccatgttcggcagggacgcacgcacggccgcgtggggtgccgtccggtgcggaagcgaggggggcacgtcttctccacgcgcgtcgccgtccgacctcttgcattcgattcggacggagtaggagccggacgcgaagttattccggcgcggtgcggcagtgcgactttgatcagattaattcggagcatgagccgcggactcgacgcgttggtaccgatcagaccacggtccacacgaccgcagccatgcacaggcacgggaatgacgcttgacgcgcggcagtgcgccgaaggccgaagtggcgcggcacgacggatgacgacccaacgtccggggacgtgcgcgggaggcaccggccgatcccgccgcgacacctgcgcgcgcgtcacgggc

SEQ ID NO: 2574 - DNA, 1083 bp, Zea mays
  misc_feature (12)..(12): n is a, c, g, or t
ctcacaacagangtgaatgatataaagagggcagtggcaccgtcttcggcgcgggccacaatcagttttcaagaattaaaccaaaagaaataccgcacgccactacttctagggattggcctacttgtactgcaaaatcttagtggaatcaacggtgtactgttttatgcaagtagcatcttcaaagctgcaggggttacaaacagcgacttggccacctgttcacttggtgctattcaggtccttgctactggagttacaacatggctgttagaccgagctggacgacgcatccttctcattatttctacctctggcatgactctatgccttcttgccgtttctgttgtattttttctcaaggataacatttcacaggattctaactcgtactacatcttaacaatgatctcccttgttggtattgtgtctttcgtcattaccttctcgtttggtatgggtgccattccatggctcatgatgtctgagatcctcccggttagcatcaagagccttggcggaagcatcgcaacactggccaactggctgacatccttcgccataacaatgacgacgaacttgatgctcacgtggagtgttggaggcacttttctctcgtacatggttgtgagcgccttcaccatcgtttttgttgtcctttgggtgccggagacgaaggggagaactctagaggagatacaattttcgtttcgctgagcattcagcgttagctgcaatggttgcccgagtgtttatcttagggcctgtttagatctcatgagctaaagcaaaaaggagctaaaatttagtcactttataaactaaagttccaatcaagaggagctaaaagtgaataaaattgtaaaagaatatccttttagtcaattttagattctaaagaggagctagaatttagtcccttgttttagcttatactccttccatcctaaaaaaatataggtctttctaacttttcttttttctgttcatattcattcgaataatgataaatatagacatacgtataaactattcattaataaatgtatccaataaattataggcctgtttggtttgctgtct

SEQ ID NO: 2575 - DNA, 4416 bp, Zea mays
cttatacaaacacattagtattcaaaagcaatgtactaagtctagaaccatatctgtaatatgatttgaatttctctctttgtttagcacataagaactttatcaatcgtgttagacatttaatcaccaaaacattatagaaatgggccaagggtatatttccctttcagtatctaaattattaatacagttaatagacaatatgtataaaacgttgtgaagagacagactcttcgcgaagagcctgtgtcttgatttttttacttaacccctagagactccttaagaaacccctcgttcaatgggattgtacatgccctaatccctataaatgatctctagctaaaatagcaacccctcacactagaggacccaataccgagactttcagacctatgaggctctcatacttcgacgcatgttagagaggatgggacctgaggccttcatgatctacgaggtgttactagactttctataaaggtggttgtgaacctatttgcactgacgtttttcagaactgccaatgctaagtgcgagtagaaacaattatttgtacaggcaggtaactgagaaccgccagtggaaatcgatttctactggcggtcaaggtaataaaactgatagtgtcatcgagagtagtgctaagggccatgaggtaggagttccacaaataaaaaccaatccaattttaactagagttaattcttgatatagattttttatattgataagcatatttgttttccaggttattgtaagttcaagttcaggtcccagcgtgcatcttttgtagcatgaaagctaaaacctttcctttgtgctccaagaacatttgatcttatcctacattcttgcaatagctctttctcttccgtcaagggtttcaccaatggcttgtaacaactgcatgcagaacgatttttgttttttaaccgatgtagtgtgtttttgcattatagttcaatgcggctatggggcggcacatttggtgatgtatacaagaggtgttttctcctattttgttggtttttttgtttccggtgtcacaatagtcatcgtgaatttaatagtaactagcactgaagttgtgattggtttatgaatgtgtttagttggacctatcaattggatgtttgttggctcatcacatattctttttaagtttgctttgtgtggtcgtggacgttgtctttataaagtctaggttcaatgttttaactctcgtgtcaacacacgagcacatacctagtattttgcacatgacaacaagagcactaaccaaaatagtggtatccatatagatgccacatacaatgatggaaaggaaaactcatactatggtcacatcgaggagatggacacattaagatgtacatgtttgttaagcaacaagcaaaccactaggcaatgtaattgtatttgtgacaagaggaagtatgtccatcaaatttgtaatgaacttacaacaacatttatcatatttttttaaataacagatataaaatttggatgtttttcgttgtagggtgcaaatactgcataaaaagatttatgtaaattttttttataacatgattgacgacataaaaggttagcaccaattccatgtatatctgtttcaaaatatcaaatttgctctaatagttgggatatacaaccctagtattaatatacggtttctataatactctctccgttctaaaataatatgtgttttagcttttatttttttatgactatactgaaatgtttgatgatgaatctagacacatatatataaaacgcatacactaaatgttgtatgaatctaataattgtcgaaaatgaatttaaatttgggatggagggagtattattagtatccttcccggccaaaagtaaactggttctcgtcgctaaaacaatgaaattactggcacgttgcatccacagatcaacccaagaaatgggaccaaaagattccgttaatggacaaagcagaaacgacgaaacgggatcaaaggggcccgaagataaagtcaaattaatccgtgcatgcatgcatgcgccgcttttttttttttttttttgacataataattcacatttttatttaaccgcatggcccactcatcatatctctgtccctctctctctctctctgcagtatttactaattaacaacagcgtatgtattactttacatgtgtgttaaacacttcaaatgtactcatcacatgaacttttatccgctgctaatcaacacagcaacatgagaatagaaagggggaggggtaacaccagatgaaatgcccgtaagaatttgcatctgcagactatatatagacagtaattaattcacactgatggactgtttcttgttccgtggtttctttgcattgagtacgtgatggattactggactagcaccagttgcttagcccgccatggacgtcgaagtgcaccgggacgtcatccttgccgccgtagacacactgccccggctgcagggcgccttgctggctctcggcggcctggaaggcactgtcgaagtactccgaccacctgagctcgtccagcgcgccggcgtagcagctgccgacgacgtggccgccggcgtcagccaccgcgtttgccccgagctccagccatgggaggttgccgccggcggcgacgttgttggtgctgcagtgttccgcttccgccatcgaggtcagcgtgctggagctggcgctggcggaggccgacgggacgaccggcgccggcgggatggggccgcagtgctgctgcagcgcgtccatgtcgaagcagcccccctgcaggtagcatggccttgacgttaccccgtcgccagcgacgggccagtccagctccaccgctagcttcacgctctccagcattgggccgccctcgaacgacggcggcggcacctggattgtagtagtagtagtagtcgggatgaggtcgacgtccccaaacaccgcgcggcgggagaccgtggtggtggtggtggcagtggctgcggcggcaggctcggcgagcggctggtgggtggcggggtcgatgccgcgctccctgagcctcttcttgatgtacgagttccagaagttcttgacctcgttgtccgtccggccaggcagctgggccgcaatctgagaccacctggccatgtaaccgttcagattcgttctccattactgctcgccatgcatccatgcatgaaaattaagcttacttgtttcccagcaaggagtggaggtgtatgatgaggtcctcctcctcttgcgagaatgtgcccctcttgaggtctggcctcaggtagtttatccacctcagcctgcagctcttgccacacctgtcgaggcctgaacagcatgaagaaacaggttagctactagccaagtaacaccgtaatgcacgccacagcttacattctgctgctgctttttcatgagcttgttgctggtaattctgggcgcgcatgtatgtatacgtgcaaaaagcaagtgagatataatatacctgcaagcttgggtacggagctccagcagccgtggccgtacttggcaatgtggttcatgagcttctcgtcctcctcgggggaccagagccctctcctaagcttcttcttgtggcagcacgactgcttcgccatgccgggatagcctggcgccaggagctagcaagctaaaaccccagccggccgttggcctcgcgcgcgcgccgaccgatccttgacgatgatcgctcgttatatggaaggcgagatgtgatggcggcaggctactaggagccgaattgaagagaggccaggagaaagagaaagagaaagagagagaaaaggatgccagcatgcaccagcagccagcagagccgatgtgtgtgtgccgagctgcctggagcgagcgagagaggaagagggaggtcgccgtcgctctcaggtaggtgccggtacagtgcggtgcggtgccctccgcttggcctgctggccgcctttacaagtggagcaatagcgtgcgcccacactttgctgggttgcacagcgcagcgcagctcgcttctcctcgctttgcgtagagggccgccgcccggcggggtagccccggataataataaataaagtggccatggatggtgccgtgataaggcaatcttcgccagtgcgtgctcataggcaggaggaggggcctctgtctcttgtaactgtccacacagctgtgtgtaggagcagttgacccctcgtcgccgacccttcctctcaatttctcacctcctttttctcctttccttcccatgcatgatgtcttcactgaccttgcttttccagtaatctttccttaatcattagaaccagctatcgattgtcgtgagttgtatcgcttactcacaacacaggaaactacataaattctgacggcttataccatcagacgt

SEQ ID NO: 2576 - DNA, 1645 bp, Zea mays
gcacgagaccattacctagaacatcctaatcgaaggagccagggaccaaatcaactcaagtcatcgagtccacagctcgcgcgcgcagccaatcgctctccctccggcctccacagcccaaaaccacctcggccccacttcttctctccgtcgccccctgtttgtccaacccatggcgacccacgccagcgacaatggcagcgggcacgcggagtggcggttcgctcgggcggcgaaggagggtgcgctggccgtggccggggacaagatgagcatccgggcggcgcggttcaagatcagcgcgagcgtggacgggcgcgacccgcggcccgtgctgccgcttgcgcacggggacccctcggtgttcccggccttccgcaccgccgccgaggccgaggacgccgtggccgccgcgctccggacgggcaagttcaactgctaccccgccggcgtcggcctccccgaagcccgccgtgctctggcggagcacctgtcaagtgatcttccatacaagctgtcaactgatgacatcttcctcaccgctggaggcactcaagccattgaggttgtcgtctcagtccttgcccaaccgggcgccaacatattgctcccaagaccaggctatccaaattatgaggcgcgtgcaggactgcacaacttacaagttcgccatttcgatctgattcctgagagagggtgggaaattgatatcgactctctggagtcgattgctgacaagaacaccaccgcaatggtcatcataaaccccaacaatccttgcggcagtgtctacacccgtgaacatttagccaaggtcgcagaggtagcaaggaagcttggaatactagtcatcgctgatgaagtgtatggaaacctggtgtttggggacaccccttacgtcccaatgggtgtctttggccacattgcccctgtcttgagcataggatcactatcgaagagatggatagtgcctgggtggcgacttggttgggtagctgtatgtgatcccaacaagattctgcaagaaaccaagatcattgcatcaataacaaacttccttaacgtttcaactgatccggcaacttttgttcagggagcacttccccatattcttgagaacacaaaggaagattttttcaggaggatcattggtctgctagcagaaacctcagagatatgttacagagaaataaaggacatcaagtgcatcacctgccctcacaagccagaaggttccatgtttgtcatggtgaaattaaatttgtatcttttggaggggattcatgacgatattgatttttgctgcaagctggcaaaagaagagtctgtgattttgtgtccagggagtgttttgggaatggaaaactggatccgcatcactttcgccattgattcatcttctcttcttgatggtcttgagaggatcaaatctttctgccaaaggcataagaagaagaatttgcttaatggccattaactgtatctacgttcaaagttacccagttccattgttttccattgtatcatcaacaaatgtggaactttgaaatccctctgaattaataaagttttccttgaataaaaaaaaaaaaaaaaaactcgagggggggcaaaaaaaaaaaaaaaaataaaaaaaaaaaaaaaa

SEQ ID NO: 2577 - DNA, 1659 bp, Zea mays
  misc_feature (1650)..(1650): n is a, c, g, or t
ggtacccccgcgggccggccaaccaactcgactcatcgagttccacagctctcgcgtcgcgcgcagccaatccctctccctccggcctacacagcccagaactcccttctccatctctctctctcgtccgtgtcgccccctgtttgtgtacaaccccatggcgacccacgccggcgagaacggcagcgggcacgcgaacggcggcgggcacgcggagtggcggttcgcgcgggcggcgaaggagggcgcgctggccgtggcgggggacaagatgagcatccgggcggtgcggttcaagatcagcgcgagcctggacgcgcgcgacccgcggcccgtgctgccgctggcgcacggggacccctcggcgttcccggccttccgcaccgccgccgaggccgaggacgccgtggccgccgcgctccggaccggcaagttcaactgctaccccgccggcgtcggcctccccgaagcccgccgtgctctggcggagcacctgtcgagcgaccttccatacaagctgtcgagcgacgacatcttcgtcaccgccggaggcacgcaagccatcgaggtggtggtctcagtcctcgcgcagccgggcaccaacatactgctcccgaggccgggctatccgaactacgaggcgcgcgcagggctgcacaacctggaagtccgccggttcaatctgatccccgagagagggtgggagattgacatcgacggtctggagtcgatcgccgacaagaacaccaccgccatggtcatcataaaccccaacaacccttgcgggagtgtctacacccgtgagcatttggccaaggtcgcggaggtggcaaggaagcttggaatactggtcatcgctgatgaggtgtatggaaatctggtgtttggggacacccctttcgtccccatgggtgtctttggccacattgcccctgtgttgaccataggatcactgtccaagagatggatagtgcctgggtggcgacttggttgggtggccgtatgtgatcccaacaaggttctgcaagaaaccaagatcattgcatcgatcacaaacttccttaacgtttcaacagatccggcaacttttgttcagggagcgcttccccatattcttaagaacacaaaggaagattttttcaagaggatcattggtctgctagcggaaacatcagagatatgtttcagcggaataaaggacatcaagtgcatcacatgccctcacaagccagaaggttccatgtttgtcatggtgaaactaaatttgtatcttttggagagcatccatgatgatattgatttttgttgcaagctggcaaaagaagagtccgtgattttgtgtccagggagtgttttgggaatggaaaactggatccgtatcactttcgccattgattcatcttctcttcttgatggtcttgagaggctgaaatctttctgccaaaggcataagaagaagaatttgcttaatggccattaactatattcgacttcaaagttgttacccacttccatcgttttccactgtatcatcaacaaaagtgtaacattgaaatccctcagaagtaataaagttaatgtttacatatgaaaaaaaaaaaaaaaaaaaacagtgggggggccccggccccaattcccctatatagggtntttaaaaaa

SEQ ID NO: 2578 - DNA, 1558 bp, Zea mays
cattgggtaccgcgtagccccgcgggggcccgaaccaactcgagtcatcgagttccacagctctcgcgtcgcgcgcagccaatccctctccctccggcctacacagcccacaactcccttctccatctctctctctctctctcgcccgtgtcgccccctgtttgtgtacaaccccatggcgacccacgccggcgagaacggcagcgggcacgagaacggcggcgggcacgcggagtggcggttcgcgcgggcggcgaaggagggcgcgctggccgttgcgggggacaagatgagcatccgggcggtgcggttcaagatcagcgcgagcctggacgcgcgcgacccgcggcccgtgctgccgctggcgcacggggacccctcggtgttcccggccttccgcaccgccgccgaggccgaggacgccgtggccgccgcgctccggaccggcaagttcaactgctaccccgccggcgtcggcctccccgaagcccgccgtgctctggcggagcacctgtcgagcgaccttccatacaagctgtcgagcgacgacatcttcgtcaccgccggaggcacgcaagccatcgaggtggtggtctcagtcctcgcgcagccgggcaccaacatactgctcccgaggccgggctatccgaactacgaggcgcgcgcagggctgcacaacctggaagttcgccggttcaatctgatccccgagagagggtgggagattgacatcgacggtctggagtcgatcgccgacaagaacaccaccgccatggtcatcataaaccccaacaaccctttgcgggagtgtctacacccgtgagcatttggccaaggtcgcggaggtggcaaggaagcttggaatactggtcatcgctgatgaagtgtatggaaacctggtgtttggggacaccccttacgtcccaatgggtgtctttggccatattgcccctgtgttgagcttaggatcactatcgaagagatggatagtgcctgggtggcgacttggttgggtagctgtatgtgatcccaacaagattctgcaagaaaccaagatcattgcatcaataacaaacttccttaacgtttcaactgatccggcaacttttgttcagggagcacttccccatattcttgagaacacaaaggaagattttttcaggaggatcattggtctgctagcagaaacctcagagatatgttacagagaaataaaggacatcaagtgcatcacctgccctcacaagccagaaggttccatgtttgtcatggtgaaattaaatttgtatcttttggaggggattcatgacgatattgatttttgctgcaagctggcaaaagaagagtctgtgattttgtgtccaggtgagatggatttgatttgttggaaaaaatcatatctgacaaaaactcattttggctctagcagttgtctgtttcgggttacaggtattccaggcctaaactgtatgtttgcgctcagaaatgctttaagaaaacagtgaattaatgctggaaaaaaaaaaaaaaaaaaaactcgagggggggcccggtaccc

SEQ ID NO: 2579 - DNA, 1080 bp, Zea mays
acgcaaggacaaaacggagtagtgagtgaggacgaggggatgccgtctcggctgccaaagcggcctggcagactcccggccggggcgcgtgaatcgtgccgcccggcccgaggcccaaacctgctggcggccgcgtataaaaaggtggagtggaggcacacttgactagccagggaccaaatcaactcaagtcatcgagtccacagctcgcgcgcgctgccgccagccaatcgctctgcctccggcctccgcagcccaaaaccacctcggccccacttcttctctccgtcgccccctgtttgcccaacccatggcgacccacgccagcgacaatggcagcgggcacgcggagtggcggttcgctcgtgcggcgaaggagggtgcgctggccgtggccggggacaagatgagcatccgggcggcgcggttcaagatcagcgcgagcgtggacgggcgcgacccgcggcccgtgctgccgcttgcgcacggggacccctcggtgttcccggccttccgcaccgccgccgaggccgaggacgccgtggccgccgcgctccggacgggcaagttcaactgctaccccgccggcgtcggcctccccgaagcccgccgtgctctggcggagcacctgtcaagtgatcttccatacaagctgtcaactgatgacatcttcctcaccgctggaggcactcaagccattgaggttgtcgtctcagtccttgcccaaccgggcgccaacatattgctcccaagaccaggctatccaaattatgaggcgcgtgcaggactgcacaacttacaagttcgccatttcgatctgattcctgagagagggtgggaaattgatatcgactctctggagtcgattgctgacaagaaacaccaccgcaatggtcatcataaaccccaacaatccttgcggcagtgtctacacccgtgaacatttagccaaggtcgcggaggtagcaaggaagcttggaatactagtcatcgctgatgaagtgtatggaaacctggtgtttggggacaccccttacgtcccaatgggtgtctttggccatattgcccctgtgttgagct

SEQ ID NO: 2580 - DNA, 1817 bp, Zea mays
acatggccctctagctagctccggctccgcccactctctatccagtagctagccacaggctctcatccgcctcttgttccttgtcttgttcatggatgcagagacactcaacatcttcccttcccagcccatgcatgtggagccgtcgccgaagggggagattagtttagtcctgtcaccggcgccggtgggatccaagcagcctaggtcaccggaccatcaccatcaccagcaggcggccatggaggagttggcggggagcaggaggcagcagcaggagcacctccacctgcagcaccaccaaccctttgctgccgctgctgagccagcagcacccgggatgatcaaagatgtcaagccactggccaagaaggatcacaggagaggcacatcgaccgctgaacgcgacccaaaaacgctgagaaggctggcccagaacagggaggctgcaaggaaaagcaggctaaggaagaaggcttacatccagcaactcgagtccagcaggatcaggctagctcagctcgaacaagaactgcacactgcaagagctcagggagttttcttccccaacagtggcatcctcgctgaccaaggtgtcgccggcaaaggcgtccccatcggcggcatcgacggcctcagctcagaggcggcgatgttcgacgtggagtacgggcggtggcaggaggagcactaccggctgatgtacgagcttcgggcggcgctgcagcagcacctgccggagggggagctgcagatgtacgtggagagctgcctggcgcaccacgacgagatggtgggcatcaaggagggcgccatcaagggcgacgtcttccacctcatctccggcgtctggcggagccccgccgagcgctgcttcctctggctcggcggcttccgcccctccgaagtcatcaagatgctgctgagccacgtagagcccctgaccgaacagcagatcgtgggcgtgtacgggctgcagcagtcggcgctggagacggaggaagcgctgagccagggcctggaggcgctctaccagtcgctgtctgacaccgtggtctccgacgcgctcagctgcccctcgaacgtctccaactacatgggtcagatggccgtcgccatgaacaagctctccacgctcgagggcttcgtcagacaagctgagaaccttcggcagcagacgctgcaccggctgcaccaggtcctgacgacgcggcagatggcgcggtcgctgctggccgtgtcggactacttccaccgcctccgcacgctgagctcgctctgggtcacacgccccagggcaccgcaggagcaataatagggccacagctggtgacggcggcgctgatgaatggtgatcgccggccgccgcatacaacggcgccacacgcgcatgtgtccattcatgcatatatgagtcgtgcatgggcgcatgcatggtgtgtcgttcgtcatcaagaacagagcttgcaggtagagccagttagggccggccgggggagagagagctagtgaggacgacaaaccaaccaaaggataatgttaatcttggcgacgattgtcgtgttgcttgctttgtagctatagctaggtgtagttgatcgttcgatcgcgatctatcgatcgatcggctgctgctgtagtcgatgcggtggagtgatgatgttgttctaagttaattatctctcatgatcaccggacgcatatgcttcgtagtcgtttaatttggagacgtgtgtggggttttaggcaaccgtcataaatctttgatagcatgtaacacatgctaatataagcttgctttgatgctagaagtcaag

SEQ ID NO: 2581 - DNA, 2556 bp, Zea mays
cgataatttttgttccatacccgtaccctaatagaggaattccccacaagttagcgggtatcgggtccccattgagatctctacttagaccttacctgccaagagaaggtcccattccatctcgttgctcgaagattttcaatctggactgcaaaactgggccgaattaagctcatcacacctagcccgtggggtttaccttccccttccttcgcggaccccaacttgccggaagcccgcaaccactagcttgatcgttccaaaaccctcatcgaccgcgtcgcatacggccatggaagcgcagaccgactccgcccccggcggcggcgacgatcttgcgatcatgcgcgagcagtgccggacactggaggagtccatttccacccgccgtgaggcgcagctcgacctcatcggctccctgcagcacctcgtccccgacctggtcccatccctcgaacaatcgctccgcctcatcgccgccttcaacggccgccccttcgtccccacgctgtaccccaacgccagcgtccacgtgcagaaccccaaccttaagccccagcaccgccgcgccctccccggcccggcccgctccacacgcctcaagacctcgccggggtcctccccagcttccgccgccgcccggggcgcgggaaccagtggtggcatccacgccgttcgtaccatggttgccgtctgtctcctcgagctcgtcccctttgccgagatcgatgccgccgcgctcgcgcgccgcctgcagtccgaaacgtcgtctgccagcgaggccgagcgcgctgctctggccgacctcgccgcggagcttgggggctccgcccccgctgctgttgctcttgccctccgtcgcatcgcagaagacagcggcggcttgcagatcgaggaggccttcattgggggcaagcagatgactatggtctgggccatcgaccggagcaaactcctcaaagagctaccagaatccgcttctgtgctccaaatccaacctccaccaactccacaggtggttcccctcgatactgatactaacatcataccaaggcctccgccactgcagcagtcggatatgtggggtaacccaatgccaccgatgttcccacgtcccaggggcatgacatggccaagaattccgccaggtttgatgccgctgcagcgaccattcatggcaccaggggcagttatcccaatgggtggtggtccggtgccgagttccacacagctgaagctgaggacagaggaagatgatcttaaggaccttgaactgctgctaaacaagaagacgtatagagagaagcagaatacaaagactggagaggagctgctggatctcattcaccggcctacagctaaggagactgcagtcgctgcaaaggtttgttctttcttcaccctgtgatgtttttaaccgagttgttggagctgccactggtaactacatgacggcttagtgtgaaagactaggcaactttatttttcaggtttggtgcttccattgtcagcacctggccgttgctaactcccaaaaatatagcctctgcgtctaacacattaaaactacctttttactttatatttatattgttggtattggtatacttttgaccttttgattatcattttttatcacctttgggtttttcctttcagtttaaaacaaagggtggctcccagctgaaggaatattgtaccaacttaactaaagaagattgccgacgccaaacaggttcttttgtggcctgtgataaggtcagtgttaatgttcttcttggttccctgcattggtaatttctcttcttttaggaaaaaaaacacacaccacattgaatgccatcacttttataagaaatcagtttgtccattgacattaagcttaaccacaagtttttatggcaaagttagaatctttacaagttatcataacatgcataactatcctttacctttactgcttccttttagttttttttaaatgagatcaaactggcaaggacaaaatctcagttccatttgtttatctaagtcaatgtgaggaggaatatgttatgtatttttatttgcaaattatttggaaactttgaaagacaactactgatattttgtgcaaacctaagtgcaattattttcacataacatgcaactataacctgcaaaaataaggctctgctttgtttagaaatctatcattttaatatcacatgatataattttctcagctatattcatatgattcattgaatttttggatccttcttccatgatttttaggtatcactgtttattttttatgtaattctgtttcactatgagcaggtccactttcggcgtattatagctccacatactgatacaaatctaggagattgttctttcctagacacatgccgtcacacaaaggtgaccatagtgttctttcttttgatataatgtctgtgatctgtttatcttttctatcttacatatgtaatatgttgtacaatatccagacttgcaagtatgtccactacgagcttgatcaaacgccagatgtacctcaaatgatggcag

SEQ ID NO: 2582 - DNA, 3527 bp, Zea mays
  misc_feature (3480)..(3481): n is a, c, g, or t
  misc_feature (3524)..(3525): n is a, c, g, or t
ccatattttattgagacaaaacttccatgtttgattggatggctaagaaatctgtatccttgtttgctcttattattcatgcgaatattgtgttatgtgtagccaggtagggtcatattagtgtgttttgtttccagcaatagctgagtaggttcagcttaatgttattctaagtatgtctctgtatttttgtgttatagccttataggtgtacttaacaaatgaaacaataaagaggatgacattaatgaaaggtttgattagtaagtaatgtattactatttttctttgttgaattcgatactctgtatttactgtttgccaagcagcccacatttttttatatctgcttgttgcttatgcctatattgaggggctgtttggttacatggaactgaactttagtgcctctcttttagtccctaaattactaaatatgaggactaaaagggaataaatcagatttcctcccatctcttttagtccttttttttttgataatttagggactaagggactaaagtttagtctcatggaaccagatttgctttattattactacctattaaggccctatttgggatagcttcagctccaataaatttggtagagttagtggaatataggtcattaggtgcttaaaaaaatcatggagttggagctgtaaaactttagaagacatttagataagtcattttgtttattatttagactaaaaatatttttaaaattatttaaattgatattataaactacagcttcacgctggaagctggagctggagccatcccaaataccctaaaaacatatcctgcgctccagctgcctataatgaattcaatactttgtatttactttttgtttttttagggtctgcttatactgatcggacagagaattaatttctttcataatgatctgccttccttgtgatttctattgatgcattccaaatctgacagatcatggctgcagttatatgcccctgtcacaaaatggattatggttgtgattgaggtttttatctactgtaccatttttaaaatagaagatgaacttatctactcttctcaaaactcaaaaagcatattctctcaaaaaaaaactcaaaaaacatagtgaaaacaaacgacctttttaactaaccattgctagaaaatatgactagaaacctggttcttgcctgacaatatagcccacgtgcctgacagtatgctcattttgtggtagtataaaatgcattcatgtttgtacaattccccgttttatagaccattaccacaaccttggagcctcccagtctattatccgataaccttcaaactcaaacatcggctctgcaattcacatgtcagcggcaaggctatcactgttttgttttcagttctagccttctaggtctggttggggacacacggctattcttgtttgctacctgaactttgtcgttggcttaaaaaaaaagctcgggatatatacacactgaaaagagtaaatcctggtgctgtcaaacaaccgcggggcggggaccagcgtcaggagacggcaaaattctcatttccctttcgtctccacatcagacttcccatcgagtcacggacacgtaaggcaccaccaccaccaccagggcacgccactgagccgactggttcggccgcgcggcgacgccatatggccgaacccaccaaaaatcgacggggaaaacgcatcggaatcgcccggtggccaagcaaaagtatgcgggaaaaaaacggctgcaaataccgcggcgcaggcgctgcgggcggcgagtccaactccaaaacggtccaacgccaacccaacggccacccccaccgcaccgcgcacacccacccctctgacccccacgctacgcctacgcgtttcgtctcgtgaggggagggcgatgcgataaaaccaccgcgtccaccccgcccgcccgtacccgacgcgacgatgcttccccacaactcgagcccctcacgtagcttccacccggcccccatccgcggcctccctcctccgttcccctttcccgttttcctcctccgcttcccgattcaactcgcaacgccgccgccttcgctgacccatgagcgggcgcgagccgatttaggcccgccgctacagagatttcgagagaatttttgggctagcggggtgtgaacagaaacttggtgccccgctgctctgccttttgtcgtccactgtttcgcgtcaattctcgcgcgaaaaggcaagttccagctgatttgggggaaattcgggtagtcccgggccgggatccgtcgatttggatttgcctcggggggagattgagtgctgattttgtggatttgatgtgcagggatgggcactggagaggggtcgccgccggcgaggcggggcatcagcggtaggcgccgtcgatggccggacgacgaggacgacgacgagtatgtgctggaggaggaagaagaagaggattatgtggaggagctctccgcctcgagcgccggcgaggagggggtggattcagacgccgagtaccaggaggcagaggaggaggacgagatcgagaagccgcgcccaaagcgaccagcgaagggcatcacatcgagcgccggcgagaggggattggattcagacgccgaataccaggaggcagaggaggacgacgagatcgagccgccgcgcctgaagcgaccggccaagggcagcacatcgagcgcgggtgaggaggggttggattcagacgccgaataccaggaggcagaggaggacgagatggagacgccgcgcccaaagcgaccggcgaaggacagcacatcgagcgccggcgaggatgggttggattcagacgccgaataccaggaggcagaggaggaggacgacgacgaaatcgagacgccgcgcccgaagcgacgggcaaagggcagcaacagagtacggaaaggaaaggtggatctggccgccgcacgatctcgacgccggaagtatgaggaggacgaggactacgaggaggaggttgacgaagacgacgaggtggaggaggagtaccatgatgaccttgaggaggtcgaggaggaggaagaagtggcaccacagcggccgaagagcattgtgaaatgcggtgcccgtggccggaatgtgaagctgtctctggcagcgaagcgatctcatcagcggaagcaggaggatgatgaggatatggattttgacccagagttggatgacgaggaggtcgagatagatgaggatattgattttgatcccgatgtcgatggtgacgaggaggatgagtatcaagacgaggaggaagaggaactggttcctgcccgtgccagaaaggtaactgtaaagaatccggtgaagcgaaagtccatttcaaagaggcgaacaccaaaaaaaaaaaaaaaaaataggggatctaaggtttctaggcggaagggggcttcagctaaagtgaagaaattcagcacctgttaggaggcggagaanncgtccagtgatagtggtttacgaggttgaggatgtggatgaanncg

SEQ ID NO: 2583 - DNA, 3525 bp, Zea mays
gttggtttggagtatgaggctatgagcacatgcggatgaccttgttatctggggtctagacagtgagaagattgcagagttcaaacaacagaagttgtttagtttgagtgatctggggatgttaagctactactctcggggatggaaggtaagcagaaataacctggagaaatcacatattatgctagagtgcttatgcatccaggataggtggagctgcgcgtctcagactggtggctggccggaaaggaactgaagtggatgtgagtatgtgaccaagtatagttgcgtcattggcagattgagatgatacttggtttacactaggcaagacattgcatatgcagttttggtctggcaagtcggttgatgatgcaggcaccaacgagtgaccactgggaagccgtcaagagaatagtcaggtgtacaactcagggaaaattgactatggctgcagattttttttttttttttgtgaaaggggagaatgcagacttagagcctattatattgactatggcggtgatctggttcatcgcagaaacagaagtacagaagccagtggctttgtcgtccacctgtgaagagctgaatacgttttgtctcagtgacgcagtagagtagcttaacactacatactgtaaacatcatcatttatcagcacgggatcctattctccaaaaggaaaaagacaatatttttttttgatcaactatgcctccctcatagctagagatagtaagcagggtctgcctgccggatgggctgttgatgaggctagaagatcgttgggcctcggaacggcaagcagacaaccctcaggttcctaggctgcgggacctcctccaaccatgccagccgacacgtctgctcctccgcaacaagcacgtcgtcgtcacagatggcaccgcctgtggctgtcgacctacaggtacagggacgaggacgatggtgttcgtaggggaggtcctggtaaaaggtgcagcgccttcggtccgtgggcgcgtagggcggcgtgaggacgtcgaggaacgcgcagtgggcgtcctccgcggccgcgaagcggtgcatgttcccgccgctgttggggaacagcacccaggcggacgccgctgcggtgacgccgtggtcgtcccgcaccttcttcgcgagcgtccggcgacgggagcccgagcagcagccggccaagacacggggacggacccagtcgtaggcctccaggcgcgctgacccgatgagcaccttcgtgaagaccgtcatgcccgggtggtcgtggagaggcatgaccgctcccagtggcaagaagaacaccgcgatctgcccacagccggaattaattggtttttgatcgatatatgatggatatatatattatattatagttagattagattcatacataccgtaaagttggcgccctcgtaaataggtttgcatgtgacgataggagggttttgaagaccagcggcgttcatcttgttgaagaagcggatctcgtccctgagcccgacgtcgtctggcccaatcttgtctgatgagaacactgaacacattagccagcagcgtaaaatcccatttatccgaaatgctcgcgtgcttggaatggaagagagataacgtacgacgtacccataatgccacggatcaaggcgacagcggaaggcgtcggcggggaggaggagccagtgagcagggcgcggcacgcactcaggagccgttggagaggcggcaccggggaaagacacggcttcacctgctgctgctgctgcggaggcccttcgctgccgctgccgctgtcgctcacgctgccgtcgtcctccgggtccgccgcgcgcttcctcttcctctccgccggcagcggcgcatccgccacccttcgcggtttcacctcctcctcctccacagcctcgcgccccagctccccatgcctatacctctcattgtctccgccagcgtcggtcttcctgagcacctccgcggccgcgctctttgcctccatattgccgcgctacactcgaaactagcaccgtgcgttcctgcaactagaagagaaattaaaaaatcacaggtaattaagtttgatttcagtgtgctaattaaagctaaggtctccggcggcacctatgggaaagatcgaaccgacgagcgagagtcgggcaggtgaggatctagcagtcctagctcgatagatgggtgaggatctaggccagcaagcgccggccggccattttatacacgcgcgcgtctcttgagatcaagtccctgcttgcggccggccgggaagggaaggaagaactgcatgcatggcatgggccgggggaggtgagcactagcgatcgagtagcgacgatagatctatcagcggataaacgttgttcacgcacgccacatgagccagcactagctactcacgcatggtggaatggtggattagacgaaaccagcagcgccgccccctcgtttccaaaagagctcgcgacggtgaaccccggccgtcgctctggtggtgtggtgcaagcaacgacgaccgacgtggtggcgagaagggcaacaagagatcgttggcgtttccccaacagcatgatatcttttggcggcctctagctgttaccttcctgccatattcgtcatcgactagctagctggcacggcacagactgctggcactggcagtacgtagctagactggtatacacggtagagcgaggagggggagaagaacgtgagtgcatgcctccggcgtgtccgtgtgccgctgcaggatgcatggcgcgcgcgaggcagctagcaaatgttgtgcacagctgggctgcaccagctgcccgttctctgtgtgctggactgctggtacatgcatgtacatcttgtgctcactcatctggtgtagtgatgtgtctggatctacggtttaatttgcctgcaggatttacaatttgttcagagattcagatagatatcgatcagggtgtcatgcttggttattgcttatgtagttatgttatcgacagataacatgaacatcacactattgttctccggcgaattgaaaagaaagatcgacaacacaaagatctatctaacataaaggaaacaaaaaaaaatcagaagtggtgtggtaccgtggttgcaagaagggcaaagctgaattgaaaatccgaattatatgccacacaatagagaatatatattgaacgcccaagcaaaataaagggtaagagtagaattgccaaaagattcatgaaatgaatgtacctgtgatgcggcggtgcgcgacgacatagggagtcggcctgaagacacctcccccaccagattaggctggaataggttgtcgatctcttcataatatctcgatggtgtatccgtagcaaagtcagtgtaagagatgagggaaactgccgatgaagaagaagggacacatgcatgacagatgcacgcacggaaaataagaagggatagtcaatggtggtgacatggctctggagccgccagccatggtcgcagatggggatagatgcttgaagc

SEQ ID NO: 2584 - DNA, 1415 bp, Zea mays
cccacgcgtccgcccacgcgtccggcggcgcccttttttttttttttttttttttgaaaggggagaatgcagacttagagcctattatattgactatggcggtgatctggttcatcgcagaaacagaagtacagaagccagtggctttgtcgtccacctgtgaagagctgaatacgttttgtctcagtgacgcagtagagtagcttaacactacatactgtaaacatcatcatttatcaacacgggatcctattctccaaaaggaaaaagacaatatttttttttgatcaactatgcctccctcatagctagagatagtaagcagggtctgcctgccggatgggctgttgatgaggctagaagatcgttgggcctcggaacggcaagcagacaaccctcaggtccctaggctgcgggacctcctccaaccatgccagccgacgcgtctgctcctccgcaataggcacgtcgtcgtcacagatggcaccgcttgtggctgtcgacctacaggtacagggacgaggacgatggtgttcgtaggggaggtcctggtaaaaggtgcagcgccttcggtccgtgggcgcgtagggcggcgtgaggacgtcgaggaacgcgcagtgggcgtcctcggcggccgcgaagcggtgcatgttcccgccgctgttggggaacagcacccaggcggacgccgctgcggtgacgccgtggtcgtcccgcaccttcttcgcgagcgtccggcgacgggagcccgagcagcagccggccaagacacggggacgggcccagtcgtaggcctccaggcgcgctgacccgatgagcaccttcgtgaagaccgtcatgcccgggtggtcgtggagaggcatgaccgctcccagtggcaagaagaagcggatctcgtccctgagcccgacgtcgtctggcccaatcttgtccataacgccacggatcaaggcgacagcggagggcgtcggcggggaggaggagccagtgagcagggcgcggcacgcactcaggagccgttggagaggcggcaccggggaaaggcacggcttcacctgctgctgcggaggcccttcgctgccgctgccgctgtcgctcacgctgccgtcgtcctccgggtccgccgcgcgcttcctcttcctctccgccggcagcggcgcatccgccacccttcgcggtttcacctcctcctcctccacagcctcgcgccccagctccccatgcctatacctctcattgtctccgccagcgtcggtcttcctgagcacctccgcggccgcgctctttgcctccatattgccgcgctacactcgaaactagcaccgtgcgttcctatgggaaagatcgaaccgacgagcgagagtcgggcaggtgaggatctagcagtcctagctcgatagatgggtgaggatcta

SEQ ID NO: 2585 - DNA, 2070 bp, Zea mays
atgacccaccgctgcgttcactgtcaggtgccagtccaatctaacgaacccagattttcaaaacagaccgctcccggcggccatgcccatgccgatggtgcggcagcggcagcggcggcgctgagcccgactgccagaaaccggccacgggatcaggtccgtcagaccgatgcctgcgcccgtcgcacctgtaacctccaggctgaagcgggaagactgcccccgcaccaagcacgactccctcttttccccatggaaggtccttgtcgggccgtcggactggagggaccacgccgccggcaaggaaggggtccagaggtaccgcatccgcaacctcccggacaacttccccggcctctacgagctaggcgttgcctgcgcggccgacgagggcgtcaggtcccggaggcgtgacgcgcgaggcgtcgtcgtggtgtacctcggccaggccgacagtgtccgggcgaggctgcagcagtatggccgctcggggtcgcatctggacactacgaactcgccgggctcttctgatagagatgcggcgaatgcgctcgccgagggtcctggactcttcagagaagtgttctccagaggctactccgtcgtgtttcgatgtgcgctgatggacaataaacaagaagctgagaagactgaagcactactcctgagagtatttgattatgcatggaacaagcttcagaatggtgcttgtcgccggcaagaaatactgcataagttagaactgcgagcagccaaccataggtctctacttagcagagtaagtgacatgaaacaaaaaatatttggacagaaagcaggtataaatataaagggaagtgggccagctaacacctcgcctagcataattaaaagtatgctcccaagggttcgtacaatcgttcgtttcagacctcagttagtaaaccctaacaacagtgaaggtgggataactggtattccctatgcaaatagacaagcacatagaaggaagtccaaaggataccaagtaaaaaagttcgatgttacaaaacggagaactgtgccgatacatgattctaactctgtctgtggagtgctgctggaagatggtttttgtctggagcacccagttcatggaagaaagaggtgcagcttacacaaaggtaaaagagtcaaaggcagcccaaaaagttcgcctactagccatccttgccaagttgggattgcaattactgagttttgcctaactgaagatttggacagctcggtcccaaaacaggaaagcgaaatacggcccaaaaatatgtctacaactctgaaagaacctcagaggcaaagcgataatttggaatcacaaaaggtgaatactggagaagcttctacagaagatggaacacaagaagtttctagggatgcttgtatcttagaagagaaggccttcttccatgctgactctgagtctcaggagcagcagccttctgggagaatgtggtttgagctgctcaaatcacagaggaaaccggcgagcgcacatccatcaagaagaggcttgggatctcagataacagcaatgacagataacaggtcctgcaaaatggtgtcaattgcaggaatggaaaggactgagaaggacagtggagtagaggtcactgctgcttcgttttccagaagctcaggatggccctgtacctgtggcgcccgtacgtcggacggttcacgttgtatgaatatgccgattgaagggaggaagagatgtgcattgcacaaagggcaaagggcagcattcccccctacaccatcggcataatagacaggacgggtttttttcttacttccaattgttgttttcacatttctgttagcaaattgaaacacagaaagctgttttcatatttcatgtgccccaaaacgactacatacattttgtaactgtattgctcatcattgaatttttcacatcaatttttaatgttttgcgcttcataggcttcctagttaccctatttcaaactctactatataaacaatgtgatttataatgcaaaaaagttttatacacgctctgttggagatagcctgcaggcatgcaag

SEQ ID NO: 2586 - DNA, 2155 bp, Zea mays
  misc_feature (313)..(314): n is a, c, g, or t
cattgggtacctcgaggccggcccgagaccactaatcctaaatcccctaggtcgtcaccaccgatcttatgcttccatctctgaggctgccgccagccaccggccagcgtcgttcgctctgtagcagtccagctctgcgcccggcgccgcagccccgcatcgcgcacaggcacaacttctacggtcctgccgctgatcgcggcctcttcagccccccttggtgatcggtcctcccccggcagactcgcctcctcggtcttgcgctcctgcgcggctgcgcgcccagcgccgtgcccggtggcagcggcgacgnncgacggtcagcccccgacagtccggacttccgactccggacctccccctcagccccctctgtccgtcccagtcccagctcgagcttgaaggttgaaacaacaagcaagatattttgaaatagcccccgccacgaaattcttcagccatcgtggaggggttcagttcaggggaggactcgactcaggaaacaggagcacgagcggagcagaaggcagtcatggcggatgaggtggagcttgctgcggaccagcacgtccgctacatcgtcacggtggagaagaagaaggactcctttgagtcgctggtgatggagcacatccgcctcaacggcgcctactggggcctcaccacgctcgacctcctccacaagctccatgccgtacatgccgccgaggtcgtcggctggatcatgtcctgctaccaccccgaatctggtggatttggagggaacgttgggcatgacccgcatgtcctctacacgcttagcgccgtgcaggtcctctgccttttcgatcggctcgatgtccttgacgtcgacaaggttgctgattgtatccttttttcccagattttgaattgggtttgtgctgttggtgtatgtaaaattgatatttaccaatctcctggtgagcaaagccagttctgcaactttggttttgttgttaagctcactgaacttggaatccagttcctcttccttatctaaatcacgccagatgtcgccggactgcaaaacaaggatggatcattttctggcgatatttggggtgaagttgacactaggttctcgtatattgccttatgtaccttatcattactgcaccgtctgcataagattgatgtgcaaaaagctgtggatttcgttgttagctgtaagaacttggatggcggatttggagctatgccaggaggggagtctcatgctggacaaatattttgttgtgtcggcgcgctcgcaatcaccgggtccctgcatcacattgatagagacctcctcggatggtggctctgtgagcgccagtgtaaagacggaggacttaatgggcggctgagaactagctgatgtgaggtttactctgtcacaagtcatgcgtggtctgcattcttcagtacatgtttccacgagcccgctatggatttaattgaaccctaccaaattctcaaggtttgctactcgtggtgggtgctatcgagcctagtcatgattgacagagtgcattggattgacaaggaaaagctaacgaaattcatactgaactgtcaggacaaagagaacggcggcatttcagatagaccagataatgcagtcgatatctatcacacgtactttggaattgcagggctttcattaatggagtaccccggggtgaagcctttggatcctgcctatgcactaccattgcacgttgtcaatcggattttcttgaaaaaatagaacattccattcgatctgcggcgcagagatatgctgagatggcgctgtcagatgtggacgctacttcacagaaccacgattcgacggagaaatagctgagggggaatcaattacaggaacatgttgggataccataatcttggacttgtattctcgcattggctgtggccgcttagtcgatgtttttttgtcatttggcacttgccctgttgaatgcttggtgcatgctgtgttttgctagttgatctgattctcttgtttaagtcgtaacattgtgtgtcctgatgacgacgacattagtcaggagctatctataaacagtatgtcttttttgtttgctttttttacaaatgataaacaaacttagccaaaaaacaaaaaaaaaaactcgagggggggcccggt

SEQ ID NO: 2587 - DNA, 2011 bp, Zea mays
cattgggtacctcgaggccggcctgggcccgtaaatcctaaatcctaggtcgtcaccaccgatcttatgcttccatctctgaggctgccgccagccaccggccagcgtcgttcgctttgtagcagtccagctctgcgcccggcgccgcagccccgcatcgcgcacaggcacaacttctacggtcctgccgctgatcgccgcacgtggccgcgccgccgcctccctcacccgagctcgaccgcgcttctccagctcgccgcctcgacggtcgctgcctcgacacctcccccgcgtgggcatcagccgggagcagagagccctggtccctggaggcgcgtcgcgttacggcgggggcgcggcctccccagccccccttggtgatcggtcctcccccggcagactcgcctcctcggtcttgcgctcctgcgcggctgcgcgcccagcgccgtgcccggtggcggcggcgaccggcgacggtcagcccccgacagtcaggacttccgactccggacctccccctcagccccctctgtccgttccagtcccagctcgagcttgaaggttgaaacaacaagcaagatattttgaaatagcccccgccacgaaattcttcagccatcgtgggaggggttcagttcaggggaggactcgactcaggaaacaggagcacgagcggagcagaaggcagtcatggcggatgaggtggagcttgctgcggaccagcacgtccgctacatcgtcacggtggagaagaagaaggactcctttgagtcgctggtgatggagcacatccgcctcaatggcgcctactggggcctcaccacgctcgacctcctccacaagctccatgccgtagatgccgccgaggtcgtcgactggatcatcccccgcgtccgccccgaatctggtggatttggagggaacgttgggcatgacccgcatgtcctctacacgcttagcgccgtgcaggtcctctgccttttcgatcggctcgatgtccttgacgtcgacaaggttgctgattatgtcgccggactgcaaaacaaggatggatcattttctggcgatatttggggtgaagttgacactaggttctcgtatattgccttatgtaccttatcattactgcaccgtctgcataagattgatgtgcaaaaagctgtggatttcgttgttagctgtaagaacttggatggcggatttggagctatgccaggaggggagtctcatgctggacaaatattttgttgtgtcggcgcgctcgcaatcaccgggtccctgcatcacattgatagagacctcctcggatggtggctctgtgagcgccagtgtaaagacggaggacttaatgggcggcctgagaaactagctgatgtttgctactcgtggtgggtgctatcgagcctagtcatgattgacagagtgcattggattgacaaggaaaagctaacgaaattcatactgaactgtcaggacaaagagaacggcggcatttcagatagaccagataatgcagtcgatatctatcacacgtactttggaattgcagggctttcattaatggagtaccccggggtgaagcctttggatcctgcctatgcactgccattggacgttgtcaatcggattttcttgaaaaaatagaacattccattcgatctgcggcgcagagatatgctgagatggcgctgtcagatgtggacgctacttcacagaaccacacaagttagattcgacggagaaatagctgagggggatcatttttacatggaaacaggaacatgttgggataccataatcttggacttgtattctagcattggctgtggccgcttaggcgatgtttgtttagcataaaaaaaaaaaaagtgtttcgctagttgatctgattttcctgtttaagtcgtaacattgtgtgtcctgatgacgacgacattagtcaggagctatctataaacagtatgtcacttttttttgtttgtttttttacaaatgataaacaaacttagcc

SEQ ID NO: 2588 - DNA, 2895 bp, Zea mays
cattcggttcggggaccgctcgaggccgaagctcacttcgctcccctctttcttccccacgaaaccagagcaaattccggcgagccggtgcggtgcggcggaggaggccgagggagacgccggcgcgagaaggagcatcaggaggaggcagcggagatggatccggactcggtgaagtcgacgctctctaacctggccttcggcaacgtcatcgccgccgccgcccgcgacctccaaaaggaaatggtggctaaagacaaggctcaatcagcacctgcaagccatgatgaagttgatcttgatgagctgttggatgacccagaacttgagaagttgcacgcggagagaattgctgcccttaagaaagaagttgagaagcgtgaagtgctaaaaaggcaaggtcatggtgaatacagggagataactgaaggggacttcctcggggaggttactggcagtgaaaaagtcatatgccatttttaccaccgtgaattttaccgttgcaagatcatggataagcatttgaaggcccttgccccagtctatgtgggaacaaaattcgtcaagcttgatgctgaaaatgctccattctttgtggccaaactggcaatcaagacactgccatgtgtaatattgttcaagaagggtattgctgttgaccgattagttgggtttcaagatctcagaagtaaagacgattttccgacaagagcgttggaaaatattctcaagacgaaagggataattgatgagaagaagaaagatgacgacgatgacgatgaagaaagcgaggctaagaataggagggttaggtcttcaactgctcaagactctgactcagactgaacctgagatgaggatcgaggactcaccgtttttgcactttggattttgtttgtttgtttgttctgtgttgtgctgtactgtactgtaattgatttgtgtaaccatgtatcggtaccagacaccacaacaagaacatgtacaagagattctttagcatccattgtgtgtaaaagctagggtttgtggctgccttttatttcgtttttcctcagccatcataggatggtacggctgatgtataatagattactatttgctatgtgggcgtcagatttgttttggcgtgcgctagagtgaaaaaggtcgcatgaaagcgaatctaaacccatgcgtgcttttgttttgtttttctgaaagggaatccatgcgtacttgagattctcattattagtacgtattagggtttgagcaacaattgtccgctgttgtgttcgctagtactctccagcatgcgtcctttttgcacctctctggacagcctgtgtccaggtctccttagattattttctccttagattattattttttctttctgtcagaaaaataagaaagaacgagatatctagagctgttagttactccctcggtcctaaattaaaatttattttacctttttactacatttatacaataattaattaatgtatgcgttgtatatatatatatctagatttataataatttatataaatatagacataaaaatttagatctaaaactattattattttaagacagaggaagcagtgaacagtgaatatttgtctagcccgtttagattgctaaactacccgttgctcgcattcgcttcgcgtggctccactccactccacccccacaggccctccttgctgtgctctcagcccctcacacacacacactgacacacggtcacaccaccagacccagacgcgcggtcacctctccggctctcccctcgttaagaaccaacaaaaacctgtgcctgcctgcctgccactctgcgcatgtgaccgagcaacccactgccgcccgggatcgagccgccgcattgccgcgtcccttctggagccgccgccgcccacgggggtaccggtgagtgaggctctctcgtcgtcgtttttggttacctgctgggctgggattctcgagttctaggctactgcactgtggaaccgggcggggtaggtaaggaagcagggttctttactgtgctaaagcctcggtggtttagggcgggtttcaagttcatcccagggcggattcttggcctggtttgggttctccggtgcgccgcatttgattgactcggggatcccttggttcttgctcgctctggagaggttcccacgccgatttcggggccgctttggtctggtatgaaagccacattctactgtgttagaggagaggatgagacattctactgtgttagaggagaggatgaggcagagggagggaaacattttcgcccccgttagcctaaaccccttttgctaattccgccccgcctgtaggaatgtagagggcaatgctggtttcagctttcaagaaccggattcgtgtactgccctagtcgtcgcctggggatttgggggctgcattgggaagattaccacggtgttgaagtgctgcttttgatgtagtaatggggtttttattatttttttctcacactgtatgatacagttgcttgatcagaggttggaattggggaaaggtctcactttgctggctccttttctcactctgctgtgccatcttatctgctggcatagccccctgtttgctttaaacataagactgcttgctttaatcatggaacaggctttcaagaaatacgctttgaccattgggtttggatttcgcaggtcactcgaggttattttgtgaataaaaaaaaagagtttctttgcttttttatttcccttgctctatgtttggttagttcttagacctgcaccatgtctttctctgatatcttctatcaatgtcaattgctctgtcctttttatcttttgtttaccagattaattaccttcctgaaatgtcaagttggctgcaggtcga

SEQ ID NO: 2589 - DNA, 1180 bp, Zea mays
gagcacgagaaattcatgaattaaccgtgtactctccccgatagagtatgtaataccggaatatatatagaattggattggatatacaacaagaatatccctacgaatacaatgcttccactgacctatctgctgctgcccccccatgccacagaatcaacctcatccctggcagatttgtacagctccagcctcttgaagcactgctgccggcgctccatcatcgccgggtcctcgtccagcatatgcccaaactccccagcctctttcttccccatctgcacgtagaaatggttgagcagagacctcttggcctcgcgaacctggcagtggacagctgccttggggatcttctgcaggagctcgtctccaaccatccggatgtactgggacacgttggaggcgatgctcctgaagtgcccgtcaccgtagcggtcaggaggcggcgcagccgccggctccgctgaaggcttgcctccagccttgctagcaggcgcatcagcaggaggatcctgagggagcttccggaagaactccaccgtcacgtacgcagcctccatgtccaccagacgaagcgccgtgctgcgcccgtcctcccggaatcgctccagggcttcgtttgcagcggtcgcgatcgctgcttgaagcgtcggaaatcttctgagttgctctgtctcccctatggatttcctgaccaagtcttttagaacaacgtggaccgcatcaaccgtggcttcagccggtcctctgaaatagttgatgcccttctcaataagccgccggtacccttgttcaggtgccatgagatggggctgatagccatctgcttctgaaaccaccttcttcacgttttgcaccgacaggtagcggtcgaaggaaagcttcttaaaagcagcagggagcttatggtcaaacacgccgtatattctatctccacctgacctccctccatcaagatgttccttgaaaacacggtcaaaagcacggcagaggtccagtatggtgtacagttgagcccctggatcagcagccacagctctccctatgtgggaacaaaattcatcaagcttgatgctgaaaatgctccattctttgtagccaaactggcaatcaaaaccttgccatgtgtaatattgtcaaataggtaggagtaatgaataacttgtaccggacgcgtggg

SEQ ID NO: 2590 - DNA, 2911 bp, Zea mays
  misc_feature (2814)..(2814): n is a, c, g, or t
tagaattaatattatttagtccctcttagttaccactcgagggattagatattaaaatgctttagtcatgttttagtctcatcgtttgttagtttagagactaaataagactaaaatatagggactaatctttacttcctcaaaccaaatagggccttagcaatttagagactaaaaattagtccctagaaaatagaaaccaaacaccttctaaatttttaattttatgtttcgcttactcaatttattagctttatttttttattacttagatttttttctttgtcctccgtcaatgtttaggctcgcctgcaggcgtcttgtttagtttcctataaacgtcataatttatctaagctttatcgtttgaattgaaaatttttaacagaaaaattagggtaagttgtgacgttttatacagagaaccaaacagaccatcaggccagcccaacacaacctgctcataaaccagaggttcgaagttagcccaaatgccgtgctgtccacctcctgccacggccaatttcgccacggaaggaagccctgccacgcacatcccaacgcgcatgcaacaggtggatgtggataaaccccacgtaaaccgtctggccttgcgggccccacgtattcagagtgtttctgctggccctggttgcctggttggcaaagaaaagcaccccgaaagccacacaaacaatttgttccccctgcctaggccgccgccggggaagcggggaaaaagatcccgtcccaatggctctcctcccccaaatcctccactctcctcaccccgcgctcgccgccgccgcctccccctctcgcgcattctgccgagcaccacgccacctccatgtctccgcgtcccggggccggggccgcggccgcctcgccacggcggcgggggcgtccgggcccggaccatcgtcgccggagccatctccccctgagtccgacgacgggctggtggagctcccgctgttccctctcccgctcgtgctcttcccggacgccacgcacgcgctgcacatcttcgagtatcgctaccgcatcatgatgcacacggtgctgcagaccgacctccgcttcgggatcgtcttcgccggcaactcggggtccgccgcggaggtgggctgcgtcggggaggtcgtcaagcacgagcgcctcgccgacgaccggttcttcctcatctgcaagggccagcagcggttccgcgtcgcccgcatcgtgcgcaccaagccctacctcgtcgccgccgtgcagtggctcgaggaccgcccgcccgcagagcccccggcgcccggggaggacgccgaggcgctcgctgccgacgtcgaggccctaatgcgggacgtcatacgcatcgccaaccgcctcaacggcaagcctgagaaggaggtcggggacctgcgcaggggcctgttccccacccccttctccttctacgtcggcaacaccttcgagggcgcgccccgcgagcagcaggcgctcctcgagctcgaggacaccgccgccaggctgcgcagggagcgggacaccctgcgcaacacgcttaactacctcaccgccgcctccgccgtcaaggacgcattcccttcctcgccgtcttcggggtgaagtgaggtgaggtgaggtcgtcactcgtcagctaggaatggatgaggataaggagtttgtggtcgtgggtataggactgaactttgttatcactctttcaagccctttttctttcttctttctcttattattatatattctatggctaggttctatctgcatggggttagcatcttagcgtgtaaaattgtataatttggtgtgtgttaactcaagaaaaattggagctgtgatatataagtccttgaaaaggacgggaattttgctctcagagagtgacttatgcttctacccttaaattggaccgaattgaagctaactcgttggtcaactgttgactctcgatttaaacaatttcaagtgcctctagaatgttctagtgggatagtttggatgtgaactgaagtagtgatagttgctactgacctgccttcataattcttgcaaatggtctgggatagtttggtgatgctgttcataatcatgtgccttcatattgaggaagcatgccacccgatacgaaagcattcttgaagttttgaaagcttgctttctgtctgaacctttgttttcaacctttttcagatgcatgttagaacagtttgtgtttcccctaacattatcaaagcaatgttatgcttcttgatgttatgacttgacatcaatctatccacccatctactgtttgataggcatagatcagagcagctgcgaaaaaaaaacataaatacttgtaagggagtatgttttctgcatttcaggttttcagtgtttgtctcgaatttaccaaggatagagaaacttcagctttgcaccgattccctatcaaataggcagacgtgtaagtggaatggttataaaacaagacaggtcgcatcattacatgaggcccaaatgacaaatcacagagctagtttgtcgtgcacatcgatcatcgccatggttgagttagtttgccaccattggtttccttgcaaatccgacattcgacatcaataatcgattctaacctccaccccgcccattccctcccctagtgacacctcaaaattgacaaggtttcatagaatgctgaaaatcagtctttgtatcaaatcgtaaattataagacattttattttttctaaattaaaagtctctgacaccagccgacttattatgcaaaattacattggcagcagaccagcagtacaatataanaaaaacacaactttaattgaggacaaatctaaaatagattaattatatagttccccggacaaaatctaaaatagattaattatatggtctaagccat

SEQ ID NO: 2591 - DNA, 1217 bp, Zea mays
  misc_feature (1017)..(1059): n is a, c, g, or t
  misc_feature (1061)..(1062): n is a, c, g, or t
  misc_feature (1066)..(1066): n is a, c, g, or t
  misc_feature (1100)..(1100): n is a, c, g, or t
  misc_feature (1102)..(1102): n is a, c, g, or t
cattgggtaccgccggcccggccgggacttcgcttcgcttttccttcacgaaaacagagcaaatccggcgagccggtgcggcggcggagggagacgcctgctcgagaaggagcattagcaggaggcagcggagatggatccggacgcagtgaagtcgacgctctctaaccttgccttcggcaacgtcatcgccgccgccgcccgcgacctccagaaggaaatggtggctaaagacaaggctcaagcagcacctgcaagccatgatgaagttgatcttgatgagttgatggatgaccctgaacttgagaagttgcacgcggagagaattgctgcccttaagaaagaggttgagaagcgtgaagtgctaaaaaggcaaggtcacggtgaatacagggaggtaattgaaggggacttccttggggaggttactggcagtgaaagagtcatatgtcatttctatcaccgtgaattttaccgttgcaagatcatggataagcatttgaaggcccttgctcctgtctatgtgggaacaaaattcatcaagcttgatgctgaaaatgctccattctttgtagccaaactggcaatcaaaaccttgccatgtgtaatattgttcaagaagggtattgctgttgaccggttagttgggtttcaagatctcggaagtaaagacgatttttcaacaagagcgttggaaaacattctcaagatgaaagggataatcgatgagaagaagaaagatgacgatgatgatgatgaagaaagcgagtctaagaataggaggattagatcttcaactgctcaagattctgactcggactgaacatgagatggggattgaggattcaccctttttgcactttatattttgtctgttctgtactgcaattgatttgtgcgactcatgtatctataccagataaccagaacaaaagcatgtacaagagattcttaacttatctaacttatgaacacgttcaaaattgagcttggcatatctcaattggccagcggccnnnnnnnnnnnnnnnnnnnnnnnnnnnnnnnnnnnnnnnnnnnannaaanaaaaaaaaaaaaaaaaaaaaaaaagggcggacgnanaaaaaggaaacaaaaaaaaaaaaaaaaaaagggggggggccgctttgggggttccaggtttacttccccgtgcttgcaaggttatagtttttttatgggggcccctaaattaaat

SEQ ID NO: 2592 - DNA, 1887 bp, Zea mays
ttgggtccctcgaggccgctttgcttccaaattaactgcgaaggcaaagccgtgccgaaggcctcgccgcgccgctcccacacactacaccctcgccgccgctgagactcggcaaactgcctcccgttccatgggctgcgtaggatccaccccggccaccaaagatgccgggggaagtagcgatgtcaatcatggcactaagagagtgaggaaacccaaagcttggaagcatccccaaccgataaccatggcccagctcaggcagatgcgtgaggagttttgggacaccgctcctcactacggtggtcagaaagaaatctgggatgcccttcgagttgcatcagagtctgaggtatcccatgcacaggctgttgtggaaagtgcaggcataattgtttctaatgccgatctgactctctgctacgatgaaaggggtgctaagtatgaattgcccaagtatgttttgagtgaaccaaccaacctgatccgagacagctgaacggcagccggccgtaggaagacccaccgatgtaaaaactgtaaatgactgcagatgccgccaaattggtcccttgcttgtggtaactggagtgcctcgagtaaccttcagatttgctttggcaactttcggcaatagggttttccagttctagtgttcagataaaaaaaaacttttgcgtaccctcgtctattgttcttggttctactgtaaacatgagtctgcttagaattctttggagcgagaatgctgctgagattgttctcgtccactatcatgatacaagctggagcatacgttttagaaacttgtcacatctcgtgcaactaattatattattatgtggtctggtctgacatttgaaaatgaaatgcatgataaggagcaaatcgcaatctaatttttacattattgcaacatatccgatgatactggagttttacactattgcgacatatctggtctggcctgatgctgattcatctagtggtagtgtggcgtggagtctgagaacctgaaccggctgaatgcctcctccatcgccatcaccatcgccagcaggtccagatccatcccccctccgtcttcgtcggcgacgctcctctcgcagagcgcgaaccggcacaccgggcagctgccgtgcccctgcacccagggggcgatgcaaccctggtgaaacgtgtggttgcagggcgtgaccgccacctgctctccaggcaggaacgcctccaggcatatggtgcagatcttctcctcttcactggtttccttccctgtccggaggttacctctgccgccgccgccgccatgcttcttctgcggcctgtattcgtccttcctcagctgatccatggcctctctgaactcctcgttggtcagtccagcgtctcctcgcctgtgtctcgggtttatggacgcgccactgccgctgctgccatggacacggtggatctggaatggtggctgcaacgggtgccaggaactggagcgctcgaaaggtggtcttctgaacctctgctccgaaagcctccaagggtaatccccatgatgcagaggccacggggacctcctcctggtcctggatggcaactgagggtaccaggcgtgctgaagctcacgagggacggggccgtactccggcccgtagctcccgtctgcccgccggccgtcactcatctcatctcccactgtggtgaccaccggggagggtgatgaccgatgagttctttgagggtgtcgctatgtgtagtataaccaaccatcgatccatgtactggggctcaggctcaccactcaccaggtggaatggagaatcaggtgcttatggcctatggggttgagcatcaggttctccttcaaatctcatctgatcaggcattgttctcgtc

SEQ ID NO: 2593 - DNA, 8346 bp, Zea mays
caagtaacatggcacttcatgaagatttaaatattaggaatataaacataatattctttctgtttacattacatagaattatacttctgtgggttcagctgagcacagtagcttattttctgaatcataatagtcaatgtttattgagtaatattgttgaagttgtatttacatctggttctcagccatactacagttgccctcttggtttctggataatcagctggtttgctcacgcaatcggtactatgaattggcaggaagaataaacttgctagttgccctagaagatgcatatatttgtgttgactagactacacagtaaggaagtagttacaccaggtgccctcttggtttctggacaaccagctggtttggtcatgcaattgataccatgaataggaagaataagtttgctagttgccctagaagatgcatatatctgtgttgactagactacatagtaagaaagcagttacctagtacaaagaataatggtaggaactataaaggttaaatctaaagatttgcattttttttgttccttcaaaatgtgtgcaagggaatctctgatttgcttactctcagttttatttatgtatgagcatgtccctgccttgtatcatgttctttcacagcatccttgtactatcacagtcatggcacttttactgatttactacactgattaaactttgaagattctacatgcttaactaagatgatgtttgtcaccttatctagtgatgtttatgttattatatgcagatgtcaatcatggcactaagagagtgaggaaacccaaagcttggaagcatccccaaccgataaccatggcccagctcaggcagatgcgtgaggagttttgggacaccgctcctcactacggtggtcagaaaggtattctcagttctcatctttggttttgtttacttgtccccggtatcttgttttgatttgtataagttgagctaattcatcttacttttatctgcttggatgcataaatgcttatatttctagttggcgctattcttactccttgcactaaccattttgaaccttgtacagaaatctgggatgcccttcgagttgcatcagagtctgaggtatcccatgcacaggctgttgtggaaagtgcaggcataattgtttctaatgccgatctgactctctgctacgatgaaaggggtacggctttttctgcttgattctttggctttctgttatcctttcacgtttgttcatttgttttaatttagttccgttttaacattccaggtgctaagtatgaattgcccaagtatgttttgagtgaaccaaccaacctgatccgagacagctgaacggcagccggccgtaggaagacccaccgatgtaaaaactgtaaatgactgcagatgccgccaaattggtcccttgcttgtggtaactggagtgcctcgagtaaccttcagatttgctttggcaactttcggcaatagggttttccagttctagtgttcagataaaaaaaaacttttgcgtaccctcgtctattgttcttggttctactgtaaacatgagtctgcttagaattctttggagcgagaatgctgctgagattgttctcgtccactatcatgatacaagctggagcatacgttttagaaacttgtcacatctcgtgcaactaattatattattatgtggtctggtctgacatttgaaatgaaatgcatgataaggagcaaatcgcaatctaatttttacattatcgcaacatatccgatgatactggagttttacattattatcatgagaatgatgctgattcatctagtggtagtgttgcgtggagtctgagaacctgaaccggctgaatgcctcctccatcgccatcaccatcgccagcaggtccagatccatccctcctccgtcttcgtcggcgacgctcctctcgcagagcgcgaaccggcacaccgggcagctgccgtgcccctgcacccagggagcgatgcacccctggtgaaacgtgtggttgcagggcgtgaccgcaacctgctctccaggcaggaacgtctccaggcatatggtgcagaccttctcctcttcactggtttccttccctgtccggaggttacctctgccgccgccgccatgcttctgctgctgcctgtattcgtccttcctcagctgatccatggcctctctgaactcctcgttggtcagtccagcgtctcctcgcctgtgtctcgggtttaggggcgcgccactgccgctgctgccatggacacggtggatatggaatggtggctgcaacgggtgcctgagcacaacatcagttggcgggcagatggtacgggtgatgatatcgtcaagtttccaaaagttcagtgcaactgaagctcctcagattgaaaacgcaggaagagtcttgtgaactgtaccaggaactggagcgctcgaaaggtggtcttctgaacctgtgctccgaaagcctccaagggtaatcctgcaaccaaatccaagagcatggcttcctttgacctttgaacttgcaaaaaaatgaatgaacttgcatgtctctcgaaacgtgcaaagatgagaagaagaggaagaagaagagtaccccatgatgcagaggccacggggacctcctcctggtcctggatggcaactgagggtaccaggcgtgctgaaactcacgagggacggggccgtactccggcccgtagctcccgtctgcccgccggccgtcactcatctcatctcccattgtggtgaccaccggggagggtgatgaccgatgagttctttgagggtgtcgctatgtgtagtataaccaaccatcgatccatgtactggggctcaggctcaccactcaccaggtggaatggagaatcaggtgctttgcaaccgatgcccacagaggatggggttgagcatcaggttctccttcaaatctcatctgatcacgcattgttctcgtcgtctttttttttcttttggcgcgaagccaaatgatatattgcagcacagacaaatttgggagcattttcgactagaatgcacacagaaagtgagcatccgattgcccttcctgtcactcatgtttatcatgtgatatattgtgatgtgcctagagtgagcataaaaccacggatttatttctcatgtcctcacattgcagaatactccattgcaagttcaaaggtcaaagccagccatgcttagcttgtgggttatccatccttttcatttcaaatcatttgggctatcaaaattcatctgaatataaacaaattctaaaacgcaaattttacaaacgacctcggatgaaaacatatgccaaaataaaagttgcagaacttagaaaagtttacgaaactttgtagtcgacaacctttttgtttgaattcgtttaccgcttacaaaggccagcgcaaatcgatttctctacactcgcggttggtggcgtaactgaaccgccagaacaaatcaatttttactcaattaaccacatgtggaaaaaaatatttcaatcatatgcatgtgtatgttcagctgcggtgcgctgaattcgattcgttggcatatctttaatttcgaccccatcgatctctccttcaattcaatcatgtgcatgttcaccacttgtacagtgtacgtcgtctttggtttgcttgcattttgcgttgggtccctaaccctaactagaccttgcaaaggctttcgaagcccatgtactgatgccgctccaccctgtggactatgtttgagatgcctacccctcctgcaaagagccagcagagatgcatggttttcaaacaaaagctgcagctcttattgttggtgatcgacttcaacagatgaaggcagggcatgcatggacgatcgatcgatcgatcgatgctgtacgtacgtacgtaccgagcgtaagcgcgctgacgaagatcatggacgccaggatgaagatgatgagcgacgcgcggcccagccacgcgatcagcttcctcacgcagtgctgccccgtgatggcggccacgaacgccacgcccgtgaagtaagcagctgcagaatcatcaaaaccaatgcaaggcgatcgatcgagagagcgagggaaccaagaaattaatagcggatgcatatggtggtaggtactagtaccataaggcactgggaagcggtgcagcaggtagtactccacgaccgacatggacgacgagaacatcatcgtgaacgtggctgtagcactagacacctgcacgcacgaggattgctctgccaagctaataagttggtgaccgacgcctgcatctatcgatctcgataattaatcaatcccagggcaaagatgcccaacgcagatcgacaaacctagctacctgtggagggattccgagctccaggaagagtggccccataatgaagccaccgcccatgcctagcaggccgcccacgagtcctgccaggacgccgaacaggcagtacaccagcagctggcgaatccttagggcgctttgctgctgctggcttcctcccttattagacgacagcgcccttctccctgttcttagcccacaggcttcgtacactgtcactcccactgccaccgggacctgcacgcataaacgtgaccagcaattaatatgcaagaggaaagatctattattactacttacccccaatgctctggactatatatatatgcctattcaaaatcctagctatatatacagaatattattattatttgtttttagatatatatacctgcagagaattcagcacccagtaccaaacggagcaggaagcggcgtagttcgtctgaaaacaacaagacgtactattaattaataagctgttattaaaatcaaataaaagaagtagtgcaatacacagcatcgttatgataagctataaggccggccagcgtacccttgtgagctgaagcccaaggaatgctatccacacgaacgcaaggagacccagctccttccagtagatgttcttcagaaccgatgatgtctgaaataatgcaagacaagcagtctccattaattcgtcgatatatatatgtacacacgtacgtatacgtacgatatatgcaatggtacgtactgcaatgcatgctagattaccgtaccgcttcattatctgtcgggtttcttgccttgctgctcggtggaggcggagcagcatctgcttctacagggatcgatgtctcatgctctgtgccaccatgaccacctgctgacgacatttttttttgcattgggagagacaagttctgtcaggaagagcgttccacaaactaatttgcgagagactgagagagattgatcgatcgatcgatcgactccgtgttgttttggatgctgctcgcttacatggcggctcttgtccttttgcgtcctccagctgtgatcgagagcgaggagaagcgataaacaaagcagctccattagcgcgcgacgacaggcgatatataagaaacaaggaaaggtaaagcggcgacgtctgaggcggacttcagcagttcagccaaagtttacccgagaaaattggcaaagctagcttacccttttctttactgtctctttcttccaggtctcgaagcccttgagatacgccttagtcgacgtgactgtgagtcaaatcccgaccgatcgagagatgcatgcaacggaagtcagttgcaattaacaatatagctagctagataaccgtgtctgctagtttctgacggtatctataccatatgttcgcccgagagtgatactcgatcggcaaaactaggcggcaaagaacgcgtttttttggtagtgtgctagctgtaacctgtaagagagggagaggatgtatagaaacaacaggcacctaggaaaatggttatgaggagggccgtgatgagccagtcggggaatatgacgttgaaaatgacgccgatgctgaccccaagcatgagcataggctgcatgagcagggcgaggtcgtagtcgatcagcggcatgtccaggctcgggtgcttccgcttcaggttgtagtagacagtcgaaacggaccctcccatgatcatgcctgtacatcccagatcaaaatatcaagagacaacaaggacacacttgtagagctaggctagcacatgcgtgtgtatatatatatgatgaaacaatacaatacaatacattcacgcacacttggatatggcagtggatgacttgggatcgaagccgacgatgagtgccagcatgggcacgaagatgccgccgccgcctacgccgccgacgctgccgcacgccgcgccgaagaagccgatcagcgaccccaccaccactcgccatccaaatcccattggctaggaaaaagaaacattggacacaccacatcgatttattatatatataaccaaactgttcagtacgtgaaaccgagcgatacggcaactgaatcagtaaccaaagtatatatatatatatatgcgtgagtgtgtattcgatcggccgggccggggctgtgcgcgcgttattaccggccaaacgtggtggtacgccttgccgtcgtcgttcccgccggggcgtgccggggccccgcctgctgatgcggaggctgtcgagttcctcgtcgggacgtcgggggcggcggcagcaacagcaacgacggccgccgcggcgcacgcggcgatgagcgtggcgacggcgtgccgccggcgccactgctgcgtcgccatccctgccagcaaacaaaagatgcaatgcaatgcaatgcaatgcagggaaagctagccgccggccctctttttaatataaatctcccaggaaagtagtagcgtccacgatgctggagtggagctctcagctcggtgctgccccaacttatagagagcgggatatatatgcatccgggtgggtcacatcctgtggcatttcacacaccaggtatcgcccgcactcagccgttgtcgtgggaacgaccgaattaacttccccagctttattaattacttattatacaaatatacaatacatctctaaataaatttattaatgatctttctaatgatactgattatgtattataaattttaatgattctatatatttaatcaaagttaaatatgtttgacatgctgtagagtagagagagaacgtcgatcgcataatggaaaaggacagaaaaagagtatattataattgcagatgtcgcagcacgacacgttgatctcgacgatctcagctgttcgcctaaggtctaataatttatgtatccatagagaggctgatctggcactcccggcaactacctggtaaggacgctctcgcgcgccatggtcgtcggctcacgtatctttctttgtgtcctcagctctaacacaagtgcctgtcggtggtaggacgatggacctgtttgattcggcttttttttctgtgaacttttctgaaaaactaactgtagataaaagctggctgtggataaaagctgagtaagaagaatctgaatgtttagttggaatgctgtgggagaaactagtggttagaatctaaatgtttggatacacagattttgatattatagattataagtgaaaaagaaaacagggaaaggcacaataatcaacacctcattacaattaaacatgatatttccctgcaacacaaatttattatggttaaggtcatatataacgacattaacggggaatgctacaaatgtacaatgtacacatgtacaaatttattatggttaaggtcatacataacaacattaattgttttctcttagtactactgtattctgtattgattttttataccaacggtacccggcagaatgtaacggccacgcaaaagaaactgtcgcatgtaaccggaggcttcttggcaacacggccttcctaccgttagtttccgcttccgtgtgtaacagccatggccaccataatcgcgccgcacagaagccggtccaaaagtgacgcgtttagaagctcaaagtgcttattctgaccagaatcggctccaaaagccgatccaaacaccaccagctccagatctcacactacagtagaaggggggcttccgtccctcagttacaaataccgattttctataaaccggtacaaacatctgatgaaagccttccgtccatcaacttttgtatcggttgtctcaaaaaacttagtattgacaaagtcatcaatatcagttataaatagtggagatcgtacagagacctttagtaccgattcaggacaataaccggtactaatatagaaccttcagtacggtttgggacacgatattaattcaggtacttgtttgacacattcgtaggtaacaagtcaatggctaaagatatcacgcaatg

SEQ ID NO: 2594 - DNA, 2421 bp, Zea mays
  misc_feature (2418)..(2418): n is a, c, g, or t
gtcaggtggtcacttgttctggggcgtttaaagatggttcccttcgggtggttcgtaatggtatagggattaatgagcaggcttcagtagaactccaaggcataaagggattatggtcattgaaatcttcgatcgcggggccgcggcccaggtaccttgtcgtgagctttataagtgagacacgattcttggcaatgaacatggaagatgaactagaagagactgagatagaggggtttgatgcacaaactcaaactctgttttgtcagaatgcgatcaatgatcttcttatacaggttactgctaattctgttcggttagtcagttgcacctcccgggagttagtgaatcaatggaatgcaccagcaggattctcagtcaatgttgcttcagctaatgccagccaggttctgttggcaaccggtggtggccatcttgtttacctggaaattagggatgctaaacttgttgaagtgaagcatgctcagctagaacatgagatttcttgtcttgatttgaacccaattggggagaatccacaatatagttccctagctgctgttgggatgtggacagatataagtgttagaatattttcgcttccagatcttgaattgataaggaaggaaaatttgggtggagaaattgttcctcggtctgttctgctgtgcaccttggagggggtttcgtatttgctttgtgctcttggggatggtaatttgttcagttttctactgaatgcaagtacaggtgaactgactgatagaaagaaggttaccctcgggacccaacccatcagccttcgtaccttctcatcaaagggtaccacccacgtgttcgcttcgtcagataggccaactgtcatctatagcagcaataagaagcttctctacagcaatgtcaatttgaaagaggttaatcatatgtgccctttcaatacagccgcttttccagacagtcttgcaattgctaaagagggtgaactttcaattggaactatcgatgatatacagaagcttcatatccgcacaatcccccttaatgaacaagcacgtcgcatttgtcaccaggagcaatcaaggacactagcattttgcagtttcaagtacaaccagagtgtggaggaaagtgagactcatttaatacgtctgctagatcatcagacgtttgagtccctgtgtgtatatcctctagatcaatatgaatgtggctgctccatcattagctgttcgtttgcggatgatagtaatgtttattactgtgtgggaactgcatatgttatacctgaagaaaatgaaccgacgaagggccggattcttgtatttgcagttgaagatggaagcttgcaattgatcgtggagaaagaaaccaaaggagcagtttattcgctgaatgcattcaatgggaaattgttggctgctatcaaccagaagattcaattgtataagtggatgtcacgcgaggatggttcacatgagctgcagtctgagtgtggccaccatgggcacatacttgccttgtatactcaaacacgtggtgacttcattgtggttggcgatctgatgaaatcaatatccttgctggtgtataagcatgaggaaagcgcgattgaagagcgtgctagggattacaatgcaaactggatgactgcagttgagatgcttgatgatgaagtctacgttggggcggagaatagctataacctattcacggtgcgcaagaacagcgatgcggcgacagatgacgaaagggccaggcttgaggtggtgggagagtaccaccttggggagtttgtgaacagattccgccacggttcactggtgatgcgccttccagactcggatatagggcagatccctacggtcatctttggcacaataaacggggtgattggcattattgcctccctcccgcacgaccaatacatcttcctggagaagctccagtcgacccttgtgaagtacataaagggcgtcggaaacctgagccacgagcaatggcggtccttccataacgacaagaagacggcggaggctcggaacttcctcgacggtgacctgatcgagtctttccttgaccttagccggagcaagatggaggaggtgtccaaggcgatgggcgtccccgtggaggagctgtccaagagggtggaagagctgacgaggcttcactagtgtagatggaacatggaagcgttgcttgtaagcaagtagtaacttgttccctgagctgtagcctccgcggctcgcacgatcaaagtgttcggccgtggctgcagtctatcctatgctatatcctatcgtgatttgtttgtttgagctgtgccagtttcttttctttattattaatgcttaatgttaaaggcaaaaaaaaaaaaaaaaaaaaaaaaaccgagactagttctctcctcgtgcaaanaag

SEQ ID NO: 2595 - DNA, 1937 bp, Zea mays
acttcaggtagtcggcacggctgaacttggtgaagccccactttctgctctcaataatcttttggcggccagggaaccttgaacttggcgcgtcgcagagcttcactggcatgtgccagcattgttgtccttgcatcgaacagaaaggagtaccacccacgtgttcgcttcggctacgataggcccccccccccctagcagcaataagaagcttctctatagcaatgtaaatttgaaagaggttaatcatatgtgccctttcaatacagccgcttttccagacagtcttgcaattgctaaagagggtgagctttcaattggaactattgatgatatccagaagcttcatatccgcacaatcccccttaatgaacaagcacgccgcatttgccaccaggagcaatcaaagacactagcattttgcagtttcaagtacaaccagagtgtggaggaaagtgagactcacttaatacgtctgctagatcatcagacttttgagtccctgtgtgtgtatcctctagaccagtatgaatgtggctgctccatcattagctgttcgtttgtggatgacaataatgtctattactgtgtgggaactgcatatgttatacctgaagaaaatgaaccaaccaagggccgaatccttgtatttgcagttgaagatggaagtttgcaattaattgtggagaaagaaaccaaaggagcagtttattcgttgaatgcattcaatgggaaattgttggctgctatcaaccagaagattcaattatacaagtggatgtcgcgcgaggatggttcacatgagctgcaatctgagtgtggccaccatgggcacatacttgccttgtacactcaaacacgtggtgacttcattgtggttggcgatctgatgaagtcaatttccttgctggtgtataagcatgaggaaagcgcgatcgaagagcgtgctagggattacaatgcaaactggatgactgcagttgagatgcttgatgatgaagtctatgttggggcggagaatggctataacttattcaccgtgcgcaagaacagtgatgctgccacagatgacgaaagggccaagcttgaggtcgttggggagtaccatctcggagagtttgtgaacagattccgccatggttcactcgtgatgcgccttccagactcagagatagggaagattcctacggtcatctttggcacaataaacggggtcattggcattatcgcctccctcccgcatgaccattacaccttcctggagaagttccagtccactcttgtcaagtacataaagggagttggaaacatgagccatgagcaatggcggtcgttccataacgacaagaagacagcggaggcacggaacttccttgatggtgacctgatcgagtcgttccttgaccttagccggagcaagatggaggtggtgtccaaggctatgggcgtttcggtggaggatctgtccaagattgtggaagagctgacgaggcttcactagtacatggatacgcagaagctttgcttgtaacttgatgcatgtacatcctctttttgccatctatttttgtgctgtagcagttccatgagctgcctcagcagttgccgcgggccgtgttggcccgaagctgtagcctgccctgctttattggttgactcggaatactttttgggttgtgccagtttgttgagattgttttttttcttttattctatgttgaatggaaagattagcggtgaatcctgtcatggtcctatctgaatatattggggtactaggagccagagagatgaccgaatgactgtcttgtaggacctggttcattccaggcccaattcaatcgggcagggtcagcaacccagccctttgtttaaaaaatgtatccggtgttcaaaggaaaaaaaaaaaaaaaaaaaaaaaaaaaaaaaaaaaaaaa

SEQ ID NO: 2596 - DNA, 3237 bp, Zea mays
ctgtttgacacccttcgcaatgaagctgccaccgacccacaggtcttaagcttgcgagctgccatttcagcgggaactgcaaaatcaggatggacggaagctgatggtctgctactatttcaagggaaggtcttcattccggacgcttcagcagtttggacagaaatcctggcagcagcacacaattgtggtcacgagggcattgagaagactgtacatcgatggagagcatccttctacagcccacaggccttacgacgggtcagagaatttgtgcaagcatgcgccacttgccaacggaataaaactgagcatctacatccagcaggtctgctgcaacccctgccggtaccatcggaaatttggaacgacatctccatggactttgttgaaggatttcctaaggttggtggcaagacagtggtattaacagtggtcgacaggttctctaagttcgcccactttattcctcttggccatccatataccgcagtgaccgtggctagggcatttttcgaagggattgtgcgccttcatggtattccgtgctcaattgtaagtgatagagatacagtgtttactagtgccttctggtccgagctttttcaccttgctggggtcaagttgttacttagttccgcgtttcacccccagaccgatggacagtaggaagtggttaacagaattattgtgatgtacttacgctgcttggcaggtgatcggccaaaaacttggttacaatggcttccatgggctgaattttgttacaatacgtcataccagactgcggtcaagtgcactccattcaggattgtatatggccgggaccctccaacaatgctttcttatacacctgggacagccagagtagctgccgtcgatcagcaacttcaggatcgagatgttttcttggcagacatcaaacaaaggctaatccaagctcaggtaacaatgaagcaggcgcaggacagtggccgtcgagatgtgcagtatgctgtcggcgattgggtttggctgcgtctgcaccaaaggtcggcagtgggtgtcactccagcagcaacatccaaattaggacctaagttctatgggccatatcaaattctgcaacgcattggagaggtcgcctataagctacagctgccaaccaatgcaagaatccatgatgtttttcatgtggcacttctcaagaaattccaaggggagcccccatccgcactagtacccttaccaacgattctgcatggcaaggtacttccggttccagcacaagtagtgaaggctcgtttaaatagaggtgtttgggagttactggtccagtggcttggacgtgagccggctgatgctacatgggaacaatgtaatgagttcaagagaagatatccagaaatacaactcgaggacgagttgtttgtcggagaggagggaaatgttatagatgcttttgtgggccgccaattcacaaggcgcagaaataggaaagaggagataagtcaggaatagtttctgttttatcagttcctaaataataggttagttcctttttatgtggctaaatagtagcagttcctaaataataggttagttcctttttatgtggctaaatagtagcagtagatatgtctatcctgagaccgcctatggctataaaggcggctgggcatcagctgtaataatcaaccaggaataagatctcccttttgttttgggcgagatcacctgggatcatcctggccaggcacgacgccggcgcaggagatctgggtgatcagcgccctcttcttctatacaccttgcgccactccaatctccctctccactccccattgaaggacaccaggaaaccaaggttacggactcaccagcgaggagtcggtaacaagtgggtatttgaagaaagttccttttttttaatgtttgatagattagtttcctgtcacttcatttttcatcattttagcagctatgtgatgagttatgtttaatcaactatcaatgttttacctgttgttttgattgacaggttactgctaattcggttcgattagtcagttgtacctcccgggagctagtggatcagtggaatgcaccagcaggattctcagtcaatgttgcttcagctaatgccagtcaggtgcttttcctttgggactacttcctgtcttccttcagaaaatttggagtgcatcccacattcagtgacatccaattactcttttttgaaacctaaatctttcctctgtcatttaagcctccgtttgggagtgctccagctccagaaaatttggtggagttaatggagcactttattaggtgatccggaaaatcgcggagctggagttgtgaacctttagaagacatttagataagtcattttgtttattatttagattaaaaatatttgtaaaaactatttaaatttatatattataaactacaactccacactggagctgaaacttggagcagtccccctaagtaatatttccatgttatctttcccaatcaggcaacaaccagttagctggttaccaaatatgatctgatcattatatgtgtagtaatacaaactttgggggattgtttactgctatagtgcccttttgccttattgtcgatgcacatgttgacgtgcatccaggtctgctgttatccaaaacaaacccaggagagggttaaggggcgagaaacataaacaagaaatagggagcttatcaaattatttcttgtgtacatgcaattgcaatctaaaggtacttgagtagtaattgcaatgcatatatgacttccaattcttgcctgcattgggaacctataactggtgtgcccacttctttttccttgagtctgaggggccagtatttggttgctaacttgttatgctgatactcacaggaacatttattgcactaactaagaatttctcattatgtctcaagaaattatgctgaaataattgctatgtccaaatcatcaacaacaacaaagcctttaagttccaaacaagttggggtaggctagagttgaaacctaacataagcgacaactcaaagttcaaacacgtggatagctgttttccattcgcttctatgcaaggctaaatctttgggtatattacattctttcaagtctccttttattgtatcttcctatgtcaacttcggccatcccctgcctctcttcccattactatcgtgcctagggtcctactatgcactgacatctctggaggtctccgtg

SEQ ID NO: 2597 - DNA, 1395 bp, Zea mays
ggcgcccgcgctagaaaagagtccatctcctccctccctggctcggctgtcggctcccttcgccaccgccttcacctccttccctcacccgccacggcacacggttcgccgcggcggcggcggagatgagcgtgtggaactacgtcgtcacggcgcacaagcccaccagcgtcagccactcctgcgtaggcaactttaccagccccaaccagctcaaccttattatcgcgaaatgtacccggatcgaaatccatttgcttacccctcagggcctccagccgatgcttgatgtgcctatatatggaagaattgcaacgattgagctcttccggcctcataatgagactcaggactttcttttcattgctacggagaggtacaaattctgtgttctgcaatgggatgcagaaaagtcagagctaatcaccagagccatgggtgatgtttctgatcgcattggccgccctactgacaatggacagattggaatcattgaccctgactgtagactcattggtcttcatctctatgatggcttatttaaggttataccatttgacaacaaagggcagctgaaggaagctttcaatatcagacttgaagaacttcaagtactggacatcaaatttctacatggttgtgctaaacctactattgttgtcctctaccaggataataaagatgtgaggcatgttaagacttatgaagttgcactgaaggacaaagattttgttgagggtccttggtcccagaataatgtagataatggtgctggtttattaataccagtaccagctccacttggcggtgtgataataattggcgaggaacaaatagtttactgcaatgccaattccacatttaaagcgataccaataaaacaatccatcatcagagcttatggacgggttgacccagatggttctcgatatttactcggtgataatactggaattttgcatttacttgtccttacccatgaacgagaaagggttactggtttgaaaattgaatacctgggagagacttcgattgcatcatctatttcgtatcttgataatggtgttgtttacgtcggttcacggtttggcgattcacagctggtgaagctgaacctccaagctgatgcaagcggttcatttgttgaaattcttgaacggtatgttaatcttggaccgattgtggacttctgcgtggttgaccttgataggcagggtcaaggtcaggtggtcacttgttctggggcgtttaaagatggttcccttcgggtggttcgtaatggtatagggattaatgagcaggcttcagtagaactccaaggcataaagggattatggtcattgaaatcttcgatcaatgatccatttgacatgtacctcggccgcgaccacgcta

SEQ ID NO: 2598 - DNA, 986 bp, Zea mays
aattcggcaccggccccaccttccccctgactcgtgcgtctgtttctcctgcctgggtctggggttgtccagttgccattgccaccaccaaccgagcctagagggaaagaaatcttggaaaggtgtggtgtgacccctgctgctgctggtgccagatttgctcgcgttcgaggcctccttttgtttccgctagattctgccaagatcagcgattccctccgccagcagaatcgctcgctctctttccatcgagcgtgcattcttttctgctgctgagtcgggcaggatcggcgtaacccctccatccaaaccccagacctttgtccagcagcctcgcgccctcgccgcatcggtatggtttttccttgccccccgtcctagttgctctgttcgcttgatttcctggtcgaggttctcgtgcgctgttccaatttcgagctaatcgtcctgctcctgcctaggaataggattaatccccttctgttcttggagttcacacacatcccgtgcgcgcggattgctggtgcagcagtcggcggcggcgcgtgcattttgcaaccgctttccaagcaccagctgcaagctttggccttttcatcctcccctccccgaaatcccgcaagaaactcgtcccttctcacgagtcacgagtttggtgaggctttgaagcgagcatagttctcgtgaatatcgcaggggaggtttggaatccggcatctctgtcggtcaggctggggtgggagtttcctcgtcggagatggatgggaatttgccgccgcgcaccctgatgccaggcggaggtccaggccacttcgatctggggcagccgttccacttcgccgcccagccccaggcgggccgggttcaccagggcgtcttcgccgtccccgccgcgaaccagatgccggagctcggcaatgtggtggagcctccgctcagcgacgaggaggaggaggacgacgacggccacctcgaccacggcaagg

SEQ ID NO: 2599 - DNA, 994 bp, Zea mays
ccggccgggaatcttcaccccaccccccctccttcgacctctctttcttgttgcacgcctgcctgggcgaaccgtcgccgctatacaccaggcgcccagggcttcgccggcgccgagtagccaccagctgccgctcaacattcacctctgccaagggcatggaccacatgacgatgctcggcgccggagccccccaccagctctccagggctgaaccaatgcctgaccgtaggtcaaggttctggcagacggatgtgcagcctgtgcctcggatagacatcatctgtcctctgccttgtcgcccttcccgctcactgctcctcaataggcccagccccaagcctaatggggcactcccattttatggagcaaaccctacttatgatatcgttgatctcatccttagcaagaatgaccctgatgtggatactgattcaagcagccaggcggcctttttctgtggctcgcctcctgcccgcactaacaaccctgttatccatgacccacagtttggaaagaaagcaccatccttttctcctctaggaagctcttctggaaaaatggcagctggaagagctgaagtaggttctccgtcctgcaggtcgagcagcccaaaaatgagaatcgaaggttttgcttgcgggaacaaagagccccctcactgctttgcctgatgatccccattgaccctgcctaaccctgttttgctaccctgcaacctgtacattttcgctgcccagctgagagttcgtttcgttataagctgttaaactagctgagagtcccatgtgattgtggcttttgaaaattgcatgatccaaggggacggatgtaaataggtcgagttgtccggtgtatgtactagatgttgtatgcgtctggtaaatgtagtcatgctgggtgggtccatgtgtcggcgtctgtaaatacagccatgcatttggatgtgaaatttaaatgcgtcttcagttaaaaaaaaaaaaaaaaagcggcc

SEQ ID NO: 2600 - DNA, 1507 bp, Zea mays
ggtacccccggagccggccggacccctctctctctctcttctcctccctctcttccttttctcttttctttttctcattgcgacgcctgcctgggcgaccgtcgccgctctacaccaggtgcccaggtcttcgccggcgccgagcagccaccagccgctgtgcaacaaatcacgtctgtcgagggcatggatccctacatgacaaggctcggcgccggagccactcaccagctttccagggctgaagcaatgcctgaccgaaggtctaggttttggcagacagatgtgcagcttgcgcctcggatagacatcatctgccctctgcctcgccgcccttctcgcctaccggttctcaatagccccaagctcaatggggcactcccactgtatagagcagaccccacttttgatatcgttgacctcatccttagcaagaatgaccctgatgtggatactgattcaagcagccaggcgggctttttctgtggctcgcctcctgcacgcactgacaaccctgttatcaatgacccacagtttggaaagaaaacaccatccttttctcctttatttggtggaagctcttccgggaaaatgacagctggaagagtcgaagtaggttctccgtcgtcttgcggggcgagcagcccgaaagtaaggatcgaaggttttgcttgcgggaacaaagagccccctcactgttttgcctgatgatccggatcattgaccctacctaaccctgttttgctacccccgcaacatgtacatttcccctgctagtttctttggttaaaaaacctggtagtttctttgagtcggagtcgagtaagagcgcttgttgttgccccttgtgatgaccgtgggtggcttttggtgcaagggagcagagcacagctctcggatgtaaatagggtggcgtatgtagtgctagatgtttgtatgtgtctgctaaaatgtagtagtaaggttgggtgggtccatgtgtcggcgtctgtaaatagcgtcatgcatttggatgtaaattgaaatgcgtcttcaattattgccaaaaaaaaaaaagctggtgctgggtccaagttgcacccggtcgagaacatagcatctgaagcaattattaagagtaatcatgatgtgctatgttaccttatacaacacctgactgtacaactagatggaactgtacaattgaattgaatggggcgaaatccaatcatggatcatccgaagaaagaaagaaagaaacatggatcatcatctgaggatggccctggagtgcctgaggatcatgtggaagggcgtggtcgccgtctcggggcgcctagtgtttgtgcttgtgctgctactgctactcaaaggagcagtggtcgccgtctcgggccctcgccaccaccttgcccaggctattcctcttgccgcagggggtgcggccgcaggtgcaggtgcaggtgtagttgttacagcggtaaatggcagctattgtctgcgacatgacgacgcctccgggccgcag

SEQ ID NO: 2601 - DNA, 630 bp, Zea mays
ccggccgggaccacgagactggcgttccactgccgcgcccttcctcctcttcctcttcttctgaccccccgctggcttggaaaagggagagaaaactcgcgcactcggttatcgaaagggaggagcgcgggcgagggtgaggtgtcgcccacacggagctgcgaggtgtttgtaggatctcctaggtgagcccctgctgcttggagacagccatggccaccggcgtggctccagctcctctcccacatgtcagagtgcgtcatgggggcgtcgggttcaccaggagcgtcgattttgcgaaggtcttgtctgctcccggtgccggcacgatgagagcaagctcctctagaggcagggcgctcgtggcgaagagctctagtactggctcggagaccatggagctcgagccatcttcagaaggaagcccacttttagtacccaggcagaagtactgtgaatcaacacaccagacaaggaggaggaaaactcgaactgtgatggtggggaatgtgccacttggcagtgatcaccccataaggattcaaaccatgacgacttcagataccaaggatgttgcgaaaacagtagaggaggtgatgaggatagcagataaaggagctgatcttgtta

SEQ ID NO: 2602 - DNA, 2705 bp, Zea mays
  misc_feature (2672)..(2678): n is a, c, g, or t
  misc_feature (2686)..(2691): n is a, c, g, or t
gggtacctcgaggccggccgggacgaactggcgtgccagtgccagtgccgagcgcccgagcccttactcctcttcttccgaccccccgctggcttggaaaaaaggggaagaaaactcgcgcagtcggtcaccgaagggaggagcgcggtcgaggtgccgcccacacggagctgcgaggtgtttgtaggatctcctaggtgagcccctgctgcttggagacagccatggccaccggcgtggctccagctcctctcccacatgtcagagtgcatcatgggggcgtcgggttcaccaggagcgtcgattttgcgaaggtcttgtctgctcccggtgccggcacgatgagggcaagctcctctagaggcagggcgctcgtggcgaagagctctagtactggctcggagaccatggagctcgagccatcttcagaaggaagcccacttttagtacccaggcagaagtactgtgaatcaacacaccagacaaggaggaggaaaactcgaactgtgatggtggggaatgtgccacttggcagtgatcatcccataaggattcaaaccatgacgacttcagataccaaggatgttgcaaaaacagtagaggaggtgatgaggatagcagataaaggagctgatcttgttagaataacagtccagggtaggaaggaagctgatgcctgctttgagatcaagaacactctggttcagaagaattacaacattccactagtggccgatattcattttgctcctacggtagctctaagggtggcagaatgttttgacaaaattcgtgtgaacccaggaaattttgctgatcgtcgtgctcaatttgaaaagctggaatatactgacgacgactaccaaaaagagctagagcatattgagaaggtgttttctccattagttgagaaatgcaagcagtatggaagagcaatgcgaataggaacaaatcatggtagtctttctgaccgcataatgagctactatggtgattctccacggggaatggttgagtctgctttggaatttgctagaatatgtcggaagttggacttccacaactttgtattttcgatgaaagctagtaaccctgttatcatggtccaagcatatcgcctgcttgtggcagaaatgtataacctaggatgggattatcccttgcacttgggtgttacagaagctggagagggtgaagatggaaggatgaaatctgctattggcattgggacactgctaatggatggtttgggtgatacaatccgtgtctccctcacagaaccaccagaagaagagattgatccttgccaaaggttggcaaatcttgggacgcaggctgcaaaccttcaaattggggtggccccatttgaagaaaagcacaggcgttattttgatttccagcgtaggagtggtcaattgcctttgcagaaggagggtgaggaagttgactacagaaatgtcctgcatcgtgatggttctgtactgatgtcagtttccctggatcagttgaaggctcctgatctcctttataggtctcttgcagcaaagcttgtggttggcatgcctttcaaggatctggctactgtagattccattcttttgagggagctcccccctgtagaagatgctgaagctaggcttgcactcaaaagattagttgacatcagcatgggcgtactggcccccttatcggagcagttgacaaagccactcccacatgcaattgtacttgtcaacctcgacgaattgtcaagtggtgcacacaaacttttgccagaaggcactagactagctgtcactcttcgtggtgatgaatcatacgagcagctagatattcttaaggatgttgatgatataacaatgttgttacataatgttccatatggtgaggagaagacaggcagggtgcatgctgctaggaggttatttgagtacttacaggccaatggcttgaacttccctgtaattcatcacataaatttccctgaaaccattgacagagatggtcttgtcattggtgctggggccaacgttggtgctctcttagtcgatggtcttggtgatggtgtattccttgaagctgctgaccaggaatttgagtttctgagggacacatctttcaacttgctccaaggttgcaggatgcgcaacacaaaaactgaatatgtgtcttgtccttcctgcggccgaacactctttgaccttcaggaaatcagcgctgagattagagaaaagacctctcatctgccaggtgtctcgatcgctatcatgggctgtattgtcaatggaccaggagagatggctgatgccgattttgggtacgttggaggcgctcccggaaagatcgacctttacgtcggcaagaccgttgtgcagcgcgccatcgccatggaaggtgccactgacgccttgatccagctgatcaaggaccatggccgatgggtggatcctcctgccgaggagtagggctgtaggctgtagccaagtctgtagtttatatattctgtaaagcgaaacacgcaatgcagtaactgagcatacgatgtacatccctacacattttgtacatttattgagatctgagaaataaactagaaaccgtcggtgacggcatgtctgcagcaccccaaaaaaaaaaaaaaaaaaaaaaaaaaaaaaaaaaaaaaaaaaaannnnnnngggggggnnnnnngggggggggccccc

SEQ ID NO: 2603 - DNA, 2983 bp, Zea mays
aacatatttaatattttttttatgtcttgcaggttatttgagtacttacaggccaatggcttgaacttccctgtaattcatcacataaatttccctgaaaccattgacaggtgactgtcaatattcctattttcttccccttggaattgtgagtcgtggctttcttgtttattctaattcaactatgtgcagagatggtcttgtcattggtgctggggccaacgttggtgctctcttagtcgatggtcttggtgatggtgtattccttgaagctgctgaccaggaatttgagtttctgagggacacatctttcaacttgctccaaggttgcaggatgcgcaacacaaaaactgtaggttcatgttttttggtttatttaatgatatggctacctctttctgtatatccagtggacgacatataccactacttgcaggagttgcagtaaaaaaaaagaaaaagggaaaagaaacagcgaaacaaaaaaatatctgttgatgtttctcactgagatgagaattgattttgtgagaagtgattttctgactttgaatgctgtaggaatatgtgtcttgtccttcctgcggccgaacactctttgaccttcaggaaatcagcgctgagattagagaaaagacctctcatctgccaggtgtctcggtgagttttctgactcaaatatacgtggtctggtcaactgtataaggctctttaaaaaaagatcaactgtaagtctgtatatacatttccttcttttctatcaattatactgatcaaccgtatacatatttgcctggcagatcgctatcatgggctgtattgtcaatggaccaggagagatggctgatgccgattttgggtacgttggaggcgctcccggaaagatcgacctttacgtcggcaaggtaatcataccgttgcttggttgccaaaatcatgtactccctgtgttccgaattataagacattttgacttttctaaatatattgtttttgttatatatatagacatatttatatctagatgcatataaaagctatgtatgtagaaaagtcaaaacatcaaataatttggaatggagggagcatatgcaatggaaagttttactatgttggccagaactgcctggttcagttagcactacacaaatgtggttatgatcccgtgatagaacaattcattcggctcgagaaagatcgacctttctttcggcaagaccgttgtgcagcgcgccatcgccatggaaggtgccactgacgccttgatccagctgatcaaggaccatggccgatgggtggatcctcctgcccaggagtagggctgtaggctgtagccaagtctgtagtttatatattctgtaaagcgaaacacgcaatgcagtaactgagcatacgatgtacatccctacacattttgtacatttattgagatctgagaaataaactagaaaccgtcggtgacggcatgtctgcagcaccccaaatgaagcacatacgatttacatattagtagtagcccatgtgagcaagacataatcctatacaatcttgaagtctgcattatatattttttccaacagaggtagcttagaaagtttttcgagcaatgcaattttgttcgttactttccgtttactttttcttttttttagcgttgagggttatataaatagatttataatacaaagagaaaaacggtcgtgattacacaacaccaaaatttttattgtggtcttgagagtttgtgatgatctattcatatccttactagagcattaatcatcgtcatataagagttctagctggcagcctgtcattaccagggtgtaaagataagattatgctagtatctgtgctaatttccattcttgtttggtttgtgaaaccaatttgctctgtcttttctgacatagatttgctatgtgcttgttaagaccgactctggttggcgagtcagttggcttaactagtgatcatttgtaacacttcggtttgctccactactgatatgctcatcccatcaattgaacgtgcgatattgtggagaacctagctgaatggggatggctcagctgctgtttagtttcctcgccacttccatagcatcggatggcaaacgttgcggtcagggcttcaagcctaacaaatctgcagtgatacataaccactatgaaccagtattttttaaccagatatgcaagagtgttgtatatcattatattaaaatagaatgatagtatcaaaacgcaaacacatcatgagactatcttcaacatccaacagactctctatctcactccatattttattcaatattttaaattttactatgcaaacagtgcaaaaacagtactttgtatgaccgtttacacagcctataggagatgactatcctagtgcaaacataacctgtgctatggtgaatagacaacccatttatatttcgaaaaatcttatgcatgccatcgatttttatacccattctttgtgtgctattgaatgacaactaaaggataatttttatgtgtatgatatgtaggctagtagcatattacgcagtcagtgtgtcactgtcgccaacctaccaaaggcgacgaacaatttggcctggtcctcgtgttgctgggcaagaattccaagggcatctccgagttgcagagcttgatgtcggagatgcgagccttgtgtccagatatcaacgtttggaaacctcaagtggacaatcgtgttgatgagctggagaacgtcgcgcgtgatgtcagcgagtgggtggaggtaaaacgctcggcagtcggtacatggaaggatcaggagggggagggtggattgggttttcctaaaaattctcataataattaaaacctaagaacaaattcagcttcaactgattgtctaatgtgttaataaagagttatgcaccctaacttcaaccacatgctatcgtgttaattctagagaagtaaaaatccaaagtaaatttcct

SEQ ID NO: 2604 - DNA, 2051 bp, Zea mays
ccggccgggacggccctcccctgtagtctcccccgatcgagctcggctcggtcctcccctgcgaggttccccgtcttcgtccgcgctgcaatccaacctggcgccgccgaacccttctctcgcccggtgctgccgaagccgaacccttctctcgcccggcctgccgtagtcctccactccgccggatcctctctcagctcgagcggtcttggagatccgtccgtcccgggatcatttggcgcggaggtttggcctgggaaaatggcaaacatacgtgcacttctggtcggcttatcgcgggcaaggggatccttagcagaggctggacgatgtgcttccacgaggccatcaattctagcatctctgggcgcacattacaagatccccatgccagcccgctggttctcatctacagggcttcctccacatctggtggttggaatgccagcactatcccctactatggtaacatcgcgaaatggagaaaacaggaaggggacaaggtatttggccaagattttagcacctgaaggttctaaagatgttcaagttggacaacctattgctgttacggttgaagacgttgaggatattaagagtataccagctgatacatctttcggtggtgaacaaaaggaagagcaatcaacagaaagtgcaccgcaaaacaaagtagttaatgtgtctgaacaaagctcaacagtgagccggatcagcccggcagctaaattactgatcaaggaacatggactggatacatcatcactgagagcatcaggcccccgtggcacccttctgaaaggggatgttctggcagcattgaagtcaggtatcaattcaagttcaaccaaagaaaagaagtctccagctcaaccttcgtctcagccaactcgagattcccaatctcaagcatcctctatttcacaaaaggatgatacatatgaagatattccgaatagtcagatacgcaaggtcattgccaaaaggttgctcgaatcaaaacagacgactccacatttgtatctatccaaagatgttgtgctggatcccttgctcgctttcaggaatgaactaaaagagctacatggcattaaagtttcagtaaatgacatcatcataaaggctgtggcaattgcgttgcggaacgtccctgaagcaaatgcttactggaacaatgataaggaagaaactcaaaagtgcgattcagttgatatatctattgctgttgctacagagaagggcctgatgaccccaataataaggaatgcggatcaaaagactatatctgcaatatccgcagaggttaagcagctggctgaaaaggcaagagctgggaagcttgcacctaacgaatttcaagggggaactttcagtatctcgaatcttgggatgtaccctgtggaccatttctgtgcaatcattaaccctccacagtctggcattctcgcagtgggtagaggaaacaaggttgttgaacctgttgtggacagcgatggaaccgagaaggctgctgcagttacaaagatgagcctgacactatctgctgaccatcgtgtatttgatgggcaagtaggaggcaagtttttcacggagctggcgctgaatttcagcgacatcaggaggctgctattgtaaatgaaaggaggcaattaccgtgttttgacgtattctttgggagcgaaaaccgctcaggaaaagagaacatttggatgcaacccgtggtctgctgcttgatcggcatcccgtacaaaagtaaccaattttgtaataaatttataataagaatgcactggcaccttcacggttttttaacccgttttccattagttgggaggaggcatgtcctgagaatttagcaggtacggtgccattcaacttcgtggttccgcaacaatgaccacccttagattatgcaatctgagcggttctggatggacgcccattttgttgatgaccttgtgatacatggaagtaataacagaatgcttttgttacaaaaaaaaaaaaaaaagctagttctagatcgcgaccgcccgctgaaaaatagactc

SEQ ID NO: 2605 - DNA, 993 bp, Zea mays
  misc_feature (929)..(929): n is a, c, g, or t
  misc_feature (971)..(971): n is a, c, g, or t
ccggccgggagcataccgcgccgccgccggggcccccagcggcgccccggacggccctccactgtagtctctcgatcgagctcggctcggtcctcccctgcgaggttccccgtcttcgtccgcgctgcaatccaacctggcgccgccgaacccttctctcgcccggtgctgccgaagccgaacccttctctcgcccggcctgccgtagtcctccactccgccggatcctctctcagctcgagcggtcttcgagatccgtccgtcccgggatcatttggcgcggaggtttggcctgggaaaatggcaaacatacgtgcacttctggtcggcttatcgcgggcaaggggatccttagcagaggctggacgatgtgcttccacgaggccatcaattctagcatctctgggcgcacattacaagatccccatgccagcccgctggttctcatctacagggcttcctccacatctggtggtcggaatgccagcactatctcctactatgaatcaaggtaacatcgcgaaatggagaaaacaggaaggggacaagatagaggttggtgatgtgatatgtgagatagaaactgataaagccactcttgagtttgaaagccttgaagaggggtatttggccaagattttagcacctgaaggttctaaagatgttcaagttggacaacccattgctgttacggttgaagacgttgaggatattaagagtataccagctgatacatctttcggtggtgaacaaaaggaagagcaatcaacagaaagtgcaccgcaaaacaaagtagttaatgtgtctgaacaaagctcaacagtgagccggatcagcccggcagctaaattactgatcaaggaacatggactggatacatcatcactgagagcatcaggcccccgtggcacccttctgaaaggggatgntctggcagcattgaagtcaggtattaattcaagttcaccaanaaaaaaaaaaaaaagggcccta

SEQ ID NO: 2606 - DNA, 2083 bp, Zea mays
aattcccggctcgacccacgacgtcaggggaggcgcggagcagccgcgaccgcgagaaagaaaaggaagccgacgccacgcacgccatcgccgcctctatcctctcctcgtcctctccctccccctctctctccctgctccacctccaccaaccaatacacacctccctctctaaataccacttcgtccgagagcacacggcagggtatcttcctttcaaaagaaacttggctgggtgttgacgcacgcagccggcggcaacctgtgcggggagcgccaagggctccaggaaagaatcggccgcgggctcgcgatcgggaaggggagcggggcgcatgcgcgagcactggcacggcgacggcgacggcgaggacgagcatgagccccagccggggtgcggggagggcgcggggcaggcggcggcgaactgcgcggcggtgtgctgctgctgcccgctggcgctgctcgacgtgctgctgctcgtcaccgtccggctccccgcgggcgtcatgcggcgggtgaggaggaggagccggcgccgccgcggccacggaggtgccggagccaaccggaagaggccggcctccgcggcgcccgcgtcgccttcgggaagcagcggcaaggcgatgatcggagcggcgatgctagacatcgaggatgaggcgcgtggcgaggtggagtcggcggcggcggcggagctggagcgcgagatcatgagctcgcacttctacggcgccggcttctggcgcagcgtctcctccaactccagctcctcgtccaggcgctaccaatagaggccaggcgcgttctggcgtaaatagtgagtactccgtcgctactaaactacaaacgattactccgcgcctgtttggttcgtggctaactgcgccacactttgcctaaggttagtcgttcgaattaaagaactaactttaggcagaaaagttaggtaaagtgtggcaagttaggtagcgaacgaaacagtcagcgcagcatgcatggcaacaggatgcatggcagtcagcgcagcatgcatggcaacaggagcagcagccttcggcatcgtgcaagtgaccgtgcacttattctgaatgcacacgtgcgaaactggcacgtgcgggttggatcattgtactgctacgccattgtctcgagcatggaccacgccagcagctgcagcttgggatggagaagcgaaaggggtcagtgattgtgcttaggtttttcatctctctcctaatctttttttgtgtaactggagcaggaaatgctgaaacctcaagcttctgtccaaacgatgtactcctatttagtattgttgattgattgagaggccgatcgataacaaatgaacacatagaacgctgttcatgacgcagtgctttttttccctgcgtcactgcgtgcttttgcgtgtgtgcacgagctaaatcaagatcgagttctatttctatttatcttttagactaaaattaattaaaattcctcatttgttaaaataacatttagatcataacctattataacctctaccggcggactccttcattcgatcggcgccgttgcagaggatccctccatgacaccttcgcttatagaggaaatactatttgaccaaaagctaaggcggccttcgatagctatctttactcattctttatcttatcttatatttcaaacttcacttaacaattagtgtaatctacaattcaattttcaattttacatgacctgttgcagataatctaatagttgacatacgtctacaattatctccttagatccaatgaggtcaagttaatagtttagctaattgttagtaaaataataaactaataaatacctttactaattagatcaaattaactaataataattaacattagtcgtgatattttaattgttaacaatgcaaactggttgtaatgctctattttgttccataaagctaaacattagctcatttgaatctgaatggattcagcaaattgttagataatctccaactagcaaaataaataatgtagtcctatttaaatgcaaaagggccaagatagagtcgcgtagagcaactgctggtcgc

SEQ ID NO: 2607 - DNA, 1358 bp, Zea mays
gcacgagctcacgtgttttttttggaaaagtttttcttttcttcgtttgtgaaaatgaaaggcaaataattggatcgccagtcaatttgtaagctcaagccgggtctcccgtctcatccagaccagatcagatcacggacgacacagacggccaccaaatctgcacctgccccagatgcagcagaggtagtcgccacggcgccacctgcccactgcactgcccccagagcctccaagctgcatatcggaagtgaagcgcctcgcagtcctcctctcggatctcgcggtggaagtcgccggtccactcgatcagcgagcgagtcggtgccgcgcggcggattccccgacccgagcaaaggaaccggacatgcggccgcggctggtgctcttcggcgactccataaccgagctgtccttcgcgtccggcggatggggggccgcgctcaccgaccgcttcgcccgccaggctgacgtggtgctgcgcgggctcagcggctacaacacgcggtgggcgctcaaggtgctgccgcgggccatggagggcgcggcgggcgcgggcgcgggcgcggacccggcggccgtgacagtcttcttcggcgccaacgacgcctctctgcccgaccaggtgcaggcgcaccagcacgtgccgctcaaggagtaccagagcaacctccgcgccatctgcgcctatttcaaggagcgatggccctccactgctgtcatactcatcactcccccaccgatttacgagccagcgagaatccgagacatgtatggagacgacgagccttcacgccaaccagaaaggagcaatgaggctgccggcgcttacgcacaggcatgcatagatgttgccacagaattgaaccatccagttatagacatctggaccaagatgcaggaatttccagactggcaaacatctgcattgagcgacgggctccacttcaccccagtaggaaacaagatcctgttcgaggaggtggtgaagacgctggagacgagcatcggtttcagccaggagcggctcccgtcggacctcccgctgttccacgagatcgaccccaaggaccccatgaaagccttcggagcttagcttgggccttatcggaggagacgcacggtcgttggatcagccacgtctgctgcatttgagttcgtcgtcagtatgcccgaggcctgctgaggccattacaggaacagtgagctttaataagcggtgttttcagtaccgtttggttgtcagcgcatcacgtgttgttggaacactgtggttggataaaaaaatcataccctctccgtccgaaattaaaaaaaaaaaaaaaaaatttataattcgtacaataattaattaaaaa

SEQ ID NO: 2608 - DNA, 2648 bp, Zea mays
acgtgctatccagccgctgtcatttggcgcggtctccggatccgtgtctggttatactctaaagcagcagcagcttgatactctaaagcagcagcagcttggatgttcgtcgacgtccttgcgcagctatggagcgattgggggctccggttctctgtaatttccagcttggtgacaatcgtcgtcctcagcctcttgtcctggacacgccggcgctcgacgtccggccgctggcggtcgatcctgctgtggttcgtgacgcgcgttgtctggttggcataccagggcgccgagatagccgcgacgggcgccctcggaagcctgtccctctccggctccgatgggtcagcggaggagcagcaggtgatagcgttctgggcgccgttcctgctgctgcacctgggcggcccggacaccatggccgcctacgcgctggaggacagcgccttgtccgtgcgcaagttcctcgagatggtcttccaggtcgggggcgccttctacgctcagtacaagtacatatatcgcgcgcgcacctggacgccgctggcgacggcgtcggccatcatgttgcccataggcatttgtcaggtatgtggagaagtggtacgcgctatggaaatccaaaagcatgatggaggaggaggagggggaggaggaagaggaggagaagaagaaggtcgcgggcgcgggaccgggaccgggacgattcacatccgcaacaagcagcaacgacgcgctgtgccttgctcaggatctgttccatgtctgccgtcgtgccttgtccgattcttcggtgctcccgggcacggagaagcagcgtgccagcgaggagatcttcctgctgggatgggagcgcatgtgcaaggtggtggagatggagctctcgctcatgtacgaggccctgtacaccaaggccatcgtgctgcacacctgcccggttgcaggctacctcaaccgtctagtgtcgcccctcgccaccgctgccgcagtgttgctcttcaaccagtatatcggcagccgcagccgccgggccatcatcatcaggagatctttcgtcgacatcacctacctcttgctggttgttgccttcgccatggacctgatgtggctgctcagagcccttggttctacctggacgtacgccgccctcagagaggcgcggccatgggcatggtggcttcgccaccacttgctgtgcagcgggagatggcgccggatccaccgcgccgtcgacgccctgcatccgttgtcgtggttattcggcagcgatccagttagctactacaggacgtggtcgggcaccatcgggaggtacaacctgctgcaggcgtgcagcgttgctgctgctcaccgtggtgcccgccgtccatggtggacgcggttcgggagctggctggaaaaaaaaattggagctggaggagacagagtatctgcgtgagcttcctcaggacgtcaaggaatcgctgatccagcgagtgcagcgaatactggtgtcgaccaaaaataataatgctgataagaagacggatgagaatggaattggatgccgctacaccctggtagacatcaggacactctggggtcagcaggccctggaggacgccaagacgaacctgttcggtcgcggccgtaaaaatggtaggaaaacaagtaacaagaaaccgaaattgcccataaaaaaaaaaaaaaaagaggaggacgtcctcatgtggcatatggccacctgcattctcttctcgtcatcaagcggcaaggagagcatagtcagcataccagggggatcctcggccgacgccgccgatgcccatgtgacggcgatcaaggtgatgtcagaatacctcatgttcttcgtcgctgtacgtcgacacatgctgcctggccttgtgctccacagcctgctcgagaaaatccgccaaactttgcacgagatatgggacgacggcaagaagaaaactactggtggttcgtcgtcgtcgtcgtctacagcagccaaagatactccgcctcctcaagacaagcttgccgaaatgctgctagagagactgaaagcaggtcggagatggtttgaccgaaacgaaggcaggctcgttgttggtaatgcagctgcgcttgctaatacactaatagaggctggcatcagtgtgcagaagcgacagcaagtgccgcagctgctggagttcatcttcaacgtgtgggtggacaagctgctctatgcggccgccagatgcagcgtggagagccatgccaagcagctcagccgcggcggcgacctcaccaccatactgtggcttattgtccaacatgctgccctatttcgcatcggagaattaaaaccgaaggaagagcctcaggaggaggaggagaagaagaaggaggaggaggaggagaagaagaagaaggaggaggaggaattgaagcctttctggccacagtatccaatgccagcgccaccgtcgaagccagcatatgcatatccagttcattacattgcagatgaagaagaatctgacgatgccgaagaatctgacgatgccgaagaagatgatgacatgacgaggcatgctatactgtactagtttatattcgtgcgttgtaacgagaccaaatatagtctcattaaattaagtttacatgtctctactgtatct

SEQ ID NO: 2609 - DNA, 2540 bp, Zea mays
cgtaagtttggtattaacgaccagaccagaccataagtatgttagtgtttagaaataaaaaatatcactggcctaaataaaacaggagctgtagtaggagtagagatgacctcgtggtgtgctccgcgtgcagactgcgcggggcaggtacactaaacgcgagaaggacgtgtgtgcgcacgagagtggagggcgctgcctacctgctgccacggcgcgggtgcccaggcacgcgtggcgcgcccaggtaggctcagcgaccgcccccgcggcccgcagctatccactccactcgcacgcggtagcggccgtagggtctcgacggcagtgcctccgtgagctacgcgacgccacgtggactgccgagccaaccgccgcaggccgcgtcgcgtactgccggaccgacgtagtacgacccacacgacagatgaagagcagaataatttatattaaaaaaaaactattgatgaggtcgcctagtttgtccttgttgcgcccggagtagtacatcctgcctgcggtccggtccgggccacagactgaaagccgtgtcccaatgcccgcgcgccagcacgaatcgtatccggcaggcccgacggagaacgagatagaaaacacgggcagcagaagtgcccgcgcgcggcatctcattctcaaatctcaacctcgctcggcgagcggcggtcatgcagccgcggctcggctgggcatccaggggttcacggaacttgtggctgcagaatgcgccacggaaggctccaggccctcggacacgcgtccggcctgagtgacttggcagctgtccctctcgccccccacacccccgccaccacaagtagtatatgatgccgctcgtcaccctcctccccttgccatctcggggatccggcactcgcctcccttttccctttccgcgccccatcaccattgccacaaatagcaaccaaggcagtaagcctagccaagccaaccgacggcggcgagagtatatatacacacacacctgacgcctctgctgctgctgggatcaacgcggcagcttagtgacgacgacgactcttctgtctctgcgttgattaatggacagtaacagatccatggcgacgagcggcgtggctccgttcgtggccaagacgtaccgcatggtggatgacccggcgaccgacggcgtggtcgcgtggggcagggacaacaacagcttcgtcgtggccgaccccttcgccttctcgcagacgctcctgcccgcgcacttcaagcactccaacttctccagcttcgtgcgccagctcaacacctacgtacgtgctccgatccgacacgctgccttcgatcatacgtactcctccctatgctgtttttttttgctctccttgctcagtgacctgatcgacggcgacctgtcgtcctgtctgtctcacccctccgcagggcttccggaaggtcgatccggaccggtgggagttcgcgcacgtgtccttccttcgcggccagacgcatctcctgggccagatcgtccgccggagcagcggcggcaagcgcaaggacgacggcaacggcgccggcgccggctccgccgacgacgaggacgcggtggccatggaggtggtccggctgaggcgggagcagcgggccatcgaggagcaggtggccgcgatgtggcgccgcgtgcaggagacggagcgccggcccaagcagatgctcgcgttcctcgtcaaggtcgcgggcgacccgcaggtgctgcgccgcctcgtctccggcgccgggggcgacgccgtgttcgccgccgcggagccggaggacggcgcgagcatcaagagggcgcggctgcttctcgatgccggaagcggcggcgacggcgccgtcgacttcagcgggctctatagcacaaccgccggaagcgaagacgacggcgtcgggttcggcagcgattacctgcagccgccaccgccgtacgtgttccccgtcaacagcggcggctactgactgatggcggtctggtagtccagcatctatccgagcgatgtggcgtgcttcgtcgtcgttagttgcccctcccgagtgacgtgttggactgaagtggcaacggcgccgacggacggtgagcaaccaacccaagataattagctaggaggtggtacaaagtgtaaagcctttggtttaggcaggtctgcggtgatctttaatttgcttgttgcaatgttttccttccctaccttgtcaagtgaatgctacggatcagcggcggcaaaagccgttagctgcagctagtttgccgctgctcttcatacagctgcacgccgttaaaacaaatctcctttgcactggctgtcttattttttagttgttgagctggtgtaagcaaccagaaaagcttgacagatagctgacaacgtgtctgatagtttgaatatatatatatatatatactgttattatatattacagctggtgcattcaatatagagaatgcacccaggcgcaacctacgcgcccatgtgtacatggtccgacccaacctatccacatacccaaaccgacgc

SEQ ID NO: 2610 - DNA, 1522 bp, Zea mays
cgaggccggccgggttggggaccctcgggctcgccgggaaatctcggggatccggcactcgcctcccttttccctttccgcgccccatcaccattgccacaaatagcaaccaaggcagtaagcctagccaagccaaccgacggcggcgagagtatatatacacacacacctgacgcctctgctgctgctgggatcaacgcggcagcttagtgacgacgacgactcttctgtctctgcgttgattaatggacagtaacagatccatggcgacgagcggcgtggctccgttcgtggccaagacgtaccgcatggtggatgacccggcgaccgacggcgtggtcgcgtggggcagggacaacaacagcttcgtcgtggccgaccccttcgccttctcgcagacgctcctgcccgcgcacttcaagcactccaacttctccagcttcgtgcgccagctcaacacctacggcttccggaaggtcgatccggaccggtgggagttcgcgcacgtgtccttccttcgcggccagacgcatctcctgggccagatcgtccgccggagcagcggcggcaagcgcaaggacgacggcaacggcgccggcgccggctccgccgacgacgaggacgcggtggccatggaggtggtccggctgaggcgggagcagcgggccatcgaggagcaggtggccgcgatgtggcgccgcgtgcaggagacggagcgccggcccaagcagatgctcgcgttcctcgtcaaggtcgcgggcgacccgcaggtgctgcgccgcctcgtctccggcgccgggggcgacgccgtgttcgccgccgcggagccggaggacggcgcgagcatcaagagggcgcggctgcttctcgatgccggaagcggcggcgacggcgccgtcgacttcagcgggctctatagcacaaccgccggaagcgaagacgacggcgtcgggttcggcagcgattacctgcagccgccaccgccgtacgtgttccccgtcaacagcggcggctactgactgatggcggtctggtagtccagcatctatccgagcgatgtggcgtgcttcgtcgtcgttagttgcccctcccgagtgacgtgttggactgaagtggcaacggcgccgacggacggtgagcaaccaacccaagataattagctaggaggtggtacaaagtgtaaagcctttggtttaggcaggtctgcggtgatctttaatttgcttgttgcaatgttttccttccctaccttgtcaagtgaatgctacggatcagcggcggcaaaagccgttagctgcagctagtttgccgctgctcttcatacagctgcacgccgttaaaacaaaaaaaaaaaaaaggttattcgaacccggcaacctcgaaggggggggcccggaaccccatttcgccccaaaagggggggccaaattacccgggcttactgggggcgcggggtttttacaaccggcggggggtgggggaaacaccccggggggggtacccacaattattatcccccttg

SEQ ID NO: 2611 - DNA, 1394 bp, Zea mays
ctcgagccgccgggccggccttcctctccggataaaagataaggagtgtctctcctctctttcagctaagtccctgccccctctctttttcttacattcaggtcctcgcagctcctctcttttttcttgtttctttctttcgatctgcgagccgtccaggtccagtactctcctttccgtgaaggaactcttgcagccggcccctctggtttcctcgaattcttgttccccggtccctcctcctgtccccgcgtagatccgtccgtccgaggagcacaccgtccccacccccatgtttacccaccagttcctctgacggccgccgtgctccgatgaagctgagcgtgctccgtatccgccgctcccactccttctccgtcgccttcctctactggttctacgtcttctcatgaacgcatcgcccctctccacctgctgatccttcgccgtctctctctctctctctctctctctctctcttagatagtcttttgaatccatctctagggctcttgtttctccccatcctccccccaccccaccccccaccaaacagattcaatccgacaagacaagcatccatgtcgtcgtcacgccggagctcgagccccgacagcaacgacacgacggacgagcgcaagcggaagcggatgctgtccaacagggagtcggcgcggcggtcgcgcgcgcggaagcagcagcggctggaggagctggtggcggaggtggcccgcctgcaggcggagaacgcggcgacgcaggcccgcaccgcggcgctggagcgcgacctgggcagggtggacggcgacaacgcggtgctgcgcgcccgccacgccgagctggccggccgcctgcagtcgctgggcggcgtcctcgaggtgctccagatggccggcgccgccgtcgacatcccggagatggtcaccgacgaccccatgctccgcccctggcagccgtccttccccccgatgcagcccatcgggttctgagaatctgagcctcagccggcgggagagagccaatttctgtcgtcgtgccgctgtctatctcgtattggtatctattcataaatcatcgttgtcatggtttgctcttcttgtcagtgttataaatttgcttcttgttagtgttataaacttggccatcggaaagtagtaataatgatcagttcgtcgtggttctcaactttgtgtggtgaatgtgaatgtcaaaaaagatgtgtttgtagttgtaatatcttgtttggagttgtaatatcttatcttgcttgtgaaatcgaataggcctatatatgttatgctgtacgagtatgtggctccaaatttgtgagccttctgtctgttatgaatccaatttgtgagcacacatgaatcaatttcgagattcgacatgtc

SEQ ID NO: 2612 - DNA, 4524 bp, Zea mays
ggtctcgaacgccgacatattagtgtttgataatactgcaatatttttcaaaattatgaaaaaacttgcctcccaaacacccctgaggtttagcacataagccatgcacgaaaagaaacggtatcatcctaaataaaaggaactattggttatagatagaatttctctcacaatacaaatacaattagtgcgatgtttgcaaactatattaagtgtaaatgcatagcactataccttgtttttttttgggttggacgcacgatacaaagatatagtaggacatgtgacaagacggcgcgaggctgtcgtgtggtccgttggcgcggctagctgtttcggtggcgtcagtgagggggcccatgccgccgtgtcgtccaataccagcggccagagcctcgtcacccgtcggtggccgctgtacggtagcctggcgctgcgatttgcgaatcaccgccgccagcacagctgcttctgcacctccactccaccgccccacgagcaggagtaggagcagagcacaacacaaaccacgggcgcaggtagtgccagactgtagtccagtgtccgtgactccgcccgtcgtcaatagcctgtcatttgcttcgctttgggttgctcgcctgcagcacattcattgtgtcatctccggtaactatcatttattttaaatttcactctatcttcacatttcttattttagaacagattatgctatctctcagatcccctgcatcatcctctattttaaacttcattctacaaacactatcaatcattgtcatctacaattctatgtccccctattttacactatccgctagagacagtcttataggctgtctgacccaaccaatacgacctaatttgctcaaaaaacctgatccgaccaatacaataagcaagtacatgccatagtttttgacccgtaacaatccacgggctagacacataccatgattttttatctaaaacccgacccacctcaaaaaacctcgacctgacacatccaacatatgggaaatagatatacatgggtcatcgtcacatgaatacatccatgggccacttaaacagacccccacccataagtagtacaccaagatgtgctattggaccgaccctccttcaggagaaacatgtactatcggaaggataacacgctcagccagaaggattccgaagaaatacgacgcaaagacgttatccgcgcgcatatgttgcagagggaccaatagaattccgaataacgtgccccgcgtgcaaccggagagcagatctttcgcgcgctaaactcggagggaagcaattgccggaagagccggcgcacaagaatagtagaagtagataagtttccacgatctgtaagaggatatctccctagtcggctatataaggctagggaggtatcccaacaaaatgaatccctctctttcaccaccataacacccaccccgtagactaatatgagatctcatcgaacgccacccgcgaatcatctgtaataatctcaagcaaactcaatactcaacatcacacatgatgtaggctattacacatttaggcgacccgaacctgtataattctcttgtgttccgacgtgcacctgcacgtaccatcgagttgcgatcaacgtcgctgtcctccaaaaacactacgtgggtaatcctgtagtgcttggtcgagactaaacaccgacacaacaaaaaagtatggaccaaaccgactcgatccgacactaggcacagattaaatatgagctatgctagatgacccgcgatccaaactcgaccggacgatagaaatagtgcatggctaagtagagcaaggtggcgtttggtccgcggctacgatgagaatgcagtagactgaatccacgtgctaaaccaaacatcactggttttgtatattggataatgcgctgcagctgctagagactattcactattattaagctttggctgcatcttctcggattacgtgtgttgtgcaaattctcataatccacggcaaccagacgggggcgcaaccaattggtgtttcttaggaagcccccgcgttacattggatcataggatgattcaagggttatgattttttagctactaattggttgtcatcatggtttataggtgaatgattgaacatccgctacatttaggctatctccaactatttagtctcctcaatccaactattcgtactttttattcatatttaaacatctttgttctcaactattcttctctctattttatctccgctctaattaattctcctatccggtctcatttacttttgaactgagctatttaacatttttacatcaatttttgttggagtttgaaaacatattataatatttatagtactataatacacattattatatattaattactagtccatccattttattctaatttagtttcgaaattgctagatatggaaactgaaatagagttttagtagtaattacaaaaactaaaatataattttagttttagtgatttaaatactaaaatataataaaatagagagactaaaaattagtccgtgtaaaccaaacattctctaaataaaccaaacattcaccgtaactttctttctttcttctttttatgcgaaagaagatagttgcaagacgaatccagagtttatctggaagaagaaagttcctaatcctcctccttccctgtagatattatcagcaaggcaagcgtgtcacggcttcttgcttgagtaatccgctcctattttttttttttgggagggcgccttcctaccggcttcgcttctaaacggtgggcaaatttggtacgataaagaaaaaaagaggaggacgagtgggagggcacttctggaagaaactttttaatgagctggaccaagcagctgggcaagccagagccagccgtcaccgtcgcccagtccgcgtcgttcggtcagcgggccccacctcatctgcattcttccattctcgtcctccgacctcatctgcatttttccagccaagtagtaggtagactagtggcggtcccgtggccgtggcatcaggaaaagaatatgccgtcccagcccaccatccccccaccgtcccgaaatcccagaactaccctcggctccagctatgccggccgtgatctgggagggtgttgaaaccttccccatctccggataaaagataaggagtgtctctcctttgccatcctcctctctttcagctaagtccctgccccctctctttttcttacattcaggtcctcgcagctcctctcttttttcttgtttctttcgatctgcgagccgtccaagtccagtactcttctttccctcaaggaactcttgcagccggcccctctggtttcctcgaattcttgttccccggtccctcctcctgtccccgcgtagatccgtccgtccgaggagcacaccgtccccacccccatgtttacccaccagttcctctgacggccgccgtgctccgatgaagctgagcgtgctccgtatccgccgctcccactccttctccgtcgccttcctctactggttctacgtcttctcatgaacgcatcgcccctctccaactgctgatccttcgccgtctctccctctctctttctctctgagatagtctttcgaatccatctctagggctcctgtttctccccatcctccccccaccccaccccccaccaaacagattcaatccgacaagacaagcatccatgtcgtcgtcacgccggagctcgagccccgacagcaacgacacgacggacgagcgcaagcggaagcggatgctgtccaacagggagtcggcgcggcggtcgcgcgcgcggaagcagcagcggctggaggagctggtggcggaggtggcccgcctgcaggcggagaacgcggcgacgcaggcccgcaccgcggcgctggagcgcgacctgggcagggtggacggcgacaacgcggtgctgcgcgcccgccacgccgagctggccggccgcctgcagtcgctgggcggcgtcctcgaggtgctccagatggccggcgccgccgtcgacatcccggagatggtcaccgacgaccccatgctccgcccctggcagccgtccttccccccgatgcagcccatcgggttctgagaatctgagcctcagccggcgggagagagccaatttctgtcgtcgtgccgctgtctatctcgtattggtatatctattcataaatcatccttgtcatggtttgctcttcttgtcagtgttataaatttgcttcttgttagtgttataaatttggccatcggaaaggatgtgtttgtagttgtaatatcttgtttggagttgtaatatcttatcttgcttatgaaatcgaatatgcctatatatatataaaaaaaaaaaaaaaaaaaagtggctcaaaatttgtgggccgcctgtccgttatggtgaggcgatgaatccaatttgtgagcacacatgaaccaattaaaaaaaaaaaaaagcggccgcaagctccgcttctagacccgcggcc

SEQ ID NO: 2613 - DNA, 1381 bp, Zea mays
aggccggccgggccgggcttccccatctccggctgtcggataaggagtgtctctcctctctttcagctaagtccctgccccctctctttttcttacattcaggtcctcgcagctcctctcttttttcttgtttctttctttcgatctgcgagccgtccaggtccagtactctcctttccgtgaaggaactcttgcagccggcccctctggtttcctcgaattcttgttccccggtccctcctcctgtccccgcgtagatccgtccgtccgaggagcacaccgtccccacccccatgtttacccaccagttcctctgacggccgccgtgctccgatgaagctgagcgtgctccgtatccgccgctcccactccttctccgtcgccttcctctactggttctacgtcttctcatgaacgcatcgcccctctccacctgctgatccttcgccatctctccatctctctttctctctgagatagtctttcgaatccatctctagggctcttgtttctccccaccccccccccaccccaccccccaccaaacacaagtccccttgttcaatccgacaagacaagcatccatgtcgtcgtcacgccggagctcgagccccgacagcaacgacacgacggacgagcgcaagcggaagcggatgctgtccaacagggagtcggcgcggcggtcgcgcgcgcggaagcagcagcggctggaggagctggtggcggaggtggcccgcctgcaggcggagaacgcggcgacgcaggcccgcaccgcggcgctggagcgcgacctgggcagggtggacggcgacaacgcggtcgtgcgcgcccgccacgccgagctggccggccgcctgcagtcgctgggcggcgtcctcgaggtgctccagatggccggcgccgccgtcgacatcccggagatggtcaccgacgaccccatgctccgcccctggcagccgtccttccccccgatgcagcccatcgggttctgagaatctgagcctcagccggcgggagagagccaatttctgtcgtcgtgccgctgtctatctcgtattggtatatctattcataaatcatccttgtcatggtttgctcttcttgtcagtgttataaatttgcttcttgttagtgttataaatttggccatcggaaaggatgtgtttgtagttgtaatatcttgtttggagttgtaatatcttatcttgcttatgaaatcgaatatgcctatatatatatgttatgctgtacgagtatgtggctccaaatttgtgagccttctgtctgttatggtgaggcgatgaatccaatttgtgagcacacatgaaccaaaaaaaaaaaaaaaaaagcggccgcaagctccgcttctagacccgcggcc

SEQ ID NO: 2614 - DNA, 1705 bp, Zea mays
tttttttttcgcttttttttttttttttttcttgattataatactaaaaatttaattgcgctgtttgggatattttttcagaagccagtctggtgcgccgtgctccagccgagaggccaccagatccgaccgccgccgacgcgagtgtgcgggcgcagccgccgcgggccagccacgccgggcgaagagcggatctagccacccagcacagcggatctagccacccagcacaccgatccagccttcccaacggcttacaggccaggagggaggagtggaggggatggaagaagggagcaggagacgggaaggggagggaaatgagggaaaaaacggtcccgccgctgtcctcctcgctgctcgccggactttcggcgagctgctccggcgacggcgaagtgaagacctgtgcggcgggtggagttgagtgggatcgatggaggagccgcccgtgtcgcccagaggaggacgacgcggtggcgttctttcttcctgtggacaaaatcaaacacagtcagatgcaaaagagaacagaaacagtagagggtcatggaggacgtgtctcattcatcgagggtgaatgcagggtgagtcctggcgatggcggctcagctaatgcgaaggattcctcggcccccgcacggtctccacgtttgcagacagcacgcacagctactacgcacgattgcggttgaagcaaaacggcggctccaacgagcgggatccaaacgacggtgactgacactcacacgtgcgcaagcagaggcggagagtccggcggtgtggggtcagcttggccatggcctaaatggaatccctatagagcagagtcgtgggagaacacgactaggaagaaggaactgtcacgcggggcccatgctacagggcagcgaacaacgcgcgacatgcgggtgccaatccggaaagaagacgattttatgttttacgccatcgcgccggtgcaggcgtggagatgggccgagcgaattcggccggctggcgtcccactcccacgcgggtgagaagaccgggagaggcgctgggctggcagcctggcactgggattgagccccgcgatcggcaaagcctttcctttttattttctttttcatttcagttttaaatttcagattcaaacgaatttcaaacagttcgagctcaaattcaaacacaaacaaacaaaaccaatgctttggcacatagttcacaatataactttatatttaccctaatatttatttttagcaaagtgtattttttgaatgtatactccatataaatccattcaatttaaatgaataattggagatagttttatttaaacttcaaattaaaattttgggcgttacaaaccacgagtgttattatggctctgactttgacaattagcttaatttgcttagtgcttaccaatcttttctgaaatatgggcaaggggggggcaacgatggggtacaactcatgttatggggtgatagtcttggctaaattaatgtaaagcccaaaattgatataaaaataataaaataaagaaataaaatagtaaattcagatatctcaaattatacttaagctttgaattttgaggactgaatttcgaaaccaagaattaatgtagaaaagaagtaatagaaagattttctatccaactaaatgattattcatttcattaaaatgaaacactataagcatttatttaaatgag

SEQ ID NO: 2615 - DNA, 1200 bp, Zea mays
gcacgaggctcacctgttcaaagttttgcttcttgggcatcaaatcatactccaatttcaatgtcaagcagaggcggcttgcaaagaaactccaactgccctcaagcggagcaacgcaatatgcttatctctcagttaaccagaggatgcttcagagaagacatggatctacaaacgagattggctgtactggactcactttctgaagcatttaggaactgcgaggacacgcactctccagattcggatgatgatgattacgaggaccaaatagcgctcggcgtcgacagccagcaaagaggcgcctctgatgatcagataaacagcctgccactatcagtaatcgagggtgaaggtcgttccgatgaaccctgcaatatatgcttggactgccctgctgctggtgattcactccggcgtttgccatgcatgcacaagtttcacaaagagtgcattgacaggtggctcgggatgaagatatggtgtccggtttgcaagtcaaatgtgttctcccagtaggccgtgagcatctcttatactttttggagcagcatcgaagctagattatagttggctgatacgaggcattgttacggctgcagtgtgtacattgcgttcttgacttgtgctctcttctgctccgtggggagcatttgaatgctcttttgccgcggagagtttttttggctgtgagagaaggcacggaaaacctcattctgctattcccatttcttgtatacgtgtatgtaggctgacatgcatacaactacctagcgtacgtcagtcttgggcggtgccatggggggtatgaagcgctgagctgggacttgcaccctgaccttgggttgccgaagctcgcgagatggtcagcaaggcgcaaattttggggaaaagattctatacagatcggatgtaaaccggtagatctgcagtcggtcctagattaacgacacgtaacacttacacagatcttaaagcatgctgcctaagtcctgtactcctgtccagcctagtcgtacggctatgttctgttcggcttgtcgttgcggttactcgcttcggctctatatctagttgaaatttttgcagaattttatatttcagacaaattccgtacaattttatatcatcattacattgtatcttgtacattatatttaatgaatgatcagtcatttacattgtatcaaaaaaaaaaaa

SEQ ID NO: 2616 - DNA, 1334 bp, Zea mays
gagacgcacacgggcagtgacacgcgcgcataccgacggacttggtagctgctcaccagctatccagatcattggctcattgctgcttccattccattccccccctcggcatcggccgcgcccgcccgtgtcgggcggaggcggacgcgcgcgggaatgggacgccacgcggcctccggcggcggcgtgcagcagaagctgcgcaagggcctctggtcgcccgaggaagacgagaagctctacaaccacatcatccgctacggggtcgggtgctggagctccgtgcccaagctcgcagggctgcagaggtgcggcaagagctgccggcttcggtggatcaactacctacgccccgacctgaagcggggcagcttctcgcagcaggaggaggacgcgatcgtcggcctccaccagatcctggggaacaggtggtcgcagatcgcgtcgcacttgccgggccggacggataacgagatcaagaacttctggaacagctgcctcaagaagaagctgcgtcagcgcggcatcgaccccagcacccacaagcccgcggtctccgccaacgtgccggcggcatcggagcagccggcgtcgaaggaccgcaagccgtttgccacagccgccgctgatggcggctccgacatgaagcaccagcaggtgttcgacccgttcccgctgaccgacagcttcggcggcggcttcggcgccgcactgtacggccacacgggcggcaagcaggacgcggccgcgttcgtggactacagcagcgtgctggacgtgtcggagaacctgggctacggcggcgagagctccagcaacagcagcaactggaactgcgcgccggaggtgcacaacaatgcggtcgacggcgacgcgccgctgcactgggcctccgagagcaaggccacgcccttcgccggctacggcggcgaggagcaatcactcctcgggcacaggttctcgctgccctgccacggccagcaggagcagagccctccgcgttttgacttcgacatcggccggggcgccgtggtcggcgagttcagcctcgagttcttctgaaggtccagcttgggaatttcagcaatctagataccgcgtagcgcgtatatatatactgtgtattaaaggcatttcacacggaacaacaattgagagatcgtgcttcgttaatttcctctagtcgaccttactccttaacaatgtcttgcgtttcttttgttttttttatgttttatgtatgtctaaaataaaggcatagacatatatatgtaaacacggtgtagtgtaatagctatacattaaagtttttgtatgcaaaaaaaaaaaaaaaa

SEQ ID NO: 2617 - DNA, 1142 bp, Zea mays
cccggggtcgcacccacgccgtccgggaaaaaaaaaagaacaaaaaggaagacagcgaagttgtctacatcacttgacttgcgagcgaccgcggctcacgtcggctgcataaattgcttcgtagactagtaccacacagtttgcgagaaggggagaggtagaggttccgaggtagagagatagagaggaggagagggagggcgaggcggcggatccgtcactccgttcttctccgctgatctggaggaaggaggcgaggggagttgcaaatccatcaatggccactccaaccacctattcagtccgcatatcctcggagacccacaagattgaagcctgggtggtgtctgacgaagctttggccaggcaactgcaggaggaggagaacacgcgtgacgctgctgccgacaccagagaagtcgccggcaatgtacccttggagtcatcgtcaccggctgttgagtacaggcctgcacagaatgcagctcaggttgcaagggaagacaatgtggacccagataatatgtcatatgagcaactacaagcattaggggaagcagtaggaattcagtccagagggttatctgatgagctgatatcttatttggagccatttaggaacaagtgcactttcttctccaggaaaaagaacagtgaggaatgtgtgatctgcaagacaacatatagaagccggcagaaattgataagactaccctgcagccactgttatcacgcagattgcataactcgttggcttaagatcaacaaggcatgcccagtctgcaacgaggaggtgtttggatgaactgcaaggttcctggcagatgctgcggtttcatcgttacttgcttgcggcatgcttttgagaagacgttggacgcataaggtccattgtttgtgattatgttgtgagcctagtttggtgccctttgcttaagaggactggctctgcccatgcatgggtcggtctacacgtgtgctagtaactggaccaggtcgcgttttgtgatgcgtctatccatcttggttttatcacaaattgatagatctgttgtgtgggtagtttggttgccgttttctgaatataatggatggtgtttttgcccccttttgagagaaaaaaaagcaaagagcagttcaat

SEQ ID NO: 2618 - DNA, 1091 bp, Zea mays
aagctcacttggacccctcttcggctcttcccacaatctcacagccctcgaaggcaccacccgcgccgccgccaccgctccgaaattacagccatcgtagtgcggcggctaggtcggccggcgtttggaggagctccgaagatgtggtgccagtcgtgcaaggaagggtacgacgaggaggacgccgggacctgcaaggagtgctacgaggaggccagcgagacggaggaggagctcaagcgggagatcgacgacctccgctcccgcctcctcttcctccgcctcccctcccctaccctcgacgccgcatccgcccccaactgcgacctcctcctccacgccatcccctccaccggcgcgggaggcgaacgcgatgctgggcgcacccccgacacacccgccgtgcccgcccatcgcgtcatccttgccagcagatctcctgttttcagagcgatgcttgagaatgagatggaagagagtaggagtggcgtcatcaagatctatgatgtgtcttatgacatccttcgtgcttttgtccattacatgtacactgcagaagcccttctagacgaacagatggcatctgacctcttggtgttggctgagaagtacgaagtaaagcacctgaaggcatactgtgagaagttcataacatccaaagtgaatgacgacaatgctattacccactacgccttcgcgcaccgtcacagcgcaaagcagctgctggaggcctcgctttctgtgctcatggccaacatgtctacgctatcggatcgtgaagaatacaaggagcttgtggagaaggacccaaggcttgttgtggagatttatgaagcatatctcaaccggcaagtcaacactgcagctgggaaggacacaaattgtagcaacaggaagtgataattacgaacagaactcgtgcagtagcaatattctaactatgcatttatgcattcatgtaagcaagttaagaacatcatattctcatgctgtcttgatttaactgctaatttttttgatgataaatcaattagacgtgttggtgaaaaaaaaaaaaaaaagctgttgataatgaaacgggatctctgttt

SEQ ID NO: 2619 - DNA, 1133 bp, Zea mays
tggttaagcattgtcacaggtacagtcagaagttcaagggtgatgccgtgttcgccaagggaagctctggaatgaacttccggagctcttcgttaaaaaaacccaacaacgtaacaaagaaacgtctgttgcaagtccaaccgcatttgtgccacacagaggagagcaggcacaactgtaaaatgatcagagtctcggtagtcacacaacaaaatttcacagaatcaacaaccagaccggtgtaagagaaacagacaacagtacatcctgctgcaattttcacacttggaagaaaagaagaaaaaagaatggtagagccctgacccgggaagcaaaatctgctcggccagcggacacaagcaatctttctaatctacggtgggatccctacaatacaatgacaagcaccactacatatgtatgtacagtatgaacaaccgatcagaagcaccaatcttttgccttaacaaacaatgtatcagccactcagtcctccgccagtcagtcagtcgtcatgctccgccgagaaatccggctccgatggcttcctgaacttaggcagctccctgatgatgctgccggctcctctcctaagtgtgatactctgttcaggggaggaggcgtcgtcgccatcgccttcgtacggtcccgtggacgagaacgactccctcagactcaggtccttggccatcttcctcctcctcaggcggcgccaggcgtgctggatgaagcacgcggcccaggtcctccagtggtgggagtagtaccggaacgtgtgctgcagcttcctactgtggaggcgcctgaactggctggcgacgaacctcaggtcgtcggcctggagagcgaacgcctcgacctcgagaaccgccttcaccgtccgggtggacagtggcaggttgacggtgggcttggggacgagcgcccatccgaggagctcctcgccacagaagtcgccgggcttcagggtgatcgagttaaagaaacccgtccggccaccgtctgtcgtggagctttccagcttgccgcggatgatgaacagcatctcggtcactgggtcgcccggacgcgtgggcggacgcgtgggcgcacgcgtgcgtggacccgtgaattgtggaccggcaccggcagcg

SEQ ID NO: 2620 - DNA, 970 bp, Zea mays
tcgctcgaggggtcaatattcttgttgtaccacaagtcgtctcttgccacgaagaccttgttcttcaccaacttcccaagccgagcatgctcatgtcatgcccatgctcagacgaagaatatttgatagctggtatcacagaccaaataatgatctgtggtaaaggcaaagaagccaccaaatcaacaacaaagtcagatctcaagtactgctttgcgatttccttaggatctgtgatgagatctcctcgaccaaaaacccctaagtttgagcttggattaatatatgcagtcctgaactttatcatcatctggatgacataaaagaggtcgacaattgatcggaacacagtaacgatgatggctaggcgtgtatccttcctgacacaatgaaaggtttgcctgtaatcgatttcaggcacatagaagtacagagggtccatgaacagagcaatgaagcatgacacacggaagacgtatatccacgtcaagatgaagtcgctcgacgggtcgataatcttgttgtaccacaagtcgtctcctgccacgaagaccttgttcttccccgaacttcccaagccgagcctgctagcagccagcccatgctgcttctggtgaataggtatggttgccttcgccctctcatcatggaatctcacggtcctctgcctcgtgagcgccatctcgtcctccacccttccggagccgaacctcatgtggccccgcccgtccagtactctactccgctgccacatcgaccgatagcttgcccaagaaacagacttgctcgctcatccggcgccgtagcagtccgaggccggtccttccccgcgtaggagaccggcgccggggcgctcggacgctgggaatcgcagccgctccctcgtgcttcggagttcggactctgaggaagtgagaagaggaggggggttggggaagcgaccggaaatggagttcgaagcccggccggc

SEQ ID NO: 2621 - DNA, 2684 bp, Zea mays
ggcccggccgggcaggaatccaagccaccccagtccgctgcttccattccatctcccttctctcgccttctgcggcactgcagtgctctgctgcctcggcgtctccacctcctcccggcgacggcagggcatccgatacgacgccgcgcttccttccgaatcccaagccgcaccccgcaccctcccggtcgccattcccgatgctggtgttctcgagcgacgacgactgctgcggctcctcgtactaggggggcaggatcgatcggcagactcgcagaactataggatatcacagaacagttcttgaggtacttattgcagcctaatagtacatggagcgatattcagatatgagaccaaaggcagaagtttcatatctcggaaggggttccagattctcttctagaaatcaaagttcagaagagaggactaaccatagcagcgataaaccgggaagcagcacaagattcaatcctacgaaagcgagaattggcggtaatcaagggaggccaagatatgtatgcgattcatttaaatctccaagctcaaaggtgtcgcctgcaggctcttccaaatttccacttagcaagtttgaggagaggcgaagacagccttttgtgccagggtttgacattgctgaaagtagtagaagaaaggctgatgccaagcagctacagggtagtaagaaaattgctgcagagaacgacagttcagacaatctgcgaggtgaatcagaaggttttactactgaacaagtagtaaaaccagaaggctctcatgttgtcggtcattcaggtgtttctgcgtatacagtcgggtccctggtccaaactgcttcactaggttctaggacacacagacagaaacacaaagaagtgaatttgggtactccaggagcatcgtcttcaactctgactaacaggtctactatacctggaaattctaccatgggtgtgaggccagcttatggtcatgttaatggagggcagatacatggtcttaaaaaccttggttgttcttcggtacctgatgctcagccatcaggttgcccatctgagtctgttattagtaggaggaggtttgagttcatgagaaagagggcctttgaccaggaaagctcttccagatcagtgaacttaagcttaggtcattcaactcctacagatattcgcagaatcagaatgaatgaacaatcactttgtcaacaaataccacgaagcagcagcagaagccatcaggaatcggcaggttcagttaggacaagacgaccttctcctcatgccactaggatgagtgttcctgatggaagagcagatggcgtgctttctctgcacgagtcatccacaaaggatgtacagccagctcaggaacatctttcattggaagaagtctccactgagagttcaataaggccattctttgtggaatttgataataacattttctcgtctagtcatcttcgtcgctcgagtactcgagctgaaaggggaagaccaagctccctttttgaagaaagtcctcgacaaatgttccatagtctcatgggggagagggacagacatagacacataaccatggaaggaattacagaggttgctttctaaaatgtttcctatactggttccagttgttctgttttcgttgttagatcttatgccattataatccagttaaatatatagtgatactggtcttgattttgataaatatccataactttgactacgatggtggtttaagtgtaacattttggaatgaaataggtttattttctgtaggttttggctgcattggagaggattgaacagcaagcagagctgacctatgatcaattgctaatgctggaggctaatctattttttggcgcctttgcctcctatgatcggcatagagacatgcggatggatattgatgatatgtcctatgaggaattattggccctggaggagagaataggctctgtgagcacagctctttcagaggagcagttcacaaaatgcctcaaaagaagcatatatagtcaggtcgctctagaagtgaacaaatcaaccgttgatgacatgaaatgcagcatctgtcaggaagagtacgcggagggcgaagaggttgggaggctgccatgcgagcaccggtaccatgtgtgctgcataggccagtggcttgggcagaagaactggtgtccagtatgcaaagcgtctgccgtgccttccaagggctgaagcattggggatgctggaaaccccgttccggattacaaaccatccttgcttttgtctacgtacattgttcttttccctatatgcattagatatagatcatgtctagatgtatgacgctagaacagcttgcgatttgggaggaagctaagagagtaatagttagctggttaataatagttcatagctaatatttgctagataactattacttggctacctattagctgtgcctttcacattgtggtacaggacaaatgcttgtcagatcgtgaacaaccttataacttgatgaatggcctaagtcaaagaggaatatgttgtgccaatctcaaccctatgctctcttcgtgtagtctgggtgtgtttggttgcgggacagtcaagaaagggacggttccctgacgttctctctcgtctttctgattttgagggataactggggataacactgtaatagttctgtgc

SEQ ID NO: 2622 - DNA, 5349 bp, Zea mays
  misc_feature (1542)..(1542): n is a, c, g, or t
  misc_feature (1578)..(1578): n is a, c, g, or t
tcatatttttttccttgcagaatgttacccctaagaaggcagaagagactgctttgatatctgatgttgttgcagattcaccatacaaggtaacatatataattggtttcagctttttagaaattttcaaagagaaagctgtctcaaggttcaggtcattcttggtttcctgcctgttgtagtttcttggttgttctgtgagaactcagttggagtagaattggctgttgacagctatgaagttactctgatgtcatgtcagaatttcttcaaccgctatttttacctagggacaatcttgtatatccagcgaagccatctcacatctcattgtggaaaaaagagttaactgattcagaatagttaagcataagaatatttgactgttcatttttttaagaatgcacatgtttctgattcacctttgatttttacagattttcatagcgggcattgctggagtgatctcatctaagatggtaatatgatagacatcagtatcggtgctttatatattaagtatctttttgttctttgtgtgaatgttatagcttatgttcctgaaaagttactgcattcccctctctttcagctaatggagattgttagtgcatttggcccattggctgcataccgctttctttttaacaatgagctcggtggaccctgtgcatttcttgaggtataagtgctgtgtgcgtaggctagagtatatgatcatcatagtcacttctgatcaatttgatatggacagtacgccgaccgctccgttacttctaaggcatgtgctggcctcaatgggatgatgcttggtggacgtgtactgactgctgtgcatgtgtttcctaatcctcatgtggaggtataaccatttcggcctattcatttactgtcatgtatatactccactgtttgaaacagtatggtgttctagttgaatttttatccaaatctagttgaattttcaggctgctaatgaggcttccccattttatggtattcctgacaatgctaaattgcttctgaaagaaccaacaaaggtcctgcagctcgaaaatgtggtatgttgtagtttatctcttctcacttcacatttctagttaaatcaacaatgctctccaaatcaaaacaatttatggcttcatatgcttcataaatcctaagtattgttggttatttttaggtctcacgagttcaaattgatagataaatgacgcagcaatctttttttttagaataatgaattaatgatgcagaaatctcgaactctgacactaatgcataccattggacaaaaacaaccaacctatcacttattttcgtatattcgaggtttataaaataaccgtgcaacctatgtagtttgaacgagaagagtatatgctactttcaaaatctgagctggaagaaacattggaagatgtacgtgttgaatgtacgaggtgcgcacatttcttttacattcattttgtgttattgattgtggtggattttgaacttacagtatggacaagattcacaggtttggagcagtcaaatctntaaatgtagttgagtatcctgctgctggtgtcagtnctgcagaggagaacatagttgagctcaagattgaatgcactgaattttctgatacggaaaacattgcaaaggctgtatcagaatattctgtaccgattattccgagcatagatgttctaaatcattctgtcgcttcggatactaaagatgtggatcttattccagagagtcaggatcagaaggacaaacacctcccttcaaatgcagcactttgtgagagtgaggcacctgtagcagatgaggacgcagagcttgatgaaactcagtctagagctgctctccccacaccgcaacatgctgaagctgatcatacggaagcagctgtggatgagaataaacatacaggagcagggaaggttactgctactgcaacggacgacgatgcagtagaaaagagtcatggagacccaagaacctcagagacctgcaatcctgctggacctacagacaaagcggagaaacctggaaggtactccgaacaaggcgctggtgatgtgactgaagatcgtccagaaaaagaagcccaagctgttgggaccagcgacactggtttcgtgtttgaacctggttctgtgcttgtggagtttttgcgggaggaggctgcttgcatggccgcacattccttacatgggcgtcgcttcgggaacagaactgtgcatgctggatatgctccgtatgatctctacttgcagaaataccccaggtgattctgcgtttgcgactgcatgagctgcgatacgagctttgcctatgtgccagtatttcacagaaacttcagacttgtagttttggcttttgagcctttggatggttcttccggtccagatagtggtaccattagttgaacgaaatatttggaaatgttgttccacagtagatatcggatggacaataggatataagtactggatagagacacaagttgtcgttaacatcgttctttacttcgctattaatgtttttgatgacgtcagacattagtgtggatggatggatggaatggatttattgcaatttttgcacgattttggctgctataatctcatttttttactatctgctcacttgtgctctgatgtttctgaatgtgtttttttctctctcgaaaccgaatcgcatacccttgtacggtttgggtgtacaagtaactcagatcatttggcacctaataacagttttgcatgggttattgactacgactcagatggcatattgacaggaatcacttcaaccattcgatggccgcaagcttagcatgttgatcgctgattgtgctggtggcggcagtctgatcgccggcagcatcgaaattcagttatccgctagcttctccagcttcagacattagtgatctgcgttgatagagaattaccttcgctgattggcacatgatatcagatgaactaaatttgatcaaatacctgacaaaacacgcaggctgttcttcaggcggacattacacaggcacgagtagcaaccattcattcgatggtgtgtgcatgttctttagactatctacgaaaagtgcagtatatattataaaacagtgttttagatgatcatatgagtaaacggatggacacggtcttacaccatgatttttgtagctgcataggcatcttcaagagcgggtcacttagattagaagcattcaagaaaacaattacaattataaatgaatcaagttagggttgtaatcttttcaagccacacttcacacttagattgataatatgacagagacaatattgatgcaagatataaagtaccaatagaaccataccgtgaagaccttaagcttctccatagctttaacattaaaagaggcattgttcaaagtgatagagaaaactttattaataacacagtaatcttcaagcacagtcataaccctgttctcacgagtgtgacatgttttaattagtctaagcccaataagtcaatgtttttttttaatagccggtccttagaaatataatgagcaataatcctccttagctttatcactctaaatatcagatataattgcgatagaagaaacatagggtatgtatacgaggaattgttgaagccaaactgtatgtagaggacaatatttaagggaagataataaaatgtattagaaaataaagataagaggagatgcatagagaaaattgttggagagagccttactgcatgacatgagcacatggcccactgcagctgcaggagtagcttgacgctgctgcgactgcgacacagggcgaagcaacgagacgggttccgagcaggcgccgtcgtcgtccttgtttcgctatccctcctgcagaaaccaatcaacctcgtcagttccggccagctccgatcctgttgataattaactcagtgcagtgaataattaggtggaacagacgccgtgcaagagggaggacgatacacactcgctacatggatgctctgctcatctgaaactcttgtgataatggacctcagctcagtgcctcttcctgccagggcatctcaggccttgaatgctgaaaaggtcacggacacagagggtcctgatgctcgtatcgtcagtatgctgcggacgcgtttgctagtgaactaaactgctgtgtcgataaaaaaaatcctccgttctttttaatttgtcatggtttagattaaaaataaactagctgagcgacaaatattcgaaaatataactctagatacattcctttttatcaaagtgtttaaaggttgatcgcgtgcgcgcgcgtgtgacaaatatatatcagcatgcttagatggtacatgagcgcgtgagcagagtttagacccacctggtatggtatctgaacataaactaggatatcaattttaaactaatgaccactagtactctgaaacatgcaatgcaatgcagacacgcagtgcgacggtcctgtgtcgctgtacacgagacagtggcagcggcgccggcggcggctgctgctgcttatcatcacagtgatcattagccccaacgcagtcacttggcggccaaacggggggcagatacagcggggagctgtctcatcatctgcctctgcctgcacgactgcaaacctgcagcgcgtgcgatactggtggctacatcttggagacagattcagcaccgacgccgttttgaagatgccaggccactgttcaggataaccatcacgatctcacagaacactagctcagggatcgtgccgcctgatgctacatcagtgatgcatccaaaaccctttgctcagactcagatgacagcggcacaggatcgtcgcactgcactgcagtgcagtgcagtgcagttgcattgcatctttctgaatccatatgtcttcaagtgctgctgcagtccactcgccacatattcatgcaggaaaccagtgtatagcatatactccctccgttccgtttagatgtcgccgctatttatagattggctgttagaaacgacttgtaaaaattggctgttagaaacgccttgtaaaaagacacggatggagtatttttttttactgagctggtagtctgctgctaactcacatcacatcagagtggcatgcactgtgcaggccttttctcactgaaaccagggagcgttttgtgcagatcagctatgccctgcaagctgtacagctctttagaccgtaggaaatgcatgcaatggcgatgcggctgcttgcgccttggattcttttgtaaacttgtggggcaacttttgaccggtttttgcagtccactgcggaaaagttgcaggagcagtgtagcaaa

SEQ ID NO: 2623 - DNA, 861 bp, Zea mays
ggattgctctgttctcccaactttctaaagctcaccatttgccctgcctacttgggtcgtacgcaaccctcgccgagagcagcccccgtaaaatcttcctctgcatcctattcgctattgcgggtggcatcgccggtggcgttcgtgtgcttctcgcgggctgattgcaaatttgtgcccctaggactttggccgttggacggtggactctgcgggatccccaacctcctgctgagctcccgcacagagggcgggcatggctggaaggcataccatcattctcatgcaaccatcacagaacagatcgacgaggacatttatggactacgattcagttaaccactcgctggatggaatatgtggtctttacgaaaggaaaatcaggaacataaacccaatggtcaggaacttgacttatgatatcggtgacctgtacaacttcatcgatggcctgaccgacataagtgcactggtgtacgatgattcacttcacgctttcctgccgtatgaccgccagtggataaaacagaagctgtttcagcacctgaagcggatggcgcagcagtagggtatccagcaccgctggcttttgacctgcatctggttaccggttcgggcttggattcaaatgcccgggatgtgtgtatagaaataagacctgtgtcccgtgtttgatgtagaacatgtggacatggtgttgcttctgaagacgattttggctcaacaatgcagatttcatgtttgtcatctctctctctctctctctctctccctccctcaaatatatggagatgaattggaaaacggagatgaattggaaaacggaagccaatccgttgggtggtagccggcccgatttct

SEQ ID NO: 2624 - DNA, 838 bp, Zea mays
ctctcggattgctctgttctcaccaaactttctaaagctcaccatttgccctgcctacttgggtcgtacgcaaccctcgccgagagcagcccccgtaaaatcctccgcggcccccgaggcccgccggcccggggggggcatcgccggtggcgttcgtgtgcttctcggtacggtgaaacctttattgccgttcctgccgcactttcctcatttcttgagactttggccgttggacggtggactctgcgggatccccaatctcctgctgagcttccgcacagagggcgggcatggctggaaggcataccatcattctcatgcaaccatcacagaacagatcgacgaggacatttatggactacgattcagttaaccactcgctggatggaatatgtggtctttacgaaaggaaaatcaggaacataaacccaatggtcaggaacttgacttatgatatcggtgacctgtacaacttcatcgatggcctgaccgacataagtgcactggtgtacgatgattcacttcacgctttcctgccgtatgaccgccagtggataaaacagaagctgtttcagcacctgaagcggatggcgcagcagtagggtatccagcaccgctggcttttgacctgcatctggttaccggttcgggcttggattcaaatgcccgggatgtgtgtatagaaataagacctgtgtcccgtgtttgatgtagaacatgtggacatggtgttgcttctgaagacgattttggctcaacaatgcagatttcatgtttgtccggcggaccagcaggccacctgcaactgactcaaagagcatgacgggccggctcggcg

SEQ ID NO: 2625 - DNA, 1115 bp, Zea mays
gacctttgcccccagtagttgctgtgattctcagtgcttggatttcagcgggctgattgcaaatttgtgcccctaggactttggccgctggacggtgcactctgcgggatccccaacctcctgctgagctcccgcacagagggcgggcatggctggaaggcataccatcattctcatgcaaccatcacagaacagatcgacgaggacatttatggactacgattcagttaaccacgcgctggatggaatatgtggtctttacgaaaggaaaatcagaaacatcaacccgatggtcaggaacttgacttatgatatcggtgacctgtacaacttcatcgatggcctgaccgacataagtgcactggtgtacgacgattcacttcacgctttcctgccgtatgaccgccagtggataaaacagaagctgtttcagcacctgaagcggctggcgcagcagtagggtatcatcaccgctggcttttgacgtgcatgcgtcgtggggagaaccccctcacctaagccttaaggctttgtttgggtgctctagtattaacctcaattcatatgtattgaggtgaattaaggtgtacattagtttaatttacaactcagggcttgttcggttagctctcaatccatgtggattgagtggaattggataggttttaatcccaaacaagtcaaacttattctcaattttttctaatctcatccaatccatatgtattgggaataaccgaacaagccctcaatccatctcaacacatgtggattatggtcaatactagagcatccaaactagcctatggttcgggcttggatccaaatgcccaggatgtgtgtatagaaataagacctgtatcccgtgtttgatgtagaacatgtggtcatgctgcggcttgcttctgaagatgattggttgaacaatgcagatttcatgtttgtcaaaaaaaaaaaaaaaatgatatctgacggactgggcagcatgaccgtgtttagagataggttgggatgatctgccattggattctagatcttttcacgttcacatatctacagaagcaaatccaatttcaaacagggtcaagctcactcgagagaagcaaatcgagcag

SEQ ID NO: 2626 - DNA, 1753 bp, Zea mays
cctcgaggccggccgggaaaaaaattcaaaaaaaaaaaaaaaaaaaaaaaccggcccccacgcctcacgcgaacccccattccggcagcggcaggcatctcctctcccgccccgccccgagcaacgcccgctaggctgctgctacccgcagtccccatccaccctacccgcagtccccaccgcaaccgccgcctcggcccgggctgtgttgacccccgttgacctccgccagcccggccgtcatggacctgcgcttcccgccgccggcgccgtcgtcctgcttcggcgggggcggtgtgctcccggcacgggggcaccaccggcgggcgcaatcggagacgttcatccggctgcccgacgcggacctcctgctggacccggatgccgacttcggcttctccgacatcgacttcccctcgctgtccgacgactcgcccgcggcgtccgacccgacgccgcagccgcaggccccgccaccccagcagccgcttccgcaggcggcttcgccggcgtctgcggcgccgccgaggccgccgagcggagcgcacatgcggagcctctccctcgacgccgccttcttcgacggcctctcgctacagggaggcgggggcgtggcggggcacaagaggagcggctctatggacggggccacctcgccgttcgagggcgagtccgcgccgacgtccgtgctgccggactacgccaagaaggccgtgcccgacgacaggctcgccgagctcgcgctcctcgaccccaagcgcgccaagaggatcctggcgaaccggcagtctgcggcgaggtccaaggagaggaagatcaagtacaccagtgagctggagaggaaggtgcagacgctgcagacagaggccaccacactttcggcacagctcacgcttcttcagagggacacctctggtttaaccactgagaacagggagctgaagctccggctgcaggccatggaagaacaagctaaactccgagatgctctaaatgacgccctgagagaagaagtccagcggcttaagatagccacagggcaggtccctaacataaacgggaatcccttcaacggaggactaccccagcagcagcagcagcaggtgccgagctatttctcacaaccacaggggatgcaatacttcagcagccaccagggccagcatcagcatccgaaccatcaccctcagagttcttcaaacggtggtggccagtccttgagtgactccatggatttcatgtgaggaccgaaggagagacagctcaggagttgcctgagatcacataccaactaaagtactgtaaaaaggttgctgatgtataccatattcagtattattatgatacgcgtcattgtaggttagctagctgttccttgtaccattaatcagaagttcattcatgcatgaattgacaacctgtcattgctttcgtttctggggttcaagtaaaatcgtttgactgcttgacgagttcagtgtcggtgttgccatgtaaagtcgttcttgtaatagtgaatgaatagttcccggttggacctagtggttttttacactgctgaaagccatcgtggttggcaataatgtctcatggtcaatgaaacgtgaaataattctgcctgtaaaaaaaaaacgtggtaacaaatctcaacaagctggtggagctaccaaaatgatccatctgaagttactcagaacaagatgcaatcacagattgattatctttcgctgaaataaaaaaggggcttccgttt

SEQ ID NO: 2627 - DNA, 1520 bp, Zea mays
ctactcgtaacccgccggtaccggccttcccgggcgccccgagcaacgcccgctaggctgctgtgctaccccgcagtcccaattccacagtccccacccctccaggtgcaccacgccgccaccgcagcctccgccccggctgcgttgacccccgttgacctccgcccgcccggccgccatggacccgcgcttcccgccgccggcgccgtcgtcctgcttcggcgggggcggggagctcccagcacgggggcaccaccggcgggcgcactcggagacgttcatccggctgcccgacgcagacctgctgctggacccggacgccgacttcggcttctccgacatcgacttcccctctctctccgacgactcgcccgcggcgtccgacccgacgccgcagccccaggccccgccgctccagccgccgctgcagcaggcggcttccccggcgtccgcggcgccgccgaggccgccgagcggggcgcacatgcggagcctctccctcgacgccgccttcttcgacggcctctcgctgcagggaggcggcggcggcgggggggtaagagggggcgtggcggggcacaagaggagcggctccatggacggggacacctcgccgttcgagggcgagtcggcgccgccgtccgtgctgccggactacgccaagaaggccgtgcccgacgacaagctcgccgagctcgcgctcctcgatcccaagcgcgccaagaggatcctggcgaaccggcagtccgcggcgaggtccaaggagaggaagatcaagtacaccagtgagctggagaggaaggtgcagacgctgcagacagaggccaccacgctttcggcacagctcacgcttcttcagagggacacctctggtttaaccactgagaacagggagctgaaactccggttgcaggccatggaagaacaagctaaacttcgagatgctctaaatgatgccttgagggaagaagtccagcggcttaagatagccgcagggcaggtccccaacatgaacgggaatcccttcaatggaggactatcacagcagcagcagatgccaagctatttctcacaaccacagcagatgcaatacttcagcggccaccagggccagcatcaccatccgaagcatgacccccagaattcttcaaacggcggtggccagcccttgagtgactccatggatttcatgtgaggactcaggggagacagctcaggagtgttgcctgagatcacataccaacttcaactaaagtaatgtaaatgtagctgatgtataccatattcagtgttatgatatgaaccattgtagtttagctagctgttccttgtaccattaatcaaaagttcattcatggtgacaaacctatcatcgcttttgttctggcgttaaagtaaattggcttgactggttgacgagctgtcgttgtaaagttgttcctgtaacagtgaaggaatggtttgcggttggaacgtggttttccccctgctgaaacccgttgcatttcgtgattggcgtt

SEQ ID NO: 2628 - DNA, 761 bp, Zea mays
  misc_feature (27)..(27): n is a, c, g, or t
cattgggaccctcgaggccggccgggngaagagctcaaaggcccgcaagcagacccgggcgggccctggcaattcacgcacctcgcgtgcacacagacacaggcaggcacacagcgcaatcaccgtctcgcctcgcagtcgtactcacggtcttgcacacacccgtccccatcctcttccggtgtcgccatcccctccgtcgaccgccgcgtccggccgcggcaacccgacctgtgtcaatcgccatgactacctcaaggcgtcttgctgataggaagatatcacgatttgagaagaatatcacaaagaggggctctgttcctgagacagccaagaaggcaaacgattatcctgttgggcctattcttcttgggttctttgtcttcgtggttgttggatcatctctctttcagatcatcaagacagcatcaaacgctggtctattctgaggtgaatcggttgacacatgcagtttgtcactagaaactatacaagtgtagggcgtggcttaatgtcgcctttttaatgttgtaccgtggagagttttaagttatatatgtaatggaagtgctaatttaagtcacctgtctgacaggaaagatgttggagtagtccataatacatatcgagtatagttatagttcgtgttaaatatttctatgctcaaattggtcgcatcattgggctattgtactcttcgatttatcgagtaatttggtaatctttcgcaaaaaaaaaaaaaaaaagcggcccccgagctc

SEQ ID NO: 2629 - DNA, 750 bp, Zea mays
ttgggtacctcccggccggccgggagacccgggcgggccccggcaattcacgcacctcgcgcgcacacagacacagtcacacaggcacacagcgcaatcaccgtctcgcctcgcagtcgtactcgcagtctcgcacacacccgtcccgccgtccgcatcctcttccggtgtcgccatcccctccgtcgcccgccgcgtccggccgcggcaacccgacctgtgtcaatctccatgactacctcaaggcgtcttgctgataggaagatatcacgatttgagaagaatatcacaaagaggggcgctgttcctgagacagccaagaaggcaaacgattatcctgttgggcctattcttcttgggttctttgtcttcgtggttgttggatcatctctctttcagatcatcaagacagcatcaaacgctggtctattctgaggagaatcggttgacacatgcagtttgtcactagaaactatacaagtgtagggcgtggctcaatgtcgcctttttaatgttgtaccgtggagagttttaagttatatatgtaatggaagtgctaatttaagtcacctgtctgacaggaaagatgttggagtagtccacaatacatatcgagtatagttatagttcgtgctaaatatttttatgctcaaattggtcgcagcattgggctattgtactcttcgatttatcgagtaatttggtaatctttcgcagaaaaaaaaaaaaaagcggcccgcgcgccccagc

SEQ ID NO: 2630 - DNA, 773 bp, Zea mays
cactcctatgggcgattgggaccctcgaggccggccgggagacccgggcgggccccggcaattcacgcacctcgcgcgcactgcgcacacagacacaggcacacagcacaatcaccgtctcgcctcgtactcgcagtcgtactcgcagtctcgcacacacccgtcccgccgtccccatcctcttccggtgtcgccatcccctccgtcgaccgccgcgtccggccgcggcaacccgacctgtgtcaatcgccatgactacctcaaggcgtcttgctgataggaagatatcacgatttgagaagaatatcacaaagaggggctctgttcctgagacagccaagaaggcaaacgattatcctgttgggcctattcttcttgggttctttgtcttcgtggttgttggatcatctctctttcagatcatcaagacagcatcaaacgctggtctattctgaggagaatcggttgacacattcagtttgtcactagaaactatacaagtgtcgggcgtggcttaatgtcgcctttttaatgttgtaccgtggagagttttaagttatgtatgtaatggaagtcctaattaagtcacctgtctgacaggaaagatgttggagtagtccataatacatatgagtatagttatagttcgtgttaaatatttctatactcaaattggtcgcatcattgggctattgtactcttcgatttatcgagtaatttggtgatctttcgcagaaaaaaaaaaaaaaaaggccccgccctcgagctccagc

SEQ ID NO: 2631 - DNA, 838 bp, Zea mays
acactgggcgatgggcttccgccccgcccggccggacttcacacgtagcgcgcagccgcagagtcaccgtctcgcttcgcagtcctactcgcactgtcgcacacacccgtccccatcctcttccggtctcgccctcccctcacgccgctcgccgcgtccggccgcggcaacccgacctgcgtcaatcgccatgactacctcaaggcgtcttgccgataggaagatagcacgatttgagaagaatatcacaaagaggggctctgttcctgagacagtcaagaaggcaaatgattatcctgttggacctattcttcttgggttctttgtcttcgttgttgttggatcatctctctttcagatcatcaagacagcatcaaacgctggtttattctgaggacaattggtcacttacttttagtcactctaaagtcgaggaacagggttgacatatgcagtttgtcacttaaaaactatacaagtgtatggcgtagctggtactctacaatgtcgcctttctaatgctgtaccatggagagttttaagttataatgtatagtccatatatatatatatatgcaatggaagtgctaatttaagtcacttagctgacagaaaatacgttcaatccataatacattacatatcgagtaaggtctagtttgagtattctagtattaacctcaattcacatgtattgaggtagtttgatgtgtaatttaaactaatttacacttcaacacatgtggaacatgtggattgaagtctaaagtactcaaacaaagactaaagttatttttatgctcaaaaaaaaaaaaaaaaaaagcgcccccgctccagc

SEQ ID NO: 2632 - DNA, 599 bp, Zea mays
gggaccctcgaggccggccgggaaacttacacgtagcgcgcagccgcagagtcaccgtctcgcttcgcagtcctactcgcactgtcgcacacacccgtccccatcctcttccggtctcgccctcccctcacgccgctcgccgcgtccggccgcggcaacccgacctgcgtcaatcgccatgactacctcaaggcgtcttgccgataggaagatagcacgatttgagaagaatatcacaaagaggggctctgttcctgagacagtcaagaaggcaaatgattatcctgttggacctattcttcttgggttctttgtctttgttgttgttggatcatgtaagtccttatgtttctgatgttttgtggttgatggtcttcctggacactctttcgcgtttaacagttgagtgcatctgctgtctgccatcctaccaattcagctcggaaccatctgttctgatattttaatcatcatcaatcctaagttcctaacacagtttcttgtcagttgttatttgtattacagtaacatgcttattattctgaagggtaatgctttatgtaccttggccacaaaaaaaaaaaaaaaaaaaagcggcc

SEQ ID NO: 2633 - DNA, 1239 bp, Zea mays
  misc_feature (1193)..(1193): n is a, c, g, or t
cattgggtacctcgaggccggccgggttttgtctagagatatacatctgcttcgcccgggctccggctcgggcgagaaatcaatgggatcctgcttccagcttgtctttgcaccaatcgatgagcttttccctgatgatgctccattggtatcttcaggctttcgcgtgatcccgttggacataaaaacagacggaccaccctctggaagaacgttggatttggcctctagccttgaagttggcgcaaccacgcaacaagtggcaggggatggatctcaggacgtttgcaacctgcgatctgtgctgacaattgcctttcaatttccctatgaaacacatctccaggacaccgttgcagctatggcccggcaatatgttcgaagcatcgtttctgcggttcaaagagtatcaatggccatttctccctcccattctggcttgaatactgctgggcagaagctaatttctggctcccctgaagctgctacacttgttcgctggatttgccaaagctaccggtatcacttgggggtggatttggtcagccactcggatcaagctggggaatcacttttgacaatgttctgggaccatcaagacgctgtcttgtgctgctctttcaaggaaaagcctgtgtttactttcggcaaccagatgggagttgacatgttagaaacgactttagtcgctctgcaagatctcacccttgacaagatctttgacgagcctggtagaaaggcactacatgcggaggttccgaaactgatggaacagggctatgcgtacctgccggctggggtgtgcctgtctgggatgggccgccatgtctcctacgagcaagctgttgcttggaaagttctcggtgaggacggcaacgtgcactgcctcgccttctgtttcgtcaactggtccttcgtctgatgtgatccaagtgcaccgcggaaactttacgatcagcgtccatttttgcattctctgtagacgagaatggtgcggtgttgctgctactgttagctaggcaacggcatgttcaggtagtcttggggaaagccagtattgtgaagatgtaaatttgcgcccgtttccgctaatttaacccgctggacttgctgttgtttgttaaggccaggggcactcgtacgtgagattaaatgttgtgaaattgtatgtgctgaaacataggtttacattngaaattggcataaaaaacggaaaaaaaaaaaaaaaaaggcccctaa

SEQ ID NO: 2634 - DNA, 1766 bp, Zea mays
tttaatgctggctggtttaagaacctgaaatggacaaaggaatccaatcaagtgtttacaaacttccttccctgattacattatgtgaaaaccgtctactctcaaacttgtacagctgtctgctatctgttgtgatccgaaccactatgttgagaagggcctgttgtatttgcattgcgtgaccggcttgtaaattcccatgttaatgttcacctagaacaaatgcatcactcactatgcttacaacaatttattttggaagaagcgtccttggtattttcacaaactgtcagtatgactggatctggctaatcccagcgtagtatttaatgttaaaaaaataagagaattgttctgggaaaagagaaaaggaacacagccttacagatgcaagtggaactgaagctaaaacttgagcagtaataatatgcgcactaattactggcaggtgaattcatctgcctgacccttctcttcactgactgcagcagctgtcacagctgatgaattcggatgccttttgttcataaaaggcccgtccgcccgttactggcccaactagtgcgaagtaaccctaacaaaacaggccattgggtaccccgggcccggccggggactccgtcccactgcccagccgctgtgcgttcgcgctctctcccactctgtctgcgacgactgcgtgggtgggcgggctaccgccgccgcccgtcgccaggtgccgatctcttcacacccttgaccccctcctctcgcgtctgccgtgcgagaacgtaccgccacgacgagcgatggggaggccgagcagggggcggcagcgcatcgagatccgccgcatcgaggaaggcggccggctgcaggtgaccttctcgaagcgcaagtccggcctgcaaaagaaggccgccgagctctccctgctctgcggctcgccggtcgccgtcatcgtcttctcccccggcaggaaggtgttcgcgctgggcagtccctcggtcgaccacgtcctccgccgccacgctcctccgatccccagcgaaggagaggaggacgggctccttccggcgctccaggacggagacgtgatgagcagcagcgctatcgctgaccgcgcggaggtggagaacatcgtgcggcgtacggaggagaccaaggcgcgttcggtggcggagaaggcgcggatggacgccgtcgggaaggccgtgaggcaggccgcggcaaaggccggaaggaggttctggtgggaggcggactccggcgtgctcggggacgctgagctgccaggattcgccaaggcgctccgtcggctcaggcctcagggtcaacctgcagcgccatttggactcgctgtcggcgtctgctaataagcaactgcagtaggagcggctgtgcaaaactggctcatttcatttggtgttgcttaggcacttagggtatattactaatgtttacaacgttaatatcatgctaaaagctaggtcttcacgcgtagaggcacgcccacggtgcatctcttaacactaaaagcgctactccttctcactccgcaagaagttttgttagcactttaagagcctgtttggttcgtgattaactgtgtcacactttgtctaaggttagtcgtctaaattgaagaactaaccttagtcataaaagttaggcaaagtgtggtaacttagtcatcaaaccaaacatgccctaaagctcgtgttgtgtaaggaaatcggcctgtaatcttcaactgaagagggtgagttggttttgggatcaggatc

SEQ ID NO: 2635 - DNA, 3459 bp, Zea mays
ctgcaggtgtgtagaactgcggattttccatgcgttcttttccccgtgcattcttttgtttgatgttgttcatttactgacgctgtttgttctgttggtagttgcaaacagtccacgaggcaacgatgttctctcgtccgaagtgcagcattctgagttgatatcgaggaattctgaagccttcaaacagatgcggtttgtactgtaactcatttgtccattttagagtcattagttcttgtaatgtgattactgttgcatcaatgcattagtattatatgccctttctagattcaattttgttggaggcactgtgattattgttgcattgaatcattggggatgataagttccataggcaaaataactaatcctatcttgctcctgttgggaaatacccatttgacaacttataatgtctccttccattccaaactataagacgttttgacttttcttcatacataatttttggtatgcctagatacatagtaccaagaatatatctaaaaaagccagaacatcttagaatttggactggagggagtactttctagtagtttgtagttagtcgtgtattgttccctgctgtcaggcataatgacatggcattggacaaccatgtcaaataattagctaggcattgtcatgttgattcgcatatcctgctgtgcctgtgtaccatgttgaatatgttaattcaagatttttgtttgcctcttgtttgtctggtaaccaaacatgttggaaattcccttgaaaccttggtgttgctgctctagcatgaagataagttgttgtgaataatcaatttgatacttccctgttcagcggcccgagcataacacaggagttgcagccatgtactatgtattattaactccatcattatgcaattaataaattggcattccaaataagaatcctataattggccatgtttctgaagggaagttttatattggcatgagacctgtgaagcagttgttttaaggggtatagattatagatctagtttgaaaagaacaatttatctgttcacttatttttatcaaacctattagataatgatgtttgactggtaaacatgtatagctagatatttctggccacagcaaaggcttataatattaagtcagttgttgggtaggaaagatcgtatgtttgtccatgcctgcagtctacatcatatctgtgacatttggagtaaagtaggaggcgtaatcgccttttgcacccgaaccacatcataagagatgtagtcttaacaaacctgtcatcatctcttttttcctcccatattaactgggttcttttttactatgaaaacgaatacaccatgatgttgggattaattatttgcttgtatgttccttgaattcaggggcaataattttgaggtggatcttgaagaagtaatgcttatggaggcaatttggctctctatacaagtacgtcaaaacaaaaaaaaaaccgttcatcaattgtaaatttagtctcctctgaaagaatgtttgccatgtcaccgtattgtgatttttctaatggtgatagttctacaatcttcatccaaatgatatcgctgtttcatttctttatctgtgtacctcttcattctccattcataatcaaatgatgcaatatccttttgaggcctcttctgtgtgacttcagatagaatttggcttctcacttagacttagatagaatttggtttctcacttagacttacattggtacctattttcatgttggatacacttccatttatgtaatgggttccagcaggattaatcaccttgtcaaaattatgagtccaccttgtccattttgtgatctttatttctttcgacaggatcaagaagctttgggaaatccaggatgtgttagcactacaccgtcatcaattccttcaaggccttttgatgatggtgatatgacaacgaccgctgaagcagcttcttctggtggatttgcttgtgcagtcgcagctttagctgaacagcagcatatgcatggagagtcttctagcgcatcaccttgccaaacaataaggtttggcacccttagcagaccagacagatccactacacaggatctgagtgtagctgggagcagttcttcggactccagagttgaggaaccaccaaccagcaatacacaccgaacaatagaggctgcagagtattctaattctaatgtccagtggtccgaggtggccgaggctgggaccagtattgctgaatctgatggtacagtggaggctggtgttgacaattcatccactttggctgggtccaacattgattctgttagtgttcctgatagcttcgaggagcagatgatgctggccatggctctctcgttggtcgatgcccgtgctagagcaggttctccggggttagcttggcggtagcatttccttgtaggcccttccactccttatactattcttttcggttgtgctgcgttttgttcctaagtgttccaattgccacgtaaaacatgggggattagatggggagcaggctcaaatttgacgaactgacagtgatacttgtgaatagtgggataaatctgtacatttgaagccagtggtttggctaattttatctcctcttctttcgattcttgaggaagaaattggattctcaggcagatttctgcctacagaagttgtgcctgatgatgttgaaacattgtgtaaatacggaaacgcactcacatttttttcatgtcccggtggtttttcctgcttgctatgtcgaacactgcatatgcatatagcggaatgacatcttataaataaagtttctaaattttccttttgtatcggcacgcacgcattgttcaatatgctcacatttcatgaccccctggaaacgtatatgactcttcgtgcattcatgcatatgcacaaaatcaatctgaatctttcgtccaatgttcttcggtttatgtgttttgaatctttttatcacactctcctctcccatgtgtagctgcatatttgtgaaaaattccacgtgcttagtcaggatattagacgtcgaattgattttgtgcatgggtgcgaaggagacgttcccttcgtttgttgctgcaccatttttctttagtctccagcgacgttctctaaatttcgtttgttgctgcatttttctttcgttctatcgcatgttgttgcattgttcaagcctgaaacgaaaggacacaaagctgtgaagtatagaggagctgctacctttggaggacgccggagacgtgcgctattttagcggatcctttggcgcatgctgctggagcctggaggtaagattgtccatagctgtgacctttaaatttttctctctatcacattttgcatcacataatcaacatttcacccactaccttttcatctcctactgcggttcctcctatttctatactatacttaaagcaccagtttcaacggtc

SEQ ID NO: 2636 - DNA, 1656 bp, Zea mays
aattcatcaacgcagcgcgtcgcctaccgctcaaactccctatgcttcctcccctctctagcggagctgcaggagcaccacccctccaagtcggcgtctagaatccattggacgctcaagtacgggaagctggtctaagaggggaaggtaccaggtggtttgcgcgggggcgccatggaagttgtgctcgctccggcccagcacgacggcctgcacgcggcgtttgggcccaatcccttcgacatcggcgttggcggagatgggcggatctcttcgagcctctcctcgctcggcggcgatcgcttctgcggctactccaccaccgcctccctcttcgttaatagccccgggctgtcctcgccgtcgccgcgcgccgactcgctgtcccgcggttcctccgactctggctccgtcgtcgacgacggggacgatgcggcggccaccgcccccagcgtcgcggagcgtcgactccgcctcgcgcgcctcgcgctccagtaccaggaggtggtcaaccgcttcgagctctgcctctcgtacctcgccgacgccatcaacgaggcggccgcgctccgccaggagaacgatgagctccgcgtcgccaacgagtacctcgcccgccgcatcaacgtggtcggcggcaggctcgccgacgagttcagcggtctccgcctcgccgaggagcacaccacgccacctcctctgtcaccgctgcccgccgcgccggtgatgccgaagagcatctccgttcgctcgcccggctatctcaagatgatccagaacggcaagcatcgggcgtccaagccaacgaagggctcgcagcgcgtgttagtgggcatggaaggcggagtgaaggaggaggagaagctcaacggcgggctgcagttcgaggtgtacaaccagggcatgctgaagacagagctgtgcaacaagtgggaggagaccggcacgtgcccgtacggtaatcagtgccagttcgcgcacggcatcgccgagctccgccctgttatccgccatccgcgctacaagaccgaggtctgccgcatggttctcgctggcgttgtctgcccctatggccaccgctgccacttccgccactccatcacccctgccgatctcttcctcccgcgcccttgaatatgtcagaccaccacccactgccactgtctcgtccgcttccaccctctccaactctacttcattgtgcggttataccatcgtcagtcttcagaacccaaaaaatgtctgattagttgtgattcagaaaatgatagccgtaaataagctatagatagatacacgagatggaaaacgaaaattgttctacgtaattagcacacaggcaagatgtgaatatgtagttctagacacccaaggtattcatatggggttgatcagggcaatcaaactcaaatatgagttatgttgggattattgtattcgtcgtatcgtttatatacacagtttaggttacgatgttctgcctagttacattttttccgggcaaattggatgacaaactggtgagttcatgtaagtaaactaaggctgttatctgaatatctctgatgtgttgaacactggcaaaaacaagcaccttctccgttgtaaaaaaaaaaaaaaaatgaagcaatgaattatggaggtgtttagttgagg

SEQ ID NO: 2637 - DNA, 1775 bp, Zea mays
attcaatgacccaccagacgctcatcgcttgcacccacgctgtcgttgccgccgctgccttttcccctgcctcccactccctccacgcctcgttgcctctccttttcacccgttcctcgtctccctcctgcggtcctgccccccctcccctgcagccgctccctccatggcgtccttcgtcgtgcaccaccacggttcgccgctggacagggagggcaaggtcaagatgtccgccctggccctgaggagtagcctcaggccgtgcgaggccgccgaggaggtcggggccgggcaggcgtggtgcagaggcgcggacatgggcgtcgccgcctttgtcgacgagttctccgtggaggacttgctggacctcgaggacctctgcgaggttgacaaggactgcgccgagctgggcgacacggtgccggcggcggagtctgtgcaggaaggggacaaggtgtccagtgactcccacgggtcgtcggtgctgtcctacgagctcatgacgctcccggttccgcacccgatgattgacctcccgttgccggcccatgacgccgaggagctggagtgggtgtcccgtatcatggacgactcgctcgccgagctcccgccgccaccgaagctacccgcggcgccgttgggagctgcgcggcggccgctggaaggcgcagtggcaggccctatgcggagcccgaccacgaccatatgcgcgctgtcgacggaggcgctagtgccggtgacgagggcgaagcgcagcaagcgctcgcgtggctccgtgtggtcgctgtccggcggagcgcccctgtcggagtcgacgtcgtcgtcttccacggccaccacgtcgtcctgctcctcgtccgcctctttctcgccgctgttactccttccggcggacccgtccctcgtcctatcctcgcacctcctcgacgagacgccgcggcccaagaagaagtccaagcacgggaagcatggcaagagcggcaagcccaagaagcgcggccgcaagccgaagcaccaccccaagccgccccagttctcgggcggcgccgcctacgcgccggcccagggcgaccggcgctgcagccattgcggcgtgcagaagacgccgcagtggcgcgcgggccccgagggcgccaagacgctgtgcaacgcgtgcggggtccgttacaagtccgggcggctgctcccggagtaccgtccggcttgcagccccaccttcgtgagcagcatacactccaactcccaccgcaaggtgctggagatgcgccgcaagaaggatggcgaccttggtcagctcccgctcccagtcccggccgcgcttctgcttgggccggccgtcgagtcgttctagccggcgctgtacattttttcgtccgcgggtggagctgtttaacctgctgtaccgtacttggttttttttttctttctcttccacttctatatttagtagttgtgctgtactatttagctagagctctgaattgtagaagctttattaggtcgagttaggtagtagagattaagatttccatggttgattaggattgttagggtatgtatggccatagtacttgtggtagtagttaagaacttggtgaggtgtttggcctgacctacgaggaatgatgttgtcatgtcgaggcgctgctggcaccagtgacaagaaagttaggcgtgccttggcgcggaacatggaactgtctgccttgttgtaatcgagagtgtcaggcgagtaagaaagtgattgtttgcattgccgaaaaaaaaaaaaaaaa

SEQ ID NO: 2638 - DNA, 5285 bp, Zea mays
  misc_feature (325)..(325): n is a, c, g, or t
  misc_feature (2237)..(2237): n is a, c, g, or t
  misc_feature (2250)..(2250): n is a, c, g, or t
  misc_feature (4081)..(4081): n is a, c, g, or t
gtaatgtagacagaaatatacatggtggtgtagcagtagctactgattgcattagcttgaggggcgtgggggagaatgtgagaatggggatgggtgcaggctgtgcggaggaatatgtgtggactgtgtggtatggggaataaaaaagacagaacaagaaatgagaattacagaacagtaaatgacaggctatttttactatcttattaattagtagagatattatatttattttttatgagtattaaatatgattgttactaattagtagagacattatatttattttttatgagtattaaatatgatcgtgtattacggcagngcacgacactgtaatactccagtagttaattccgcaaagacaggcacccaccaagaataggcgtttgtcgtgtctcgtgcccgtgcctgtgaacctctcacgtgccgtgccggaatctcgcagccatcgatcgatccagcagatgtgccagccgccgcggccgcgccaagcccaagccgagctgacgatcctgatgcggttgaaaatttccacgaacatatagatcctcatcgtcgaccccatccgtggtgctcccggtgcgccaggctaccagagtccgacgcagacgtagctcccggccacagcagagcccacgccttgagcccttgacgcgctccgtgtgagtggagcgtacgggcgccggccggcggccagagaggaaacggatctaggaggctcagctgagtcgaggagatggaccgcaaagatgtcgggatcctcgccatggacatctacttcccgccctcctgcgtgcagcaggaggcacttgaggcccatgatggggcgagcaaagggcagttcactatttcggttctgctgttacgaccgactccgctgcggggcgactctgatgcttccgatccgcgtctccgggaccttccgcatcggcgcattgcagtgcggggtgaagatgggactttcctgcgtctaaggattgtgtttctctagaaattgacggaagtatttggctagatgggtctcatgggtggaattgtcgccacttgttgggtaaacctttgattattcgtgattgccgtgcagtaatgccgctgaagatcaaatcgatagttagatatgcggtatttaagattataattcaaatatttgaaactccagtaaatttggagagtttgacctccaaagatccgtgtaaatacgggaaagtgagcatttcaagtaaaacatgagaagttccggtttagctggtgtttgttttagtgagcgaaaattaggctcattgtttttaataaataaaaacctcatagctgatggctttaatgtaggaggcacttgaggcccatgatggggcgagcaaagggaagtacaccattgggcttgggcaagattgcatggccttttgcagcgaggtggaggatgtcatctcaatgaggtatattctcttttgatagcctaagataaacaagactgttagtctgtttcatgtttatattcacatagatcgctttttcccacctagttcagcaaatggaaaaaaaacttcccaatgcatatattgtgttgtgtgggagatgtatatagttggtattctaagggtgtatgcagttgatattttggatataggtttacattttgatttggatcctcatggaagagctaattgcttgcagtttgacggttgtcaattctctgctgaaaaaatacaagattgatcccaagttaatcggtcgcttggaggttggaagtgaaacagttatagacaaaagtaaatccatcaaaacttggctgatgcagatctttgaggtttgttagtctaactttgtagagtccccatgtagcatcaacacatgtacagatacagtattttcatgcccactacatctttttagtaaaacatcttcatttgtttttactcatttagttttcccaaaaagttaatttttgttagcatttgttcacaaaatgtaggaaagtggtaacagtgacattgaaggtgttgactccagcaatgcatgttatggcgggacagcagccctactgaattgtgtgaattgggtcgaaagtaattcctgggatggccgttatggtcttgtcgtttgcacggatagcgcggtttgtcatccagcctttcctttaagcatcagttttgtaattggtttttttcttttagaacacgcaatcactttctgccatctgtattgactattgtgatgttcaggtttatgccgaaggnccagctcgtccancaggaggtgctgctgctatagcaatgctcattggtcctaatgctccaatttccttcgagagcaaatatagagcttctcacatggctcatgtctatgatttctacaaacctgatcttgcaagtgaatatccggttagttttcgattgataaaacaatttatactattttatatgtattcccctgaccttcagagtccagacccaagtgaatgtttctggttatccatcttagagttcaacattttttacaacaacacattcattccaggttgttgatggtaaactatcccaaacatgctacctaatggctctagactcatgctacagacagttctgcaacaagtgagctgctgcaccttttcccatttccttttagtaataattagattgaatctgcttaaaatttcccctatgtcccactgtaatttctgaaactaggtatgagaagattgcgggtaaacaattctcaatttgtgatgcagaatattttgtgttccattctccatacaacaaggtaagatacaaataacccagggctttaaatgaagaccaaaaactgccctggaagttttcctctttttgtcgtttctagtttccgtaatactattcttctgttattacagctcgtgcagaagagtttcgctcgactttattacaatgactttttgcgcgcctgcaggtttgtactcttttattgagcttcctccttttctgagaaaaatttgtcttaggtcaaacagtatatattaatcagctctgaagaatcttacaatgtcagatggagggtactctcttttttttttgcccacatcaagtctatgttgatcttttaactgaacttctgtactttgccagctctgttgatgatgatgctaaagagaagctccagtctttttcaaatttgactggtgaagagagctaccagagtcgcgacttggaaaaggtgttttatccatttgtgaggaaattctatcatgtaggaaatttgtggtctgatgatttttttcctgcaaactttccaggcctcacaacaggtcgcgaagcacctccatgacatcaaagttcagccatcgactctgcttccgaaacaaattggtaacatgtatactgcatccctttatgctgcattagcatctgtgctatataacaagcatgatagtctggtgagccctgacctttaaactatttatctattgagtcgttctaccatcgttcttgaaagctgataattacttgtgtgtttccttacagaatgggcaaagaattgtgatgttctcttacggcagtggtttgacatccactatgttttcattgaggctaaacaatggccagcatcccttcagcctatcaaacattgcttcagttcttgatgtcaccgagaagcttcagtcaagacatgaggtaagcccttcccgttcatgcttatcattcacctgtttctaattgaccaatgtctatccttgcattgcgctgacatgatttctcctaccagactttgcctgagaaattcgttgagacactgaagctgatggaacaccgatacggcgcaaaggacttcgagacgagcagagacacgagcctactgcagccgggcacattctacctcaccaaggtcgactccatgtaccggaggttctattcccagaagctgtccgaggaaacaggcggcgggaaaaccaagtgctgcaacggcctcgcaaatggccactagtggtcgcccagcactgttgctcatcattctcagtattttgataatgctcatggttagcgtttagtctagcgtgtttctgaaataatataattgttctttgaagctgtcccaccccacctanatcagctagttttttattttaatattttattcttctgaacattgaaattcatcagtctctacattgtttctctttgtttcttcttttagtactctcttcgttccaaattctaaattacgtacataatgtttgctatgtctaatagtaaaaaaaaagtcaacaccttataatttagagttagagtggaaatgtggaatgtggcaaataacaaggccataggcctattgacaaagtgatgcatgtgtggctagctctagcaaagctagagcaaattaagggatactgcacttctcttatacgtgtgaaaaattaagttgtaaccatagtgaaaatttggtcctaatagtttttaaattttttatggatgtatcctcactcacaagctacagtgtacaccggtggctaagggaacctttgagtgagccccatggtagcaggacctaaatgtaaatggtacgaatattatctatctatattgaatttaatcagtctaaaaggttgagatgtgatctgtatccgagtctgagtattcagtgttcgatacatatctgatctatatttgtattcgtatattcaaagttgaatatttaagacgtcgatatccatttaaatcttatgtgacataatttttgataatattcgtattatatctgaatccgaagagaaaatatgaatacaaacatggaacaagtaatatatgttcatattctatccgattacattcctaggaggcatgtagcttaggtttacagttcggcgggggacactaaggatatgattggttgtcgtggaagctcgaaccgaacggttcgatgcacacgtagacagaaaatttgcagcgttttccaacgactggaattggataggggctctgtataaacccctctagctggccatttgaaggtgtggcagcccaaacaagataccaacacatgtgatacacatatctaagtgttcaaacacacaagtgcttaatagaatcacttgatgattaacgtaggtgctttgagaagttttttaggttagttagaccgcttatgcgctttctctaggttgttcctagttagttgagtgagtttagaaaatcccacaaaacccatcggctcttgcgcaagttgttgtcattgtaccgagtggacgagagttttgtgagaccgtatcaaccgcgcttgtgatacggctgtcaccgtgtactggagggaat

SEQ ID NO: 2639 - DNA, 1958 bp, Zea mays
atcccgccagcagatgtgacaaccaccgcgccgagcgcgagctgagctgacgacgctgacgcggctgaaaatttccacgaacacatagatccgcatcgtcgatccatccgtcctcctcccgacggtacgccagcctgccagagtccgacgcacgcctagggctcctggacacagcagagcccacgccttgactcgctccgttcgagtggagcgcacaggcaccggccggcgaccagagagggagcggatcgagggggctcggcttgagtggaggagatggaccgcaaggatgtcgggatcctcgccatggacatctacttcccgccctcctgcgtgcagcaggaagcacttgaggcccatgatggggcgagcaaagggaagtacaccattgggcttgggcaagattgcatggccttttgcagcgaggtggaggatgtcatctcaatgagtttgacggttgtcaattctctgctgaaaaaatacaagattgatcccaagctaattggtcgcttggaggtgggaagtgaaacagttatagacaaaagcaaatccatcaaaacttggctgatgcagatttttgaggaaagtgataatactgacattgaaggtgttgactccagcaatgcatgttatggtgggacagcagccctactgaattgtgtgaattgggtcgaaagtaactcctgggatggccgttatggtcttgtcgtttgcacggacagcgcggtttatgcggaaggaccagctcgtccaacaggaggtgctgctgctatagcaatgctcattggtcctaatgctccgatttccttcgagagcaaatatagagcttctcatatggctcatgtttatgatttctacaaacctgatcttgcaagtgaatatccggttgttgatggtaaattatcccaaacatgctacctgatggctcttgactcatgctacagacagttctgcaacaagtatgagaagattgcgggtaaacaattctcaatttcagatgcagaatattttgtgttccattctccatacaacaagctcgtgcagaagagttttgctcgactttactacaatgacttcatgcgcaactgcagctatgttgatgatgatgctaaagagaagctccagtccttttcaaatttgactggtgaagagagctaccagagtcgcgacttggaaaaggcctcacaacaggtcgcaaagcacctgtatggcatcaaagttcagccaacgactctgcttccgaaacagatcggcaacatgtatacggcatccctttatgctgcattggcatctgtgctatataacaagcatgatagtctgaatggacaaagaattgtgatgttctcttacggcagcggcttgacatccactatgttttcgttgaggctaaacaatggccagcatcccttcagtctatcaaacataggttcagttcttggtgtcaccgagaagcttcagtcaagacatgagaccttgcctgagaaattcgttgagacgctgaagctgatggaacaccgatacggcgcaaaagacttcgagacgagcagcgacacgagtctcctgcagccgggcacattctacctcaccaaggtggactccatgtaccggaggttctattcccagaagccggccgaggaaacaggcggcggtaaaaccaagtgctgcaacggcttcgcaaatggccactagtgggagtccgcgtgccgtttgaattgctacgtcgcccttctgtactgttgatcatcattctctgtgttttgatcatgcttgtggttagcgttttcaccctagggtgtttctgaaataatatattactagatatatccccatctgttacaccggggtcacgaattttgccatttaggccttctctatttttctttagttatttattgactctctaatctttttttatctacaaagccaacatatcttccaatttaaaaaaaaaaaaaaaa

SEQ ID NO: 2640 - DNA, 2041 bp, Zea mays
ggtgcctgtgaacctctcacgtgccgtgccggaatctcgcagccatcgatcgatccagcagatgtgccagccgccgcggccgcgccaagcccaagccgagctgacgatcctgatgctgttgaaaatttccacgaacatatagatccgcatcgtcgaccccatccgtggtgctcccggtgcgccaggctaccagagtccgacgcaggcgtagctcccggccacagcagagcccacgccttgacgcgctccgtgtgagtggagcgtacgggcgccggccggcggccagagaggaaacggatcgaggaggctcagctgagtggaggagatggaccgcaaggatgtcgggatcctcgccatggacatctacttcccgccctcctgcgtgcagcaggaggcacttgaggcccatgatggggcgagcaaagggaagtacaccattgggcttgggcaagattgcatggccttttgcagcgaggtggaggatgtcatctcaatgagtttgacggttgtcaattctctgctgaaaaaatacaagattgatcccaagttaatcggtcgcttggaggttggaagtgaaacagttatagacaaaagtaaatccatcaaaacttggctgatgcagatctttgaggaaagtggtaacagtgacattgaaggtgttgactccagcaatgcatgttatggcgggacagcagccctactgaattgtgtgaattgggtcgaaagtaattcctgggatggccgttatggtcttgtcgtttgcacggatagcgcggtttatgccgaagggccagctcgtccaacaggaggtgctgctgctatagcaatgctcattggtcctaatgctccaatttccttcgagagcaaatatagagcttctcacatggctcatgtctatgatttctacaaacctgatcttgcaagtgaatatccggttgttgatggtaaactatcccaaacatgctacctaatggctctagactcatgctacagacagttctgcaacaagtatgagaagattgcgggtaaacaattctcaatttgtgatgcagaatattttgtgttccattctccatacaacaagctcgtgcagaagagtttcgctcgactttattacaatgactttttgcgcaactgcagctctgttgatgatgatgctaaagagaagctccagtctttttcaaatttgactggtgaagagagctaccagagtcgcgacttggaaaaggcctcacaacaggtcgcgaagcacctccatgacatcaaagttcagccatcgactctgcttccgaaacaaattggtaacatgtatactgcatccctttatgctgcattagcatctgtgctatataacaagcatgatagtctgaatgggcaaagaattgtgatgttctcttacggcagtggtttgacatccactatgttttcattgaggctaaacaatggccagcatcccttcagcctatcaaacattgcttcagttcttgatgtcaccgagaagcttcagtcaagacatgaggtaagcccttcccgttcatgcttatcattcacctgtttctaattgaccaatgtctatccttgcattgcgctgacatgatttctcctaccagactttgcctgagaaattcgttgaaacactgaagctgatggaacaccgatacggcgcaaaggacttcgagacgagcagagacacgagcctactgcagccgggcgcattctacctcaccaaggtcgactccatgtaccggaggttctattcccagaagctgtccgaggaaacaggcggcgggaaaaccaagtgctgcaacggcctcgcaaatggccactagtggtcgcccagcactgttgctcatcattctcagtattttgataatgctcatggttagcgtttagtctagcgtgtttctgaaataatataattgttctttgaagctgtcccaccccccctagatcagctagttttttattttaaaattttattcttctgaacattgaaattcatcagtctctacattgtttctcttaaaaaaaaaaaaaaaaa

SEQ ID NO: 2641 - DNA, 1957 bp, Zea mays
acgtgccgtgccggaatctcgcagccatcgatcgatccagctggagctccccgcggtggcggccgcgccaagcccaagccgagctgacgatcctgatgcggttgaaaatttccacgaacatatagatcctcatcgtcgaccccatccgtggtgctcccggtgcgccaggctaccagagtccgacgcagacgtagctcccggccacagcagagcccacgccttgagcccttgacgcgctccgtgtgagtggagcgtacgggcgccggccggcggccagagaggaaacggatctaggaggctcagctgagtcgaggagatggaccgcaaagatgtcgggatcctcgccatggacatctacttcccgccctcctgcgtgcagcaggaggcacttgaggcccatgatggggcgagcaaagggaagtacaccattgggcttgggcaagattgcatggccttttgcagcgaggtggaggatgtcatctcaatgagtttgacggttgtcaattctctgctgaaaaaatacaagattgatcccaagttaatcggtcgcttggaggttggaagtgaaacagttatagacaaaagtaaatccatcaaaacttggctgatgcagatctttgaggaaagtggtaacagtgacattgaaggtgttgactccagcaatgcatgttatggcgggacagcagccctactgaattgtgtgaattgggtcgaaagtaattcctgggatggccgttatggtcttgtcgtttgcacggatagcgcggtttatgccgaagggccagctcgtccaacaggaggtgctgctgctatagcaatgctcattggtcctaatgctccaatttccttcgagagcaaatatagagcttctcacatggctcatgtctatgatttctacaaacctgatcttgcaagtgaatatccggttgttgatggtaaactatcccaaacatgctacctaatggctctagactcatgctacagacagttctgcaacaagtatgagaagattgcgggtaaacaattctcaatttgtgatgcagaatattttgtgttccattctccatacaacaagctcgtgcagaagagtttcgctcgactttattacaatgactttttgcgcaactgcagctctgttgatgatgatgctaaagagaagctccagtctttttcaaatttgactggtgaagagagctaccagagtcgcgacttggaaaaggcctcacaacaggtcgcgaagcacctccatgacatcaaagttcagccatcgactctgcttccgaaacaaattgaatgggcaaagaattgtgatgttctcttacggcagtggtttgacatccactatgttttcattgaggctaaacaatggccagcatcccttcagcctatcaaacattgcttcagttcttgatgtcaccgagaagcttcagtcaagacatgagactttgcctgagaaattcgttgagacactgaagctgatggaacaccgatacggcgcaaaggacttcgagacgagcagagacacgagcctactgcagccgggcacattctacctcaccaaggtcgactccatgtaccggaggttctattcccagaagctgtccgaggaaacaggcggcgggaaaaccaagtgctgcaacggcctcgcaaatggccactagtggtcgcccagcactgttgctcatcattctcagtattttgataatgctcatggttagcgtttagtctagcgtgtttctgaaataatataattgttctttgaagctgtcccaccccacctagatcagctagttttttattttaatattttattcttctgaacattaaaattcatcagtctctacattgtttctctttgtttcttcttttagtactctcttcgttccaaattctaaattacgtacataatgtttgctatgtctaatagtaaaaaaaaagtcaaccccttataatttaa

SEQ ID NO: 2642 - DNA, 929 bp, Zea mays
atgatgatgctaaagagaagctccagtctttttcaaattggtctgttggaattcggccagccagagtcgcgacttggaaaaggcctcacaacaggtcgcgaagcacctccatgacatcaaagttcagccatcgactctgcttccgaaacaaattggtaacatgtatactgcatccctttatgctgcattagcatctgtgctatataacaagcatgatagtctgaatgggcaaagaattgtgatgttctcttacggcagtggtttgacatccactatgttttcattgaggctaaacaatggccagcatcccttcagcctatcaaacattgcttcagttcttgatgtcaccgagaagcttcagtcaagacatgagactttgcctgagaaattcgttgagacactgaagctgatggaacaccgatacggcgcaaaggacttcgagacgagcagagacacgagcctactgcagccgggcacattctacctcaccaaggtcgactccatgtaccggaggttctattcccagaagctgtccgaggaaacaggcggcgggaaaaccaagtgctgcaacggcctcgcaaatggccactagtggtcgcccagcactgttgctcatcattctcagtattttgataatgctcatggttagcgtttagtctagcgtgtttctgaaataatataattgttctttgaagctgtcccaccccccctagatcagctagttttttattttaaaattttattcttctgaacattgaaattcatcagtctctacattgtttctctttgtttcttcttttagtactctcttcgttccaaattctaaattacgtcatgttttgacttttctacgtacataatgtttgctatgtctaatagtaaaaaaaaaaaaaaaaaaaaaaaaaaaaaaaaaaaaaaaaaaactcgag

SEQ ID NO: 2643 - DNA, 3061 bp, Zea mays
tgggttattattaactatagatgtttcgtttcttataaaaaatcatttcaaaggctccggattatacaatctctgatcggcgcactcgcacccgcacctgatcggcgcagttgaaggacagccgcacctccctcatcactggctctcattttaccgttgaggcctggtgaccaccaaagtggacatacatacagtccactctacgcacgcaggcagggagggcaggggctactaactctaggattctgttcgccggaggacagtcccgtaattgcgctccgcataatgcctgcgagtgtgccactgccactacagtgcccgcgccactgttttaaatcccctgccgccgctcaaccccgccgtcccccctctccggctctccgcgacgagatcctctgcaccggctctcccccattccatccattctcccaaaacagcactttcgaattccacggccgcgccgctccccacccaccattctgcgattctcccactggaaacggaggggagcgccatggcgtacatgtgcgcggacagcggcaacctcatggccatcgcgcagcaggtgattcagcagcagcagcagcaacagcagcaccagaggcaccaccaccacctgccgccgctcccgctcccgctcccgccgcgccaggcgccgccgatgccgccggccccggccccggcttccccgcacggccagatcccggcggcatccctaccgtacggcggcggcgcgtggtcccaggcggaccatttcttccctgacgccttcgtcggaacgtccccggccgacgcggtgttcccggacctctccgccgccgcggacttcgactccgatgtgtggatggacagcctcatcggggacgcaccggtcttcgcggactccgacctcgagcgcctcatcttcaccaccccgccgccgcccgtcgacgcggcggcccagcccgagtccgccactcgcgcgtcgcttccccagcctgccgccgtcgcaacggcggcagcgtgttcctctccgagctccttggacgcctcctgctccgcgcccatcctccagtccctcctcgcctgctcccgtacagcggccgctgacccagggctcgcggccgtagagctcgtcaaggtgcgtgctgccgcctccgaagatggggaccccgcggagcgcgtggcgttctacttcggggacgcgctggcgcgccgcctgccctgcggcggcggggcgcaaagcgcaaccctttgacggcggtggacgcgcgcttcgccaccgacgagctcacgctctgctacaagacactcaatgacgcctgcccctactccaagttcgcgcacctgaccgccaaccaggccatcctggaggctacgggcacggcgaccaagatccatatcgttgacttcgggatcgtgcagggtatccaatgggcggcgctgctccaggcgctcgccactcgcccaggggagaagccgtcccgagtacgtatctccggtttaccctcgccgtacttggggccaaagccagcaacgtccctcgccgcaaccagtgcccgtctccgcgacttcgcaaagcttcttggggtggagttcgagtttgtcccattgctgcgaccagtgcacgagctggatcggtcggatttcttggtcgagcctgacgagactgtagccgtcaatttcatgctccagttgtaccaccttcttggcgactccgatgagcccgtgcggcgagtcctccggctggttaagtcactcgatccatcagtggttacccttggcgagtatgaggtcagtctgaaccgagctgggttcgtcgaccggttttccaatgcactgttgtattacaagccagtgttcgagtcacttgatgtggcgatgccacgggactcaccggagagggtgagggtggagcgatgcatgtttggggagcgcattagaagggccattgggccagaggaaggagcagagaggactgataggatggcggctagtagggagtggcagacgctgatggagtggtgtggctttgagcccgtcagactcagcaactacgccatgagccaggctgatcttttgctttggaattacgattcgaagtacaagtattcgcttgttgagctaccaccagcgttcttatctctggcttgggagaagcggccgctgctccccgtgtctgcttggcggtgagtccctttttttgtgtattggtgctgttgttgtatgtagcattgtcataggctcagcgaagaaatggtgaaattggttttgcattgtcccaagatgatggcaatggctagatggtataattggtacttttgttagcttgtttgattgtttgtcctactacatgatcagtagctagtgcaattttagcgctaattgtacagaaatggatagcaggtggagtagattgattgctcatgtggttttctgaattctgatgacatttgacattctatatgtatatgaatttgaaaaatcatactggcacctccatcattgcaatcaattacagtcgtaaaggcagtgtagcgcaaatttaaccaatgattgctcaagtgttactgcaactaccattctcatgtatttggttgcaatggtagtgtagttcacaaaatggaagtttggcaacaaagctaatgtcaaccttgctagtccagttattctggatgctaacacagggttgtcatctactgtataagcgtgtgaattgctactccgtccgtcccaaattatgtcattgtatcttgtttaactaaatttatacaataacataataacatttataatactaaataaacattattagattttttattaattatattttaatagcatacctatttgatgtcaataaatctttgaaattttctccataattttagtcaaacttgtgatgcctgcactctaaatacttcattaacctgcattttttccttagtcatatgtgctatttataaatgtttgctctttcggtctcaagcctcgacttgttcattgagattaatactccctctgtcccaaaataaaatcagtttgagtaaaacattggattcattcaatatttaatgtatat

SEQ ID NO: 2644 - DNA, 1450 bp, Zea mays
cttcatggaaggaaaggtgttaaaggggctcaacccggcccggtcttatcatggttgcagcgtgtgaagatagctgttggggcagcaaaaggcctcgagtatcttcacgagaaggcgcagcctcatatcatgcaccgagacatcaagtctagcaacgttcttcttttcgatgacgacgtagctaagatcgctgacttcgatttgtcaaaccaagctccggacatggcagcccgacttcactcgactagggttcttggaacgttcggataccatgcgcctgagtatgcaatgaccgggcaactcagctccaagagcgatgtatatagttttggagtcgttcttctcgagctattgaccggaaggaaacctgtggaccatacattaccaaggggacagcagagtcttgtgacttgggctaccccaagacttagcgaagacaaggttagacaatgcgttgactcgaggcttggaggggactaccctcctaaagctgttgcgaagtttgcagctgttgccgcgctgtgtgttcagtacgaagcggacttccggccaaacatgagcattgttgtcaaggcgctacagcccctgctgaatgcgcatgcgcgggcgaccaacccttgagaaaaatgctagctcaaaagcttcgcattgctcctctccgccctcttgtatgatagataactaagataagtaagatacgagtcgccgatgtcgttcttgcggacacatggctggcagcgtgtgacatttgtgattatttgtcccctgaattgtaaacaagattcttgtatccccacaacacttgattctttctatcggttgcaagatgacctgccgttttcttcttaagaagaagtcaccttagcaaaactcacaaactttattactccctctgttcaattatgggatgctttgattttgtctagtcgtatagtttttgttatataaatatcttacaatttggaatggtattgactattaagggcttgtttggatccctcgagctaaaacaaagtgactaaattttacgctttgtttggttcccttgtatgatagaatgcttggatgctggttacaagtattcagtgtagtctaattataaaactatatacatagatgagaactaaacgataatatgaatttattacatataattagttcatgattccttcatgtgatgttatattaaacatttgctaatcataaatagatttaatgaatttgtcctacgtttagtcttcaactgtgtagttagaccgtatttaatcctcgtaatagatattcaaatatctaatgtgatacgagctaaagatccacacaataagagttaaaattggctagaatggtaaaaagataattagttcatgattccttcatgtgatgttatattaaacatttgctaatcataaatagatttaatgaatttgtcctacgtttagtcctcaaaggg

SEQ ID NO: 2645 - DNA, 727 bp, Zea mays
caagctccggacatggcagcccgacttcacccgactagggttcttggaacgttcggataccatgcgcctgagtatgcaatgaccgggcaactcagctccaagagcgatgtatatagttttggagtcgttcttctcgagctattgaccggaaggaaacctgtggaccatacattaccaaggggacagcagagtcttgtgacttgggctaccccaagacttagcgaagacaaggttagacaatgcgttgactcgaggcttggaggggactaccctcctaaagctgttgcgaagtttgcagctgttgccgcgctgtgtgttcagtacgaagcggacttccggccaaacatgagcattgttgtcaaggcgctacagcccctgctgaatgcgcatgcgcgggcgaccaacccttgagaaaaatgctagctcaaaagcttcgcattgctcctctccgccctcttgtatgatagataagtaagatacgagtcgccgatgtcgttcttgcggacacatggctggcagcgtgtgacatttgtgattatttgtcccctgaattgtaaacaagattcttgtatccccacaacacttgattctttctatcggttgcaagatgacctgccgttttcttcttaagaaaaattaaccaaaaaaaaaaacacaaactttattgcgccctctgttcaattataggatgctttgattttgtctagtcgtatagtttttgttatat

SEQ ID NO: 2646 - DNA, 1611 bp, Zea mays
tctgtcagcttgttgaccgcaagatttatgtgaaaaatatccaagaaccaaacaaatctttgacatcaaagagagtttcatttgtggacaagccctccgaaaaaggagccaaaactgtggctaatgatgcttatgatttgaatatccagcaagatctgacactcctttccagtgaggtgccaaaaagagccaggtcatctcatccaactaagaagcatatggttgctaacaggacacctacggtgaatgataatgtggcgaatcctagtatgcccccgcgtccggtcaagaaaaaaaagggcaggaacatttccagtgagaccagtcagaaggtaaaaccggtgatctcatgcccagaatcagatggttgtgctagagcttccattaatggatgggagtggcgcaattgggcacggaatgctactccgtcggaaagggctcgtgtgagagggtaccatgttcggactattctttctgcctcaaatgataatgtgtggaaaaattctcaagcaaaggtttcatctgcaagaacaaatcgggttaaactgcgaaatctgttagcagccgctgaaggttctgaactgctgaaaattacccaaatgaaggcaaggaaaaagcgtttgcgttttcaaaggagcaagatccatgattggggtctggtcgcacttgagtcgatcgaagcagaagactttgtaatagaatatgttggtcaactgattcaccggcgggtctctgacatacgtgagtctcaatatgagaagagtgggattggaagcagttacctctttcgcttggatgatgattttgtggtcgatgccactaagcgtggtgggttagcaaggttcataaatcattcttgtgagccaaattgctacacaaaggtgatcactgttgatggacagaagaagattttcatttatgcaaagaggcgtatatatgccggtgaggaaatcacatataattacaaatttccattggaggaaaaaaagataccgtgccattgtggttctcggaggtgtcgtggatcaatgaactaagaaggccatcttttgaggttgctgcaacacttaagattcttggctgtgtgcaactcatcaatcaggatttacatcaatatcaaaatatggagtgcacgaacatgctggacagcaagaacaaactgccgcattatacttatttaagctatattggtcagactaattccacggtatcccaaggatggtgcaagaggaagcccatactgcgctgccctgtggaggtcgcgagcatgggaaatcagttgaggatgggctgagctagtaaagggttgttttctgacaaggccagtactattgtttttttttgacatacctgggtggagttgcaaactcttgtacaggcgcaggctttacttattacattgtttggattggggatatagttcacatggtgcatacgaaacggttagattggtttaaattctctacctcgtccttaaatcatttatcatactaattagttattgaaagatgaaacacccgaaccactagttcttgtaatacttccactgcttttgtgaaggatgttatgagcatcaaaccgaactgaatggatgccctgctcctgttgatc

SEQ ID NO: 2647 - DNA, 2983 bp, Zea mays
cattttcacatgtcattcaccatggtcaatcctctagcttctctagttcttcaatccaagactcaacgaatgtccttcattactcttagaccaacggtatggaccagctaggccttcatcttcaacgtcgaccattttggggctctataattgcccactccacacaatgagacttgtgcatcatgtactcatatgatggttagttcacaatttcaatcaaaaacttatcatttttttataattactcatcatacttaaacaacatggatcaatattaacctcatgttcgcaagacttatcatctactgtttgctgatagataaccatgtcctcctctgctcagaagcaggcgaaaacaaagggccaagagctgtgcagtgcagagataggacatgatcaaacaatgcgcaaagctgctcctgctgcaaactgggaaaagaagacaaaactatattcaaaacaatttcgcgaccaaaagaggatagacaacaatcgtaatctttcttgctgatgatcacgttgagctcactaattgtaattactgatcctagctatatacatcccactaaagagtcctggcaacacacgcttcttcctcggaatcgtaatatgaaatggagcaaggtgactttttgttctcccaccattgttcacacatgatgatgatgcagtctactccactttgtagataggaatagaacctcaaccataggaggtaatgtagtattcgatactgaagagtcaagatgacccctcgcgcaattattcattagtttttggaccgccctgcgcagagaacaaagtgctagtccatgggcggggtagggctattctgaaaccatccacacatgtcgcaagcaagcaatcaatcaatcaatcaaagcagtggcaacggacatcgtcagcccacatttttttattgcttgcactgctgccagtgccagcacaagggctgcagacgccggagaagattctaaacacctctccccctctctctagtctctactcgcccctagcttttccatctcttttctcctccacccgaaatgattcaatttggcaaatttttttctcactctaaaaccgcccatttcccggctataaatggccgcgccgcccggcccgcccgggccttttcccctcttcccgagctcccttgctaggttcctcgtccgcctctctgtcctagtctcgtcagcaacagcacagtgttgttactgacgcgccttcactctgttgacctgcatctagccaagtttatttggagactccaacctttggtctcccaaacttggagctcccaaggggagaggttctgccaaaattttggcttctgagcatccattttcagggggaggttctgccaaaatctgctcctgtgaacatagatttctcaaggggaggttctgccaaaatttcctcctgtaaccaccagctttccagggggagattctgccaaaatttcctgcactgatcatcattcttctaaggggaggttctgccgaagttttcttgtgtgacgacgacgatcagtttccagggggagattctgccaaaattttctgcactgaccatcagtcttccaggggaggttctgccaaaattttcttctctcactatcacttctccaaggccaagccctgccaaaatttccttcatatatcacatgcatcgtagacatacagacaataaactctaatttgcaaaggtaacaaaaaaaaagagagagagtgctttcctccttggccttgatggtaggctagtagagaaaaccgcgcgcagcatctgtttacatgttgttgctcgtcctgtccgagcacctcctttccagatttatggtcggttctgccctaacccgccttgtccagtccttctctgttgttttcctctactggttttatgtcttctcagtaagccgccagtagttggactcaccttttcaagttatctaggcatttcctatatatttaccacatataaaaattatactaaggcagtaacaaaagaggtgcctttatatctgacaaacagaagggagtgaaaaagtttagattacacctcagtttgcctgtggtgacaactatgtcaagtggcacttcgtccggatcgagccggtgggtccaaagttctagatccgaggatgacctagatctccaggcccagatggagaggaggagaaagcggaggaaggagtcgaatcgggagtcagctcggaggtctaggcaacggaagcaagaacaccttgacgacctcacctcacaggtaaatcagctgaaggaccagaacaagcagctcagcatggcactgagtataaccagccaaaaccttgtggcagtgcaagcgcagaactctgttctgcagacccagaagatggagctggacagcaggctgggtgccctgacggagatcctctggtacatgaactcaagcaccagcaccagcactgctcctacaaatccagccatagcgaacgacttcacagcatggagcagagcctctgatattcttggtggaaccagctacagcgccatagacctgtaccaatgcttctagctctaagctctagctctagaagagagaaggtggctgtggcatatgacatagtggtagggccaggaagaaaggaggcgggcaggcatcaagttctgttcaatcgtgtggggcctttgtgtcactgttgatgtgtgcagtgtgtgcttgatgcttctccctccactgtttattttcgaggcgacggcgatgttttggtttggtagagactcaaggacggacaaaatggcagaaagttgccttggctttgtgtgacgtaaatgcagttgttctccggtatttatatggcaaataatattgggccagctagtgaaaaagacaggcagatgatttgatgtggctcttgatatatagggaaataatatgcgtaacgatgattataatgtttattaagatgtcgatttgatgtccattgatatccgtttccagtctc

SEQ ID NO: 2648 - DNA, 2320 bp, Zea mays
atgaagtttgatgagcctatcgcctttccaatgaacaatgtaggcatgcaagagagggttcagctctacaattctactggaggtatagttgttctcaattcatttatcttagaaacaatagctattgacctgtgaagcttctgactaataacattccacattccaactcttcccagatgctcaactaagtagaaatgcgaacacagggaagtgttcaaagggtggcaaaaggaagggttctggagaggacagttcatcactacgttctctagtaaggaagctagaagcttccattgctttctctcatcgtatcacactccctctatttcatcctactgtacatgtaaatgtattactgcagggtgaaaccagtgcattgcagcgagaagtcagcatggagtgtgctgatgagaaggcgggtgatgctagagccaagagagaggactacgtgcatgtccgggcaaagcgcggccaagccaccaacagccacagccttgcagaaagagtagtttctacctcttaagcaacatttttctttgagcgacatagttaacgctccgattgaaatgcctcaattctgttgcttacggtagcatgcctgtccgaactgcagtttcgaagggaaaagataaatgaaaggatgaagcttcttcaagaccttgtcccaggttgcaacaaggtatggatggcatcaagtagacccttacgttaatactgatgtggtgatggtgtgttctaaacattagggacatgtttcttatgacaaggcagattacaggcaaggccatgatgcttgatgagatcataaactatgtgcaatctctgcagcgacagattgaggttagtgtatcgaaaacttatggttttggaggtttactctatggtttgtttaggccaatggccgagtcttcactttcatgtttgcgttggacatttcagttcctttcgatgaagctctcagcgatcggccctgggctcaactgtgacctcgacctacaagatgtaaggttgcaaagctcaactcgggttgaaaaagaaaatgcctttagattgatctttcgtcaatccttgtcactgcagatcctctgcacacaagatgctagctctgcttttccaggatacaacctgcaaacgagcaatgtgcatattaatctgtacagagcatctgaagaaggtttctcacacaggaacaggatcatccctagtccagcaaatgttcacgtgacaagaaacgcccagctatctgcatttcctcaggttttcattcgacgcccttgaacagcttcaagtgctttcctatgtcgattatactagtttctgccatggcagagaggagttatctggaacgaggagctttgcagcatcgcttcagatagaaatgctggtagcctggtagcatagattttttcgtgtcttttaattttcacattcatcgttatgttttgcacttctcctgcagctgtactcagttttgtgagatttttcaagtcccattttgacattgcagattcaatgaaagtggagtgacattgtggcaactgacaagccggcagtttaatggtgatcaactctgaaagtcttgacgagttgggttgctactgaggtgccttttcaagttgcagtggtagcacgacttctcttgggatgagctagttaacttttggtatttgagaggaattctggtgtgtccacccatcctgtacagttattagaataactaatcaaaggagtactgtgaaattcttgcgatctggtggagaaaatagtggacaattttcgtctggaatttctgacacaactgagttagtgctttggtggggtgtggctccacctaattatttagttgtaatagctggcagagctctatgactataactgcttgagattcgtgacaacgaatttaaattggccaaataaaacaccgttcttcggtagtagtgtagaacccttgtaaacttcaaaaatatccgttgcaaccaatacttttagaattcataaccggggcaaaaaaaaacgagtaacttgcctataaaacttatgttactcacaatttcataacctagtccatgacaattagctggcaaataattatttactaacaattagccagagtatgtttggagttttggctttttatctttatacgatttattagcacttattagcaagattaaatggttaatgagcaaacaatttgctagcccttcggttaacaattagttaatttattagacagtttgtttggagaaggtgctaaaattagtcggtataccattatgttagtcataaatcgataacttatgttcgttaatcacccaca

SEQ ID NO: 2649 - DNA, 2882 bp, Zea mays
ggagtgtacagcagtagggctagctacacattcgttctcatttcccggtcaagtgctgcataatgttttgttggttgtttgctgcattgtgtggctatgcattttcggctaaacactctgccccagtcttcccaggattgggcgattggcatagtgctcgtctacctcttacagcttaccttttctccatgtttgctgtactttcttgaagcatgtgcctcttgcttcgatactctgaaattagtttcctgattgtcaatgatgaggttgggagatcttagtgctgattcttgatagatgtttagttcttgggtagtgataattggtagctagttacttggtgtaggtttaggtggagatctcattatgaatgaggctttagcttattactgcatcaaatggaattcatcgcatgtttacattcgtttgaacagttctagcgtagctaattgttttctttaagaaaaaaaattggatctgttttgttgttttctggtagttataactctgtctaccttgtttaatgtactcagggtttccgcaaggttcatgctgacagatgggagtttgctcacgaagatttcctgcgagatagcaagcatctattgaagaggattgtcaggcgcaggtcctccccaacaaaacaaagcagcgttcagcctggctcttcttctggagagtccagcttggaccctgagctccacacgctgaggagagagaagaacgcgctgcttgaagaagtagcaaggttgaaacaggaacaccgccagacaattgagcaaatgagcacgctgaatcacaggctggaatctgcagaggaccggcagaggcagatggtctctttcctggccaagctccttcagaacccgagtttcgtgaggaagctgaagctgcacagggagaagaaggagatcgactccaccagggtgaaaagaaagtttctcaaacatgttcctcatggcagcgtagagtcaggtgaatccagctcacagcacgccggagagaatggttcgtatttcgctgtgagttcccccatggctacaactacaagcgtgcatgacgacatcacggagcttcagaactttcttttggaagatgatgacctcaacttcggcatggattcagaaaacaccgggcttgaaggcaccgaggcaacagatgatattggagaactgattcaggggttcgacacacaagaggaacttgacctcggcagtggagctgagctacaggagatgcctccagcttctggccctcttgctcgagatcccacaatcggcaggttcaagggaaagaatgtgctgtgtccaggactggacgctacctcctccgaaggcgactgcctcagtccattgcctgacaacatggggctgctttcaggcaccatgctagggacggcaggcagcatgatggccgctgacgatgagcaaatatggggcgttgatgcttcggcagccctgcaaagctcttgcagtggcactagccaacaagctttcggtagccatgctagtgatccctatctgatggacatcgccaacaggcctgagagattctgggagcttgatttccaggcactggatgaggctgatctgcagctggacaagtgtgctatcgatgaccctgctcttcagcagcagccaagcatgaagaagccgtagacgtggtgctttatccactgaggtgctacgattatggtggtgcttcatccactgaagtgctacaattaacttatggagattgctatagttacttcggtattttggagcgaggctgatgaactcgcctactatggcacttagtagtagcagcagcagtagtatgtttttgtttcccatttattcacccccggtgtttttgaatggaaacttgtatcctagtgatttcttcagagcagctgttaactgctctggccgattctttttttttgtgtccccatttatgtttttgttcgcggccttttacttgctagttgctacttgcgaatgtcttgcaatgagtaatgggatttaaaaaaaaatccgttctcagagaaccaagcgatgtactgatgtgctgctgaatgccaagaagtggctgaattctgtttatcagcgtgctatcctgtggacagatatttttgttaaatttatggtcttcctacagcgatcgtgaggaggacatatttctctagatggatatacaggttgggcaatgctgaccaaaatggtcatgaaatatgctggtacttagctcatgaaatatgctgaccaaaatggtcatgaaatatgtttggttgatccaagaacttgaaccggtgtgtagccgcatgatcctttgccgactagcgactacgatgaaactgaaagatgcgcgacagactttttccaggtccgtcattttctagactccaagtggcatcgaagcagggacagggtgatcagaagtttcagttctttgccaaccctcgtggcaaaactatttattatgtgttcacgtcgctagccgagtgagcacatactgggaggaggttccaccacgtacgtagtgcactcttccacaaagggtggaagaaccctagttgggcaggagggcggagcaatcgaaccggtttcttcttgatcttgaatgacgcgatgattgccatgatttccttccaccatctggaaccatttaatcatgttaatgattgctcgtacaaatatcttttcttgcaataaaatgtcgggtgtttggttggaggacatcagatgtttgaatactagtaacaactattaaatatagtttaattataaaactaattatatagataaagattaaataataagacaagtcttttaagtctacttagtttgtgatttggtcatgtggtgctacagtaaatatctgctaatcctagatcaatc

SEQ ID NO: 2650 - DNA, 973 bp, Zea mays
catctctgagccggtctcccggcagcagcagtccctcgggttgtccacgcggagcgccattgggtacctcgaggccggcccagtatgtcggttcacccgaagcctataaattcctcgccgccccgcctctcgccgcccatttccttccgccgcctcctaatcctcaacacccgcgcccccaccgcgcccgtcgtatgccaccatgcaccgcgcccgccccaccgcgcacgctaatgaccccgatgctccgtacgccgccgccgcgatgctgctggagcccaaactcgaggacgaggagttgccgctgcagcagctggcgtccccgggcaccttcgtgtccctggaccagctgatgccgccggtgaccgcgccagccgagccgcgcccgctggaggcgctgctgcacggcccgcagctgccgcccttcctgtccaagacgtacgacctggtgaacgagccggcgctggacggggtcatctcctggggcgctgccgggaacagcttcgtcgtgtgggacccctccaccttcgcgcgggacgtgctgccgcacaacttcaagcacaacaatttctccagcttcgtcaggcagctcaacacctatgtgcgtacacacaactcttccgttcctctgtttcttccccctcacaaatccacaatccgtcgctctgttgttggaatgctctgcttcggctcatgccccccctgacccctgttatgctattgatcatcttgggtaccgtacgcctaagtaaaattcccgctgacgtgtagagtgcctacggagatattgctgcggatttgtttttcttttgggtggtaattggtgttgcatcgtgtgagtcatgtataaaaactgcccttgtaatggagtgcggactctgatcttgctttcttccttgagctgaaccacgtcatgtaacacgcatcacaactggccgcaccaaaatataaattggattaggattgaggcaat

SEQ ID NO: 2651 - DNA, 1396 bp, Zea mays
ataaacaactagtatagtgtttacttatctttttgccatgtaaactggaaagggatctaggacgtcgtttggtctctctgctgccttcttcctccttcctccacccctgccttgctcaaagtagtcagtcgtcatcgtctcctccgatcgcctccagttcattccagttagcgccgctgatcccctccctaatcaccatccatccatccggtaggattccccagccatgtcggcgaccgcggtgaagtttcccgtggaggcgccgccgaggacagtgaaggtcaccaacgtctctcttagtgcaaccgtgcaagacattaaggagttcttttccttttcaggagatattgaacatgtggagatgcagagtggtgatgagtggtctcaaattgcatatgtcactttcaaagatgcacaaggcgcagaaactgcacttcttctttcgggtgccacaatagttgatctttctgtgatcattggacctgctccagagtatcagccaccccctattgcctctgctccaccaatgagtggaaccagagttccagttggtggagacaacaacgttgtccacaaggccgaggatgttgtgagcactatgcttgccaagggtttcgtgctaggaaaagacgcggttggcaaggccaaagcgttcgatgagaagcacggcttcacatccacagccggtgctaaggtggcctccatcgacaagaagattgggctgagcaataagattaccacaggcacttcgttggtcagcgggaaggtgaaggagatggaccagaagttccaggtctctgacaagacaaagtcagcgttcgcggctgccgagcagaaggtgagcagtgccgggtccgccatcatgaagaacaggtacgtcttcaccggcgcgtcgtgggtcaccggcgcgttcaacaaggtcgccaaggctgccacggacgtcgggacaatgaccaaggagaagatggcggccgaggagcagcagaagggcttctccggcccgtcgtctaggagccactcgtacacgcccatccgatgattcgttggctttctgttatgcgccctccctcagacagacaatgttgtattgtattacacaaacacattggtggatgtaagacataggtagctatatatagaacagatcaccaggccccctcgcaccacttgttcaccgccccatgttctgttaaatttcgtactgcagggatttgtttctttaggacaagcaagtatggtggtgataccaatatgttggtttttacaaatccatgttcagactgtttgtggtttgaatgaacattttgtagaagtggtgggaagttaactggataatatgatgttgctgaaacaacatgctatcactatttgcagttatttggaatgcttcttgttt

SEQ ID NO: 2652 - DNA, 6180 bp, Zea mays
gccgggcagtgtttttttttcgcccctcgacgcggcgggccacaagtactagtcgtctcctagtcctctcctctgtactagtcgtcgagtctgcttccattctgttcaagttagcgccgctaatccgctccctattcaccatccaatccaatcggcttcccccaggcacccatggcgacggcggtggaggttcccgtggaggcgccggtgaggacagtgaaggtcaccaatgtctctcttagtgcaactgtgcaagacattaaggagttcttttccttttcaggagatattgatcatgtggagatgcagagtggtgatgagtggtcccaagttgcatatgtcactttcaaagatgcacaaggcgcagaaacagcacttcttctttcgggtgccacaatagttgatctttctgtcatcattgcacctgctccagagtatcagccacctcctactgcctctgctccaccaatgagtggaaccagagttccagttggtggtggagacaacaacgttgttcacaaagccgaggacgttgtgagcactatgcttgccaagggtttcgtgctaggcaaagacgcggttggcaaggccaaagcattcgatgagaagcatggcttcacatccacagccggtgctacagtggcctcaattgacaagaagattgggctgactgataagatcacgacaggcacttccttggttagcgggaaggtgaaggagatggaccagaagttccaggtctccgacaagaccaagtccgcactcgctgccgccgagcagaaggtgagcagtgccgggtctgccatcatgaagaacaggtacgtcttcaccggcgcgtcatgggtcaccagcgcgttcaacaaggtcgccaagaccgccacggacgtcgggacgatgaccaaggagaagatggccgccgaggagcatcacaagggctctggcccgtcttctggcggccactcgtacacgcccatccgatgattcatgcattggcttgctgttacgtgcctcactcaaacggtgttgtactgcatattggtggatgtaaaacatggtcttttagtcccaactcttattatgttgtggttagctagagttgaaacctaatagaaaccacaagttaaggttcaagcacatgaatacctattttccatacacatatatttaaagttaaattttgtactcttatcaaaaaaaaaaaaatttatcgtctttccacatattaaagttggtatttctctatatctctttccatagctgtcgcgctttaggatactactatgtacgagtgcttctagcactccgaaggtctcttaaccggctgtgaagtttttttttccttccgattttgctatctatagcatatcatctatattcttgtatgatcataaatttaatgtaacatatacatttttacaacacttatttgttgaacatgaattttgtaatgttaacattctgcaccctaaatattgtaggtttaattgccgttctataaaatttaaattttagcttctatggtactctcttgtcacacggaatgttaccctgatttagttctatcattaacatgttcttcaatatccttgtctctctatagcatttgatagttataatcaccaaatctattgtaactattgaatcgcagcggtgtttgagatctgatactatctgtggattgccttagtacttttatattttcagaacacatcaagaaacatatccagcaatgtcgttgcggtatattattatagtgatgagtattccagtcctccagcttgtcacgcgacgacccacccccagcaacggcgttttccttttttttaatatatatcaaaacatctgtggcggattcagtcgcctgcttggccatagtccatcaacagcatgaagctttcagatggtgtggtgatggccacatgaagagaaagaagtactcactccagctcctagttcaagagaagagaagggtagagaagataatataatagaatagaagggtcagttcatcaccactcacagagccacaatcgccgtctatgtcaatgtgtctcactcaggtcaagatcacctcaaaaaaacatcccttgccaagctacacaaatggcatcagcaggcactcatcggatgggcgtgtcgccgtcatgctcactgctcatggctattccatgcttctcagctatgccgtcaaagactccatcacaggcttgattttcttccaagaatatatactgtattttattttaggaatatcgacctccccaaaatcccattacagttctgcaacataacctgattacagttcagtacaaaatcgcattacaccctctttttttttttttgtgtgtgtgtgtgggatcgaatcccgggctcccttgactagagcgttttctgattacgtttgcaattccgttgacatttcccaaccaagcaccttcattgttcatcggatgcaggtcagtcaatgtctccattgtatatggttttcctgctcatcatctgccgtgtacacggattgtgcacgctgaactacttacatgtcagattaataaataacgggtcgatctagttaactaactactccggcgtgttaacagtctcccggatacttggattccctggcaaggaaggaagtctagtacgttggtcagacagacagctagctgtgggcagggggttaggttgtaattaggtcactacctgctgcctggaattgggggttaacatgtaatagtcagtcccttggagggagtgttagctcagatgggtctagcaagcaaccatataaagcagaatgatcatgtgctcacaggccacaaccatcgtcgatctcactgaaacacatgcatgtacaagacaataagaagcctgcatgcctgcagttaactaagtttgttaatggataacaaagcacatcaagctgcatatatttattctggcacattcagaggttatggcataccagaatcaggtagcttgtgcctgttttcaggaacaaacacagacacagatgttgaggactcggaacagtttcctacatctgactggaactgaatccctctcctctcctgtgctaaaaacaactgttgctgccagtaaggagtaggaccgacatcgacatgctccgaaacaaactaatagctgacgaattgtcaacctcaccaccgcaacagcccttgcttcatctgcacgcacaagctagcatcagagttgacttgggcatgcatgcacggaaacctgcactcaatcaaagacagttaggcctgcaaatcaactacaatgctgaaggacttggttttatttattttttaccacagccttattactgaatgaagcgcacctcgctatccactgagagaaaactgtcgcagagcggcacagttgtgttgtgtgtccgtctgaccatcatcgatctcgctgtccttcagaaagcacttcaacgtacttacttgggttgagagggatacataatcatccaaacgagacctagaaaataatccaaacatagtacgcaaaatctaagtcgttttggattcttgcgttacgcaaaatctgagccgttttttggattttttggtttgatatatgcatggtgatttgtatgaaacatgcatggaccaataatgcaaccatcatcgtccccgcccccggtttcagtagaggtggtgatgtcaacagatgcatgaacccatgcaaccaacaaagcccggctggccggctccgcctaactacctagtacagattatgcgaaaaaaaactgtcttaatctttgtaaatacaaaggctagctacacaagtttcatgccacagcacttgctagcttgtcggtttatttctacaccaccgtgacacaccgtggagatctggtctgactgtgcactgcaagttgaccatctatctgatcgaagaggaaaaagaactgcatctgcccttatatacagtcagatttcgctcttgttttttgcagctatccattcattaagatccagttcttatctaatccgaatcaaataatgcatcttgcggtctaaattaccctgtaacccaagatgtcttctttcgaaaggagaagggaagcacatgtaaaccgtgatagtaacaactccctgttttttttttgggtcatacggagggagcaatagatttctttgatgacgtgcatgatgacacatgtattgacacacctgatctagcgatctgtttcccattaaacaagcaacacgttgatcctatacatatgtaactgatgatgtcaacgcgaaggaccggagcagggaactcggtctccaacactcgttgttgactggcccattgcatattattatcatatcctcctgatggcgtctgcaattaatagtagaacagtgtaccttccaactggatgcacatactattgtttaatcaagctgtccttcaggtaattaaacaacagatcgatgcatatatgcatgacaagcacgccctgattgggattcattgttactttaacgacatggcacagatgcgtgtgtatgtagagtgaagcagcagcggcgacggatcggaaggggagagatcctacgtagaaaactttgacatgcagagatcgatcaaagccacaccaaattgcaacaaactagctacagctcgcctaacggtgacatgtggtggacaattggatcgtgtaaagatctggtccccatttctttatcagattctgtttactaactgctacgatataacattatataatatgctcatcaagttgcagttaactaacatgtctctccctgttggtcttggaagttctgagaagtcacttctaaaaatacgactacatacggttggattacgctaggttatattaagagacttattaagttaatgatgtcctataatagcgctgcacaactgttcatcctctttcatattttccattacttgacttaaccgtttggaaatatgatctgtttgaatcattctctctcagaactgattacaaaatccagataaatttcttcttttatgtttctgagtactaattttggctatgattagaaaccgggaaaaataatattattcccaacgacagatgcatggaccacaaaagcacccaaagatatataggaaagtgaaagtggtgtatggtttatcacaattagaaagttgttccgccacattttcaatactgttgcttcctgtgatacacatcaattaatgatgagctgaaaacgattgtttcattgatgaacctatctatatatagggctgtacaagctgtcagtatcgagacttcctttttctgcagttaatccttctccgtcgagaactggttattactgccaacctctcttcacaaacgcagaataactaataacacaaataattctacagaagaaatctaatgaaacgttcatatcgcattattctgcagttaatcttttctctgattagcatagcatagcttgtaggtactaactgtacagttgtgtgtaggatttgtcatcatctgtgagaaggtttcggtatatattaattagtgtacaatggtacgtacgtatctatagacgcaaaggttgccacttgctaacagtaatacgctgccgtcgtgatgatatatatataattctactgtgtcatgcttgccaattcatctatcatgagctggattacttgctgaagctaccaaaaagaaaacacgttcttttttttcttcacatataatcgttaacaaaaagggtaaatgtttatgaatatttacacaacatagggttcttcaaacaaggcaagtctcaatcctttctctgtttttttttgcaaaaaaaaacattaatatgactaatttgcttccttgatcggaacccagggtgaaatatatgttaccaataatttgcgatcgcaatttggtacgccaaaatgccaaatcatattttgaatctagacccttcatccaagaatcaggtccaatcggtttggtttatggcgaggaccctcttcttacggtgttttcccccttttctgatgtcttttagtaggttcttaaccactaccttctgtggttctgtgatctgcacaaaaccgttcttttggtctttcccccctcttaacgagacatgtgtcaatataacgggtgtgttctcgaaaagaacacaactatgtttctctcgcagaaatggcaatggaaatcaggacagatgctct

SEQ ID NO: 2653 - DNA, 727 bp, Zea mays
gtaaacaggaaagggatttaggacgtcgggtggcctctttgccctcttcctccttcctccaccctgccttgcccaaagtagtcagtcgtcatcgtctcttccgatcgcctcgagttcattacagttagcgccgctaatcccctccctaatcaccatccatccatccatccggtaggattccccagccatgtcggcgactgcggtgaagtttcccgtggaggcgcctccgaggacagtgaaggtcaccaacgtctctcttagtgcaaccgtgcaagacattaaggagttcttttccttttcaggagatattgaacatgtggagatgcagagtggtgatgagtggtctcaaattgcatatgtcactttcaaagatgcacaaggcgcagaaactgcacttcttctttcgggtgccacgatagttgatctttctgtcatcattggacctgctccagagtatcagccaccccctactgcctctgctccaccaatgagtggaaccagagttccagttggtggagacaacaacgttgtccacaaggccgaggatgttgtgagcactatgcttgccaagggtttcgtgctaggaaaagacgcggttggcaaggccaaagcgttcgatgagaagcacggcttcacatccacagccggtgctaaggtggcctccatcgacaagaagattgggctgagcaataagattaccacaggcacttcgttggtcagcgggaag

SEQ ID NO: 2654 - DNA, 1054 bp, Zea mays
  misc_feature (1027)..(1027): n is a, c, g, or t
ccgggaatccgtcagagctctctacccagttacccacacgaaggaataataggctacctcgccgccccccgcccgggagtcgcactcgcacgccgccccgccttcatccccctgtgcagcaggcccagccggacgctctctcctgatcttcctccgccgtctcctcctgtcacccgcttgctttgaatccctttcttctgctccgccatcgcgacgcgccgacatgactgggtcttctaagaagcatgacctcaaatctaagcaaaaattggaaaagaagattagtttttacacaaaagtaaaagatgcagttacttccttaaatgctaagaagactgtcagtaagaaaaataaacagagtcggcgccagaagaagcttaaagcatacgatctgtcggcactttctgagttcctcccagaaccagctgcaccagagcagaagactgaagcaaagctgaactgcaagtcaagacagacattagtggtgcaggagtctgctcatcttaaggctgtactggacaacccgcagttccagcttgacccattcgctgcgatccatcagcacctgctggcaacgcagccgcctgcagctgcaaagaaggacgacgcagcggggaagcaggggaaggtttccaaggacaagaaaagcaggaggaagaagggcacatcgtcaatctctcaggcaatggatatctgattgtgttccttcagtactagtaacttggtccgatgtcgactgcccgtgttccactagagggagctcatcgaagttcgatatcgatggttggcatagtttgagtaccagtagaggtagtactgtaccagccctcgcttttggcagcctgtcgattgatgtttgcagaatcggtgccatcaacatttggtgctactttggaaactggggatttgaggagaggattgagggagaaaatgaacttgaggggattgagagggtcaatcctatattcctatatgaggtggcaatttccaagcacaacaatttcattggtatatacctgccgactgntttctgatccagctcaactgttgtaag

SEQ ID NO: 2655 - DNA, 2486 bp, Zea mays
tgcagcctggcttatttattttctcttgtgttgctatcacaatgttcaccacacgcatttgctatggatccaatatctaaattcacgtacacttgccatcgtacgtaatatgcttttcattttctattatgatcctggtgttttacaattttttttcccgtaaagcagaaaaataaacagagtcggcgccagaagaagcttaaagcatacgatctgtcggcactttctgagttcctcccagaaccagctgcaccagagcagaagactgaagcaaagctgaactgcaagtcaagacagacattagtgtaatcctcccttgttccttgcttcaggtggtcatgctcttcaactgtctctaaacccaaatttcttgtccagggtgcaggagtctgctcatcttaaggctgtactggacaacccgcagttccagcttgacccattcgctgcgatccatcagcacctgctggcaacgcagccgcctgcagctgcaaagaaggacgacgcagcggggaagcaggggaaggtttccaaggacaagaaaagcaggaggaagaagggcacatcgtcaatctctcaggcaatggatatctgattgtgttccttcagtactagtaacttggtccgatgtcgactgcccgtgttccactagagggagctcatcgaagttcgatatcgatggttggcatagttttagtaccagtagaggttgtactgtaccagccctctcttttggcagcctgttgattgatgtttgcagaaccggtgccatcaacatttggtgctactttggaaactggggatttgaggagaggattgagggagaaaatgaacttgaaaaaaaaaaaaaaaacaatcctatattcctatatgaggtggcaatttccaagcacaacaattcatttgttattatacctgccgactgtttctgaatccagctcaactgttgtaggaagcttggaaacaagcgctccaatttcatacgtttgatatggttttagctgaaagttcgcagggacgtggcatgttcagttccgatcaatctaaccgatgaaatccaaaactggcgaggtccaggccgctctatttacagcatctaataccgactacacattcgtgaataacactggacaaaaaaaaaaaaaactcagcctgctagatcgtttaatttgtggtcagcttggctttggctcgtcgtctttaacctaatttttcatcatgttagttacaataattgagtagtttatcttgttagttacaataattgagtagctcggctcgttgtctccaaacttctataaacaacttgataacgggatttctcctattgcgggggatgaccaaacccgtttatggttgcatcatttatcttccagttccagaactgttagggtcaagccaccgacgttgaagtgggtctctttgttgggcttctaaggtcaccattctttactcaaaggccgactccagtagattatccaaagttatccatatatactgttctgcattgtacactatactattatagagtgaagtttaaatataggtatggagatgggtaaagtgtagagataatctaactagggacgtctttaaggacaaataaaaattaccaacaatattttgctggggtcaaccacatgttacattacaaatacatgccttggcaaacaggctgcaaacaacaaaacctacaatgtactaattcagacaatatatagagatgtgtaaatgtaacatcatgtctagctccacatgcactaaatggataagagagtggaaaacatcagtaatcagcggtctgtgacttagttctggttgcacacataaaactgccacctgcagaggtacataatagcaatcaaaatagttggaaggataatttcatatgaaataaagaccattaataggctaacaaaacagtacttggttttatctaggcataaaacttttgttggctgacaattatatttgcattgtttttttctatgctagctaatatttctaaagcagatgacaatcttacccatctgagatcaagatgacaattagcggcatatcttaaccaacaagctcatattcttgagaagtgagtatcgagttcctacatttttagataatggggtaaaagtacacggcctttgtctataagtagatcctcatccatgatgtcggaaaaactgcatcaccaacacctccatcttacggcaagcagtcttcatttgctcctgatcgtcttccttacgctgaagttgagtccaaaagcagagccaatgtgtagttcggaataccacctgcataggagttttcaaaggagcattatcaaagaccacaccattcctactcaaccagatagctcagcacatagctgagaccactaggagcaacattcgtctcatttttacatccctaccatcaagccaagaaccaaaaagatgtgttacattgtgcggaggtcgtattccacactgtattgaaacaaccgccat

SEQ ID NO: 2656 - DNA, 1496 bp, Zea mays
tttccttcttatgattacccatgtttccataattctacacagtcgtagaagcaactgaggacattcctttggtttttgtaatcctttgatatcttcctgttgaattaactgttgctttactcattgaaccaggatcaaggccagaaacttctgactatcctcagtcaagtgagaggccactgactgccacaagcagtttcagttctgcatccccattttcagaatcaagccagttagcttcgtctagtaaacaaccagccccatatctacctcgcaaccatatgggcaggcggtctttcatgtctaaaccagtctacccacttgtcttccggaatcctgtctcagaatcagaagcgtgcaggatgcttgaggttggtaatgccgggcgagcgacaccaagtgatgacagccaagcttctcctctgtggcgtcgcagcttggcgagcccagatctcaagttccacaatgcaccgaatgaacttgggaagatggaaacctcacccgaaccgaacacaagctcaagaagggaagggttcagatggagcaacgccagcagttatgactttggatacgatggagatgccattgacatttcagatcatatcagcatcgagtcccagagatctcccacgagctcagcgaggttcctgaagtgtgggctgtgcgagagattcctgcaccagaaatcaccctggacctcgaacaggattgttcgaaacgccgacatgccagtggcagcagttctgccttgccgacatgtcttccacgcggattgcttggaggaaagcactgccaagacagaagtccatgaaccaccttgccccctgtgcgcgcgagccactgacgatgaagggcacgtgtcgttctcagaacctctgcatgttgccctccgatctgctcgcaggaacctttcgttgggcactggtgctggtgggaacagcggcatttctgaccctcctcgcactgatcgtggcttgaagaggaacaactctgcagtcatgcctaggcgcagcggcggcgcattgttccgcaatcgcttcaagaaacagttccccttcaaagcgaggatcgggaaggagctctttggcggtagggttctcaacaaggttggattgtctttgtcttcaggtcagcatgatgatcatcgacagcaagcgccaaagcatgaccggcccatgaagtagctagatcttagtggcacagagtataatatgttgtgtgccctcctgatattttatctatggcatctgttatcgaaacttggcatccatgcgcagcagtcgtccaagatgggggccctgtatggattatggaaggctgcttgcattgcgtgtaacagtagcaccttgccattgcatgtattttgcatgtagcacagtaagaatctatgccctgtgattgatatgttctgaatgttccgcttgatctgttcacattggctgctaaaaaagcgtgttgcccccagcaattggaggaatagccttgatgaccattcc

SEQ ID NO: 2657 - DNA, 1381 bp, Zea mays
ttttaaaaaataaatagtcaacggcaaatccagccgatcggactctgctctccttttcccctttctccgttcacctttctctcttcctttttctttcccctccctctccctttctttcctcctggcgacgactgggcgagtgccgccgaacttcgccaggtcttcaccggcgacgagcacctacaaggtgacactattccttttcttcacttggtgtataatctctctttgctccgatcaagcttttcaaacataataagcaaatagtctctgcacgtgattgccaaaattagtcaagacgggtgctctttgctgcgtggccgctaggccacatgggacaaagtctgaccctgctagcagagatcgttctatggatcctactgagcctcgttggcgcataaattcgagcttttctcctccaacgtcaaggaggtgggattgccgctattcatcagatggattgccccacagagttcatgatgctcctcatgatcacccgccatatgtttcatcactatcatcccatagcaaaggaagcagaagtgcatttggcagtgatcagtacctcaatcatcatcattctgcatctgatggagcactttcttactttgggagtccagctgacagccttcaggccccacgctggacaccctctcttcaaagatttgatctcggtgaattctctacccctgcaggaggatcaagaccagaaacttctgattatcctcagtcaagtgagaggccactgactgccacaagcagtttcagttctgcatccccattttcggaatcaagccaactagcttcgtctagtaaacaagcggccccatatctacctcgcaaccatatgggcaggcggtctttcatgtctaaaccagtgtacccacttgtcttccggaaccctgtgtccgaatcagaagcgtgcaggatgcttgaggttagtaatgccgggcgagcgacaccaagtgatgacagccaggcttctcctctgtggcgtcgcagcttggcgagcccagagctcaagttccataacgcactgaacgaacttgggaagatggaggtttcacctgaacggaacacgagctcaagaagggaagggttcagatggagcaatgccagcagttatgattttggatacgatggagatgccattgacatgtcagatcatatcagtatcgagtcccagagatcacccacaagctcagtgaggttcctgaaatgtgggctctgcgagagattcctgtgccagaaatcaccctggacctcgaaccggattgttcgaaacgccgacatgccagtagcagcggttcttcattgccgacatgtcttccatgcggattgcttggaggagggcacttccaagacagaagtccatgaacca

SEQ ID NO: 2658 - DNA, 867 bp, Zea mays
ttgggccccccgggcccggccggtgtcctttttccctttctcccgttcacctttctctatcccttttctttcccccatccccctttctttcctcgtggtgacgactgggctagtgctatcgtccttcgccaggtcttcgccggcgacgagcacctaccaggtgaccctattccttttcttcactcggtgtataatccccctttgctgcaatcaagcttctcaaacataataagcaaatagtctcttcacgtgattgccaaaattagtcaagacgggtgctctttgctgcgtggccgctaggccacatgggacgaagtctgaccctgcaagcagagatcgttctatggatcctactgagcctcgttggcgcataaactcgagcttctctcccccaacatcaaggagatgggactgtcgttattcatcagatggattgccccacagagttcatgatgctcctcatgatcacccaccttatgtttcatcattgtcatcccatagcaaaggaagcagaaatgcatttggcagtgatcagtacctcagtcaccatcattctgtgtctgatggagcactttcttattttgggagtccagctgacagccttcaggctccacgctggacgccctctcttcaaagatttgatcttggtgaattctctacccctgcaggaggatcaaggccagaaacttctgactatcctcagtcaagtgagaggccactgactgccacaagcagtttcagttctgcatccccattttcagaatcaagccagttagcttcatctagtaaacaaccagccccatatctacctcgcaaccatatgggcaggcggtctttcatgtctaaacagtctacccacttgtcttc

SEQ ID NO: 2659 - DNA, 2313 bp, Zea mays
gccgtgtctagtgtcttccgtctcgatcccgcgggtgggactcgccggcgacaaaaacgaaaagcgacttgccctccgcggcctccggccttcccactccactcgccctcctctcctagcgtcggtgagccggtgcgctgcagtccccgctccccttccgcgtcgccgcgatggaggtcttccgggagcacggggacgacggagtgccctaggattccatcacgccgccaagcaccagtcccgcagccagggatttcttctccgaccccgaccttcatgtgagtcgcggccttcctcctcgaagcggatccggcggattggaggggcccaaccatagcaggtacttcttgcgggtgtaagcatttcgctgcacttggagacgcttatttggagtatttgaaggctttggagactgcccagatgaagagtagatttcttgttctctgtgccattgtctgcgtcatggctcagatgggagatgccaatgtcgtgctattggggaataatctgaccttgtcctttgctgatattgaggcaagcttttctccaggagtgaaaggatcaggagtcaatggcatagtttatgcttctgaacctttgaatgcctgcagcccgttaacaatcaaggcagtcaagggcccgccatctccctttgcattaattgtaagaggcggatgcacgtttgatgagaaagtgaaaaatgcacaggatgctggattcaaagctgcaattgtgtatgacaatggaaataggggggtcctggtttcaataattgttgcagtggctggaagctcaagtggcatacacatatacgctgttcccacgcgtccggcctcaggagaggtgttgaagaaatcttcaggacatactgatgtagaggtgtggatactacctacattcgacaactcagcctggtcgatcatggcaatctcattcatatcgctgcttgccatgtctgctgtattagctacgtgtttctttgtgagaaggcatcgaataaggagagaccaccctagaatcccagaagctagagagttccatggaatgagcagtcagttagttaaggctatgccaagtcttattttcacgaaagtgcaagaagataactgcacatcatcgatgtgtgccatttgtttggaagactacagtgtcggagaaaagctcagagtgctgccttgtcgtcacaagttccatgcagcttgtgtggacttgtggctaacttcttggagaacattctgccctgtatgcaagcgagacgcgacgagtggagtatcagaacttcccgccacagaggctacccccttgctttcttctgctgtccggttaccttctcagccatcttcattcaggtcgagcgtggcagcctccccacccaggccgataagccggcatccttcatcgcactcggtttctcgtgcttactctgtctctagtaccccccactcccccaaccccttcagatctcacacaaacttacctggcgtcatccatgcaagcagaagcaccgcagaccttgcaaacatgtcgtctccccaccctcgcatctcacacttgtcgtcgtcgacacactccctcgtcggcagccacctatctccaccaatcagcataaggtatccattgccccattctcggcatgaatcgcccagtccacacgtcagttcgccctacatctcaaattctggctacggttcttcaagctactactaccttggcggctcgagccagcacgggtcgtacctgcggcggtgtggagagtcagggccaagcctgtctaccatggtccctcggtcgtcgcagcagcagttccagtcagaggcaaacgtggccgcaggcgcgtcgtctgcccagtcctcacggcagtcctacctgcgacgctgtggcgattcagacgccagcttgtctgacatggcgtcagcccagtcgttgccggggtgctgaggcagatgtgcactacaagatgcggcttgacctgtgcatacaatgaggcttgcagcgtcacataggtggggaacatgtatagcatagactttatgatcctgttcttgtctgtgagtggtatatggttctttttttgtgccttttattgtgtgcatctgacgtgacaggagcctgttgaagttgattctgttaacattttagtccgcaccatgcgtccatgccaacttctccctagatttgctactctactaccatgcacacatttgaacgaggcagtgctcagctgcatgcatctgatgttaatgttgtgctgctcgctcagtgagcatgaagagatggtcgtctgagcaaattcagaaaacagccctttgtctg

SEQ ID NO: 2660 - DNA, 1416 bp, Zea mays
  misc_feature (1341)..(1341): n is a, c, g, or t
gtgtctagtgtcttccgtctcgatcccgcgggtgggactcgccggcgacaaaaacgaaaagcgacttgccctccgcggcctccggccttcccactccactcgccctcctctcctagcgtcggtgagccggtgcgctgcagtccccgctccccttccgcgtcgccgcgatggaggtcttccgggagcacggggacgacggagtgccctaggattccatcacgccgccaagcatcagtcccgcagccagggatttcttctccgaccccgaccttcatgtgagtcgcggccttcctcctcgaagcggatccggcggattggaggggccaaccatagcaggtacttcttgcgggtgtaagcatttcgctgcacttggagacgcttatttggagtatttgaagtatgagttggctctctgtcctgtcagttatgtgcctgtgcttcataaaaaagagctacattttcttctactagggctttggagactgcccagatgaagagtagatttcttgttctctgtgccattgtctgcgtcatggctcagatgggagatgccaatgtcgtgctattggggaataatctgaccttgtcctttgctgatattgaggcaagcttttctccaggagtgaaaggatcaggagtcaatggcatagtttatgcttctgaacctttgaatgcctgcagcccgttaacaatcaaggcagtcaagggcccgccatctccctttgcattaattgtaagaggcggatgcacgtttgatgagaaagtgaaaaatgcacaggatgctggattcaaagctgcaattgtgtatgacaatgaaaatagtggggtcctggtttcatggctggaagctcaagtggcatacacatatacgctgttttcgtttcgaaggcctcaggagaggtgttgaagaaatcttcaggacatactgatgtagaggtgtggatactacctacattcgacaactcagcctggtcgatcatggcaatctcattcatatcgctgcttgccatgtctgctgtattagctacgtgtttctttgtgagaaggcatcgaataaggagagaccaccctagaatcccagaagctagagagttccatggaatgagcagtcagttagttaaggctatgccaagtcttattttcacgaaagtgcaagaagataactgcacatcatcgatgtgtgccatcttgtttggaagactacagtgtcggagaaaaggctaagagtgctgccttgtcgtcacaagttccatgcagcttgtgtggacttgtggctaacttcttggagaacattctgccctgtatgcaagcgagacgcgacgagtggagtatcagaacttnccgccacagaggctaccccccttgctttcttctgctgtccggttaccttctcagccatcttcattcgggtcgagc

SEQ ID NO: 2661 - DNA, 2430 bp, Zea mays
ctacgcgtccggctaagactgcggaaaggttgttgatgtgatggggccccttctcacagaatatcttggttcaccacagcagcaggctgcagcttctaaaagtaattctgaaatcgatgatacaagcaaaactgaggatatgattggttgtgcaagttatgatggtgaaaatatagatagctcaaagcagagacatgacaatgctgaaggtcagcagcctatggacacgtcagttgatcatcctacctgtgcaagtgaggtggatgggatggacgtggttgattgcaatcatgatgaaaacaatgtggcttctggtgaacaaaattgtggggaagcatcattgattaatggtaaacccattgagacatcatcagataatagtttggagcaaggcaaggcatgcaaggatggttcttccagtccaaacaacaatgtccttgctgctaatgcatgccagtttaagaatgtcgttgctattgtagaccctccacgtgttggccttcaccctactgtgatcaaggcattgaggacgcatccacgtattcgacgtctagtgtacatttcctgcaaccctgacagtctagtcgccaacgggatcgagctttgcacaccaacacccgagaaacaagagaagaacaaaggcaaccgagggtggcggtctatgagcagcgcgggtctcgctcggcagaggacgaagtcgatgcccaactctgaaccttttatccccaagagggcaatggctgtcgatctgttccctcacacaccgcattgcgagatggttatgctttttgagaggtgaaggaagtgtgtctaccaattggacgcagctggcgtgcctcagattcttgttaagagatttttgacctttgtgtcgaggaccatatctgtttttcctcctcaccttggcccatccatatgttgtaacttagtaacatctattcgattgagaggccatgacggttggtgttggtggttactctttcggatttgccttctgttcggctacacttaatcactggtatgtatttctttttcgtgttaaatggatggcatagtaggactaattcgtgtacgtaaaatgtgtgctagtagccatacctggctcagcttttatatcgatggtccaacctggagtgacatcctagtcagggaagaaaaccgtgcatgagagctagtgttggcccaaccgtgctagcatttgtatctgctactagaaataggcagcgtcctatcggacgctttgtaccagccacctacactatggaaaaactggggagagaccggagttgcaagatcaggttgttcagaggtatctttgcaaatcctaatagaaatgtatttacagaaatagagcatcgtgtcagacaagaaatatgttagtgatgctcaggaaattgaagttttcctcttcctgaatattcattctcttgtgtgttagagttcaaaaagatgcaaaacagacttaaccacattattcccgcttcaccaattgttcttaagaaagaaggggaacaacatgattcttaactggagatgaccccactgaattgtcaaattaaggcgctacatctactaaagccacatttagtacttttgtagggttgcaactcatgtcctattggttcaatttttcaaagctcggttaaatagtaggagaggaatcgtgtcaccaacagagaactgcataaataactttttggtgatcctggcacttattttatttcataaataaccaaaaatattgcttgtgagttttgttgggttttaattctagcccaccacaatttgtttgggactaaaaggtttcgttgttattgttgttgaaataacgaagtatattaaaatcatttttaacttataaagtcttacacttcgacaaaaacaattattgcataacttactgaattcctgagcatgaggcgcatgtgccatcagattaacttttcaggtacccttgactccattactgcgataatgtgttacacacgacatatattcaatggataccagttaataggtattctagttgatagcagccttggaggttagactgagatttttttaagcggcagtaacggagtagtatccaacttttgcatattatgcaggtaaggcttggcgtagagcctaccgtctgtaatcggaaggtcccaggttcgagccctaccctctgcatattatgcgggtaagccttggcacttaaagatacccttccccataccccgcatagtacgggaagcctagggcactgggtacgccccagtggcctggcagatagttttggcgaagtccagaaattcacaggttcttgatgctccagaaaattcatggatcttgctcccaaatatgaatttttgggtgcttcagatttcatggagctagtgtgtttggatataaaaagcaagattggaactattttatctagagcta

SEQ ID NO: 2662 - DNA, 1893 bp, Zea mays
atgtccaatgaaacaaatattggtctatttacaaactaaaaacttactatagaattgtatgcttggggtaaacactggcattactgatcacctaacgcctttttaaccctccaggatccagtccaaagtagtgtgactgttggagtttcacattttgagagatgctcgctctgggttcaagttttgtattacccgttttatggaagtagtggatcaacagactatgaaggagattatgcagaagaggattcacagatgatgaggcagaagcgctcacatcggcctgaacttggggaaccggttgttttgcggtgccaaccatacaagtttcctctcgctgagctcctcctaccattagagtgttctccagttgagtatttccggctatggcctagcctaccagccatggtggagtgcactggcacatacacatatgaaggcagtggtttcaaggccaccgctgctcagcagtatgacagctctcccttcctcagtggattgaagtcgatttcttctaagcccttccatcaagtctgctcacatttcatccggacagtagctggattccaggtaatctttggtacgctgtatactaaatggtgcagtatttatttcgtatccataactagtaaacattttgagtgatgactataacttacatctcctacagttatgttatgcagcaaagacatggtttggtggatttgtgggcatgatgatatttggggcaagtgaagtcagccggaatgttgatttgggtgatgagaccaccacaatgatctgcaaattcgtcatgcgcgcatccgatgaatccatcacgagagagatcaaatccgacctccagggctggctggatgatatcaccgacggcgctgtggaatacatgcctgaggatgaggtgaagagtgtggccgccgagcagctgaagatctccatggagaggattgccctgctcaaggcagccaggccaaaggtcccacccgcaaagaccgatcaagaggaggaagaggagcgaaagcagagcgaggaactagatgggtttggaaaccccaagggcccctcgacgctctccaagctcaccgcggaggaggctgagcaccgcgctctccaggctgccgtgcttcaggagtggcaccagctatgcaaagagagagccatgaaagcgcagtgaggtcgatttggaccgtgtggatcttacgcgcatgtataattttgtatttttccttcgtctcccattctttgcgtgtctatactgctggtttcactcactgtataccgtcgccgatttgttcattgtattctcaaatacttgtgcacgaaaaaacctgttttgtaacatactactgttagggcgtttttaagcttcggtgtgaagatcgattgtacaagagaatccaaatgtcattgttgccttcccagttttatgaaaatgcattctgtaattgaagaattctccccaaaatgccacgatttataaataagaaatgtggaattgtaatgatgtaacgatcactctggttaggacgtgtttggctaggctctagttgctcttgtgtccgtgaagatgtgctcctctattctaaatttcgtcgtataaaaaaatattctttatcttttataatatttcctaaaagattccgtattttatatatcttcatctctagcaatatcttcagcaacgtttcctaaattcaatcctctatatatacaatgttacccataaaagaatatattattctctaaaagatttcgtcttttatcccttctttatctctagcaatatctctagaattggatcctctatatgtacaatgtttatacatgtctaaactgagcagacccgtcgtgcagcccgacacgcctgagcacggcccaggccggcacggcacaaaa

SEQ ID NO: 2663 - DNA, 2191 bp, Zea mays
  misc_feature (27)..(27): n is a, c, g, or t
gtcatatatatgataccacgaggcggngtgaagacaattaaagctggtgcatctcaagatcagattctgaatgagacacgacttagaaatttgcagctgcagcttatcagggaccttcgcgaggttcacactccacgtatatcttcacgcttgatatgggcaatttctgaacactttgatcttgaaggtctggatccccttttagctgatgacccagaggacccactgaatattgtcatatctaacatgcacaagatattattcaacaccgattcatctgctactacatcaaataggatacaagatgtgcaggctgttctaatttgcgctcagcggttgggagcaagaaatgcaagagcaggccaacttctcactaaagaactggaagagtttagggcaagtacttcagctgattctatgaccaagcatcaatcacgttatgtgttgcaagtaataaaatacgtaacaaaccatcctgacaacaggtgggttggtgtaggtgatgctacaggggattatccatttagtcaccacaagcttaccgttcaattttcagaggcgtctgctgcccaagataggaaattggagggattagtccataaggccatccgggagctttggaggccgaatcccagtcaattaattctcctacaaacaaggggaattggtgctttgcataaagagcttccaaaagcgtgtgctttgactggcagcagtgatccgtgctacatcgaagcatatcatttggcagatccaactgatggcagaattaccctacatctaaagattttaaatttgactgagctggaactcaacagggtggacatccgtgttggcctgtctggagcactgtattatatggatggtttctctcgcactgttcgtcaccttcggaatcttgtttcccaggatccagtccaaagtagtgtgactgttggagtttcacattttgagagatgctcgctctgggttcaagttttgtattacccgttttatggaagtagtggatcaacagactatgaaggagattatgcagaagaggattcacagatgatgaggcagaagcgctcacatcggcctgaacttggggaaccggttgttttgcggtgccaaccatacaagtttcctctcgctgagctcctcctaccattagagtgttctccagttgagtatttccggctatggcctagcctaccagccatggtggagtgcactggcacatacacatatgaaggcagtggtttcaaggccaccgctgctcagcagtatgacagctctcccttcctcagtggattgaagtcgatttcttctaagcccttccatcaagtctgctcacatttcatccggacagtagctggattccagttatgttatgcagcaaagacatggtttggtggatttgtgggcatgatgatatttggggcaagtgaagtcagccggaatgttgatttgggtgatgagaccaccacaatgatctgcaaattcgtcatgcgcgcatccgatgaatccatcacgagagagatcaaatccgacctccagggctggctggatgatatcaccgacggcgctgtggaatacatgcctgaggatgaggtgaagagtgtggccgccgagcagctgaagatctccatggagaggattgccctgctcaaggcagccaggccaaaggtcccacccgcaaagaccgatcaagaggaggaagaggagcgaaagcagagcgaggaactagatgggtttggaaaccccaagggcccctcgacgctctccaagctcaccgcggaggaggctgagcaccgcgctctccaggctgccgtgcttcaggagtggcaccagctatgcaaagagagagccatgaaagcgcagtgaggtcgatttggaccgtgtggatcttacgcgcatgtataattttgtatttttccttcgtctcccattctttgcgtgtctatactgctggtttcactcactgtataccgtcgccgatttgttcattgtattctcaaatacttgtgcacgaaaaaacctgttttgtaacatactactgttagggcgtttttaagcttcggtgtgaagatcgattgtacaagagaatccaaatgtcattgttgccttcccagttttatgaaaatgcattctgtaattgaagaattctccccaaaatgccacgatttataaataagaaatgtggaattgt

SEQ ID NO: 2664 - DNA, 2215 bp, Zea mays
aattccgttgctgtcgctgatcccgactgagctcgagcgcgcgtttccatatagtggagccagaccacgggcacacaaaacttcgtctctcagaacaaggctcgaggagcaattcgaaggatggaaactcctattgctggtgttggtgtgtcattgggccatatcgatctgggaaaatcttttctcctcaaccagcttctctccttatcttgtgataaaggttttggagttggtcatatgcgagatactaaaactaaaggtatttggatttggggtactcctgttgagatggatgttgatggttccaaagtttctgtcatttatctagacactgaaggatttgaaagtgttgggaaatcaaatgtgtatgatgataggattagaatgttttctttctttggtaggatatttgctttggcgactgtcttaagctcggtccttatctacaaccttcctgagacggtacgtgaagctgatatatctaggctttcatttgccgttgaaattgctgaagagttctatggaagagtgaaggggcaagatgttgcttttgagccagcaaagcttctctggcttatccagagggatttcctccaaggaaaatctgttcaacaaatggtcaatgaagcccttcaacgggtgcctaatgataatggtgacaaatatattgatgaggtcaatcaaatacgagattcgttggcagttatggggaacaacagcactgcttttagcttgcctcagccgcatcttcaaagaacaaaattatgtgatatggaggacaaagaacttgaacccttatatgtaaaacggcgggagcaattaaagcagcttgtttcgtctattgtaaaaccaaaaattgtgcagggcagaactctaaatgggaaggactttgtgtctttcttgcagcagattcttgaggctttgaataaaggcgaaattccatcaacagggtctctagttgaaatttttaacaaagccattcttgatcgctgtctgaaggtgtacagggagaaaatggatggcttaggcctaccagtaccggtagacaaactgcagaaacttcatgagatggcaaatggtgatgctagaattctctttgataagcagcactttggcaaacatcatgctgctcagtcagcactcaagcttgaagatgatattaaaaaggtgtacagaaacttacttctagctaatgaatatcaatcgtcaaagctgtgtgaagctcgcttttctgagtgtgaagataagatggatcaccttcaagtcttgaaacttccttcgatggcaaaattcaatgcaggctttactcactgcaaccaaagtttcgtaaaggaatgtgttggacctgcaaaagaaagctatgaacgtagaatgtcaaagatgcttgccaagtctcgtgctcttttcatcaaggagtacaataacaagcttttcaattggttggtgaccttctctttggtcatggtggtcatcgggcgctttgtcatcaagttcttcctacttgaaatcgctgcctgggtgatgttcatcttcctagagacgtacacgagaatgttctggtcagcggaatcgctgtactataatccagcttggcacatcattgtttcttcctgggaaaccatcgtgtacagcccaattcttgatctggacagatgggccgtcccaattgtcataatgctattatttggggttctttactggagatgcttcggtggtagaaggaagcggggaaggggttcgctcctcccattgtacaagaattcttataactcgagtcgtcgctcgagatcagactagttatacacgcaatgttcaagtttttttcttttaaagaatggtacaaaatatctgcctgtagaagaggctaaactgccgaatgtggatcatctgtaagtgcttttggatgggcatgttttgatggtgccctgccaatgtatctccaattctttttggtggatgaagagaggcggtgaagctgctagtatggggcggggcacctgcacaaagcctcatttgtaattcataccagggtaccttttctgtagctagattatccttacatgtcacggtcccaattgattgattattgtttacgtctactgcaattttttttggcaagaattttgttttttaacgtcataaataaaaggtagctgttaaagcgtgtaccgagtcaatcatatgttcaaagttataatctggtggtgggatttgg

SEQ ID NO: 2665 - DNA, 2789 bp, Zea mays
  misc_feature (433)..(433): n is a, c, g, or t
  misc_feature (571)..(571): n is a, c, g, or t
cctcgcaagtttagcatatgatgtttattatatatgttcgttttattagggttatgtgcgagtctccctatattcttcatatatagttggtatctgcatgcaagccatggcaacaactcactatatatttccattgaagtatgaacctaagacatgtattcctttctagatgttccaacccatatcattcccccatggcttacgtggtattcttcatggctagtagtagctaggtttaggggttgaagcttgccaggcccattttagaagctctgtatattttctctagtttcttctgttacatgtgtagcatgggtgtgcatgtcagtggccaaatagtggctgtactcctaattcctaagccttattgaacttggtcccataagtgtctcatggtatcactatcactagtagtacctgatatgcatgctgntttgggactgttctttctctttagattaaaatcggctgtttagactgttgtagttgtaatttatatagacaaaaaacaccgtagagaaaccgctatatattaaaaccaagcgaattgacttaatttttcaggtctttntggcaccgtggttggttctgaactctgtaccatgaaaattcagaacagccgggacgatcacctgacacctgagcagcaaatcgatgggaaactgtgcctgaaaactcaaggcctgagcaaggagcacctgtgtcagtgtcagtgccaaaaggcttcaaatctctggctgtagttgccgtctgctgtaggctgtagccagtttgaagtagatcaagctatctgtatgttcatgtataatttagcggcgatagccgggtatatatatggcctccatatttagctcctctattagttgttagagagggcatttgctaaatgtcatgtatagccaaagatttaggacatgtttggtttactgtctaatttgtcgcactttgtctatctttttcgtctaaagttagttattcaattcggatgactaaagtgtggcacattacgaaccaaacaggaccttaaaacattgctcagcctcagcgtgcctggttttgaacactgctacaagtcttcaagagcaatggctagtaattaggtttctttctgctggagcagttcatcaggtaaaaaggtcaacaagatgaaatatagcattctgcccccccctcgagttttttttttttttttttagcttcagaatgtattattattataattattattaggggagacgattccattctacaccggaaagaaacatcagcagatctcacagccatttcatgcacactcgacaagaaactaatcagagcagcaatactgccagtactccatgagatctgcgcaaatttctttctagtaggagagaagatggtgaacgaagcagacgacacacacgacgctagctgagccttgagatctctgcagctctcaagaacccaccgccaccggccgcgtcacggggaccaccaccacccgaggcggcggcggcccgagcccgactccgacgacgacggcttctcgtgattcgcctcgtagttccacttagtggacggcccggacggagggatggggagccgcttgctctccgccatcgccgcggccgacggctgcgaatgctggtgccggctgatgattacagcctcccgcgcgggaggagcagcggcggcggctgctgctccaacggccgggccgccgccggtcgcttgctctccacgcccgtgatcctgggcacccagcagcagcaccaggaaggccaggccggcgacgaggaggagctggccaagcgacgccatgagcgcgcgctagcactgagcggtgccggtgggcacgcggtcgaggtgcggtcagtgcagctatagccgcgtcgagctgaggagacggcgacgaagcagtagcgagaccccggccggcctccaggggcccacccttataaggcgggtgcagcagccgtagcaattacttccgaccttggaatctttctcccgagagagacgatgtgagagatcgatcgaaggccctcggctccgctccgatccatcgtcgccaccagatcgaaaccacggacggctgcatggtcaaaaaggcttcaggacaggacgtgaaacggctgccagccgtgttgagtgacgccatgcatgcaaggccgccatcaaatttaagagctctcgaccgaggtcagcactactctcatctccagtaggccgtgtactgttttgtgttatagattacactattttatttatagagtggagtttaaaataatgattaagatagtgacatctcagtggcagccagctggagcagatgttagatggtatgcaagatgcaacaagagatgcagttgacggatgatggcgtgatgtctggctgcttgcattgcttgcgtaggcataagcagctgtatcatcatcatcagaattgaattgcattggatcattcataattaattcatggagggccgagtggggatggttgttcaaccagtggagattattgattgttggcgatagaattcaattgcaacaaactcgttgcttggcattttctgcaaatttcctgaggccttctctctctaactctctctctctctctctctctgtttttttgctcctcggcttggctatttttcgtaccatcttttcgaaattatactacaaatgaactttggcctggcgtagctttgaaaacatttgacatgggtgtagctttgaaagaaaagaaaaaactaactttaacctcagcagaagaaagaggcaattaaactgaataaatattaaatctg

SEQ ID NO: 2666 - DNA, 975 bp, Zea mays
tggttacacattttcaagtttatttggttggtggactcttttctgacccgccctttccagaaggcccagattgaaatattgcttggcaagacggagaagtttgatgagctgatggcagcggctgccgaggagagggaggctaatggggccgaggaacaaagctgagtacctgcaaggaaggaccttgttgtagcttatttactgttttctgctgctagatttgtcttcttcatagtttgtcgagtgggctagagacgattacttgtatgatcaattaaaggcgcggcttatttagtgtgcttttttacttgattcatttatgttggaatgatacaagttgtgttcaatatgatatactttagattcatcactatcttcaatttagaagatagtgcgttgctcctgatgttcgtggatattctgtttggtggcgttgcaatcaacgtctcctatatactacaggtgcctgaaatagggataaatttcaagcgccacttccacactttcacatccaccaaacatttgggttggggggctcgggggaggcaggcataggcggcagctggcagtgccgccgtgtgggaggagagctactgggctagggggaggcacaggggctatccgcactgacgatactctggaaagagtattctaagcttatatattatataatctaaattataatctagattatataatttaaaagaatagcgaagtccttattacttatgctaggaatggcgtattccgggtgctactgttctgtaccgtgatgcatggcgttatgcctttgtggtgtgttttctctatttcatacgccatagcgtgcggatagccttagcgcggcggcagaggggactcgggtcagtcgtggcctctaggggcgagagtccgtctccggtaggctagggcacatgtgaacgacatgagacatgttgaagaataacaaggtaaaagatccattctatcatgtga

SEQ ID NO: 2667 - DNA, 881 bp, Zea mays
cctcgaggccggccgggaccccatataaaacccggcaccgatggggggccgggccggattccacccatcgccgccgaaatcccgttgcgtctctcgcgcgttaccaagctctcaagttttctcgcgccgacggcaatggatgaggtcaccgaggccgtgaacaacctcaacatctcgggcgtaggggccgcgggcgttgccggggcggaagggcacaagaagaatcgcatccaggtctccaacactaagaagcccctcttcttctatgtcaacctcgccaagaggtacatgcagctgcacaacgaagtagagctgtcggccctcggcatggccattgcgacggtggtgacagtagcagaaattctgaaaaataacgggcttgctgtcgcgaagagtatcatgacatctactgttgatatcaaggacgagactaggacccggcctatccagaaggccaagattgaaatattgcttggcaagacggagaagtttgatgagctgatggcagcggctgccgaggagagggaggctaatggggccgaggaacaaagctgagtacctgcaaggaaggaccttgttgtagcttatttactgttttctgctgctagatttgtcttcttcatagtttgtcgagtgggctagagacgattacttgtataatcaattaaaggcgcggcttatttagtgtgcttttacttgattcatttatgttggaatgatacaagttgtgttcaatatgatatactctagattcatcactatcttcaatttagaagatagtgcgttgcttctgaaaaaaaaaaaaaaagggccccctggcgttgcattttttccccacgtctcctatatactacaggtgcctgaaacagggataaatttca

SEQ ID NO: 2668 - DNA, 2730 bp, Zea mays
  misc_feature (86)..(86): n is a, c, g, or t
  misc_feature (1656)..(1656): n is a, c, g, or t
ccgtcctgactcttcactgactactgaatttattgtttggctaatcaaatggtcacttccaatgccctgtagcagacaacacttcnctgtaccgatgttgcctagttgtctttcgtgcactccagaagaatctctttaagcaaacttgtgataatttgtgtgttctatctattagacaacatagatgtcaattgtcgtgggtcatgtcaatgtttacttagatggttatgaaattatcggctgtaccaatttgggtctgtctaattgctacaatgaagttattaggtgtttgtggagtagtttttatatctgacatattaaaaggatacctctaaattcttttaataaaaggtaataaaccagtaactgcatcaagccaagctgtataaaaatctttgatgaaacaccttgcatgatacgatgttgcatcacagcatactgcatcctttaggtataaaattgagcagcggtgctgaactagggacataggattaaaaatcctttttttttttggtgaaacatgtacatcttatattgcctaccggttaagatctttgagaatgctgactgatgatctttacgatgttgattgccttgtcaatcattgtttcgcctgcatttttggcagttgacgtcacgaatgctctccctggttatactgttgggtatttttctttcttagtagaattacagaacatcaacagttgagaagcattttcttgatcaaagttcagttttgtctttattcttcctactgtggctaaggcaatgctcttttcttgtaaattctacttctaacgaatacaacgttgctgtcgccgttgctgtcggggtgatgcttagtagatcattcctggagttttgcttactgggatgggataaccttcctcgcacactactcatgtatttcaccaacttcctctcgtcctcagaaggctacttccacacagtgatctgcaactcagagtactaccagaacaccactgtgaacagtgatctgcgcttcatggcatgggataacccacctcggacgcaccctgctaacctcacaacagagcattttgatgcaatggcagacagcggggcgccgtttgcacactcatttgccaatgataactcagtcctggatatgatcgacgccaagttgttggggcgagcacctgaccgcttcacgccgggtggatggtgcctgggtagctcagtaggcgggaaagatccgtgtaccttcttgggaaggtcctttattctcaggccgaccaaaggctcggccaagctagagaagttgctgttgaaacttttggaacctgataacttcaggcctaaacagtgtaaataacactcattttacatggtagccagttcttttcttttttgtggtagtgttcagaggccgaagtttgatgacatgtttcttgttgttgcggcagtaggcattacatacagatgttttatacttgcaaccggaaagctcaactcacaagtgatttgagatcatacacgatacataaactcttgctgtttcatcacttctacggctgtacaacaaccgatgataatgagaggttcgctggaagtcagtctgatatgagaggttgccctaggtttcggccccaccctgttccatccgggaattaaccggttcggttcgtgtgggantttatcatacattttgttttggcaacattggtaaagtaaaattcctgagcgctgcagcagtttttgaacacgaaagtgaagacgctttggtcgttaaagatcgcaaatcccactcacctcaagtcacttcccaacttggacatggcggtccactcccaccttcccgaaactgctcgtacgatctcaagcacggctcctccctagttgtcggctctcggccgcatcaccatccccgtcgccccgagcagtctcgttctccaggtacttctctgattctctctttcttcgtcatggcttacccttccggatcggtgctttctccccgccgcagtaagaatccccccacccacgggttccggttaccactcggcggtagacctgacggtgttgaggtgtttccgcttgctggaacaacttcgctggcgcctgcaagctgttcgaccgaatgcttctgcgaatgaagttagtctcacctcatcatatcgaggcttgcgtgctaccgttcagtttcatgcaatcatgcccgtattcatctacaattattctaccgatttaaagcttctacctgttggtccctgtagtgagaaccacgttcactgatactttggttgctttctgctgttcaaatcagtatgcttaaactggataacgcaagatgtccatatagtgtaaaacacatacttattgcaaatgtgttcaagcaccattcgttctacttccacccgaggtttccttcaagcatttcatctctcccacattgatttgttactccttgaattattgctcttctgtatgtgttgtggtgctgaggtgggatttagggctactcactgtaagtagagggactctaactctcatcagaggatgacactatgagttggggcaattttctgtttatttcctcaaacactacacaatgccatacccgtctaagggtcgggatacatatttatagcccaaggggctgcagcatatgcttcctagagttgcgaatatgctgtcctacaaattgcactaaccactaggtgctgttgtactctagtcaaaaaggaaaaaaactgcaggcatgcaagc

SEQ ID NO: 2669 - DNA, 1080 bp, Zea mays
  misc_feature (126)..(126): n is a, c, g, or t
ggctccgtctcgcggaggggccccaccgaattggcctccacgctccacgccgccgcggtgctgctccgggagttcgacggctggagctggttcatcaatcttagcgcctccgatttcccgctccgnatgcccgggccagatgacatccttcatatcttctcatacatgccaagagacctcaatttcattgagcacacaagcaatattggttcggaaagagtatcaaagagcccgaccaatcattgtagacccagcattgcaggtcccaaataaaactgaggttgtaacaacaaaggagaaaaggagtatgccctcagctttcaaaatatttgtaggttcgtcttgggtgatgcttagtagatcattcctggagttttgcttactgggatgggataaccttcctcgcacactactcatgtatttcaccaacttcctctcgtcctcagaaggctacttccacacagtgatctgcaactcagagtactaccagaacaccactgtgaacagtgatctgcgcttcatggcatgggataacccacctcggacgcaccctgctaacctcacaacagagcattttgatgcaatggcagacagcggggcgccgtttgcacactcatttgccaatgataactcagtcctggatatgatcgacgccaagttgttggggcgagcacctgaccgcttcacgccgggtggatggtgcctgggtagctcagtaggcgggaaagatccgtgtaccttcttgggaaggtcctttattctcaggccgaccaaaggctcggccaagctagagaagttgctgttgaaacttttggaacctgataacttcaggcctaaacagtgtaaataacactcattttacatggtagccagttcttttcttttttttggtagcgttcaaaggccgaagtttgatgacatgtttcttgttgttgtggcagtaggccttacatacagatgttttatacttgcaaccggaaagctcaaatccctttcccccctaaaaaaaaaaaaaaaaaaaaaaaaaaaaaaaaaaaaaaaaaaaaaaaaaaaaaatcgagggggaaaacccggtaccca

SEQ ID NO: 2670 - DNA, 1398 bp, Zea mays
gtaaaagctccactggagagtgaaattaactaccaggactacttgaagttgaggaccagagttgattttctccagactacacaaagaaacatccttggcgaagatctgggcccactcagcatgaaggagctcgagcagctggagaaccagatagaggtatccctgaagcatatcaggtcaagaaagaatcagatgcggctcgatcagctctttgatctcaaaagcaaggaacaagagttgcaggatctcaacaaagacctaaggaaaaagctgcaagaaacaagtccgcagaatgtgatccacgacgtctcctgggaggaaggcgggcacagtgggagtagtgttcttggtccgttccagggactccttcagtaccatggcaatgatccttccctgcagacacggtaccatcagcaggcctacatggaccagctgaacgaggacatggcggaccctgacgagcacggtcggtctggatggatatgagatgctccggtccgatgccccccaaataatgtcgatgcatgcatatagtttcctgcggtatgcggaagcggaactatatatgtgctgaaactgcaccaatgattagctgcctgattgtaatggttagcttaagaactccagtgcattgtattgtgctgtgttgtgagaaccttgcaactttctatatgtacatgtatggtatttgtgtgtcagttgtgccatgcgaatggtttctgttagatagtgtttggttgatgagccaagtagaatagagccgtttcatacctgattctaagaacagagccactctgttatgtgtttggcaatctggaacggagcgactctgttttttgtttggttgcagagtaaacgaaatggagcgtgactgtaagagcgggatgggaacggagcggttccgtccggttgattttttggagcggaatgattccggatttgaggagaatattctctaattggagtcattccgttatagttactttgtaaccaaaaaatagcaaaactaggacagaacgactcttttttactttgctcttcaaccaacttggagctgcgcaaaaccgtcttcatttctgggcttcagttcagttctcctttctatatgctctctgctccaggcaggcttagatccctgggccgtctccctctctgcccagcagcctgcatcaccgtgcgcatagctcgtgggccgcatcatcatcttcacacggcagacgggcacactactaactgccgacgccagtcgtcgcccctcgctctcgcgaatcgttttgggtgctggggtcgtctaatgtcatggaggccaccgctcggcatgtccatggcccaagaaggagtgagcgagcccgccagcccaatactaattcaccggcccacaatggacttcatcagggg

SEQ ID NO: 2671 - DNA, 1213 bp, Zea mays
aataaggttgaaaagtctccaaaagcgccgagtaaaaagatctcgccccaacaaagggtacgaatacgatcacgcaatataagcatctctcactgctgcttaaagcaacccaggactctgctgcttagagctagagaggacacggaggtagagagacgaagctagagggacgcaaaacaagctagctaggaggaagatgggtcgcggcaaggtggagctgaagcggatcgagaacaagatcagccgccaggtgacgttcgccaagcgccgcaacgggctgctcaagaaggcgtacgagctgtcgctgttgtgcgacgcggaggtcgcgctcatcatcttctccggccgcggccgcctctttgagttctccagctcctcatgcatgtacaaaacactcgagagataccgcagctccaactactcacaagaagtaaaaactccactggacactgaaattaaataccaggattatctcaagttgaggacaagggttgaattcctccaaactacacaaagaaatattcttggggaggatctgggtccacttagcatgaaggagctcgagcagctggaggaccaaatagagatatctctgaagcatatcagctcaagaaagaatcaaatgctacttgatcagctctttgacctcaaaagcaaggaacaagaattgctggatctcaataaagacctaaggaagcagctgcaagaaacaaggccagagaacgcgctccgtgtctcctgggaggaaggtgggcacagtggcgcaagtgggaatgttcttgatccttatcaggggctccttcagcacctggacaacgatccttccctgcagttcgggtaccatcatcaagcctacatggatcagctgaacaacgaggacctggtggacccgaatgagcatggtcgatctggatggatatgaaatgctctgatgacccaaaataaagttgatgcacagcagggattcaccctgcaggacgcgagactatgtattgaagctaagacctcgtgtgtgttgtgttgtgtgcgaagcttggaactttataaatcgttgtcatgcccatggctttctatttctttctcggagctgcgcaaaaaaaaaaaaaaaactgcggcctctcaggacagctggacgcgggaagccggaaccaaaaactctgttccgcactcatctcctctgctccaggcttcaacatccgcgcaggagcgaaaa

SEQ ID NO: 2672 - DNA, 1346 bp, Zea mays
ctataaacagacagacttgcgttgcgagagaggagacggagagtcagagaccgagagagggacgatagaaggcataggagctaggagcgatgaccgtacgcgcatatactaggagcagcaaattaaaggcatatataggcaaatagtagtagtagcgagtagcgacgggcgagagagaaagcagtgctactgctacgactactccttagctcgtagccgggtagaaggtgacgagagagagagagagaaagggggagagagatcttgatctagttctagtagactgctagcagtgaacaggcccggtggaggagctgaggtagctgggaaggagaaggaaggaatcgaagaaaaaggcagcaaaacaagcaggatggggcgcggcaaggtggagctgaagcggatcgagaacaagatcagccggcaggtgacgttcgccaagcgccggaacgggctgctcaagaaggcgtacgagctgtcggtgctctgcgacgccgaggtcgccctcatcatcttctccagccgcggccgcctcttcgagttctccacctcctcatgcatctacaagacgctggagcgataccgcagctgcagctttgcatccgaagcatcagctccactagaggctgaattaaataattatcaggagtacttgaagttaaagacaagagttgagttcttacaaacaactcagagaaatctacttggtgaggacttgggtccacttagcgtgaaggagttagagcaacttgagaaccaaattgagatatctctcaagcaaatccgatcatcaaagaaccagcagatgctcgaccagctctttgatctcaagcgcaaggaacaacaactgcaagatgctaacaaagatttaagaatgaagatagaagaaactagtgaagaaaatgtgctgcgactgtctagccaggatattgggtgtagtggatctagtgggcatggtgatgaagccaaccaagaacaccttcaacttgctcttgatccttcgctgcatatagggtatcaagcttacatggaccacctgaacaatgattaagttgcttctttgtgcgctgtgtgctctagtggccatggatcttctatatatgttggacgtaatgcttttgataaatcctctatatataaccatatcggtcctagctttatgcatgctactgtatgtactaaactaagaagccctacgacttctgttgaggaagaatgttctgacgatcatgactttcttgctaaataataactactgtatctcattttgaattgatcgtctactgaagagccatgcttttgtgagtacttaaaaaaaaaaaaaaaaaaaaaaaaaaaccacccaa

SEQ ID NO: 2673 - DNA, 1286 bp, Zea mays
gccggccgggccggagaagatcgataattacttgagtgtgtgagaccgcgcgtccgggcgcgcgcgaggaagaagttaggttagaaggactctccaaaagcgccgcttgagtaaaaaagatctcgccccaaggggtacgacgactacgatcacacaatataagcatctctctgctgctcaaagcaacccaggccggactcccgagggagcttttttagagcaagagaggacggagaggtagagagagaagggggacggaacaagcagctagctagcagggaagatgggtcgcggcaaggtggagctgaagcggatcgagaacaagatcagccggcaggtgacgttcgccaagcgcaggaacgggctgctcaagaaggcgtacgagctgtcgctgctgtgcgacgccgaggtcgcgctcatcatattctccggccgcggccgcctcttcgagttctccagctcctcatgcatgtacaaaacactcgagagataccgcagctccaactacagcacacaggaagtaaaagctccactggagagtgaaattaactaccaggactacttgaagttgaggaccagagttgattttctccagactacacaaagaaacatccttggcgaagatctgggcccactcagcatgaaggagctcgagcagctggagaaccagatagaggtatccctgaagcatatcaggtcaagaaagaatcagatgctactcgatcagctctttgatctcaaaagcaaggaacaagagttgcaggatctcaacaaagacctaaggaaaaagctgcaagaaacaagtccgcagaatgtgatccacgacgtctcctgggaggaaggcgggcacagtgggagtagtgttcttggtccgttccagggactccttcagtaccatggcaatgatccttccctgcagacacggtaccatcagcaggcctacatggaccagctgaacgaggacatggcggaccctgacgagcacggtcggtctggatggatatgagatgctccggtccgatgccccccaaataatgtcgatgcatgcatatagtttcctgcggtatgcggaactatatatgtgttgaaactgcaccaacgattagctgcctgattgtaatggttaccttaagaactccagtgtattgtattgttgtgtgctgtgctgtgttgtcagaagcttgcaactttgtatatgtacatgtatggtattctgttagtttcttggagctgcgcaaaaaaaaaaaaaaaaataggcaccagtcctaaaaaaaaaaaaaaaaaaa

SEQ ID NO: 2674 - DNA, 2146 bp, Zea mays
ctcaccgccgggccccgatctacgagtatccccacgagaaacccccattccaccatcctctacccacccaatggatccgtccgccgtcggctcctcgcggcggaaggcggagcagtggttgagcgtggctgagaagctcatggtggcgcgggacattgaagggtgcaagcagttcgcctcgcaggccctggccgccgatccccacaccccgggcgccgacgacctccacgccgccgccatctccctcctggcagcccagcagcgccgcctccctaacggtcagcctgatccctacggcgtccttggtctggaccccgcaaaccccgcatcacgccgaccggatgccatccactcacaatatcgccgcctctctttcctcctcaatcgttcccaccaggaccgcccctgctcgctcgccttcgccgaagccgcccggctcgtcgctgatgcctgggcttttctctctgatcccgttcttaaatcctcccttgacgtggacctcgatgccgccgccgcagctcgcgcgtaccactctcctccaaatctaccgcagccgcactcgcagccacatctgcctgcacggctaactccgccggtggctgctccctccccgcggtcgactccgccgctggtttctccccttccgcgggcaacatcaccgccggctgcttcccctccacggcaaactcagcggccggctgtcccccaaacaaggtcaacaccgccgccggctgcttctgctccacgatctactccaccaccaccggtttctcctcaaacactgtcaacaccgctgcctgccgctcccgctcccgctccacggtctacaccaccacctgttgttccccaaacaccgtcaagtacgctgcggccgactactccccaaacgccggtggctgcaactgtcccagcagcgaagtctggtgcggcaccttcatcaacgttctggacagtgtgctcggcctgctgccacattcaccagttcgactgccaatatgagacgtgcaagttactgtgccctagttgccgccagccatttgtggccaaggcaatggctgagccaccgcctattgtgccaggcaccgacatgtattactgcacttgggggttcttccccgttgggttccctgggtgtcctggctttgaaagaatggtcaatgcacagccatcgggagtagatcagctgaatgcgccatggcttggaagcgcaggtggtgtacatggtaatgctcagaatggggtgccaccagttagtgccccagtggtagaagtgccagtcaaggatcccatagaggtgcctgcagtgacaccgccagcgaagccgatgcgagtgaaggtgggtgcgaagaagcgtggtcgccccaagggtagcaagaacaagaagaaattatgaatgccaatgatgaacatgatggttatcatcatagatcacatgaattaactgagatatgcattcaatcacactgccattgtagtcaaccgaagcactcgtctgctggttgaattctcacttgctgttgccaggatctctaatgtggagcaagcaattttattgctgaaagacttctttttcaatggtagaattcttccttttcgagattatgatgttaatctctggttcgtccccactgccgtatttgacattatgctttagctgtaactattgtatttgcatattcgtctaatttctgcttccctgaagacagttgtattgatctaaatcgataggtgtctagttactgtttattgtacgttttgagtttggtgctactctgctctagtgctctgtgtcgtaatgctgcaataaatggaatggtttaaagctctaattttaacgcgaattttgcttatgacactttccgtaccagaattttgcaccttggctgtccttattgcaatgtcgtgtgatcaaaatctatttcctttttaagttttttagcagctattagtttcactcatcgagatacttgttctgctcctgtttattagtttacttgttcaagaaaatcgtatcgaactgggaactgttataaaagtctaaatgtgcacgctcttatcatgattatatcttctccgtcgaaccttttctttctttcttttttgcgttgttgataggctcttctgaatcaagtatgtctgcaggtaa

SEQ ID NO: 2675 - DNA, 547 bp, Zea mays
ggtaccctccgggtccgggtcggcccggggagccgtcgtcttgtcgggtcttcaagccacaccaaaccacactgcgacacacagtaggcgaggcgaaggagaggcaaggcggcgcggcgggcaagatgtttgacgatcaagacctgggcttctttgccaatttcctgggcatcttcatctttgtcttggttattgcgtaccacttcgtgatggcagacccgaagtacgaaggaaactgatgtcctctagtgcaaagatcctattatctgcaggccgaaatagggctatactgttagctaatgctagtgagatcgcttgacactttgagtgcatatcatggaagctggacatgcagttcctggcattttggttttgcccatgttttaatctgctgaattagtaaatcctggagaattcaaaagcgttttcaagtactgcagttggtggttgtttctggtcctagtgtatgcatgccagaatcttatgaataatattctttgttttgttgcctaaaaaaaaaaaaaaaaaaggggcccctaggccccta

SEQ ID NO: 2676 - DNA, 2556 bp, Zea mays
  misc_feature (1696)..(1696): n is a, c, g, or t
ttatcggggtgcgacgattagggcacccaattggagaagcggggtggcacgtggtgggtgggttggagcgcacagactaatcggatcgccactagggataacacgtttttggtccatcaccctaggtgactatatatatgcgtgcgctataagataatggtattagttgatttgtcataaaagagtatatatatgtgtgtgcgttgtggtttgtacttcaactgttatcgagttattagaagtaaaaccgtggaccagggtgaagcactgaagctacattatttatatgggtgcaaatgcactcctaaaaattcaaaatctataaatttagtttaaatttcactatatatgcatctttatagtaaatccttatacgtttacaaggcaagtacaatcccatcaaatttgcaataacttggtcattgtcgcggacatgtaactaaccctttgtattgacagtggcgaatctacgggccccacgtacgaagcgtatacagagtatatatatatagaaaattgtaaaaatatattttaaaaatatttaacataaaaaggatgttgcctaataattttgtagattgtgcttcctttgtgtttaggcttatagccttaggatctatctaataaaaatcttgagatggtctattagacagacaatacgattataaaatcagcaatctaacgctcgattgctcggattctttattgaatgtgactcacgagatgacgctggagactagactgctaggtgtaggctcgtgaaaacaacaaaacgcacaaacaactttatggtgggtcttaagctttcagcactcgagagccagaaaaggatcgatgttgatcaacaactcgatatatattatgtgactatttgtataatcatatgtgagagctgaggatttaagctgtccaagtataatttttaatcacttggtattatgttttttaaatgggtgaagataacataactacaatattgattgtgtctcttagaaagtcttagctaaaaatcatataaattatcagtataacttttcatatatttatattatagtttattccaaatttaagagttattatttaagtttttaatttaacctttaagtttaaaatttaccggtaatttgatttaaaaatagtttctaagttgttagagggtttgatcgaatatatatgaaaattttagatgatatactctacagtgaaattctagattagccactgtgtatgcgtcaccaaaatgagccaaaagaggacgaacacttcggaggacgtacggagaagaaaatatggcattcgagaatacctcgaacttgtgctgcggagtggggaagcttggagggaaactaatgcgcaacttcctatcaccaccatgtggtataaacaaacaaagtgcgtgccaatataccatatgaaaaatgcatgcatgcatggccaatatacgaagtatatccatattccatgcatgcacgtgtgccaaatgattgaaccctaaataatccctaatatatgttcactcaagtacggatgcaatgcacatgtccatatcgattattcgcgtctaagtccgccctcgtgctaatttgacccatcacttctcaagcttttcggccacccattcctcgatccatcatacatatcatataaaaacaccacttgcgcctaccttggccagcatccatccatgtactacatntatatacagacgctcactaacgtggttagctcatcgatcgaacttgctaaaccagcggaaacctaaccagctagcagcattagcttttcaacaagcctcgctcgcgcgccgtgaccgatagatggccatcacccacgacgactacgtctccctgtgcctcatggcgctcgcagccgcgggaggaggaggagggcacgctgcggctgccagtgccaggacgacgacgatgacgacgcaagagtgcgagctccgcttccggtgctccgtctgcggcaaggccttcgcgtcgcaccaggcgctgggcgggcacaaggccagccaccggaagccgccgccgacgctcgtacaggcggcgtcgtcgtcgtcgtcggtgacgacgaatacctcgtcggcgggcggcagcggcgccgggcaggggaggcacaggtgctcggtgtgccaccggggcttcgccacggggcaggcgctcggcgggcacaagaggtgccattactgggacgggctctcggtgtcgctcaccgcgtcggcggcgtcggggtccgcgtccagcttgaggggcttcgatctgaatttggtgccggccgccggcgcggcaaggtggcgagaggaggaagaggtgcagagccccttgccggtcaagaagcggcggctgtcctccggtccttccaccgaacttagtttaacgatttagagttccttttggtgagctgaggcatgtagagtgttttcgtagcttcattcttttaaccgtattttggtttttgtgtttgcgcggtgaataaacgtgtatttaattttgtcgagccatatatacttgagataaaagccataggccatataggcatctaccaattgaggtt

SEQ ID NO: 2677 - DNA, 1192 bp, Zea mays
aacaaaagctccagagccccagtaaggaggtccatgcctcctgggacggcccacgtagtaagcagcccgcaaaacccccctcgaggccggccgggccgggctaagccacagcaagcaagcaaaaccagcatctcctccatcccaccccgcgccgccgccgccgccgcatcccctcccgtcccgaaccctaacccaactccatcatggcggccgcccactacgatcgcgaggacggcctgcctccatcggcgccgccgcacgcggcgacggacgcgtacgaccccaactacgtgccggactccgtcaagaccttcgtggtgcacctgtaccgccacatccgggacaagaacgtgtacgagatccaccagatgtacgagggcggcttccagcgcctctccgaccgcctcttccgcgacgtgccctggccctccgcggaggccgtgtctccctactgcgacggcgaccacgtattcctcctcctctaccgcgagctctggtaccgccacgcccacgcccgcctctccccgctcaccgccgcgcaccgcgccgagtcgtggaccaactactgcgacctctttagcgtcgtactccacggcgtcgtcaacatgcagctgcctaaccagtggctctgggacatggtcgacgagttcgtctaccagtttcagagcttctgccagtaccgagccaagctcaagaccaagacggaagacgagctcaaccagctcaagcagttcgacaaggcgtggaacgtgtacggggtcctcaactacctgcaagcgttggttgagaagtccatgatcacgcagatcctcgagaaggagaaggagggcctggagcagttcactgccaccgatggctacgactacgagggtggcagcaacgtgctcaaggtgctgggctactacagcatgattggcctcctaaggatacactgtctcctcggggattaccacaccggcctcaagtgcctcgcgcccatcgacctcaaccagcaaggggtctacaccattgtcattgggagccacatctcagccatctaccactacggcttcgcaaaccttatgatgcgcaggtatgttgaggccactcgtgaattcaacaagattcttctgtatatcctcaagtacaagcggtaccaccagaattccctcagtatgatcagatactgaaagaaaatgagcagatgtatgca

SEQ ID NO: 2678 - DNA, 1097 bp, Zea mays
  misc_feature (1066)..(1070): n is a, c, g, or t
  misc_feature (1072)..(1086): n is a, c, g, or t
  misc_feature (1088)..(1088): n is a, c, g, or t
  misc_feature (1091)..(1091): n is a, c, g, or t
  misc_feature (1093)..(1094): n is a, c, g, or t
tcttttcattgccctcactaaattttctattggagtagaatttttttctcaaccagcaaggggtctacaccattgtcattgggagccacatctcagccatctaccactacggcttcgcaaaccttatgatgcgcaggtatgttgaggccactcgtgaattcaacaagattcttctgtatatcctcaagtacaagcagtaccaccagaattcccctcagtatgatcagatactgaagaaaaatgagcagatgtatgcattgttggcaatttgcctatctttgtgcccacagaacaagctcattgatgaaaatgttagcacccagctgaaagaaaagtataatgacaagatgacaaagatgcagaggtatgatgatgaagcatacgctgcttatgatgagctattctcgtatgcttgccccaagttcattacaccgtcgcctccaattctggaccagccgctaacaaactataaccaggatgcataccgtcttcagttgaagttgtttctctatgaagtaaagcagcaacagttgctttctgggattcggagttatctgaagctatattcaacaataaccattagcaaacttgcccaatatatggaagtggatgaagcaacactaaggtcgatcctgatgacatacaagcacaaaatgcatgcagttgacagtgaaggaaagatagtatcaagtgcagactttgacttctacatcgtcgaggatgtgattcatgttgtggagtccaaacctaccaagcgtcatggtgattactttttgagacaaattttgaagtttgaggaaatgattggtgaactggagaaggtacagcttgactgaaatctgatagcgatcatggagagaaatgtcactgtttcctttttgctctcttttgtactccgttgaaaccccatcttttttttttttgtttccttattgactctgaagcccgttgaaaccggccattattaaccgtgtaccgtgtaatgttacttactagtaaattgctcgctccttgcgcgtgtcgtcggtcgatgcatttacacacatttaagggaggggttggcccnnnnnannnnnnnnnnnnnnnanaanannccc

SEQ ID NO: 2679 - DNA, 1906 bp, Zea mays
gcacgagagcaagcaagcaaaacccgcatctcctccatcccaccccgcgccgccgccgccgccgcatcccgtcccgaaccctaaccccactccatcatggcggccgcccactacgatcgcgaggacggcctgcctccatcggcgccgccgcacgcggcggcggacgcgtacgaccccaactacgtgccggactccgtcaagaccttcgtggtgcacctgtaccgccacatccgggacaagaacgtgtacgagatccaccagatgtacgagggcggcggccaccgcctcgccggccgcctcttccgcgacgtgccctggccctccgcggaggccgtgtctccctactgcgacggcgaccacgtattcctcctcctctaccgcgagctctggtaccgccacgcccacgcccgcctctccccgctcaccgccgcgcaccgcgccgagtcgtggaccaactactgcgacctctttagcgtcgtcctccacggcgtcgtcaacatgcagctgcctaaccagtggctctgggacatggtcgacgagttcgtctaccagtttcagagcttctgccagtaccgagccaagctcaagaccaagacggaagacgagctcaaccagctcaagcagttcgacaaggcgtggaacgtgtacggggtcctcaactacctgcaagcgttggttgagaagtccatgatcacgcagatcctcgagaaggagaaggagggcctggagcagttcactgccaccgatggctacgactacgagggtggcagcaacgtgctcaaggtgctgggctactacagcatgattggcctcctaaggatacactgtctcctcggggattaccacaccggcctcaagtgcctcgcgcccatcgacctcaaccagcaaggggtctacaccattgtcattgggagccacatctcagccatctaccactacggcttcgcaaaccttatgatgcgcaggtatgttgaggccactcgtgaattcaacaagattcttctgtatatcctcaagtacaagcagtaccaccagaattcccctcagtatgatcagatactgaagaaaaatgagcagatgtatgcattgttggcaatttgcctatctttgtgcccacagaacaagctcattgatgaaaatgttagcacccagctgaaagaaaagtataatgacaagatgacaaagatgcagaggtatgatgatgaagcatacgctgcttatgatgagctattctcgtatgcttgccccaagttcattacaccgtcgcctccaattctggaccagccgctaacaaactataaccaggatgcataccgtcttcagttgaagttgtttctctatgaagtaaagcagcaacagttgctttctgggattcggagttatctgaagctatattcaacaataaccattagcaaacttgcccaatatatggaagtggatgaagcaacactaaggtcgatcctgatgacatacaagcacaaaatgcatgcagttgacagtgaaggaaagatagtatcaagtgcagactttgacttctacatcgtcgaggatgtgattcatgttgtggagtccaaacctaccaagcgtcatggtgattactttttgagacaaattttgaagtttgaggaaatgattggtgaactggagaaggtacagcttgactgaaatctgatagcgatcatggagagaaatgtcactgtttcctttttgctctcttttgtactccgttgaaaccccatcttttttttggtttccttcttgactctgaagcccgttgaaaccgaccattattaaccgtgtaccgtgtaatgttacttactagtaaattgctcgctccttgcgcgagtcgtcggctgatgcatttacacatttaagaaagtgttagtataaaaaaaaaaaaaaaaaa

SEQ ID NO: 2680 - DNA, 1915 bp, Zea mays
tgattacgcaggaaggaaaacaatagggcttcatcccaccgcccgcccccccgccactggaccttgaacccccctgcctccccagttccccagccatggcggcggccccctacgaccgggaggacggtctgcagccgtcggcgccgccgcacgcggtggacgcttacgatcccaactacgtgccggactccgtcaagaccttcgtggtgcacctgtaccgccacatccgggacaagaacgtctacgagatccaccagatgtacgagggcggcttccagcgcctctccgaccgcctcttccgcgacgcgccctggccctccgcggaggccgtcgcaccctactgcgacggcgatcccgtcttcctcctcctctaccgcgagctctggttccgccacgcccacgcccgcctctctccgctcactgccgcgcaccgcgccgagtcctggaccaactactgcgacctcttcagagtcgtcctccacggcgtcgtcaacatgcagctgcccaaccagtggctctgggacatggtcgacgagtttgtctaccagttccagagctgctgccaataccgcgccaagctcaagaccaagaccgaggacgagctcaaccagctcaagcaattcgacaaggcgtggaacgtgtacggggtcctcaactacctgcaggcgctggtcgagaagtccatgatcacacagatcctcgagagggagaaggagggcctggagcagttcaccgccaccgatggctacgactacgagggcgggagcaacgtgctcaaggtgctcggctactacagcatgattggcctcctcaggatacactgcctccttggggattaccacactggcctcaagtgcctcggtcccatcgacctcaaccagcaaggggtctacagcattgtcatcgggagccacatttccaccatctatcactatggcttcgcaaaccttatgatgcgcaggtatgttgaggccactcgtgaattcaacaagattcttctgtatatcctcaagtacaagcagtatcatcagaagtcccctcagtatgatcagatactgaagaaaaatgagcagatgtatgcactgttggtgatttgcctatctttgtgcccacagaacaagctcattgatgaaaatgttagcacccagctgaaagaaaagtataacgacaagatgacaaagatgcagaggtatgatgatgaagcatacgctgcttatgatgagctattttcgtatgcttgccccaagttcattacaccatcacctccagtgctggaccagccgctaacaaactataaccaggatgcataccgtctacagttgaagctgtttctttatgaagtaaagcagcagcagttgctttctgggatccggagttatctgaagctatattcaacaataaccattagcaaacttgcccaatatatggaagtggatgaagcaacgctaaggtcaatcttgatgacatacaagcacaaaatgcatgcggttgacagtgacggaaagatggtatcgagtgcagactttgacttttacattgttgaggatgttattcatgtcgtggagtccaaacctactaagcgtcatggcgattactttttgagacaaattttgaagttcgaggaaatgatcggtggactggataaagtacagcttgactgaacctggtagcaaatatggagagaaatgccactgctttctttttgctaatataggaatagatgtttatgatggatgtcattagcaagttatgtttgtgccttctgtagcccatgcaaaaacccgtcattttttctctcttttcactggattcgactttgaagcccgttgaggcaattagcagagtcgtgatgttaattttggtcgcccagttgcctgaatagtgatctcatatcctatctgggagtggcatgcag

SEQ ID NO: 2681 - DNA, 1005 bp, Zea mays
ggagctgctgtccttcttcaagcactatgaaagagcagtggacgaacatcgctatgctgagctgcaagccgacttccaagctcttcagagctatccaagaatacccccagccaagatgttaaagcaaactgctcatacatataccccggtggtatttgagatctttcgtaaagagtttgagctattcatggactctgtgttattcagttgtggggaggctgggacgacatctgagtacaaggttgcttcatctgagaaacccaaggagcactttgttcggttcgattcaagtgattgctcctgtctgtgcacctgtaggaagtttgagtttatgggtatcccgtgctgtcacatgttgaaggtgctagattacagaaatatcaaagagcttcctcaaaaatatcttttgaaacggtggagaaggaccgccaaatctgcaaatgaagacaatgaaggcaacgcaacaaacgccaacaacgggtcattattgattgtccctgctcctcctacaaatcaccatgggcttcagagcttcagtgcaatgattcaagatgcttcagtttctagcatgcattagaatgcatctcatagaagctcttaatgcaggaacttgcagggtcaatgccaacgacgcgtttataccttgcaagactccacagcgttggccactgaagaagcattggatgggccggccaccgtcaagattcaagcacgcatgtgctcaccatgtaagagtcggcgccgttggccactgaagcaacggttaggcggccgccgtcaaccgcgcccctggataagttgggtgggcggacagttgggtgggcggacctgtgttgtacattgttcagccgtaggggatttcagtcaccgaggcaccggtccttagcctaagctgtagagtagattttttttaattttagttttaaaggcataatgcttgtatttgcgctgccataatcccagaattttgtgcgcgcctaataaatgctagcccgtttatttaga

SEQ ID NO: 2682 - DNA, 2689 bp, Zea mays
tgcagtggatatgtggcgagagccggtgcccagagttctgtcttgcaactgaggtacaaggacaaggctcactcaagttgcattttaccctggtgtctatttgcactgtacttagtatatggttatgtgcttgaactccatgtatagcatgtctaatgtttcatatgcagacttgaaaactgatggttcctattaatgcctgtagtttaaaatggtcttattgaatcttccgtttcctgttctcagatttatgtattcatggtatgcctgaaaacagtgtatcattaggcttaaaattatcaccaagggtcagataatgttatctggcaagcccttttttttcttgcggtattgaatcaatacactgtcattgtacaattggggcaatatggatgcaagtccccatttcttacatgaaaacctctgatgtttttgtctctctatcttctaacctaagtaaggcctgctttcttttcaggtgttcctttgctttggcaattcagttgcatcaacccgcttcttgctgcaagatgaatttaacatacagaccactcagtgtgacaactgcatcattgtaacaccacttgcctcttaaatttcctgtctgatgcgattcaacgtcctgtggagggttcctgttctttcttccgatgtcacttggactgaatataaccttttatgcagggcttcatgttatgccttcaacaagttgcttgcatcttctctatagttgcagctattgttggtagcgaggagctttcagaggcttcccagatccttaattgtctgtctgatttggtctactggacgtaaggccgcccttaactgtctttttgcaaatctccatagcaaatgtctcagttctgataatcctatgccacattcttttgcagggtttgtgcatgtatgcaggtatataactcattcttttcttctcgcaaccttactgatcagggctcttgtgaaccaaaccctcacatatccttcttgtggcattgaaataaatgcaaatgcagacgcagcacaaagtcgaaatggacaagagggatggaaagttcagcccacagcctatggcagtgcccccggtgcaacaaatgtcacgcatcgatcagcctatgccgcctcctgctggatatgcaccgcaaccagcatatgggcagccttatggtggctatccatctcctcctggccaaggttatccgcctcctcctggccaaggttatccgccagctggatactcccagggcggtgcataccctccacccgctcaaggttacccacatggtggtggatatcctccacctggtcaaggttacccccagggtcagggtggtgcatatcctccgcctggttcttaccctccacaaggttcctaccccccagcagagggctcctacccagcacaaggttcctaccacccagcacagggctcctacccagcacaaggttcctattccccagcacagggctcctacccagcacaaggttcatatcccccacccccagcacaaggttcatatcccccagcacagggctcgtacccagcacaaggttcctaccccccacaggcttaccctggcaagtaaagatgacacgacaggtgaaccaaatatcgtgaacatgtaaacagtaggaccgctttagcgctataggttattttgataaaattcttgttactgttcagggtggcattcggtgaacaatatttctattttatacggtcaacatcttgtgttgatcatgtcgtgttgagtctatcctcttttttcttttcctgaataaggaatggcattcaactggaaagtatttgaatttggtgacaactcacgtggatattgttttggttcaaaaaaaaaaaaaaaaaagagttgtcactttgctgtgtatgatagtcgcaacttttgatgacgtttgataatggagtgaaggaatggaatgcttatgacttgtgagcacgagcagtccctttcacacacgttactattatcataggacgagatgaatagacagacagcaaccctcagtctgtacgtgattgtcatccttttttcttcgtgtcctctttttttttcttttcctgatgaaccaattatctgtttgattccaggatagcgatgtctcaacggagctgtccttgtagctagctccagcatcaatcgatgggaatatctgacaaagtcgcgtagcagctattatctctttgagacattaatcagagacgatgtatgtatctgaatttcatgcagctgtaggcatgaatacgcgccggaaaaacgttgggattattatgagccttaatttgtcccgtggcgtttgttaggcctaatcgcccaataaatctccaccgggctgtccagtttcagtttggtacacctaatcgatacaaggcccacagcgatagagatttccgatctgatccacgcagcagccgtcgtctgaatggtattgcgccaaccaagcgtattatatcttgtactatatgattggcatagctaccatattttatgaacggagactgattctcgttgacaaacagagtagaaacagcttatatggtacaaagatgaatgcaattaacctctctgttcttcgatctcttcctgccagcagatgagatggtcagatcaggtcactgtatatatgtgcacagggggtggggtggacaaactatggctatacaataataaca

SEQ ID NO: 2683 - DNA, 1538 bp, Zea mays
gcacgagaccattacctagaacatcctaatcgaaaaaaaccaaatcctccccaaaggcaaatacgaaggtacagtgccccagccccgcgccccctagaccaaagcagaccagaatccgccctaccaatcgcctccccagatcggcggtccacccggaggcggcgatggcgtcgtcgcaggcgaacctcgacaagatgcagctccgccagagctaccgcaacgtctggcacaccgacatgacgaacgccatccaggccgacttcccctactgctgcctcgcgctgtggtgtggaccttgcgtgtcgtacatgcttcgcaaaagggctctctacaatgacatgtcaagatatgtctgttgcgctggctacatgccatgcagtggaaagtgtggcgagagccggtgcccagagttctgtcttgcaactgaggtgttcctttgctttggcaattcagttgcatcaacccgcttcttgctgcaagatgaatttaacatacagaccactcagtgcgacaactgcatcattggcttcatgttatgccttcaacaagttgcttgcatcttctctatagttgcagctattgttggtagcgaggagctttcagaggcttcccagatccttaattgtctgtctgatttggtctactggacggtttgtgcatgtatgcagacgcagcacaaagtcgaaatggacaagagggatggaaagttcagcccacagcctatggcagtgcccccggtgcaacaaatgtcacgcatcgatcagcctatgccgcctcctgctggatatgcaccgcaaccagcatatgggcagccttatggtggctatccatctcctcctggccaaggttatccgcctcctcctggccaaggttatccgccagctggatactcgcagggcggtgcataccctccacccgctcaaggttacccacatggtggtggatatcctccacctggtcaaggttacccccagggtcagggtggtgcatatcctccgcctggttcttaccctccacaaggttcctaccccccagcagagggctcctacccagcacaaggttcctaccacccagcacagggctcctacccagcacaaggttcctattccccagcacagggctcctacccagcacaaggttcatatcccccacccccagcacaaggttcatatcccccagcacagggctcgtacccagcacaaggttcctaccccccacaggcttaccctggcaagtaaagatgacacgacaggtgaaccaaatatcgtgaacatgtaaacagtaggaccgctttagcgctataggttattttgataaaattcttgttactgttcagggtggcattcggtgaacaatatttctattttatacggtcaacatcttgtgttgatcatgtcgtgttgagtcaatcctcttttttcttttcctgaataaggaatggcattcaactggaatgtatttgaatttggtgacaactcacgtggatattgtttggttcagagtgtcaaaaaaaaaaaaggaaataaaaaaaaaaaaaa

SEQ ID NO: 2684 - DNA, 1648 bp, Zea mays
aaacattcctaattgccaattggagccagagcgcagagcgcgaaaggcgagcggcgactccctggcgttgaccagagccccaccccactcgccgtctcgccctaaaccaaatcctccccaaaggcaaatacgaaggtacagtgccccagccccgcgccccctagaccaaagcagaccagaatccgccctaccaatcgcctccccagatcggcggcgatggcgtcgtcgcaggcgaacctcgacaagatgcagctccgccagagctaccgcaacgtctggcacaccgacatgacgaacgccatccaggccgacttcccctactgctgcctcgcgctgtggtgtggaccttgcgtgtcgtacatgcttcgcaaaagggctctctacaatgacatgtcaagatatgtctgttgcgctggctacatgccatgcagtggaaagtgtggcgagagccggtgcccagagttctgtcttgcaactgaggtgttcctttgctttggcaattcagttgcatcaacccgcttcttgctgcaagatgaatttaacatacagaccactcagtgcgacaactgcatcattggcttcatgttatgccttcaacaagttgcttgcatcttctctatagttgcagctattgttggtagcgaggagctttcagaggcttcccagatccttaattgtctgtctgatttggtctactggacggtttgtgcatgtatgcagacgcagcacaaagtcgaaatggacaagagggatggaaagttcagcccacagcctatggcagtgcccccggtgcaacaaatgacacgcatcgatcagcctatgccgcctcctgctggatatgcaccgcaaccagcatatgggcagccttatggtggctatccatctcctcctggccaaggttatccacctcctcctggccaaggttatccgccagctggatactcccagggcggtgcataccctccacccgctcaaggttacccacagggtggtggatatcctccacctggtcaaggttacccccagggtcagggtggtgcatatcctccgcctggttcttaccctccacaaggttcctaccccccagcagagggctcctacccagcacaaggttcctaccacccagcacagggctcctacccagcacaaggttcctattccccagcacagggcccctacccagcacaaggttcatatcccccacccccagcacaaggttcatatcccccagcacagggctcgtacccagcacaaggttcctaccccccacaggcttaccctggcaagtaaagatcacacgacaggtgaaccaaatatcgtgaacatgtaaacagtaggaccgctttagcgctataggttattttgataaaattctttactgttcagggtggcattcggtgaacaatatttctattttatatggtcaacctgtcaacatcttgtgttgatcatgtcgtgttgagtctatcctcttttttttttcctgaataaggaatgacattgaactggaatgtatttgaatttggtgacaactcacgtggatattgttttggttctgagttgtcactttgctgtgtatgatagttgcaacttttgatgacgtttgataatggagtgaaggaatggaatgcttatgacttgtgaaaaa

SEQ ID NO: 2685 - DNA, 1513 bp, Zea mays
  misc_feature (1460)..(1461): n is a, c, g, or t
  misc_feature (1463)..(1463): n is a, c, g, or t
  misc_feature (1471)..(1471): n is a, c, g, or t
tgggaccctcgaggccggccgggggtctctccccttcgtcatcttcagatcggagctagcaccggcgacctcgtaacgaactcagcgcgccaaggaaatctcgcgtggtcgttacgtgccgagctcgcctcctcgcgcctatataacctggccatctgttcctcctccttgtctcatgaggtcgcgatcgaagccaccatctaccgggagcagagggtgtcgccgccgatgaacttgcgatgggccaacgcagggaccccggcgtgctgctcggggggttttccggttccgagggtcgagaagggtgtcttcatgaagccgatgcagtggagcgccctgtggtggcttgattcctcaccggacttggtgtccgccgcggaaccgcgctccgccccagtaaggttgtaggtttgcattcaacgattctgtgggttgaagcagctaagcaacttcttctgctggatccaccacacagtcgtcgaaagaaaggagcagaaacgagaaaacgctgaccatcgtttcttgcagaggaagcagttcgccttgccttcaatctgactacatatcctatagatctatatataaatacgaatggtctagcaagcaggctgccacgcccaaaccgcagaagaaacatgtcttcttcacctgttaagatcatcggccattcggtaagcccattctcgcaccgcgtcgaggccgctctgcggctcaagggcgtgccgtatgagctgatccaggaagacctgagcaacaagagcgagctgctgctcgccaaaaaccctgtccacaagaaggtgcccgtgctcctccatgccgatcgtgccatctgtgagtccctcgtcatcgtcgagtacgtcgacgagaccttcgacgggccgtccctcctcccggccgacccccacgaccgtgccacggcccgtttctgggcagacttcatggacaggaagctcctgaagccgttctggctggcgcactggacagagggcgacgcgcagaaggctcaggtggaagaggccaagcagaagctggcgctcatggaggcgcagctcgacgggaggaggttcttcgggggcgacaccgtcggctacgtcgacatcgcagcctgcgtgctagctccttggctcagcgtcgtagaggaggtgactggagtggccgtggttgacgaaggtgagttccctgctctgcgccgttggtccagagagtacagctcctgcgaagctctcaagcagtgcgtcccggacagggaccagctcgtcgccttctatactgaaaggaaggaggcgtacaaagtgttcgctaatgcatggttgcagcagtagtttggttttgtgtgtggaataataatgtatggatcacagattgtctgtgctgaaataacagtaatgagcctagctagataagtaaataaccatatgcatgtctcagaaaagtttagatgagttgaccatcgaaaaatnntntttaaggngggggcgcccccaaaaaaaaaaaaaaaaaaaaagaaaataat

SEQ ID NO: 2686 - DNA, 897 bp, Zea mays
gtgcctctcttctcgacggagctcgagtcgggtccgagaggtggccgggtttcggacttggaggtgatctgacctgtgaagggctgagggcggaggatggtgggggaacgaggaggagggatgggtcggcggcaggagcggcaggccatgatggtgacgttcgcgttggcgctgctcatgggcatcgccgtctacttccgcatctgggcccgccagtccagcgacccctccttcaccgccgacgaccgcgaggagctccggaggcaatttgaacaagcaaacctagaagcgatggatgaatctgccgaatggaggatgaaatatgacaaagaaatagagaaaaacaggcagttgcatgatgaactttcaaaggttaaggcctcattagctggtgcagccaagcgtcttgagttgttgcagaagaataacgagttgcataagcggcagactgaatcactgaggcagcaatgcaattgcactctccattgaaagctatgcaagattaagggcatggaaggagtttttcagcttctttggcggattagctaattttttttttccaacaccaagggaggaaaaccagattgagttctaggaatgagaactggaatatgaaaatgattgagaacatatatagtgtatagaccatagtgttcgtcctttatacggatggtgagctgcacagttcatccaaagtgatcggtgggaacttcatcggtgacaatgcaaagcgcagaaatcaaaacgtaaaagatggcgccatatggttataagctcctaatttctgagtgattttgcagtggcagtttgcatgagtacctgactatctgtagatatacattgtacactgggtgcaaaaagatggtgacaagtttgaaatcaaaaaaaaaaaaaaaa

SEQ ID NO: 2687 - DNA, 1211 bp, Zea mays
cacggcccacgatggggcaattgcttcgtgtccattgcgtctcttctcgacggagctcgagtcgggtctgagaggtggacggagtttcggattcggaggtgatctgacctgtgaggggctgaggaggaggaggaggagggatggggcggcggcagaagcggcaggctttgatggcggcattcgcgttggcgctgctcatgggcaccgccgtctacttccgcatctgggcccgccagtccagcgacccctacttcaccgctgacgaccgcgaggagctccggaggcaatttgaacaagcaaacctagaagccatggatgaatctgccgaatggaggatgcaatatgacaaagaagtagagaaaaacaggcacttgcatgatgagctttcaaaggttaaggcctcattagctggcacagcccggcgtcttgagttgttgcagaaggataacgagttgcagaagaggcagactgaatcgctgaggcagcaatgcaattgcactctccattgaaagctatgcaagattaagggcatggaaggagtttttcagcttctttggcggattagctatttttttccaacaccaagggaggaaaaccagattgagttctaggaatgagaactggcatatgaaaatgattgagaacatatatagtgtatagaccatagtgttcgtcctttataccaatggtgagctgcacagttcatccaaagtgatcggtgggaacttcattggtgacaatgcaaagcgcagaagtcaaaacgtaaaagatggcgccatatggttataagctcctaatttctgagtgattttgcagtggcagtttgcatgagtacctgactatctgtagatatacattgtacccggggtgcaaaaagatggtgacaagtttgaaatctgggaccgtgccaatacttattggcaggaaacttaataatccatattgtattatcgatacttgcaattccttccaatggtagcctgggcacttcctattgtgtacaaatatttcatttaccagcatattaacttattaagaaggtaagaaaacttaataattcctgtgctaactcatgttcagcaatcagcaactcgatcgttatccgcacgccatcgatcacagggtcatcaggctacaatacacggcatatcctccccgagtatctgtagactgcatcagtacactggcatcaggtactgacgtgctgtagt

SEQ ID NO: 2688 - DNA, 3112 bp, Zea mays
gacaaattacatagtaattagttttaattggtttacttatcatttagttctcatctatctaattagttttagaattagactgtacttaatatttctaattagagcatgtttggatccttgtggcaaaatgtttgccgtctaattttagcatcttaacctccaaaccgtctggctaacaaattggctaattgttagccggagggctagcaaactgtttattcattagccatttgatcttgctaataagtgctaatagatcgtataaacagaaaatgacatatattaatccagtctccaaatatatcatgactaatttttactagctaattatttatcggctaattattaactactgataaacaataagccaggaggatcaaactggacattagtatctaaacatctgtgataggtactaaatttctcgaggatccaaacaccggcacaagcgtaaaatacttcgctagacaggagacacacaggagatctgcaagtcaaccgaacagacattcgctggaagctctgctcggagtgaggtcgctgcgcatctaccacacgatgccgccgcctctccgctgtctccttctcgccttcgtcgtcgtcctctccggcttcccccgtctcgcccaccccttcacggctctcgagtctgaccagatcgcccgcttccaggaatacctccgcatccgaactgcgcacccatcccccgactacgccggcgccagcgccttcctcctacactacgccgcttcgctcggtctccacaccaccacgctccacttcaccccgtgcaagaccaagcccctgctcctcctcacctggcgaggctccgatccctccctcccctccgtgctcctcaactcccacatggactccgtccccgcggagcccgagcactgggcgcaccctccattcgccgcgcaccgcgacccgaccacgggccgcatctacgcgcgcggcgcacaggacgacaagtgcctccccgtccagtacctcgaggcgatccggggcctgcaggccgcggggttcgctcccgcccgcaccatccacatctcgcttgtccccgacgaggagatcggcggcgcggatgggttcgacaagttcgcccgatcggaggagttccgcgccctcaacatcgggtttatgctcgacgaggggcaggcgtcgccgacggacgtgttcagagtcttttacgcggacaggctggtgtggaggctcgtcgtgaaggcggcgggggcgccagggcatgggtcgaggatgttcgacggcgccgccgttgacaatttgatggattgcgtggagaccatcgctgggttcagggatgcgcagttcaggatggtgaagtccggggagaagggtcctggggaagtggtctcagtcaaccctgtgtacatgaaggccggcataccaagccccacggtaagtaagcaatggtgctacctaatttagctttgatacagtaaatcaggtcctggtttgaaacggtgttagcggatacaattgcccgctaccgttgctaaacaattttgcaatttgaatgtttatactctccaccaaatagaaatagtgacatacagaactttatagcttttcatcaaatatttcaaaaatctagcgaccaccagcagattgtgcatattgtgcatatggtcagtacgaaacattgttttacgctacactgtctacaatgataatctgtggcttgtgtagtctctaaagacagattgttgcagggtttcgtgatgaacatgcaaccttcagaagcggaggtcggctttgacctccgccttcctccaaccgaagacatcgagcagatcaagcggagggtcgaagaggaatgggcaccatctcacaaaaacctgacctacgaggtgatttttttttattttcgctgtcgtttcgatcaccggaacaaaaacaaaccgagtcctgctgaaatgcgtcccttgttgctgggcattgctgcagctggtgcagaaaggtccggcgacggatgtgtccggacgtcccgtatccacagcgacgaacgcgtcgaacccgtggtggctgacgttcgagagggccatcgcctccgcgggtggggagctgtctaagcctgagatcctgtcttcgacctcgggcccgccccttgcgcgccccctgggcatccctgccctcgggttttctccgatgaccaggacgcccatactgctacatgaccataacgaggtaaattaattggaacttctgagcttgagaccaggccgcgctatctactggcccgctctccttccttgccttgtccagcagaaccaatgtttttttccccttttatctcggtgttgcagtttctggaagacagagtgttcctgaggggcatccaagtgtacgaacatgtcatcagagcactaagctcgttccaaggctgattcgtaaaaaaaaaagaaaagaagaaggaaaagtggcagtgctgttgcgtggagtgtaacatagcaggttttgtaataattggttcagtcacaaacacgccaaaggaaacattccgaaactattgggatctgtgaaactgtgttgttgtgggaagaagactagcagctgggtcgtgtgatgagctgattgatgttcgggcttgttgcttgatatatctccaataatgcgtatatcccagacgttcaacacttgaaagtgcaagcgcggcttaggccttaaaaagaggagtttcatgacacacttaccaaaatcgtcaagttagtttttttatttatattactatctatctctctctctttacaattaacatgctaactctgtgaatttgtccattgaacacaaatcgcgtctctaataaatatctcgtattgtccatgccatgcaaatttgtcgacattgatgtcaggatgaatggctgtgttcggtctgcgtgactgatcgaaccacgtcgaccttgcacgagcacacgggttcgtgtgcgtccctgtgagtaggaagaaccggagccgcggtttttgaagcggacagcgcatcgtcgtcaggttccacaccgcccggcccagctcgcttgccctggctaaactgacgatcgagagctcctgtctgtctgcccagcgtgacactagtccggttcaaaagtgag

SEQ ID NO: 2689 - DNA, 1734 bp, Zea mays
cattgggtacctcgaggcccccccgggcgaaaaatacttcgctagacagcagacacacaggagatctgcaagtcaaccgaacagacattcgctggaagctctgctcggagtgaggtcgctgcgcatctaccacacgatgccgccgcctctccgctgtctccttctcgccttcgtcgtcgtcctctccggcttcccccgtctcgcccaccccttcacggctctcgagtctgaccagatcgcccgcttccaggaatacctccgcatccgaactgcgcacccatcccccgactacgccggcgccagcgccttcctcctacactacgccgcttcgctcggtctccacaccaccacgctccacttcaccccgtgcaagaccaagcccctgctcctcctcacctggcgaggctccgatccctccctcccctccgtgctcctcaactcccacatggactccgtccccgcggagcccgagcactgggcgcaccctccattcgccgcgcaccgcgacccgaccacgggccgcatctacgcgcgcggcgcacaggacgacaagtgcctccccgtccagtacctcgaggcgatccggggcctgcaggccgcggggttcgctcccgcccgcaccatccacatctcgcttgtccccgacgaggagatcggtggcgcggatgggttcgacaagttcgcccgatcggaggagttccgcgccctcaacatcgggtttatgctcgacgaggggcaggcgtcgccgacggacgtgttcagagttttctacgcggacaggctggtgtggaggctcgtcgtgaaggcggcgggggcgccagggcatgggtcgaggatgttcgacggcgccgccgttgacaatttgatggattgcgtggagaccatcgctgggttcagggatgcgcagttcaggatggtgaagtccggggagaagggtcctggggaagtggtctcagtcaaccctgtgtacatgaaggccggcataccaagccccacgggtttcgtgatgaacatgcaaccttcagaagcggaggtcggctttgacctccgccttcctccaaccgaagacatcgagcagatcaagcggagggtcgaagaggaatgggcaccatctcacaaaaacctgacctacgagctggtgcagaaaggtccggcgacggatgtgtccggacgtcccgtatccacagcgacgaacgcgtcgaacccgtggtggctgacgttcgagagggccatcgcctccgcgggtggggagctgtctaagcctgagatcctgtcttcgaccacggactcacgctttgcgcggcagctgggcatccctgccctcgggttttctccgatgaccaggacgcccatactgctacatgaccataacgagtttctggaagacagagtgttcctgaggggcatccaagtgtacgaacatgtcatcagagcactaagctcgttccaaggctgattcgtaaaaacaaaaagaagaaggaaaagtgttgttgcgtggagtgtaacatagctggatccccaactctcatctgctgaatgaaggtgagagagttgcggcctagccagtacaggtttgtaataattggtccagtcacaaacacgccaaaggaaacattccgaaactattgggatctgtgaaacaaaaaaaaaaaagcgctggctctcgcccgccggccttcgggggcggaggtggatggatggctgtcgtttgttgtgggaggaacactagcagct

SEQ ID NO: 2690 - DNA, 745 bp, Zea mays
attcctcttctcccccagcagccgccgcatagggatcctggcctccaccatccgccaagcacctcccatccattgtcttcaacctctagctcgtgagcccctctcttctctgatccatggtgcagccctctgctccttttccttgtgggtgctggcttcctcctccagcgaccagcactagggagcaccaccccttcccttccccaggaacgacgagctcctctctactcccagcaacttccatggccgtcggcccctacgagctccctgctccacgcgccctcagccatggcgcacgacccctgctcctccatggccgccaatcatcagccgttcggcactccggaccatccatggcatgcgacccctccacgccggtgtcgagctccaccatccgctcctctaccacccatctcccacacggtatgctagacatggaacacatggacatgaacgacgtggtgttggagacaaacccgaagatgatggaccgatcaaggggacgttcatcaagcagatgtcatctaaccaaaaacactaacctagtgtttgattccaagcaagccccgacatctaattaccatggtttgcaataattgttttattcgcctaccatcctatgattgttgcattaggttgcaggagttgtttggaaacaattgctgcatttatctttgattacctttggttatcgctatccttgtcacctgggtaaattacttaaatgcttaggcctgcttagacg

SEQ ID NO: 2691 - DNA, 2361 bp, Zea mays
agatcctagaggctagaccctctctcgcgcacacgctctctcctctcttcacagcggtttttgcctcgcaaacgataagacaccaacccgggcccggagggtcaagtggagagcaggggaggaggggagaggaaagggaaaagcgggtcgcgagtcgcgactcgcgagtgcccgcttttgctccaatccaatcggtgccgcctcgggcgagatccgctccgcgtgccccgccgctgccgaggtgagctccgaacgcccgccctccgccgttgccgagatagagggtgtcgtccccactccccagcatctggttccacggagagttgttgatcttggatacctgatccgcaatttggggctgattgagtcacttgaccttttcaacatctgccccgttcctgctgccttgctcactataagaggctggcctggttccagagatgattctattgtgagtggagatggattctgtgagaagttggttccagaagttccagccgagagacaaatcgaagaggccagtggtggctgccagacatggaaaagatccaggaaagcccccgatggatgatgccccttctagtgcgacgaaacagagggtcgccgctgcaaaacagtacattgagaaccactacaagacccagatgaagtccctgcaagataggaaagagaggcgctggatgttggagagaaaattacaagatgccgaagttcctgtagaagagcaaaataacattcttaagcatttggagaaaaaagagactgaatatatgcgcttgcagagacacaagatgggagttgaagattttgaacttttgactattattgggagaggtgcattcggagaggtgcgtctttgtagagagaaggtctctaagaatgtttatgcaatgaaaaagctcaagaaatctgaaatgcttcgtaggggccaggtagaacatgtcaaagctgaaaggaaccttcttgctgaagttgatagtgcttacatagttaagctctattattctttccaagacgaagagttcttatatctcatcatggaataccttcctggtggagacatgatgactttacttatgcgcaaagacacactaacagaagatgaagctagattttatattgcagaaactgtgcttgccatcgagtctattcacaagcacaactatgttcatcgggatatcaaaccagataatcttttgttagatcacagtggtcacctgaagctttctgacttcggtttgtgtaaacctttggacagcagtaatttccctaatttgaatgaaccagattatatgtctggaaaagttaccacacctttgcctgataccactcggttaagcaacccttctgcaccgaggcgtacacagcaggagcaattgtcacactggcaaaagaaccgtcggatgttggcatactcaacagtcggtacacctgattatattgctccagaagtgctactgaagaaaggatatggaacggagtgtgactggtggtcccttggtgctattatgtatgaaatgctagttggttaccctccattttattcagaggacccaatgtctacttgcagaaagattgtgaactggagaagtcacttgaaattccctgaagaggcaaagcttcctcctgaagctaaggctctcatcagcaagcttttgtgtaatgttgagcatcgacttggtacaaaaggagcccatgaaataaaagcgcatccatggttcggaggtgttcagtgggagaagttgtatcagatgaaagctgctttcataccagaagttaatggagagttggatactcagaattttgagaatttcgaggagattggaactcaaattcaaagttcatccaagtcaggcccttggagaaagatgcttccatccaaagatgcaaactttgttgggtatacgtacaagaactttgaaattgtgaatgatgatgaagtggcaggaattgcagagttgaagaaaaagagttccaaaccaaagcgaccaaccatcaagacaatgtttgagaggatggacgaagaggagcctgttcaagggagtttcttaagtatgttgcccccggagggccaaccttcgtcccactccagcgttccacaggaaaaataccaacctcgccgtaaataggatatggaggtttggaaagtaaagcataggaaagtaaaacaagaaaaaaaaatcgtctgctgccttttgatctgttccctgtctaggttttgtaaatcctaaccaatgcgttctttagtcaaatgcttaaaaaaatctctccggcaaaatagtgtattgcatttgatgtgaacatcagtgttcggctgtatattgtgtcaccgttctaacttcgaaaaaaaaaaagcggcca

SEQ ID NO: 2692 - DNA, 2453 bp, Zea mays
  misc_feature (1)..(1): n is a, c, g, or t
ngaagagtcggacagggtctctctctctctctctctctctcgtactcctctcacactccccccacggtttgccttgcccacgaaaagacaaccaacccggggccagggggcaagcggagagcagggaaggaagggagaggaaaaggaaaagcgggtcgcgagtgccccccaccccccgcttttgctccaatcggcgccgcctcgcgcgagatccgctccgcgtgccccgccgccgcgctgctgccgagatagagggtgtcgtccccggcatcgggttccacggagagttgttgatttgggtacctgatccaattgggggtggattgagtcgcttgaccttttcaacatctgtcccgttcctgctgctttggtcaccataagaggcttgcctggttccagagatgatgtcattgtgagtggagatggattctgcgagaagttggttccagaagttccagccgagggacaaatcgaagagtccagctgtgtctgccagccatggaaaggatccaggaaagcccccaactgatgatgccccttctagtgcgacgaaacagagggtcgccgccgcaaaacagtacattgagaatcactacaagacccagatgaagtccctgcaagataggaaagagaggcgctggatgttggagagaaaattacaagatgccgaagttcctgtagaagagcaaaataatattcttaagcatttggagaaaaaagagactgaatatatgcgcttgcagagacacaagatgggagttgaagattttgaacttctgactattgtgtgggagaggtgcatttggagaggtgcgtctttgtagagagaagacatctaagcggccgccccccgtcgaaaaactcaagaaatctgaaatgcttcgttgggcccaggtagaacatgtcaaagctgaaaggaaccttcttgctgaagttgatagtgcttacatagttaagctctattattctttccaagacgaagagttcttatatctcatcatggaataccttcctggcggggacatgatgactttacttatgcgcaaggacatactaacagaagatgaagctagattttatattgcagaaactgtgcttgccattgagtctattcacaagcacaactatattcatcgggatatcaaaccagataatcttctattagatcgcagtggtcacctgaagctttctgacttcggtttgtgtaaacctttggacagcagtaattttccaaatttgaatgaaccagattatacatctggaaaagttaccaagcctttgcctgataccacttggttaagcaacccttctgcaccgaggcgtacacagcaggagcaattgtcacactggcaaaagaaccgcagaatgttggcatactcaacagtcggcacacctgattatattgctccagaagttctactgaagaagggatatggaatggagtgtgactggtggtcccttggtgctatcatgtatgaaatgcttgttggttaccctccattttattcagaggatccaatgtctacttgcagaaagattgtgaactggagaagtcacttgaaattccctgaagaggcaaagctttctcctgaagctaaggatctcatcagcaagcttttgtgtaatgttgagcagagacttggcacaaaaggagcccatgaaataaaagcacatccatggtttagaggtgttcagtgggagaagttgtatcagatgaaagctgctttcataccagaagttaatggcgaattggatactcagaattttgagaaatttgaggagactggaactcaaattcaaagttcatccaagtcaggcccatggagaaagatgcttccatccaaagatgcaaactttgttgggtatacgtacaagaactttgaaattgtaaatgatgatgaagtggcaggaattgcggagttgaagaaaaagagttccaaatcaaagcgaccaaccatcaagacattgtttgagagtatggacgaagaggaacctgttcaaggaagtttcttaggtatgttgcccccaaaggaagggcaaccttcgtcccactccagcgttccacaagaaagacaccaacctcgacgtaaataggatatggaggttcaaaacgtaaagcataggaaagtaaaacaagtgggaaaaaaaaaatcttctgctgccttttgatatgctccctgtctaagttttgtaaatcctaaccattgcgttctttagccaaatgtttaaaacaaaaaagatcaccggccaaatagtgtatggcattggcatctgatgtgagcatcagtgttcgctgtatattgtgttaccgttctaacttccaagtgatgtttctcagccatattggcaaaaactactgtatactacataccactggtatgataccaggagcagacaagctgtggcaagcccaggaacatactatgtgtttgaccacaaaaaaaaaaaaaaaa

SEQ ID NO: 2693 - DNA, 944 bp, Zea mays
ctctttcgatcctagaggctagaccctctctcgcgcacacgctctctcctctcttcacacggtttttgcctcgcaaacgaaaagacaccaacccgggcccggagggtcaagtggagagcaggggaggaggggagaggaaagggaaaagcgggtcgcgagtcgcgactcgcgagtgcccgcttttgctccaatccaatcggtgccgcctcgggcgagatccgctccgcgtgccccgccgctgccgagatagagggtgtcgtccccactccccagcatctggttccacggagagttgttgatcttggatacctgatccgcaatttggggctgattgagtcacttgaccttttcaacatctgccccgttcctgctgccttgctcactataagaggctggcctggttccagagatgattctattgtgagtggagatggattctgtgagaagttggttccagaagttccagccgagagacaaatcgaagaggccagtggtggctgccagacatggaaaagatccaggaaagcccccgatggatgatgccccttctagtgcgacgaaacagagggtcgccgctgcaaaacagtacattgagaaccactacaagacccagatgaagtccctgcaagataggaaagagaggcgctggatgttggagagaaaattacaagatgccgaagttcctgtagaagagcaaaataacattcttaagcatttggagaaaaaagagactgaatatatgcgcttgcagagacacaagatgggagttgaagattttgaacttttgactattattgggagaggtgcattcggagaggtgcgtctttgtagagagaaggcctctaagaatgtttatgcaatgaaaaagctcaagaaatctgaaatgcttcgtaggggccaggtagaacatgtcaaagctgaaaggaaccttcttgctgaagttg

SEQ ID NO: 2694 - DNA, 871 bp, Zea mays
ctttactatcatggacacacggtgcgtcacctcctcaccgtttcctccgcttgctgcagcttcccgtctgctctctccatctgcgcaggttcagctactgatctacttcatgctcaagttcgccatggaaatcctactctcggagtcgagtgttgtgaccacgttctatttcaagtggacaactagtaccgtggcaatctttctggcagttcttggcctgacggttctcccagttaatgtcatcgttgggagctacgtcaccaacctgttccaggacaggcaaatcctggtggcctccgagatcatggtgttgatcggcatcgtcatgagcttctgcttcacccctcactactccgtcccccagtatgtcacgtcagctctcatcacgttcgtgttcgccgaggtgctcgaaggggtgaacttgtccctcctctcccgcgtgatgtcgtcgaggctctcccgcgggacctacaacggcgggctgctctcgacggaggccggcacgctggcccgcgttgccgctgacatgaccatcacggccgctggctatctggggcagggccgcctcctgaacgccaccctcctgccgtccttggtgatctgtctagcatctatcgtcgcgacgttctgcacttacaactcactctactgattaccggtcgatgaactcctctccctcttatacaagttgccgaattgcgtcttgcagtgacgctgaaaattttcgggctgctgctgctaatgtaaactgctgcggcctgcgggtggacgagcggtccatgtgtatcgacgcctgtagtgttgcgaacttgctacggctgtaacatgacacgtgcgcgttaaataaaatgccctactgaagtaccctgtc

SEQ ID NO: 2695 - DNA, 4284 bp, Zea mays
  misc_feature (2339)..(2339): n is a, c, g, or t
  misc_feature (2930)..(2930): n is a, c, g, or t
  misc_feature (3683)..(3683): n is a, c, g, or t
  misc_feature (3689)..(3689): n is a, c, g, or t
  misc_feature (3695)..(3695): n is a, c, g, or t
  misc_feature (3760)..(3760): n is a, c, g, or t
gatgaaattgagttttgtagggagtttataaatttaaggattttctttacataactgttggggaatagttttcttaaaaaatttcttaaattcatatttagaaaattgtttatataactattggaggtgctcttaggacggagggagtaacaaagataacaatactcttgctctgcttataagctccagctagccccgccgcgtcatgaacaaataagatcagttagcttgtctttatttcttcctccgatcactgattatacacacgcacttgatgaggttagatcgctagttaagcaagaaattagaggaggagagaggggtagccatggaagagcagcagccccgcccccgcccaagcatcatgttcgtcctgtcgtcgctcgccaagaataacccagagtccgtgctggcgctcatcgcggtgctcaccgtcgtcgccctgcgccacttgatctcctcatggcggcagcaggcccggctgcccccgtcaccgacgagcctcccggtgatcggccacctgcacctgctccgcccgccggtgcaccgcaccttccaggagctggcgtcccggatcggtccgctgatgcacatccgcctcggctccacgcactgcgtggttgccagcaccccggaggtggccagcgagctcatccgcggccacgagggcagcatctcggagcggccgctcacggcggtggcccgccagttcgcgtacgactcggccggcttcgccttcgcgccctataacacgcactggcgcttcatgaagcgcctctgcatgtcggagctgctcggcccgcgcactgtcgagcagctgcgccccgtccgccgcgccggcaccgtgtccctgctcgccgacctgctggcgtcgtcggcgcggggggagacggtggacctcacccgccatctcatccgcctctccaacacctccatcatccggatggtggccagcaccgtgcccggaagcgtcaccgacgaggcgcaggaggtggtcaaggacgtggccgagctcgtgggcgccttcaacgtcgacgactacatctccctagtccgtggctgggatctccagggcctccgcaggagagccgctggcgtccaccgccgcttcgacgcgctgctggaggacatcctcaggcacaaggaggaggcgagggcggcgcgaaggctcgaccaagacgacgacggacgtggcagcagcaagcaggacaagaagcaggccacgcacagcaaggacctgctcgacatcctcatggacaaggcagacgacccggcggcggagatcaagctcacccgggaaaacatcaaggctttcatcatcgtaagatctatctatcatgctttttattaacacttctcatgcttttttcaattatatctatattatatacatatgcatgcacatgcactgcaggacgtggtgactgctggttcagacacgtcggccgccatggtagagtggatgctggcggagctgatgaaccacccggagacgctgcgtaaggtggcggaggagatcgacgcggtggtcggcggcgacaggatcgccagcgaagcggacctgccacagctgccgtacctgatggcggcgtacaaggagacgttgcgtctgcacccggcagcgcccatcgcgcaccgacagtcgagcgaggagatggtggtgcgcggcttcacggtgccgccgcagacggcggtgttcatcaacgtgtgggccatcgggcgcgacccggcgtactgggaggagcccctagcgttccggccggagcggttcatgcccggcggcgccgccgagagcctggagccccgtgggcagcactttcagtacatgcccttcggcagcggccgccggggatgccccggcatgggcctggcgctacagtccgtgccggccgtgctggcggcgctcgtgcagtgcttccactgggccaccgtcgacggcgacggcggggtgaacaagatcgacatgtcggagtcggacgggctggtgtgcgctcgcaagaagccgcttctgctccgccccacgcctcgcctcacccccttcccggccgtcgtctagcgtgtcttccatggcaataccgtctatgtctgtaccaacctctaccagtaccaccacgtacgtacggattcgaagaatgtggataccatgcattaattatatgtatcacattattatatatatgatatgcaagagtaatatgcatggcattgtcttgcatgctctttgttaagaaaaaaaaaaaaaaaacggaccatccaagcgtgttagttactggactttatttcactaccaacactaccaacaccaacgctgacatgacatgacatgacatgacccatcnacctatatatctctcccactctcagcacggaaaacatacgaccacatctatcgttttggattggatacacagtcgtttgacaaatcacatccataccgaacagcgtttcgctttcgtttcatatgccttcgagaggaagctgatggtaggattggatttccacttcggtcaccaacaacacaacctaactaaaattagacaaaattaaaaagttcaatttccccgctttattatgtttcaagcgaacgaaagtgtcacaattcagtaaacaaaacgcatcgttatatgtgatcatgatgcaaacgattctaaagaaattaggtaatgtttggtccccaagctagtcaggtggaatggctccgtccctgtgagccgctccatccgggagactttagtgagctaaatggttcaatatttgagcataatttttcgtttttagaaccactccatcgtcctatatggaatcaatccaaacaacaacaaattaggagcgaagcggttccattcaactatactccagaatcaaacgttaccttaggctatctgttgttccagtaccatttcagcttcctggaggttctatttgtagtntacgtttgtgacatcaacaaggttttaaagacgtccgactaaccgcgattagtcggccttatcgtcgaagtaagcacgattaggagcttcgacttgattagggcgactaggaaccgattagtcgtcctagtaactgactaatcgcgattagttgcccgattatgtgttgtgaccaactagtttatgtctggtttgggcctgtaatctatcctctgttctataggtcgcggccgacccaccatctctacaataaaaagtagaaaccctgtgttgcccctattgtaccatagcggccgcacagtagccgccaccccttctccagcgtgcgactgcgccccatctgctccggcgaccctctactctatcgtgaccctctgcttcatcgtgtggctgttgtagaggcctctgctcgagcctccgccctctagtgtaaagtgcccgcctctgctccatgcctccaccggagtccaccgtccagcgtgtggccgtcctgaacttcagagttcaaactttagagttcatagttcagacttcttcaaagttcagacttcctaaccactctagagaatagcaaacttcttcagagttcatagtctgttgtgaacttcagaccgagatgaggaccccttcagacggtgatgcatttgtttttttttcttattcacttcttcagcagtattgtgcgtgcctgctacaactatagtgtactactgtactgtggtcctgctacaactatatatatacatatggtcntgttanaggtgnacgactataggacgactaggagtcaactaggatcgactaatcgtgattagtcaccttatcggtgntcaggcgactagagtcgactagccgactttaaaaccttggtcagcaaccttcctgccacaacatcgaccagggaacgcgggaagctagagatcaaatgcttgattacaagtgacaggttcaccgtctccacggcccagacgcagtcaacgtgcgagaaagcccaacacgcagtatgtctataacacctcatatccatcaattaaaataattcattactagttattaaatttagtagagaatacattaaaatttaaatcaagtgcttgatttcgttcaaccattttgggaacatgattttttgtttgctgatgattaattgatgattttatttatagaatacttttattggaaacccaaattttaattataatatacctcggtctaaagataaatatttagtattttaattataaatattattattagttttattataattttgaaataattaaaaataaatttatctatatttttataaataacctattcaaaaaatatttgaaaccctagccgcgctggtcat

SEQ ID NO: 2696 - DNA, 1993 bp, Zea mays
acaccatcatcacactcgaaacccaacagcttccttcctggcgatccaattaacggcttctcttctgagctcagcacgaacaatggccaccatcctcaccgtcgcaagcttcttcgcacttgtgtgcatctctcaacaagcgcgggctgcgaactacacgttcatgaaggacgcggtgcacgcgccgcggacgggcttctacgactacatcatagtcggcggcggcacggcgggctgcccgctggcggccaccctgtcggcccgcgcgcgggtgctgctgctggagcgcgggggctctccgtacgaggacgcgcgcgtcctgaacatggcccacttctcggacgtgctggcggacacgtcggcgtcgtccccgtcgcagcggttcgtgtcggaggacggcgtgatcaactcccgcccgcgcgtgctgggcggcggcagctgcatcaacgccggcttcttcacgcgcgccggcgcgggctacgtcagggccgccggctgggaccccagggaggtgcgggcggcgtaccggtgggtggaggacgtggtcgcgttccgcccggcgctgggcccgtggcaggccgtgcggatgggcctgctggagaccggcgtgctgccggacaacggggccacgtacgaccacatcccggggacaaaggtcggcggctccatcttcgacgccgacggccgccggcacacggcggcggacttgctccggtacgccaacccggacggcatcgacctgtacctccgggcgagagtggccaagatcttgttccgtttcaaaggaaccaagccggtggcggacggcgttgtgtactacgactcgcgaggcaacactcacgaggcgtacctcagccccggcgccgccagcgaggtcatccctgtcggcgggggcgctgggcagcccgcagcagctgatgctcagcggcatcggcccggccgaccacctccgctcgctcggcatcgacgtgatcctggacctgccgggcgtggggcagggcatgtcagataaccccatgaacgccatctacgtgccgtcgccgtcgccggtggaggtgtcgctgatccaggtggtcgggatcacccggttcggcagctacatcgagggcgccagcggggccaactggaacagccacccctcgggcacgcagcctcctcctcctcctcctcggaacttcggcatgttctctccgcagacggggcagctcgcgacggtgccgcccaaggagcggacgccggaggccatcgcgcgcgccgtggaggccatgagccaggtccccgacgcggcgctccggggcgggttcatcctggagaaggtgctgggcccgcagtccgtgggccagctggcgctccgcaacctgaaccccgacgacaacccttcggtgcggttcaactacttcgcgcacccggacgacctccgccgctgcgtcgcgggcatcgccgccatcgagcgggtgatccgctccagggccttctcgcggttcacctaccaaaacttcgcgttcccggccgcgctcaacgtcacggccgagttccccgtgaacacgctgtaccggcgcggcggcgaccccagggcgctggagcggttctgcagggacacagtgatgaccatctggcactaccacggcgggtgccaggtcggccgggtcgtggaccgcgactacagggtgctcggcgtcgacgccctccgcgtcatcgacggctccacgttcaacgcctcgccgggcaccaacccgcaggccacggtcatgatgctcggcaggtacatgggcgtcaagctcttgaaggagaggatgcttctggaaggatgaagcagaaaaaggcctagtctcactcacatctctacatctctacagggtgcgtttaaccttgaagattcttttagtggcgatcgtacaagttaattggagatgctaattgtaatggatgaattccacaccgattaatttgcacaaaatgtggatggtataattcaacaaaaaaaaaaaaaaaa

SEQ ID NO: 2697 - DNA, 3148 bp, Zea mays
tttaaattttaaaatgattcatacaataattagtatatatatttttgtatgtgtctaaattaatcattattaatttaattatagataaaaaatttaaaagctaaaacgaatactaatttagtaagatagactatgaaagtctaacatgcggttgacatggttttcttataaaggctagtttaggaatcctgttttctcacgggattttcattttctcaaagggaattaattcattttcccttgataaaatagaaatttcttgggaaatgtagctcccaaactagccctaaattatggaaaactgcgcttgggattgggaaccgcggtgcgcccgctcttgttatcttgtactccctcaggtttcctattagttatcgttttagataaggtttaagtcaaacttataaaattttgactacaaataactattttgttatttagttttggaacctaatatttatatgcattaatttatcataaaaagtacttttataaaaatataaatgtattaagagttcatttgtattttaacaaaaaaacattggtcaaagttatatattggagaccgtgtcgttgtcctaaacgacaactaataggaaaccggagggagtatgctgagttgctgacaacctaaaagcagaaagtataactgtataagtaatgccatcagctccgtacttgacgtagaattccaatggaaatggaactagaccctttcctgggcgtcgtgctcgccaccgccgtcctcctcgtcgccgtcctccgccggaagcgcggctccagccgcaagtacaagatgccacccgggcctaggccgtggccggtgatcggcaacctcaacctgatcggcgcgctcccgcaccgctccatccacgcgctctccgcgcggcacggcgcgttcatgtcgctccgcttcggctccgtccccgtcgtcgtcggctcctccgtggaagcggccaggttcttcctcaggaccagcgacacgtcgttcatcgaccgccccaggatggcggccgggaagtacaccgcctacgactactccgacatcgtctggtcgccctgcggggcgtactggcgccaggcgcgcaagctctggaaggcccatctgttcagcgacaggcagctcaggtcgcaggagcacgtccgcagcgaggagctgcgcgtccttctgcacgctctgtcgtcgtcctcctccgcgggggtggccgggcgcggccggcgcgccgtcgcgctcaaggagcacctgctcatgtacagcctcaacgtgatctcgcgcatggcgctgggcgggaagtacgtcggcgagggcggcaccgcgggctcgccgatctcgccggccgagttcagctggatggtcgacgagctcttcctcctcaacggcgtgttctgcgtcggggacttcatcccgtggctcggctggctggacctccagggctacgtcgggaggatgaagaggctgggcaagatgttcgatcgcttcctggagcacgtggtggacgagcacgaccagcggcggcggcgggagggcggcgggttcgtccccgcggacatggtggacctgctgctggagctcgccgacgaccccaaactcgaggtccccatcgaacgggatggcgtcaagggattcgcgctggtaaggcttgctaataattcactccttcggcgcttagctggacgatttgatcacaaacttaaatttaataacaacatgttagtggtttgtccccaaataccccatcaggagctgtcaatttatttggatatgataagctcttctccagtttatttaattaaccaatcgctgtcaatcatgttaatttaattagaaaataaagtgatggcacatatgttatagttatttgtcacgtggtacatgaacgcattaaatcgagatctgcagggtagttctagtttgaaatttgaacagttggcttatttaaaaattttctttccgatttcgatcgacaggaggagcccgctatctaattttgtaccttggttgaagttcagactggtgcacaacttaagttagggattgtttgctttgtaaagactaattcttagcctctctttttattctattttagtctttaaattgttaaattgaaaaagtagagttttagtttccgcatttattaatttaaagataaataaaataaaatggaaacattaaaaattagtcctagaaacaacctctaaatggtactccctccgatttttttatatttgacttttgttagtatataattgaactaaccagcgtcaatccttaatatataactgaactaatcagcgtcaattaaaaaaatgaggtagtacagtataatatacttcgccatacttttaaaagagaacctctgaagcgatgaataccgaatacggatgcaggacctgatcgctggcggcacggactccacggcggtgaccatcgagtgggccatgtcggagctcctgcggaagcccgaggtcctcgccaaggtcaccgaggagctggacggcgtcatcggccacggccgcctggtcaccgagcaggacatcccggacctgccgtacctggaggccgtcgtgaaggagaccctccgcctgcacccggtgacgccgctgctggcgccgcggctgtgccgcgaggacgcgtccacgggcagctacgacatcccgcggggcacgctcgtgttcgtcaacgtctgggccatcggccgcgaccccgccgtgtggggccacgacgcggaggagttccgcccggagaggttcgtcggcagcgccgtggacgtgaagggccacgacctggagctgctcccgttcgggtccggccgccggatgtgcccgggctacgtcctcgggctcaagatggtgcaggtcaccctggccaacctgctgcacgccttctcgtggaggctgcctgatagcgtggcgccggagaagctgaacatgcaggagaagttcgggctcgccgtgccgcgcttggtcccgctcgaggccgtcgccgtgcccaggctgccaccacacctgtatgccgggccatgatgcatgtctatgtttgtttttgtaggcgcatacaactgtctcgtaataaaagatacatatcttttctctgtacatatacacctaataaagagacaaacaatatcgtcgaaaaaaaaaaaaaaaa

SEQ ID NO: 2698 - DNA, 1768 bp, Zea mays
gacaacctaaaagcagaaagtataactgtataagtaatgccatcagctccgtacttgacgtagaattccaatggaaatggaactagaccctttcctgggcgtcgtgctcgccaccgccgtcctcctcgtcgccgtcctccgccggaagcgcggctccagccgcaagtacaagatgccatccgggcctaggccgtggccggtgatcggcaacctcaacctgatcggcgcgctcccgcaccgctccatccacgcgctctccgcgcggcacggcgcgttcatgtcgctccgcttcggctccgtccccgtcgtcgtcggctcctccgtggaagcggccaggttcttcctcaggaccagcgacacgtcgttcatcgaccgccccaggatggcggccgggaagtacaccgcctacgactactccgacatcgtctggtcgccctgcggggcgtactggcgccaggcgcgcaagctctggaaggcccatctgttcagcgacaggcagctcaggtcgcaggagcacgtccgcagcgaggagctgcgcgtcctgctgcgcgccctgtcgtcgtcgtcctccgcgggcgcggccgggcgcggccggcgggccgtcgcgctcaaggagcacctgctcatgtacagcctcaacgtgatctcgcgcatggcgctgggcgggaagtacgtcggcgagggcggcaccgcgggctcgccgatctcgccggccgagttcagctggatggtcgacgagctcttcctcctcaacggcgtgttctgcgtcggggacttcatcccgtggctcggctggctggacctccagggctacgtcgggaggatgaagaggctgggcaagatgttcgatcgcttcctggagcacgtggtggacgagcacgaccagcggcggcggcgggagggcggcgggttcgtccccgcggacatggtggacctgctgctggagctcgccgacgaccccaaactcgaggtccccatcgaacgggatggcgtcaagggattcgcgctggacctgatcgctggcggcacggactccacggcggtgaccatcgagtgggccatgtcggagctcctgcggaagcccgaggtcctcgccaaggtcaccgaggagctggacggcgtcatcggccacggccgcctggtcaccgagcaggacatcccggacctgccgtacctggaggccgtcgtgaaggagaccctccgcctgcacccggtgacgccgctgctggcgccgcggctgtgccgcgaggacgcgtccacgggcagctacgacatcccgcggggcacgctcgtgttcgtcaacgtctgggccatcggccgcgaccccgccgtgtggggccacgacgcggaggagttccgcccggagaggttcgtcggcagcgccgtggacgtgaagggccacgacctggagctgctcccgttcgggtccggccgccggatgtgcccgggctacgtcctcgggctcaagatggtgcaggtcaccctggccaacctgctgcacgccttctcgtggaggctgcctgatagcgtggcgccggagaagctgaacatgcaggagaagttcgggctcgccgtgccgcgcttggtcccgctcgaggccgtcgccgtgcccaggctgccaccacacctgtatgccgggccatgatgcatgtctatgtttgtttttgtaggcgcatacaactgtctcgtaataaaagatacatatcttttctctgtacatatacacctaataaagagacaaacaatatcgtcgaaaaaaaaaaaaaaa

SEQ ID NO: 2699 - DNA, 1669 bp, Zea mays
gaagcagatggccaacgcaattcaccagtagtagtagttgtagcggcataactagctatggctaccaccatggcggctaacgacccgacgagcatccgcgtggttagccgccggctggtgaaggcctccgacgcttccatccagcctcatgtcatgtccctctccaacctcgacctctacgtctgcgactcacagctcggcacgctgtgcgtctaccccaacgccggcggcggcttcagcgcgcgcatccccagcctgttcgagtccctcttgccgtccttgctcaactacctctacccattcgccggccgcctcgtcaccaacccaagctccggcctccccgaactccactgccacaaccaaggcgcagagctcgtggtcggcgaggtcggcgtcgccctggggagcctcaactacggcgcgaccaaggattccttcaagaagatggtgctcccgttccccagggacgtccttctgtcggtgcagctgctctccttcgcgtgcgggggcttctccgtcatgtggtggatcaaccacctcgtcggcgacggccacgtgggcgccacgatcgtcaggacgtggtcccagctcgcgcggaccggggacatcggcggtgcgcccccgctcaactacgaccgctccgtgttccgcccgcgcagcccgccgtcgtacagcgactccgtcgcggccaccttcacaacgttcgacgagaagcgcctgcccaacgccctcacggcggaggccagcttcgtggaccgcgtctactacgtggaggcgagcgacatcgccgcgctgcgcgacacggcggcggcggccaccacggcccagcgcccgacccgcgtcgaggcgctgtccgcctacctgtggaaggcgctcgccgacgtcgtggccgcgtgcccccggagcaacaaggagcgctgccgcatgggttggtgggtcagcgcgcggcgccgtgtcacggcgcctaagctcgtcgctttgatgcccggctacctggggaacgtgacgacctacgccctgggcgacgcgccggcggaggagatcgtgcggaagcctctggcggaggtggcggccatggtgcgggacgccatcacgtcggtggactacgacgagtacctccaggagatggtggactgggtggaggtgcacaagacggaaggcctgatggaggcggccgtcatcggagtcggcgcgcccacgctgaaccagtcggtgatgaccacgttcccgctcgacaccgacttcggcttcggccaggctactctggcaaccacggtctctgactatggcaggctttgctcggctttcctttcggtcggagcgcggccgggaggcgacggctcctggctcgtcaccgcctacatatggccgcagctggcggcggcgctggagtccgacggcatcttcaagcttctcacggcggagtacctcggtctagctatgtgagcaactgaacggaacacagttagctcgacggatcgatcatatatgtgttttctttcttttgattcgaatcgatgcatgatgtgcttcctttgtttttctgtcagcttttgtacctgtacgccagcagatgagactctggtctttgggatattatatatctgctaaataaagatgagctcgacataaaaaaaaaaaaaaaatacagcgcccgctggggcattgt

SEQ ID NO: 2700 - DNA, 2518 bp, Zea mays
cgccttggtttcaatgacgggacatgtcgacaggatggggtgggacgaccccttagataagattgtttggttcagggttaaaggttaagagttgagacatgactattccagcttgtcccctgttatccctcaaaattggagggacgagaggggacactgaaggatgtggatgccccggctgtccacagctgtcctgcaaccaaacatggatggttatttgtgtaactttcatgaatttgcaaatagaatatggggtcccaatacaacaacatagccttttgtcccaagcacaagcagggtagtctatttccatagaatggctaagtagaggttggctcgccaagcctaacacccccttcctcctttacgagggcttgggatttgctgctatgttgagacaagctcagcatagacggagttgggggatcctaatataaataagaatatgggagcttgagtgttgacaatagggacgctgttaattatccccttccaatggaagttggtagctatattttgtatgtattactccctcagttccaaattaaaattcgttttacctttttactagattcatacaataattaatgtatatgttatgtctaggtttatgatcatctatatgaatatggatataaaaatctagagctaaaacgactactattttgggacggagggagtattatgtaataatttgtcatattttttcctgacgagatgactaatctagtttgtctatgtttattttagtcaaacaagtgatagcggcggctatgctaccttggagacagagcaacctgggagcctaacgcccatgcttggggacaaaaaggttggcctgtgacccccctgttgtattctgtaattattactttgtttaatgagggacaatgacatatgtattcagagatctgatgttgactggtttttcggcagcccattattggcccggaaaagatgagagaggctcaatctcgtaatcaaacaccatacctcattttaagtggcaatgcaaaaacaggtcaaacaagtgatagcggcggctatgctaccttggagacagagcaacctgggagcctaacgcccatgcttggggacaaaaaggtcgagcattttttgggcatcaaacgaagtgccaagcctggaagcttacctcctccagtcccaaagaaaccgaagaactgaacctggtggtagcactcagccaacgaagcaggctacaacgcatttactgtgagcagcaatcagcccacaagcttccacggctcaaccccccgccgccgcactagaaatgcaatatcctctgtatttcttctaagctgattacactaacattctggcatgttcgatggggttttgtaattcagtgatatacgtgtgcatccttgatctgccttgaacatgtaagtgatggaactaaatattgttctaacgacacaccgtttccgtttgaataaagtgtagttatgatgtgacggtttaaggttaaagcagctgtgttcaagagctacattcgttctgaaaatatagacggggcgcctggaaccaaaaaaaaaaaacggttttagaccatctacttttttgatccaatttatatggaaatttgtcaatatttatgacatcaaattgatatattaaaaatgtatttcatgacgaatacaatgttactccatgcgttctaaaataaaattcgttttacctttttagtggtataataattaatatatttattttatatgtgtctaaatttatcattatctatttaaacgtaaacgtaaaaagtctaaagctaaaacaattaatattttagaatggattgagtatttgatatcataggtattcttttgagatcgtctcaaaataaaatttgttttatctttttagtgatttgtacaataattaatatatttgttttatatatgtgtctaaatttatcattatttatttgaaaaaatatatataaaagataaaacgattaatattttgagacggagtgagtatttgatatcataggtattcttttgagatgagcctgctgggagttgggtatttcacagccctagcagcggccagaactcaaaattctcacaaacgaagggaactcaagttccttgtgcgctgattagggcgggacgaatattcgtggcaacccaagttccttgtgcgctgattagggttggacggatattcgtggcacgttcttggttgggttggatcagctcgttttaattttttttttcataatctgagttaatatctaagctcagtttgttcacctttcagcaaaagaaaattctatacatatcatttatacatgaatcggtgaaatatgtacatgtatgtgtgttgcccgtaacatacgggtttaactgattattaatatgcttgataaactgtgtctatgttaaattggtctgtacaactgtgcatataggttaaactaacgaacatgtgtgccgatttgtgacgaactcataagtgatgaactgtgataatttgatgttgaattaatatggtc

SEQ ID NO: 2701 - DNA, 1395 bp, Zea mays
gcacgagaccattacctagaacatcctaatcgaaaaaagatctgcagaaatctctagagcaagcaagaaagttggccctaaggaagcaggaagaggcttcagcttctggtcctcgttccatagtcgaactggctactgcaaccaagagccaagaggaaacagaagccacagaaggagattcagaacagaataaggttgttatcacagagatggaggaatttgtgtggggactgcaattgaatcaaggaacacgcaagccagaagacgatgtgtttatggatgaagatgatgatgccatgccttcagataatgttgcaaaagatgacactaatgggttggcagagatggaagaggatgctctgacagaaataccagccaaggtcgaagaggatgaagtcaaaccagatgaggttatacatgaagttgcagtaggaaagggtttagctggtgctttaaagattcttaaggagcgaggaagcctcaacgagggaacagattggggaggcagaacaacagacaagaaaaagagcaagcttataggtgtcgaggatggacctaaagacattcgcattgaaagaatagatgaatttggcagagtgatgacacctaaggaggcattccgtcatctttcgcacaagtttcatggcaaggggcctggtaaaatgaaacaagaaaaacgccagaagaaatatcatgatgagctgaaaaccaagcatatgaaatcttctgacacaccattattggccgcggaaaagatgagagaggctcaatctcgtaatcaaacaccatacctcattttaagtggcaatgcaaaaacagctcaaacaagtgatagcggcggctatgctaccttggagacagagcaacctgggagcctaacgcccatgcttggggacaaaaaggtcgagcattttttgggcatcaaacgaagtgccaagcctggaagcttacctcctccagtcccaaagaaaccgaagaactgaacctggtggtagcactcagccaacgaagcaggctacaacgcatttactgtgagcagcaatcagcccacaagcttccacggctcaaccccccgccgccgcactagaaatgcaatatcctctgtatttcttctaagctgattacactaacattctggcatgttcgatggggttttgtaattcagtgatatacgtgtgcatccttgatctgccttgaacatgtaagtgatggaactaaatattgttctaacgacacaccgtttccgtttgaataaagtgtagttatgatgtgacggtttaaggttaaagcagctgtgttcaagacccgcgggcgttctgaaaaaaaaaaaaaaaaaaaaaaaaaaaaaaaaaaaaaaaaaaaaaaaaaaaaaaaaaaaccaaaaaaaaaaaaaaa

SEQ ID NO: 2702 - DNA, 1075 bp, Zea mays
ttgggtacctcgaggccggccgggacctgtgctttctttatggataacgatgatgatgacgatgaggcggccgttgtgggcgcgccattccggaccctccactccagctccactctcccatggcttcctccgccctgccttccagaaccttgcaccgccgcgcgctcccctcgtctaccccgtgccaccctgcgacggagaccttcgcccccggcgccgtctcccggcggcgagcagccgtgcggctcctctccgcggggttcctgaccgccgtcgcgccgccgccgtcgctcgccgcgaggaggggacgcgttgtcgtgccaccggaggactacgccactgcacccgatggtctcaagtactacgatcttgtcgaagggaaggggccaactgctgagaagggctcaaccgtcctggtccacttcgactgcatttaccgtggcatcaccgcggtgtcgagccgtgagtcgaagctcctggcggggaaccggagcatcgcccagccttacgagttcatcgttgggtcgctgcctgggaaagaacgcaagcgggatttcgcggacaacgccaacgggctgtactcggcgcaggcggctccgaagcctccggccgccatgtacaccataaccgaggggatgaaggtggggggaaagaggagagtgattgtccctccagagctggggtatgggaagaggggaatgagtgagataccgcctgacgctccttttgaactggatatagagctactggaagccgtttctcctgccaaagaatgagcttttctgtttccagcagacaggggggcacttatggagtgtgccagatttcagaggaatggattacataatctactgacattttgaggtccatactggctagatatgcaattgaaggcagccgcaattgaaataacctatgattagatgcatgctgagatggtggttgctgggacaatattatttttttgggttcaaggcacagcaatttctttttggacaataagcagaaatgtggtgtgtaaattgtttcccctcctcgaagtaaaatacgtgtataaatttccttcattattttc

SEQ ID NO: 2703 - DNA, 2990 bp, Zea mays
  misc_feature (199)..(199): n is a, c, g, or t
gtttagaacatttcagtttttataaaccagtttctcaaaaaacgggtgcttccaaatagatcatatctctacttagacattaaatacaagaaaattataataaaatattccgaaacaaatatttcgaacgtgctaaagttgcggagcgcaaaccccgcgccggggcggccaccgactggtcctctctcaattcacgagngaaaaaaaagaataatctctccactttccttcaggatccagcccgcaccaccgcacgtctcctcctctctctacaccggccaccgtaacaggaataatccagctcgtgattgaagaatccgatgacgacgccatgcctgggcgccgcggccttaagcgccagctggacggcgccctccctgacgggggcgtttctcgatctgacgctcgcctgggcctgcctctgcctcgccgcgctcgccgccgccgccgcgcgcctcctcgcgctcctcggcctcccgctcccctgcacctgtgcgcgcccgcacctgccctgcctcctcgccttcctggtgcgctaccctccccgcgccgtcggatcccttcacgccgccctccgcgcccgcttccccttcgccggccccaccgacgacgaggcacgccttcagaaaggggtggaggaagagggggaggaggaggccatcgatgtgcggaaggaggaaggggattttcgtcgccgcgtggaggcgcgcgccgagctgcagatggagctcgagaaagagcgcagcgccgcggcgtcggcggccgaggaggccatgtccatgatcctgcgcctgcagaaggagaagtcggcgcttgagattgaggcgcgacagcagcgccgaaccgctgacgagcgctgcgccttctacgaggacgaggtcgaggagctccgggacatcgtgctcgtgcgggagcgtgaggtgcgcgcgctgcgcaaggaggttgacgcctaccgacgcctgctcggttttagcgctaccgaggaggacgaggaggaggatgacgagcaggagatggtcacgccgcatagtttccccatgtacgaaggagagcccagctcgtccaaatcggtcgatgcgaatcggatgcaacattttgggaatgattctgggttcagcttcaagacgccatcaccgcgtgaacaaccaacggtgccgcctcttactgcagggcaaatcaatgtgggaagcgatgattgtgttgctgttcagacgccggccaaagttcccgtggttcaatcaagactggagctagatagctctgaggatgaggacgaggatgaggatgatggagcagagacggtggaaatcctccccctatccgcccggagccaagatttggatcaaggtagccatttccatgctgatactgcacaaggtatggaatcgacttgtaccaaggaacagacagctcatgcatttcaggaagtcgagtgtccaggtatagacaagattgttaatgaccagataggaagcaagaatgatgccaatgtgtatgatgtgcatgtggtcgatgacatgcgcttctcaacagaagtcaagggcctgattggccgaagcttctcagaggcaacaatgcaagcagagagattacagtctcgagctgttgcagatgatctccttgagaaaagcctgaatgccatcaaaggtgcacaggacaagataagaaatgcagctaatgaaaggaggcagtcattacagttgcaactcttagaggacatagctgatcaacttcaaggaatcaaggatgctgcagaagcagggaggcaagtattctgtgctgctcctaaaagctccaagaggagctagggacttgtgttacgccactaatgcatggttggcgccgtacataagtgtttcgggtttgtagaccaggtctgttgatttgttgattcaacaagtttgcttcttctttaaataagtagtggctattgctttgtacatgtatatatataaacaacatgggattcatcccagtctttataaaacgaatatatgtgtaaagaaaaacgaaatggatatttgatcaggaaggcaggaagctgactgtactgccgttgtatcggacgacagtttgttggacatgtccaaccataatcaaacgggtcaaacctgagaatgacagcaaatgcagaagttggcctgaatataacatttcttgatttgcaatgcagagaagtcaagtataaatttcaatcactccatatctttgtcaaacattcaaaccatcttcacaagttgactcattcagcagccttggtgctcaaagaccaaatgagagggtaatgtaaatcaatcaggtattttcattcccgtcaactactctgatttcaacatttcagaaaaaaaatgtgttgctaaactccttggccctaggtttaactcttgtacaaaggctgaaaaagtacacacaaatttggttggataaccggaaaatcgtgattggcggtattagtaagttctataataaagctgttgatgagattgattcatatcctcactgcttcaaggcagatattggaatggggaaaccacttgcagcaatcggcaagttctaatgctttgtacaggtgaaccagtcaacggtggacatcaaagagagatttgggaagtttaaggatgtacttgatcctggatgccgttttgtaccgtggatcattggaaaccgcgtcgaaggtcagctcacgcattggaaaccgttgtgagacgaagacaaaggtattgatatctcacttctgacttgtcacatgcaagattcagcttccatgttcaatataggtagtatttgttaagatagtgataagtttttaccgcctgtttgcaggcagcattcttcagatcttttgctcaccttatctaataatgtttttgaacacttatttgtttaagcatcctgtcgcaggataatgtttttcggtacggttgttgcatccattccaataccgggcgatggaagacaaagcatgccatgcatattataagctgagcaac

SEQ ID NO: 2704 - DNA, 1395 bp, Zea mays
acgggcatcctgcccatccagtaccagtggggcgactgggcgaggcgagccaaggattcgaccgttgcgttctccgcccaaaccttaaagccccgaccccctagcgccccccggccgcaaacttcgcctcgccgctccccctccctacgcaagcttcctccccctccgcgccgctcctccaggctccagccatggcgatcgccaccgagtcgcgcggcagcgaggacagggcttcagcccatgcaaacgaggagaagcggtgggtgctgtctgatttcgaggttgggaagcctcttgggaggggcaaattcggccacgtatatcttgccagagaaaagaggagcaatcaaattgtggctttgaaagttcttttcaagagccagcttaagcaatcacaggtcgagcatcagctgcgacgcgaagtggagattcagagtcatcttcgtcatcctaatattcttcgcctgtatgggtacttctatgatcagacccgggtttacctaatcctggaatatgctgccaagggtgagctgtataaggaactgacaaggtgtaaacatttttctgagagacgttcagcaacttatattgcatcattggctagagctctgatctacctgcatgggaagcatgttatccatcgggacattaaaccagaaaatcttttggttggagcccagggtgagatcaaaattgccgactttggctggtctgtgcataccttcaacagaagaaggactatgtgcggaaccctggattacctgccacctgaaatggttgagaagacagaacatgattaccatgttgacatatggagcctgggtattctgtgttatgagttcctttatggggtcccaccttttgaagctaaggagcactcagaaacatacagaaggatagtaaaagtcgacttgaagttcccactgaaaccattcgtttcgcccgctgcaaaggatttgatttcccagatgctggtcaagaactcggcccagcggctgcctctccacaaggttcttgagcacccatggatcgtccagaacgccgacccttccggtgtgtgcagaggatagaaccaccaccaccgtctgaagggagtgcgattctttccactctccccatttcgaggggagtgcgattctttcgactgtttatggcttctgtcgcccgaattgccccaccccgaactgtatcttgtagcaccgtgtactgtgtagttggggccgtgggcaaattgccctgtacccttgaacaaccttctttactcgtagtctcgtatgagagagccttgtagagtctcgtccgtccaattatgaactccagggcaatgtgcaggaaaatgttgaaggtatcgtccataaccagcaaaacttatgtagcgagctcaatttagaattt

SEQ ID NO: 2705 - DNA, 1195 bp, Zea mays
gcacgagggcgtgccccgtgccgtgcgaccatccctcccctcatggcgtcatcggcggcgcgatccctcgcgctcgtcgcgtctgcctcggcatcgctcggcgtcgggcagcggtcgtgggctcgcttggctgtctcttcctcttcggctgggtcggccctccccaagctccgcgggctccgctcgttcgccgcctccgcacggggcgccgtgatggggaacccaggccccggcgccgttgacgccgacgtcgggatggacgccgtccaacggcggctcatgtttgaggacgagtgcattttagtggatgaacaagacaatgtcatcggccacgagtccaagtataactgccatctcatggagaagatagaagctggaaatgtcctgcacagagctttcagtgttttccttttcaactccaaatatgaattgctactacagcaaaggtctgcaacaaaagtgacatttccacttgtctggacaaacacctgctgtagccatcctctctaccgcgagtcagagttgattgaggaaaattgtgcaggggtgagaaatgcagcccagcgcaaactatttgatgaactgggaatagttgctgacgaattacctgttgaccagttcatcctccttgggaggatgctttacatggctccttcagatggaaaatggggcgaacacgagttggattacctcctgttcatggttcgtgacgtgaagctcaacccgaatcctgaagaggtggccgacgtcaagtacgtgaaccgcgatcagctgaaggagctgctcaggaaagctgatgctggggaagatggcgttaagatgtccccttggttcaggctggtggtggacaacttcctcatgggttggtgggatcatgtcgagcaagggactctgcagggggcagcggacatgaaaaccatccataaattgtaagcctgtagtcttgtagatccgcgaagcacgtgctgtgctccgttgagaaataagcgtttctgcaggtgtttgcgctgcctttgttttagccatcattctgatggaaatagtcgataaagtcataatagagtgctcttaaatagggaacataactatttatattgaaacccgtctatgatgtgtaaatttctaccgaatgaatggaattatggaaatcatagtaattggcgagcaaaaaaaaaagaaaaaaaaaagaagaaaa

SEQ ID NO: 2706 - DNA, 1234 bp, Zea mays
ggtacacctcctgcccccccgggcatggtcggtcgcaccgaacagcacgaccagaccagttgcccggctcaccaaatccaggcgtggccgtgcgaccatccctcccctcatggcgtcatcggcggcgcgatccctcgcgctcgtcgcgtctgcctcggcatcgctcggcgtcgggcagcggtcgtgggctcgcttggctgtctcttcctcttcggctgggtcggccctccccaagctccgcgggctccgctcgttcgccgcctccgcagggggcgccgtgatggggaagccaggccccggggtcgttgacgccgacgccgggatggacgccgtccagcggcggctcatgtttgaggacgagtgcattttagtggatgaacaagacaatgtcatcggccacgagtccaagtataactgccatctcatggagaagatagaagctggaaatgccctgcacagagctttcagtgttttccttttcaactccaaatatgagttgctactgcagcaaaggtctgcaacaaaagtgacatttccacttgtctggacaaacacctgctgtagccatcctctctaccgcgagtcagagttgattgaggaaaattgtgcaggggtgagaaatgcagcccagcgcaaactatttgatgagctgggaatagtggctgacgaattacctgtcgaccagttcattccgcttgggaggatgctttacaaggctccttcagatggaaaatggggcgaacacgagttggattacctcttgttcatggttcgtgacgtgaagctcgacccgaatcctgaagaggtggccgatgtcaagtacatgaaccggcatcagctgaaggagctgctcaggaaagccgatgccggggaagatggcgttaagctctccccttggttcaggctggtggtggacaactttctcatgggctggtgggatcatgtcgagcaagggactctgcagggggcagcagacatgaaaaccatccataaattgtaaatcttctagatcgcttaagcacgagtcttgccctgttgaggaataagcgcttgtcctgctgtttggtgctggcttaaccatgccaatgatggaaatagtcgataaaattataacagagtgatcttaattctggaacgtaactattaacattgaaccccatctgtgatttgtaaatttctacccaaagttatagtctacctaagtatcgagacatcccaataaaaggggcacccc

SEQ ID NO: 2707 - DNA, 1163 bp, Zea mays
aactgaattgcggcccccgaccccggcccccgccccaaccaatccaggcgtgccccgtgcgcgcgcgcctccgcctcatggcggcatcagcgtctcggcccctcgcgctcctcgcgtgcacctcggcatctcacggcgctgggcggcgggcgtgggctcgcttggctgtctcttcctattcggcgaggtcggcgctccccaggctccgcgggcgtcggtcgttcgccgcctccgcagggggcgccgtgatggggaacccaggccccggcgccgttgacgccgacgtcgggatggacgccgtccagcggcggctcatgtttgaggacgagtgcattttagtggatgaacaagacaatgtcatcggccacgagtccaagtataactgccatctcatggagaagatagaagctggaaatgtcctgcacagagctttcagtgttttccttttcaactccaaatatgaattgctactacagcaaaggtctgcaacaaaagtgacatttccacttgtctggacaaacacctgctgtagccatcctctctaccgcgagtcagagttgattgaggaaaattgtgcaggggtgagaaatgcagcccaacgcaaactatttgatgaactgggaatagttgctgacgaattacctgttgaccagttcatcctccttgggaggatgctttacatggctccttcagatggaaaatggggcgaacacgagttggattacctcctgttcatggttcgtgacgtgaagctcaacccgaatcctgaagaggtggccgacgtcaagtacgtgaaccgcgatcagctgaaggagctgctcaggaaagctgatgctggggaagatggcgttaagatgtccccttggttcaggctggtggtggacaacttcctcatgggttggtgggatcatgtcgagcaagggactctgcagggggcagcggacatgaaaaccatccataaattgtaagcctgtagtcttgtagatccgcgaagcacgtgctgtgctccgttgagaaataagcgtttctgcaggtgtttgcgctgcctttgttttagccatcattctgatggaaatagtcgataaagtcataatagagtgctcttaaatagggaacataactatttatattgaaacccgtctatgatgtgtaaatttctaccg

SEQ ID NO: 2708 - DNA, 2591 bp, Zea mays
ctggcgagagaaccagaccggaatgtgtgacgactgacgactgaggtctgacgaggcgtaaacctcgctgactcgccctgccgccgccccgccccgcccgcgcgttctccgccgtcgtccccggaaggtttttgcctcagggcatgtggatctgttagttcacctgctgcaagcaagtatagctatagggttgaccagtgcagaagtatgaatccttactttgttgggattcttgtccccgtcgcggtctccctgctgctccgcaagaggagaaaggcccaaaggatgaggggagtgccagttgaggttggtggggagcctggatatgcagtccgtaactatcgttttgaacaacctgttgagacacactgggagggggtgtccacacttgctgatctgtttgagcaatcttgcaaagagtatgtatacatgccactccttggcacaaggaagctcatttcaagggaaactgaagcagcacctggtgggagatcgtttgagaagctgcatctgggcgagtatgagtggaagtgttatgcagagtgcttcaagagcgtttgcaacttttcatctggactaattagagtaggtcaccagaagaatgaacgtgttgctatttttgctgagacacgggctgagtggcagattgggttgcaggcatgcttcagacaaaacattacagttgtcaccatctatgcctcattgggggaggaagctttgtgtcactcactaaatgagactgaggtcactactgtagtttgtggtcagaaagaactaaaaaagttgattgatataagtgggcaacttgacactgtcaagcgtgttgtctatatcaatgaggaaggcatctcaactgaagtttctttagctcaaaactgcactagctggatagttgaatcatttgaggaagtaactaggttaggagctgaagcacctgttgaagcaaacatgcctctaccttccgatgttgcggtgataatgtacacaagtggtagcaccggattgcccaagggagttatgatgacccaccgcaacgtcctggctacactctcagcagtcatgaccattgtgcctgcacttggcagtaaagatatatacttggcctaccttccacttgcacacattcttgagttggcagcagaggcactaatggctgctgttggggcctcaataggatatggatcacctttgaccctgattgatacatccaataaaataaaaaagggaactctaggtgatgcttctgcactaaagccaacattgatgactgctgtacctgctatacttgatcgtattcgtgatggtgtcaggaaaaaggtggatacaaagggtggtatagcaaagcaattgtttgacattgcctataaccgtcggcttgctgcaatcaatggaagttggcttggtgcctggggactggagaaactcttgtgggatacacttgtgtttggaaaggtgcgtgctattttgggaggaaagattcggtttgtactttcaggtggagcacctctatctggagatactcagagatttatcaatatatgccttggggctccaatagggcaaggttatggtctgactgaaacttgtgctggagggacattttcagagtatgatgacacatctgtcggtcgtgttggtgctccactaccttgttcgtatattaagttgattgactggcctgagggtggatacttgactgctgatttaccaatgcctcggggagaaattgtcattggaggtccaaatataactaaaggctatttcaagaatgaagctaaaacaaatgaagtctacaaggatgatgagaaaggtatgcgatggttctattctggagacatcggacggttccatccagatggctgccttgaaatcattgaccgtaagaaagatatcgtgaagcttcaacatggcgaatatgtatctctcgggaaggtagaggctgctttgattgtgagcccatatgtggagaacattatgatccatgctgatcctttccacaattactgtgttgctctcgtggtggctgcacacattgagctggaaagctgggcttcgcagcaaggaatcaaatacaacgatttctcagatttgtgccagaagcaagaggctgttaaagaagtgcttggatctttagcaaaggctgcgaagcaagcgcgacttgagaagtttgagataccagtcaaaatcaagctgataccagagccatggacccccgagtcgggactcgtcactgctgccctcaaactcaagagggaggtgatcaggaagacgtacgagaacgatctggctgagttgtacgcatgatggttctactctttttgatacgtttagtgtggaaaatgtgtagagtgtcaatgtcacgctgagatctatggtaatttgataccgattatcgttctgggattattattattattttgttcagttagaggagatatataaaccttgaagttttgagttatatggcttctcttgatgccgagaagctatattgcgatgattcctatgtgtttaggatataacgctttcgaattcttattgcgcttgttcatctcgtaccttgaggcaaaaaaaaaaaaaaaaaagcggcc

SEQ ID NO: 2709 - DNA, 825 bp, Zea mays
caagaatgaagctaaaacaaatgaagtctacaaggatgatgagaaaggtatgcgatggttctattctggcgacatcggacggttccatccagatggctgccttgaaatcattgaccgtaagaaagatatcgtgaagcttcaacatggcgaatacgtatctctcgggaaggtagaggctgctttgattgtgagcccatatgtggagaacattatgatccatgctgatcctttccacaattactgtgttgctctcgtggtggctgcacacattgagctggaaagctgggcttcgcagcaaggaatcaaatacagcgatttctcagatttgtgccagaagcaagaggctgttaaagaagtgcttggatctttagcaaaggctgcgaagcaagcgcgacttgagaagtttgagataccagtcaaaatcaagctgataccagagccatggacccccgagtcggggctcgtcactgccgccctcaagctcaagagggaggtgatcaggaagacgtacgagaacgatctggctgagttatacgcatgatggtgctactactctttttgctacgtttagtgtggaaaatgtgtagattgccaatgtcatggtgagatctatggtaatttgatatcgattatcgttctgggattattattattattattttgataagttttgagttatatggcttctcttgatgccgagaagctatcttgcgatgattcctatgtgtttaggataaaatgccttcgaattcttattgcgcttgttcatctcgtaccttgaggtaactactggtattgcagtctataaaattgcatgtacggtgt

SEQ ID NO: 2710 - DNA, 1865 bp, Zea mays
  misc_feature (21)..(21): n is a, c, g, or t
  misc_feature (26)..(27): n is a, c, g, or t
gcacgagaccattacctagancatcnnaatcgaaaaatgcaacccaaaacaacacggagaaaaaaactaactgagcatgactcgtcatcttttccaactctctttcttccccttgttctgctgacgcgccggtccgttggtcgcctcctatctgctcgctcgcccggtccggcctccgtccatggcgatggcggatgatgaggacaaaggagagccgcctggattggacccaagaacccggcgacccgtggcgaccggcaacatggccggcggtggcggagaggaggagtgggaggggggccccggctacgtgctctcgctcccggcggtggcgctgctcctacccgtcgccgtctcctgcctcgacgccaccgtccggcgcaagaggcgcagccgtccccgcctccgtgcccagccgtcgggctggtgggccttcaagctccccgtccccgcgccggaggaggcaaaggggccggttctctcagcgtcggtggttaataatccgtctgaggaggctcgtccacagagcctgtgcgtgcgccaggcgccgtcgccagacccatacacccccgcggcggcagaggagaggccggttaagagtgtgaggatgtgcctgcagtgcggcgcggtggtgacgccgcagtggaggtcggggccgatggggcagggcacgctctgcaaacgcctgcggggtccggctgaaggtggccggggcactgcgggggcaggtgcggcaccgccccgcgccaggacggccgcccgaccgcccccggacagcccggcctcggagtcgtcgcctgacagcccgatctgggagcccgggtcagttcccgacgtttacctggtgaggaagaggcctctgaagcaggggagacctccgctcaccgtcgccgatgcccgcgccgccgccgccagcgccagcggtgtacctcgtcaagaagaagaggaagaagacgccggcttcggtggcctcggcgaagaagccgtggtggcccccgaagtccgggaagcagtgcctgcactgcgggtcgtcgtcgacgccacagtggcgggaaggcccgctggggcgcagcacgctgtgcaacgcgtgcggcgtgcggtacaggcaggggcggctgctgccggagtaccggccgctggcgagccccaccttcgagccgtcggagcacgccaacaggcacagccaggtgctgcagcttcaccggcagcggaggagcgggagccagagccaccaccagcagcagcagcaccctctgcccgtggagaagcaccctccgcgacccacggccgcgctccagtttccccagcggtggcacgtgaaggaggagtacccgccgacgccgccccaccagcctctactacacccggtggtggccggcagcctcgccgccggcgagctgcgcgttgggggcatggtcgacgcggcggcagatgcagacgccgatgcaggacacggcggcggcaacggcaatggcctgagcaacgcgccgagctctctggactcgctcctgctggagggcccgtcggcgccgctgcttgtcgacgacgacgatcccttgatcgattagctagccactagccagagcctactaggggcaatccggcttccagcctagccgatttgagagaatagtaatcttcttggaccttctctttccaaaaaaaaaaaaaaaatcatcgtctttggttgtgcgtatctctgttcatctttcggcaaagtttttcgtgtaacttcatcatcgtcaaatggcaggatttgcaccaatgcttaggtgctgtcgtaacagagatgataatggatggataaaaaaaaaaaaaaataatggcactggcatgatcgacctgcaactgtgccaatcacgaac

SEQ ID NO: 2711 - DNA, 2648 bp, Zea mays
atgtcatatatgtttagagacatatatttgaatacatgtcactaatatatatatatatatatatatatatatatatatatatatatatatatatatatatatatatactacaccttaaggctggagcgagggcgtccaccaccctcaccgtgcccccgctccagcccccgtccgcactgtcttcctcccggcaatcccgcccccgcccgcgccgtcccttccctgcatcctgcccccgcccgcgccgtccctccctgcaatcccgcccccgccagcgccgtgtccccgccacgcatctttcccacctctttctttcccttgctctgctaacgcgccgccggtccgtcggttgccgcctatcctgcttgctcgcgcggccgctgttcatggcgatggtggatgaaggcggcaaaggagaggcgcagccgcctggattagacccaagaaaccgccgatctgcggcgaccagggcgaccggcgacatggatggcggtggccgaggagaggagtgggagggcccccccggctacgtgctctcgctcccggcggcggcgctgcccctgcccgtcgccgtctcctgcctggacgccaccgtccggcgcaagggtcgcagccatatccgccaccgtggccatccgtcgggctggtgggccttcaggctccccgtccccgcgccggaggaggcgaagaggccggttcccccagcgtcggcggccaataatccgtccgaggaggaccgttcctgtcctcgtcaccagcgcctgcccgtgcgccaggccccggcccccggtccacacactcccgcgcctgcagaggagaggccagcgaagagggtcaggatgtgcctgcagtgcggcgcggcggtgacgccgcagtggaggtcggggccgatggggcagggcacgctctgcaacgcctgcggggtccggctcaaggcggccggggcactgcggggtcaggtgaagcaccgccccacgccagcgaccgccaggacgcccgcccggccgcccctggacagcccggcctcggagtcgtcgcccgacagcccgatcttggagcctgggtcagttccagatgtttacctggtgaggaagaagcctctgaaacgggggagacccccgccgcctccgaggacggtacccgcggcggcgccgccgctagcgccagcggtgtacctcgtcaagaagaagaaaaatcggcttcggcgaggaagccgtggcggcccccgaagtcggcgaagcagtgcttgcactgcgggtcgtcgtcgacgccgcagtggcgggaagggccgctgggccgcagcacgctgtgcaacgcgtgcggcgtgcggtacaggcagggccggttgctgccggagtaccggccgctggcgagccccaccttcgagccgtcggagcacgccaacaagcacagccaggtgatgcagctccaccggcagcggaagagccagggccagcaccaccctctgcccgcggagcatccgcgagccatggacgtcctccagtttccccagcggtggcaggtgaaggaggagtacccgccgacgccgctccaccagcctctgccgcatccggtggtggacggcagccttgccagcggcgagctgcgcgttggggacatggtcgacgctgcggcagatgcaggacacggcggcggcggaggcaagggaagtgacctgaacaacaacgcgccgagctctctggactcgcggctgctggaggggccgtcggcgccactgcttgtcgacggcgacaagcccttggtccactagctagccagagcctactaggtgtaatccagctgatttgagagaacagtaattttcttggaccttctccttttttctgagatcttggtaactttattatcgacctcggttgtgtgtatttgttcgtgtttcggcaaaattttcgtgtaactttattatcatggcaggatctgtagaaatgttcctgccaattctaggtgttgttgcaacagagatgatatatgatggataatgacaatggcatgatcgacctgcaactgtggtttcatgactttcatcacgaaccgtactcgtgtccagtccatgtgaagtgaaacgtgagacctaagccaaattcggcaagatgaactgcaggttcaatgtttctccctattcgaaaaagtccatttttatgtctgtcaacaatcataaaagtcagtctattactcttttctttgtttaccctagattatataatcgagtttaaataagtttttatataatcaagtttaaataagttgagaggtaaacaaacaacataaattatcaagtggattatataatttagatatctagattatgataatctataagcagatcaataaacgtttatataatacataagctaaattatatagttccagagggaaccaaacatgacctaaattgtttaatctatctaataatctcaagcaatacatagccaacatttgtggtagaatgtgacatgttgtagagtgaaggcttaacatcttaaactaggtggcactctccaaccattaccaatttcgatttagaaaagagggaagatatctcaatgcatttcgtcacttatttaccaagaactacaattggatataactcaattggttcattatggaccaactcatcaagctagcac

SEQ ID NO: 2712 - DNA, 6482 bp, Zea mays
  misc_feature (6227)..(6227): n is a, c, g, or t
ggtgatgcttctgcactaaagccaacattgatgactgctgtacctgctatacttgatcgtattcgtgatggtgtcaggaaaaaggtaatgtccttcacattgttctggtccagtgtaccttgctgattattgacagctaccttttgtgttgagatgtcttcaggtggatacaaagggtggtatagcaaagcaattgtttgacattgcctataaccgtcggcttgctgcaatcaatggaagttggcttggtgcctggggactggagaaactcttgtgggatacacttgtgtttggaaaggtgcgtgctattttgggaggaaagattcggtttgtactttcaggtggagcacctctatctggagatactcagagatttatcaatatatgccttgggtaagattatgtatgcctcatttctgttgtttgatggcaattatcttgaaatcctatgttcccatcgcatgcatttaatacgataaatatgttatgacttcctcactgtgtttgcagtctgacattgataaggtttatgcaatttcagggctccaatagggcaaggttatggtctgactgaaacttgtgctggagggacattttcagagtatgatgacacatctgtcggtcgtgttggtgctccactaccttgttcgtatattaaggtcagcttcatttcttaactattttgtatcaaagctgtttttatcacgatgttatctgtgcggatctattttgtattttttatgcctaacaatgtttgtatgttgaaatcttccttagttattggttgttcttagcttcaagattatttacatgcacccgcttagatttttttggtcttgttgaacttctttcctcactgggtcactgggatatcttatctattcttgtgacagtgaatgagttcttactgttgacctcccacagttcctgacttcctgacatatcagccactgtatttttagttgattgactggcctgagggtggatacttgactgctgatttaccaatgcctcggggagaaattgtcattggaggtccaaatataactaaaggctatttcaagaatgaagctaaaacaaatgaagtctacaaggtatggtgttctcctaccaatatattcatagattgtttcaggcattgaactttaacttcttcacactttctgtaacaataaccacacaccacatatattatgtgaaggatgatgagaaaggtatgcgatggttctattctggagacatcggacggttccatccagatggctgccttgaaatcattgaccgtaagaaagatatcgtgaagcttcaacatggcgaatatgtatctctcgggaaggtatgcaatattcttattctggtccaactggctgaattgcactgcttaacttgttaggtgatgacaggtagaggctgctttgattgtgagcccatatgtggagaacattatgatccatgctgatcctttccacaattactgtgttgctctcgtggtggctgcacacattgagctggaaagctgggcttcgcagcaaggaatcaaatacaacgatttctcagatttgtgccagaagcaagaggctgttaaagaagtgcttggatctttagcaaaggttcgtgttttctgttcacctgtcagcatctgttttctttactgtgttggatcaccacacgttcatttttttttttgattatggaaacaaaatgttccagccttttgcaatctcttacatacggccttacaaatcgaaaaaaacaatcatccatcataaacattctttgaaataaaacatcaacaaatcaagctccttctaatctagcattggacctccatccatggcttgcaaagatctccatagccatcacctctaaggatcgacataccgcaaggatctcgtgttgaatcaccacatgttcatacctgactccacgcttattggaagtggatttgtatgaaagaaaagggtttagcatccattgatcttccactcatccatgctttgattttccaggaacatagcattatagttttggcttgattcactgttacagctggtctcctagaagtgtttttttccgcgtaattttagcaacaatataaatatggaaataggaaactattttgtagtgtttctgaaaggaatgaacagtcacctagcacagcgtaaaacatatccatccagagagtttttattagtttcaatttcacaaaggccattagcactgccgagtgtgtttcataagcactggcggcgaactaaggtaaaccacgattatgttgtctcatatacgttgatatccttgggaagttctctcttcctttttaccacgtgtgtgctgaaagttgcaagcatgtcaagcgagacaaatcctgtgcaccgttaagacaacaattttgattgcacccgatgcacttgttattttccaggctgcgaagcaagcgcgacttgagaagtttgagataccagtcaaaatcaagctgataccagagccatggacccccgagtcgggactcgtcactgctgccctcaaactcaagagggaggtgatcaggaagacgtacgagaacgatctggctcagttgtacgcatgatggttctactctttttgatacgtttagtgtggaaaatgtgtagagtgccaatgtcacgctgagatctatggtaatttgatatcgattatcgttctgggattattattattattttgttcagatagaggagatatataaaccttgaagttttgagttatatggcttctcttgatgccgagaagctatcttgcgatgattcctatgtgtttaggatataacgctttcgaattcttattgcgcttgttcatctcgtaccttgaggtaactactggtattgctgtctatagaattgtatgtacggtttcggtgtatttctccagttttttcttgagacgagttgttaaacatgtgctaatcatagattagtagacttaataaattcatctcacaaattagccatgaattatacaattagtttcataattaatttaggtttagctcttccagttggcatctaaaatctgaactaaattttagtgccgattgccgaagatcagcacaaacactggtcggctgaatcatatgtcggttggttcctattattgcggtttgttggtcaggacaattagatcagttgaatatatagttccgcaaatgaatgtacgattggtgccgctggcatttggaataaagtcaaagtcggctcccaagcacaaaggctagctaaagcgagatgcacatagtagattttttttttgttttgacaaaatgaaatggaaacgataggattgcaacgtctattttgcttgcggggaagatactgaactttaatcaagctctctgtgtgctaatttaataacctgcgcgtacatatggaggatacacacactgacacatgcttcgctcattccaaccacatgaatcatatttgacgttgtggacaaatggcacggaaccactcactagtcactgctactcacttcgtcacaatttataattcgtttgactttttattacaagtttgactaactcgtcttgttaaaaaattatggaaaaaaatcaaaaatttcgttgtgatttgtcatatatatactttacatatgacttaaattttttcatcttttcatgaatttttctaataagacgagtgatcaaagttggggttgaaaaagtctaacgaattatattttgcaacggagagagtatatgcgaagaagatagaacaagagcgtctccgaaattccataaaacatttagcataaacctaatcttgccaaccggccagagagccaggagcagaatatttgatgtggaccaaccattaccaatttgttgttcctaaaatattgaattctatttttttgggttcctaaatttttgaatttgtggtttagcgattgaatcagcttgatttgtgtgttcactaagcagctctattcaatattcagagcgcgtgcgagtggcgcaaaccaggcaaccgagcgcagccggattgaatttagggatggatacttaaacatctcaattatagaataaaattaatatttaatatatatatatatatatataaaataaataatttgatgctaatatttagttatgtaaatatgaataatttttgtacttttttgcattattttctctgcaatgaaaaaggtgaaaaaacgtatgaatctgaacatgtatttgaacttttattttatactagtatatacctcttgctaatgctatgattttagggaggataaaggtcgatggcgacggtaacaactacgacatgaaggagaggctgacagtggcaacagaggcaggaggggcagcgggttcatggagagataagataatagatggttcaaataatattatctatttaattgaaataaggaagacaaagttattcagtgatccgaattgttgattttatgatatattaagtgtagatataatttatttggttgatttagtaaaggttatgttgtgagggtgattttttggattaattttgcaaagttaaactaatggattatataattgtatagaggaattgtaataagcttaatgataaaaataaaaacacacagattctatattttatttatttgtaataaaaaataatatccgtataagtatttagatccatctatctagggatcccatctatctatctatagttataagacggatagcaaacccaatacagagaatgcatcggaatggagcgtttaacaatcgactgatacagagggaaacgtggaatttaatccatattcatcatattttgtgtcaataccgtttaaattttgtaattttgcagaagaaaaatacaagtcagggcacgcgttctcgcctccgacaaagctcgccggagttcgtgaaaacaatttgctgtttccgtgaccctctatgcaacccaaaacaacatggagaaaaaaaactaactgagcatgactcgtcatcttttccaactctctttcttccccttgttctgctgacgcgccggtccgttggtcgcctcctatctgctcgctcgcccggtccggcctccgtccatggcgatggcggatgatgaggacaaaggagaggttcggatccattaatatctctatttttcgttgggtggttgggaagataaactcgcatcctgtaatattgctcgggagcctgctaaagatagcattcttcttgtcaagttgcgcagccgcctggattggacccaagaacccggcgacccgtggcgaccggcgacatggccggcggtggcggagaggaggagtgggagggcccccccggctacgtgctctcgctcccggcggtggcgccgctcctgcccgtcgccgtctcctgcctcgacgccaccgtccggcgcaagaggcgcagccgtccccgcctccgtgcccagccgtcgggctggtgggccttcaagctccccgtccccgcgccggaggaggcaaaggggccggttctcccagcgtcggtggttaataatccgtctgaggaggctcgtccacagagcctgtgcgtgcgccaggcgccgtcgccagacccatacacccccgcggcggcagaggagaggccggttaagagtgtgaggatgtgcctgcagtgcggcgcggtggtgacgccgcagtggaggtcggggccgatggggcagggcacgctctgcaacgcctgcggggtccggctgaaggtggccggggcactgcgggggcaggtgcggcaccgccccgcgccgaggacggccgcccgaccgcccccggacagcccggcctcggagtcgtcgcctgacagcccgatctgggagcccgggtcagttcccgacgtttacctggtgaggaagatgcctctgaagcaggggagacctccgccaccgtcgccgatgcccgcgccgccgccgccagcgccagcggtgtacctcgtcaagaagaagaggaagaagacgccggcttcggtggcctcggcgaagaagccgtggcggcccccgaagtccgcgaagcagtgcctgcactgcgggtcgtcgtcgacgccacagtggcgggaaggcccgctggggcgtagcacgctgtgcaacgcgtgcggcgtgcggtacaggcaggggcggctgctgccggagtaccggccgctggcgagccccaccttcgagccgtcggagcacgccaacaggcacagccaggtgctgcagcttcaccggcagcggagnagcgggagccagagccaccaccaccagcagcagcaccctctgcccgtggagaagcaccctccgcgacccacagccgcgctccagtttccccagcggtggcacgtgaaggaggagtacccgccgacgccgccccaccagcctctaccgcacccggtggtggccggcagcctcgccgccggcgagctgcgcgttgggggcatggtcgacgcggcggcagatgcggacgccgatgcaggacacggcggcggcaacggc

SEQ ID NO: 2713 - DNA, 2795 bp, Zea mays
tgggtaccccctcgagggcccggcccgggaaccttccccagccagcataaaacaagcgaagagccacccgccgccccctgcgagagcaaatactctcaagtcccaactaaccaaaactgggaccccccccccccccccagacacggtctctctctcacccttcaccgcttcacgtagcagcaagaaaaagaaagaaaataaaaagagagagagagacagagatggcttgcaccttgaaactccaaaacccaccatgaaaaaagaccttctctggcccctgaccctgagagagagttgctgttgctgccattcggtcggtgcctccttttcggtacgccgctggtatgtggtatcactggtatggttgttctcccatcccaaggcgacgagggaataggaagctagaaagttcgtctgcagtctgcacctttgcccatggcctaggcgcctagctcaggccgtagctcagcgtccgtccatgggccagggagtctgaaaccttgcttgccttgcctgcccgctcctctcacttctctctctcctcctcgctcgtgtccccggcgttctgctggtccctggggactggagagcgaaggtctgtctcctttgcgcctgctctgcttcttcaatgctgggcgtcggtggcttgggctcgggctcgggcatggaaccaggtaccagctgcggtgctctgctcagagagcttcagcaaatctgggcagaagtaggggaaagtgagggcgagaagaacaaggcgttgctggacatcgaaagagagtgcctggaagtctaccgcaggaaggtggacgatgccaatcggactagggtccagctgcaccagtcagtggctgccaaagaagctgaggttgcatctctgatggcaacccttggggagcacaagctgtacttgaagaaagacaagggcgttgtgccactcaaggaacaacttgccaccgtcgccccagtactggagagcttgaaatgcaagaaagaggaaaggatcaaacagttctctgatattaggtcacagattgagaagatccgctttgagttaagtgaatataatgatcagggtgatgacccgagcagtcttgctgctgaggaacacgatttgtcgatgaggaagcttaatagttaccaaacacagcttcgtgcccttcagaaagataagtctgagcgcctccgcaaggttctggagtatataaatgaagtgcattccttatgtggagtccttggaattgattttggaagtactgtacacgaagttcatcccagtttgcatcagaatggtgttgagcagtccagaaatatcagtaacagcacactggagggccttgctagtacaatttataagctaaaagcggaacgaaagtctagaatccacaaggcgagagagatcatggaatcgttgtgtcaactttggaaactcatggactctcctgaagaagaaaagagacagtttagtaaggtaatgagcagcctcatattacctgaggagggaatcacgtcacctggagttctctccgaggaaacaatcgagaagatggaatttgaggtcgagaggttaacaagactaaagaccagcagactgaaggaaatcgtcatgaaaaggagggcagagttagaagcgatctgccagaatgcacacatagaacctgatgtcagcacggcccctgaacagactgatgctttgatcgattctggcctcatcgacccttctgagctcctggcgaatattgagtcacaaatattaaaagcgaaagaagagtctcttagtcggaaagatataatggacaggataaatagatggattgctgcttgcgatgaagaggcttggcttgaagaatataaccaggacccaaagaggtacagtgctggaaggggtgctcatataaaccttaaacgggcagaaaaggcacggattttggttagaaaaatcccaagtatggtggacgacttgataaaccgaacctttgcttgggaaaacgcaagaaataaaccctttctctatgatgggggacgcctaatatctgtactagaagagtacaggcttagccggcatcagaaagaagaggaaaatcgacggtaccgggaccagaagaagctggagagcatcctacttgcagagaaagaagcgatcttcggatctagaccaagcccaaggaagacgagcagcttaagtaggaaggcaaatgggtaccggccaaatgggaacaccaacggactcaagactccaactcctcgccgattgtctctcggcagtgctactcctgagcttttgacgcccagatcgtactctggccataatagatactttggcgatgtgaggcgtctatcgacttcccatctgaacttcggtgatgattcgctgtcaacgtttacatccatcagtggctctgaaccagaatccccctctattggatgaacaccgtactgctggatgactggatggtcagtattgcgtattgtaaatgggcaccatgttaccaagttcttgcactagcatgtacattcctgatgtcatatatttagctcatattggagtactaagtattggacgggttgacttggtttgggttgggtgtggagttgaattgtttcaagttgatggctttgtagattgacaattaggcggaaagatgtaggggagcgatctggatttgggcagtcagctgtaacatatcataacttatgtgtttggtttgtgtgtgcaaccttgtgtacaggtgcaatgaaaaatctgtgtgcagaatctactacttcaataataaaaataaaacgcgaccccgagtagt

SEQ ID NO: 2714 - DNA, 1329 bp, Zea mays
gcggccgggccgcgactagagagaaatactctcaagtcccaactaaccaaaactgggaggaagagaaaagctgcaaacacattctctctctcccacccttcaccgcttcacgtagcagactagcagcaacaaaaagaaagaaaaaagagagagagagagagagacagagatggcttgcaccttgaaactccaaaacccaccatgaaaaaagagcctctggcccctgaccctgagagagagagagagtgagagttgctgccattcggtcggtgcctcctttccggtacaccgctgcccgctggtatggttgttctcgcatcccaaggcgacgagggaataggaagctagaaagttcgtctgcagtctgcacctttgcccatggcctaggcgcctagcccaggccggccgtagctcagcgtccatgggccagggagtctgaaaccttgcttgcctgcccgctcctctcacttctctctctcctcctcgctcgtgtccccgacgacgtcctgctggtccctggggactggagagcgaaggtctgtctcctttgcggctgcgctgcttcttcttcaatgctgggcatcggtggcttgggctcgggctcgggcatggaagcaggtaccagctgcggtgctctgctcagagagcttcagcaaatctgggcagaagtaggggaaagtgagggcgagaagaacaaggcgttgctggacatcgaaagagagtgcctggaagtctaccgcaggaaggtggacgatgccaatcggactagggtccagctgcaccagtcagtggctgccaaagaagctgaggttgcatctctgatggcaacccttggggagcacaagctgtacttgaagaaagacaagggcgttgtaccactcaaggaacaacttgccaccgtcgccccagtactggagagcttgaaatgcaagaaagaggaaaggatcaaacagttctctaatattaggtcacagattgagaagatccgctttgagctaagtgaatataatgatcagggtgatgacccgagcagtcttgctgctgaggaacacgatttgtcgatgaggaagcttaatagttaccaaacacagcttcgtgcccttcagaaagataagtctgagcgcctccgcaaggttctggagtatataaatgaagtgcattccttatgtggagtccttggaattgattttggaagtactgtacacgaagttcatcccagtttgcatcagaatggtgttgagcagtccagaaatatcagtaccagcacactggagggccttgctagtacaatttataagctaaaagcggaacgaaagtctagaatccaca

SEQ ID NO: 2715 - DNA, 5907 bp, Zea mays
  misc_feature (5347)..(5347): n is a, c, g, or t
  misc_feature (5366)..(5366): n is a, c, g, or t
  misc_feature (5410)..(5410): n is a, c, g, or t
tggatcttaatctgtatatattaaaatgaatttagatgtaaattagtttaagttacacttcaatccatatcattatagattaggatcaataataaaataaccaacgtacatcaccgtgtcggcgaggtgccattacgactacttcgaagcgcttggaaacttcctacgttgtgcccctggtatctctactgtctattgtcatcagttgtggtattatacgagtaaaatctgtgtgcagttgcaggattgcaccctcctcgcagtcccagacgagatccccacagacaaagatgaggaaacaggaattgacagaagcagcaggccgcccccacggcgcctcggaccgctcgcccgcctctgagtcctttccgaggcctacgtgtccccgtccgccccgtgctcgtgcccgcctctccacgtgtaacagacctccccggcttttccgacgtcacctcacctccctccccggccattaatcctcgtcccccccgcagtgcccgcacccacccggttgtcatcgtcagccgctcgctccctcggtcactcactcactcactcactcccctctagtacatcactcaccgcccgccaagcgcgaagctgtcactctgctgaccgcttgacagagcagagcacggcacctagccgccctctcaccgacccatggccatgggcggcgcgttccccttccagtggcccgagggccccgcggatcctgttctcgacgacgtgaccttgcctccgctgcccacggcggcgcccgacgccggggtcgccgcgtactacgcggacgcggcggacgtgcacgcgatgcacatggcgctgcccgatttcgcggcggcgctggcggcgatgcggcgggaggaggaggaggccgcgggcatccgcctggtgcacctcctcatgagctgcgccggcgccgtcgaggcggccgaccacgcgggcgcgtccgcgcacctggcggacgcgcacgccgcgctcgccgccgtctcgcccacctccggcatcggccgcgtggccgtgcacttcaccgccgcgctgtcccgccggctgttccctcccacgccttcgccttcgccttcgcctccgcccccggccccgcacgccgccgacgccgaccgagccttcctctaccaccgcttctacgaggcgggtccctacctcaagttcgcgcacttcacggccaaccaggccatcctggaggccgtccagggctgcaagcacgtgcacatcatcgacttcagcatcatgcagggcctccagtggccagcgctgatccaggccctcgcgctccgccccggcgggccgccgtcgctccgcctcacgggcattgggccgccgtccccgccagggcgcgacgacctccgcgacgtcggggtccgcctcgccgacctggcgcgctccgtgcgcgtccacttctccttccgcggcgtggccgccaaccgcctcgacgaggtgcggccctggatgctgcaggtctcgcagggcgaggccgtggccgtgaactccgtgctccagctgcaccgcctcctcgccgacgctccctcgtcgggcgacgcccgggcgcccatcgacgccgtgctggagtgcgtcgcgtccgtgcgccccagggtgttcacggtggtggagcaggaggcggaccacaacaagccggggttcctggaccggttcacggaggcgctcttctactactcggcggtgttcgactccctggacgcggcgagcggcggcgcgggcgacgcggcggcggaggcctacctggagcgcgagatctgcgacatcgtgtgcggcgagggcgcggggcgcagggagcggcacgagccgctgtggcggtggcgtgacaggctgggtcgcacggggctggccgccgtgccgctgggggccaacgcgctgcggcaggcgaggatgctggttgggctcttctccggggaaggacactgcgtggaggaggccgaggggtgcctgacactgggctggcacgggcgcccgctcttctcggcgtccgcgtggcgcgcggaagagaacaatcagagtgacagcaggagcaggagcagcggcagtgaggagagcaatatcagctgcagcagctagagcgtcgctactttactgtaaattccttcggtgagaggctagtagcggggtttactgtaaaatcgcggtgcccgcgatccaaatggttcgattgagagagcgttggcatcggtcgtaaatggcagactgaaaaaaaatgacatggaattctgttaggcatgtcgtcgttagctgaataaacggcactgaaacagcgtccctggaaaacgccattgcaatgcagtcgtagaagctctagaaacacttgctccctcgtccctcccatggatttgttttagagcatgactggatgcttgcgtggcctgctgacacatcgagcacgacaagatgccctggcatttctgagctggctggttacaacagcaacgagcaatatgtgaacctcctcatctatcgaaagaaaaaaaaaagcaaatccacgaatgcctacatctagccctgtttataaccaggaagaacatgccaaatcaacaaccataccaaatccacgatgcgcccagtccatatgccagggattctattctactacaatataacccacatctctgaactagctctgccacttccatgaaaaaagaatcgatttcagcttcaaaccgcaaggcatctgtctgaagtctgaaccaatgcaatgcaatgcaatgcaatgcggtgagtaatctatacactgccccccacagcgaatcacttgctaccgacgatcctgtcttgctatgttgacgcttggatttgcaccgaccgtgcctgctgctaacacgccagatcggtcgcgcgctgacgaccgttgccctgttcaccacacgataaacaacgcaggacagctagccggctgcgatcgaggccgcctccgcaaaagctctcgcgtgtacggttgcatctgtagctttgcaaagcgcaacgattaagtacatgtttttttaataaaaaaaatgaacttgtcacagtaggatagcagtagcaggagtggcacgtgcggcgcacacgcgcacggcatctctctctatctctctctcgggcggtcacagattctcctgggtgcggctgcacctgcacggctgcacgtcaggggaggcgtcccccgagaagcgcagaaaaagcccaagccctcttgcgagccgtgccgcgactagaacgcaacgcagccaggcaggcaggcaggatcagaccgtctgtatttgaaacacgccgtacgactagttgacgctcacatgtcgtggtaccggcccggtctcaaagtcccgaatcatattaaaaaaacacaaactgctgctaacggggagagttgggatgctcaatggtcagtcgcgatcgcaaccacacagcagaggatcacacttttacatgcagcgcatgttgctaacctagtacgtacgtatcccgtagctctagtacgtggacgtagcggcactctgtggtgtgggtggaagagagcttcggttaccgaggcatgagcaggaggcagagcagatgaccggaccaccgccgcgttcacgagccggccggcgcgatgctgcgcgctccccctactctccgccgcatggcagacggacgggacgggtggctgtcacgcaactggcgcgcgcggccgcagggcctctctgcgctctgaaaggcgcgcggcgcggaccacggcacgttcaggcgtacagccttccagactccatactgtcagtgtcccgtgtgtagggtggtccggcctgggtccgtctctccccggccccggctgcgcgcccgattgttactcaagcgctctaaactcacggatccccaagaacaacgcgcgccgcggctgatgcgttgagcaaagccatgaactgagcactgatttgtctactgtctatacaagcctcattagcacattgtccaataaaataatattgtaaggtcagaatatcaaactggcctattagctcagttggttagagcgtcgtgctaataacgcgaaggtcacaggttcgagacctgtatgggccatactattttattttgccacgtacatttttggttttgtccatctgcccattcatgcatttttttggcccattcaggcccagttttatttccaccatcgtgtttttgtaatgttctcttattttggtccacctgcatggcccgttttttccctacactcttaatgtttccgtctcggttgatgaggtcagttgcggcacctgttccaaatataattcgaaacgtttgagtttagattttttttttctgctaatctagcctacaaactaaccctagaaatagaatgcgtgttttttttcttctgtttttgtctcaggcgttggattttgttcgcctcaagtttagaacttgccatagttgcttagccagttagctccatccatccaaacaaccccgtcctcacagaatgttctgcacttttttctgtgcatcatcgtgttttttttcaatccatttccatctcaattgataagccaagccgcagcacccgttgaaacaagaccattatttattgttgagaatcaaaatgcttgttttctttttgcaaaccaaatctatccgtatatctcctttttgaataagcttggatttccgacattggacaattcagtttgtccgcacaatcgtcacccagcttagaaataagctacagcccacacatcccgttaaaggcatgtacaatctagagcactttgctcgatttttcaagtacaagagacgactaaaaaactgtattatacaatcctaaaccattagaacgttaataaagaccgtgtgtaggctggttcgggatgcgtccgtctctctcggtgccggctgaccggcttggtttgaagtcaaaatagaatgggatggagtcgataccgtatattcgattttttagaatcacgccgccactaaaacctacttcggtgtttatctcgtccctacgtaactctcatccaaacattatataaattgtagttgcctcctccattacactatatacatccaaccaaacacacccaagcgctctacactaacggatggcaagaactgcgcgcgccgcggctgatgtgttgagcaaagccatgaacggagtactggtcgatctattatctatacaagcctcattacttaagtttatataaatatagtaaaattttaaaaacaaattggcctattagctcagctggttagagcgtcgtgctaataacgcgaaggtcacaggttcgagacctgtatgggccattttattttatttttctacgtacgcattttttggtccacctggcccattcaggcncaatgttatttccaccatntctgcatggcctgtttttccccgtacactcttaatgtctccatntcggttgatgagcccagttgcggcacctgttcgaaatataattcgaaacgcttgagtttagatttttttctgctaatctagcctacaaactaaccctagaatgcgtgttttttttctttctgtttttgtctctcaggcgttggattttgttcgcctgaagttgagaatttgcgatagttgcttggcaatggcaagttagctccatccaaacaacccctcaatcgataagccaagccgccgcgtcctcacagaatgttgtacactcttttctgtgcatcatcgtgttttttcaatctatttccatctcaattgataagccaagccgcagcacccgttgaaacaagaccattatttattgttgagaatcaaagtgcttgttttcttttcgcaaaccaaatctatccgtatatctccttattgaataagcttgggtttccgacgttggacaattcagtttgtccgcacaatcgtcacccagctggaaataagtacagccc

SEQ ID NO: 2716 - DNA, 2798 bp, Zea mays
  misc_feature (1111)..(1111): n is a, c, g, or t
agggaagggtgcacgcggcgggaaccgctgcagcccatctaaaggtgtctccagcggattatataaaataagagacgttatagtatttaatattatttattatagagtaaagtttaaaatagaaaataagataaaaaaaataaaatagagaagttgatagagacaagcataagaattccctcctggtccctagacaacgtatagtgtcctgcaactatcataagtaatggagattgggcggctctcctgcctctttgatgtcgtatatgattgggcggcaatgcctcttgcatggcctatttgaacctcaatgtcaacgagtacaccaccaccacactagcgtcatttgtttctggaataaatccatgaaaatatggttccctctgcaaagtcgagcaatggacccgtttggttcacggctaactgcgtacactttatctaaggttagtcgtctaaattgaacaactaaccttagagagaaaaaagttagccaaatcgtgaaaatttaggcagcaaactaaacaagctaatgtccgacctggatagatgtattccaccacaaagaatataaccaactaagctagaagacaagaatatctaataatctacttaaccagaaggtacacaaatcaataaatcatggaagcatgacgcaatcgaaaataagttccactcctcattcaccaccactcaaccaatatttacagaattgccagctttccccttcctccctgcagaattaacactacccttcatttcaccaaagcaactcttgtccatctccagttgttttctcatgctcagccagtttgaattctgaaacttccccatgcttcctctgtggttttggagcttttattaagaacgatctgcaccaatagtactcatccaggaacattgaagtggaagagccaggatataacaaatgcaaataccatgcaagcgaggaggaagttgaggaaccggtgcccttgccaaaatctacgaggctcggtggctgttgcctgggcagatgcagtgttgcttgattcattccactgctcgatgaactccgcatcacagaaacctgccacgttgcatgctgttgagccacagatttcgcagatcttgntgcctatgacaatgaaagaagggatggagacacttaaaacaaatccttgtttgcattcagataatatgttgtgacgcaaatttacttaaatgacaccaggggaaacatatttgataatgcccaaatactgaaacactacaccacaaacaacacaaaactttaatatgatacaaattgactcaagataaacagaaaatacaagcctaatttcatctgaactagtggaacaaaattatgttttatgattttgtaaggatactgaagcacctttcatttttatcttgagtcaacttatatacttctcatggttatcccaattcaagtgataacgcaagagggtgtctaacaatatcaaacatagcagtataaactcactttcatatttttctataatattgaagtaacttagaggtttcacaagatgcctaccattgacctttgcttaaaataaaaaatagcatcgttcatcaccatttaaaaaacacaaggcatatattgttttggaaaaatcaactttagtaaaattcgggcaacaattagtcacatcataggtatgtgtaacgaataaagttttacaatcagatcgtatttcaaagtaatagacaaagtctgtgcttgaagatcaagtgaaaataaaatttcacaaagaaaacaagattgcttttgtagacataagtagtaaaagacttggctataacatctttcaataatgcaacagaaaatatgtacgtatgttacattatgaagaaagctgtcatcccaattaatctctatgcttgtatttgaattgaaggctacttgatttatcctttttcttggaaacttgtactcaaagagtctcagcattgatgtttcttcaagatgatagcttggtgtaatgttattttcatgtatgtttgattacacatatggttgatgaaaaaatgggtgtgaggaagttcagaaataaggctctactgatgtagcttaactcaggtttccctcttatggaatgttcttttcccccacaaatctagtttctttttttctcaattacgcatgaggcctgcgtacagccagagaaagatttcactttgaggggtgtcaaatgagcttgtaactctacaaatctagatttcatagacgtgacgtgacagaaactggacctgccactctatacaatcagatcgttcggctggctttactacgactcgcttctgctttctagcttaagctcatgcgaacggcgtgctgtatgaacagcagccgagcagcggcagcagctgcaaaactagccgtagcgaacatatggaatatctctattatatgaagcaccagtttccactgtcatcgtcgtgctccctcactacaaatggggattcgagccatattgttggatttaaacctacattcacacacacctaggcaatagaacatacatatttttgtgtttaatactctaaacttataaatgaaaaccgcagcaacaaacatgtactttgctagttttagattaaagcatcttctgaataacgtttgacactgaaaagcacagctgctgagcaatttttcggattcagtaaccaacagtgcttataacctcgagtgcttcaccagttcaccctatgtggaattctcagcctaaatgaactatttgtaagatatatcttgaataaaattatgagcaaaagacactctctaccccccc

SEQ ID NO: 2717 - DNA, 3722 bp, Zea mays
gcgaagacgttaaaggatttctagatctagcgatgcgtcggttatcttcctgtgggatattacccctgaattctgctatgctttactgaataatgttgaaaacacttatgtcattcgagttgtaataaagtactctacccttatttaagatttgagcaatgtcttttgatatacacttatgatatcaacatacgtatgaaaatagattctagcacacatgttatgcattctgtttttttttcctaaaatcgggtgtgacattccctcaacaacgtcagtatggtagcaccacgcgtgtagcaaggatctcgcgatcgagtctaagagaagtgatggctagggattgcatgtgctgtgaaatgaccgtaaccccatatacttataaggccttgttcggttaatcccgttacccatggattagataggattggaaaaaattaagaaagagtttgacttatttgggatttaatcccacccaatcccactcaatccatatggattgagagctaaccgaacaagccctaaagtgtattaataaatcatagcctattaaatcgcttatgacaatatgagctggactctagtccaaattgtttatgattacgtcttatgcatatctagcatccctggccgaacgcgaacgtgaacaccttaatgctcttgtcggttcacagctgcttgtcctggcaaatcgaacacaataaacacaatcctcgagaacagcatgcggttggcttcatcatctttactaaaacaactgcactgaatttacagctggtccaattatgttgttttgttgatcttccacgctccctgcgtgcccatgttcccacttcccagtctgcacagcaccacggtccacggcccctcttcatataccccaccgcactgtacacgcaacacgcttcgtccacagcccaactacccaagagcagagggcagaggatgcctcttgccgcaatggcgtcggcatcctcctcgccctgctcgcggcatcctctgatcttggtcgttctcttgtgcgccattgccgccatctctttctcttcctctgcggctgctggaaccgttggcggcggcacaggcggactgggccccatcagcaccaacgggaagaactacaccaaggtgtgcgaccccgcacggttcgtggcgctggggctcgacatgtcacgcttccggtactgcgacgcgtcgttgccgtacgccgaccgggtgcgcgacctcgtgggccgcctcgcgctggaggagaaggtgcgcaacctcggggaccaggcggagggcgcgccccgcgtcggcctgccgccgtacaagtggtggggggaggccctccacggcgtgtccgacgtcggccccggcggcacgtggttcggcgacgtggtgcccggcgccaccagcttcccgctcgtcatcaacagcgccgcggcgttcaacgagtcgctgtggcgcgccatcggcggcgtggtgtccacggagatcagggccatgtacaacctgggccacgcggagctcacctactggagccccaacatcaacgtggtgcgcgacccacggtggggacgcgccagcgagacccccggcgaggaccccttcgtcgtcggccgctacgccgtcaacttcgtccgcggaatgcaggacgtcgacgaccgcccctacgccgccgccgcagacccgttctcgcggcccatcaaggtgtccagctgctgcaagcacttcgccgcctacgacgtggacgcgtggttcaaggccgaccgcctcacgttcgacgcgcaggtggaggagcgcgacatggtcgagaccttcgagcgccccttcgagatgtgcatccgggacggcgacgccagctgcgtcatgtgctcctacaaccgcatcaacgggatacccgcctgcgccgacgcgcgcctgctgtcggagaccgtccggagccagtggcagctccacgggtacatcgtctctgactgcgactccgtacgcgtcatggtccgggacgccaagtggctcaactacaccggcgtcgaggccaccgccgcggccatgaaggccgggctcgacctcgactgcggcatgttctgggagggcgcccgggacttcttcaccacctacggcgtcgacgccgtccggcaggggaagatcaaggagggcgacgtcgaccacgcgctcagcaacgtctacaccaccctgatgcggctcggcttcttcgacggcatgccggaattcgagtccctcggcgctagcaacgtttgcaccgacaaccacaaggagctggctgccgacgccgcaaggcaggggatggtcctcctcaagaacgatgcccgacgcctaccattggaccccaacaagattaattcagtgtcgttggttggcctgttggagcacatcaatgccacggatgtcatgctgggagactaccgaggtaagccatgcagaattgtgacaccatacaacgctatcaggaacatggtgaatgccacatacgtgcacgcctgcgacagtggggcttgtaacacggcggaagggatgggcagagcatccgggacagcaaagatcgccgacgcgaccatcgtcatcgccggtctgaacatgagcgtggagagggagagcaacgacagggaggatctcctgctgccgtggaaccaaagcagctggatcaatgccgtcgccatggcctctcccacaccgatcgtcctggtgatcatgtcggccggcggcgtggacgtctcgtttgcgcacaacaacaccaagatcggcgccatcgtttgggccgggtaccccggcgaggaaggcggcacggccatcgccgacgtcctcttcggaaaatacaatccaggaggacggctgccgctgacatggttcaagaacgagtacgtcaaccagatccccatgacgtccatggcgctgcgtcccgacgcagcgcttggctaccccggccggacgtacaagttctacggcggcccggccgtgctctacccgttcggccacggcctcagctacaccaacttcagctacgcgtccggcaccaccggcgccactgtcaccatccacatcggcgcctgggagcactgcaagatgctcacctacaagatgggtgcgccgtcgccgtcgccagcctgcccggccctcaacgtcgctagccacatgtgcagcgaggtggtgagcttcagcctcagggtggcgaacaccggcggtgtcggcggcgaccacgtggtgccagtgtacaccgcgccgcctcccgaggtgggcgacgcgccgctgaagcagctggtggcgttccggagggtgttcgtgcccgccggcgccgccgtcgacgtgcccttcgccctcaacgtgtgcaagacgttcgcgatcgtcgaggagacggcgtacaccgtcgtgccgtcgggcgtcagcacggtcgtcgtcggagatgacgcgctggtgttgtcgttccccgtcacgatcaacctggcagtgtagactacttgtctgcaggactaggcgtttattgattctttttttttactcaaggtaataactttaaaccattaaatgtggcgggcgagaaagtggaagcaagtgtaattactttacacagtgctatacaaaagcagaagcagatcgatccattaattgtcacatgatttgtatccctgaaagcagaacgggtgaaaaaatttactattgctgttttgcgcctttgcggcacagtttgatctcatcttaaatataattctaccacggtactg

SEQ ID NO: 2718 - DNA, 1879 bp, Zea mays
ggccgggaaaaaaaaataaaaaaagagtctccgaccattctcgcacgagaccattacctagaacatcccgtctcatcgacagaccgccgctttccaattccaggccatcaagacgtagcagctccccttgcgtctgcgcacgccaccgaaggatcctcgccgcgcgtgcagtgcgatccgaggggaggggtccaaggccatgatgaagagcgtcagcggcaccggctcggccgggagccggagcgatccgggcggcagcggcgagctgtcccgcttctccgtcgccaccacggcgtcgtccgcctcgcagccttccgcgaacggtggcgcgcgcgggatctccttcctcgacgccttccggtcctgcttcgtgcccccggaggcgcgctcgctggagaactccatgtccgacgaatcccacccctcccaccaactctcgcagtctttgagctcacaaggttctaacagtgggagcgtgtttgggagcaagcgatcgattaaaggaatgtatagtcccatgcacaggagttctttagatagggagatccctggcagcacaaaattctccttgccacagatccagaaagcaacaaagaacttctcgccaaacttcaagattgggcagggtggttctgggactgtatacaagggtcagcttgctgatggtactcttgtcgctgtcaaacgtgccaagaagaatgtgtatgacaagcatatgggtcgtgagttctggaacgagattgagacattgcaacgcattgagcacctgaatttggttaggttccatgggtacctggagtttggtggcgagcagttgattattgtggagtatgttcccaatgggaatcttcgagagcacctcgactgtataaatggtaaaatattggaattctcactgagattggaaattgcaattgatgtggctcatgctattacatatcttcatacctattcagatcatccagtcatccacagagacatcaaatcctcaaacattcttctaatgaacaattgtcgagccaaggttgctgactttggattcgccaaattggctccaactgattctagtcatatatctactcaagtcaaaggaacagcaggctatctcgatccagaatatctcagaacataccagctcaatgagaagagtgatgtctactcctttggagtccttctggtggagttggttactgggaggcgccctatagagccaaaaaaggcaatcattgagcgtgttaccacaaaatgggcaatggaaaattttgtggagggcaatgctatccaaacactagatccgaatctggaagcgaccgatgcgatcaatctagcggtcgagaagctgtatgagctggctctgcaatgcttagccccaactaagaggaaccgaccgagcatgaagcggtgcgcagagattctgtggagcatccgtaaagattacagggagttggttgtacccacctctgcgatgaactgaagcaggtcgtctggagcagtcaagtgaacaaaaagatgtatcactccagtttgcctctcttgattcgcttcaaagattggtggttgaaatcatccgattgctgggattctttcagttaccgcaagtggtcgtgaacaggactgatggccttcctagatgctttgtttgtgctagaaaccagaaaagtcccttacaggtcttactatgctgtgtgaaagtgttgctgagtaaacatgtacgagtatatatcagatatctaatggtgtgtatatcttgtaggttctcttatacaggtaattgcatcacgcatgaagaaatctagttgtttccattgcatcttttttttttgtctatgatgaacaatattcagcgtatgattagcaagcaacaaaaaaaaaaaaaaaa

SEQ ID NO: 2719 - DNA, 2933 bp, Zea mays
tatatcttgaataagtaaatataattcgtatcattgttatagttgtaactaaaaccattgtttttttttctttttggtcaatctgtagaggaagttcaatgatgcactcatgggcattctacgagtccgcgatttgagcagccctccatatatttacacaaatccacacacattgagtcacaaagttacagatgatgatttgttcgttgtgcttggtagtgatggcctatttgatttcttcagtaatgatgaagttgttctgttggtttatcaatttatgcacgataatccaatgggggatcctgcaaaatatcttatcgagcaacttatactcaaagcagccaaggaagcaggtaccctccaaattagatttcgagctttttatgattgaaatatcaaacagctgagtgggctattgcctcgcagatcattaatctaagagtcatctgcagaattagttttccatattatgctagaagcatcaggatttatttgacagtagttttgcaccttttgattcctatgtatgtaatcagcatgtttgaaatcatttcagttcgtgcagtcgacctgcatcaatgccaactcagccactcctaaccgctttccttgtattcttgcagctttaacagccgaagaattgatgaggatacctgttgggagtaggagaaagtaccacgatgatgtgactgtcgttgttatcacccttggaaatgcacagagaacgatgactgcgtcaacatccatgtgaaagaatggagagctagagagacgggctatatcagctggtaatttttgtgggtttttgcatacgtgtcctccaaattacaagcccttttttttgttgagattggcgtgtggtagtcagtaaacccgaataaaaatgtatatattgttttggaatttgggaagtgaacaaaaaccttttgttcaatcgcaaggtgggcatggattgtttggcctacttttgtacatacatgaattaaaacatggaggttcgtacttgagccaatgaatccatgagcagagcggtggatcgttccagttttcgtttgccaaattttttctgccaagtatttgttgtttgtgtcgatcttaaaattatgactcctggctggtccggtcttgcttgaagtgaaacctattgttttctattttcttattattaaatgtttatatttccaaaaaaatgaaaagggtgaaagcatttgaatgtggactggaatttggatccacgcaaaagcgagtccagtgcagaggatttactgatatcaccggccactaattcgaagaagatattatgtggtgcgcgatgattctaagcgcacagaccacacagatccatacctctagctcttttgtgctctctgtccacaattccatgccgcggcaagcaggcaaccatctcccaattcttgtgcgttgaaaattccgagtaatcgtctggttcttgtttattttggtgcatcaatcaatgacagcgacgtcctggttaaaactactggcaccagtagatgtgaccgaggaagagagacatgggggagtggcattacgaaggcctctcttattttctccagaagcagccaggcaaagcaatatgtggcgctggacctttcggtaattttggtagcggtgggcgttttattttttgtgccattgtggacttcacacttggcatggctaatagcagctgccttgtgaaattggttaaaggcaaaagcgactggcgacagtgacctccatgcttcacaacaccaggatctgggtgagtcgcgtggcgcgctctatttgcgtgcgtcgctcccggccggccgggccgccctctccctcttcttcctcctcctcctcttcctctgttttgcttttgtgttgctgttaggttcttggatagtttgatgaatgatactgtgcagcagcagcagcagtagtaattcatagtgggcggtgtgatagcagcagtgagatcgaggagaggatggaggtgttcatccacgaggactacgtgaacaagcgcaacgagctgaggagggagcagaggcgccgggaactgcagaggctgcaggtggagagcaaccccgacgcgtccagggaggcgctggcaagccgggagagcccgaggacgccggcccagtgcctgacgccgaccggcgcgtcgccgtccagcttcagatccccgacttcgaggagcacgctgcagtcgccggccgcagcggcggggcaggctgccggttggccgtcggagcatcgccgcctctacgactgcctcaagccgtactagtaggtaggcggacgtggagtggcctcaatccggctgcatacacggccagacgtggcatggcatggcatgtcgtccaaccgaataaagcgtggagacactccctgtggtcaaagcagtgcttctgttgctgctcgtactgtgcggttcagatctgtgccatggcatggtcaagtgaactgaggctgatctgctctgttccactgtcatatggtcacagcaatctttgattcagtttcaaggacgacgtccagaactgcccagtactgtttggcctgttgtgcatcagaaattcagaagagtcaaggagttccaataatgcaatagccatttttagttagccccatagaaaacctacctgcttcgatgctgctgctcgttagatagatagatagggggtcttacttgtatttttctctttataagcggttttgaactcctgtatttgtatatgtatttgggctagttgcctaataaataataagtcctattcataacatggtacccgagctaggtcctactgttattttttccttctccgtacgaacgtttatttcctttgttgtgagaacttgacatcgaatctatataacattcagtacctatataaaaaatgaacagtatgaaacaactacgcaattgaaaaaatggaagccat

SEQ ID NO: 2720 - DNA, 992 bp, Zea mays
  misc_feature (971)..(971): n is a, c, g, or t
  misc_feature (978)..(992): n is a, c, g, or t
atccgcgcgccctcttcctcctccgcctcctcttcctctcttttgcttttgtgttgctgttaggttcttggatagtgtgcatcggcaccagcagcagcagtagtaattcatactagtgggcggtgtgatagcagcagtgagatcgaggagaggatggaggtgttcatccacgaggactacgtgaacaagcgcaacgagctgaggagggagcagaggcgccgggaactgcagaggctgcaggtggagagcaaccccgacgcgtcccgggaggcgctggcaagccgggagagcccgaggacgccggctcagtgcctgacgcccaccggcgcgtcgccgtccagcttcagatccccgacttcgaggagcacgctgcagtcgccggccgcagcggcggggcaggctgctggttggccgtcggagcatcgccgcctctacgactgcctcaagccgtactagtaggtaggcgacgtggagtggcctcaatcctgctgcgtacacggccagacgtggcatgtcgtccaacagaataagcgcggagacactcctgtggtcaaagcagtccttctgttgctctgctcgtaccgcggttcagatctgtgccatggcatggtcaagtgaatgaggctgttctgctctgttccactgtcatggtcacagcaatctttgattcagtttcaaggatgacgtccagaactgcccagtactgtttggcctattgtggtgcatcagaaattcagaagagtgaaagagttccaataatgcaatagccatttttagttagccccatagaaaacctacctgcttcgatgctgctgctcgttagatagatagatagggggtcttacttgtatttttctctttataagcggttttgaactcctgtatttgtatatgtatttgggctagttgcctaataaataataagtcctattcataccggggggtgggggggagggggcccgtatgttttnttcgggnnnnnnnnnnnnnnn

SEQ ID NO: 2721 - DNA, 970 bp, Zea mays
ccggccgggaaaaaaaaaaaaacccccggcccggccgggcgccctcttcctcctcctcttctcttttgcttttgtgttgctgttaggttcttgggtagtttgatgaatgatactgagcagcagcagcagcagtaattcatagtgggcggtgtgatagcagcagtgagatcgaggagaggatggaggtgttcatccacgaggactacgtgaacaagcgcaacgagctgaggagggagcagaggcgccgggaactgcagaggctgcaggtggagagcaaccccgacgcgtcccgggaggcgctggcaagccgggagagcccgaggacgccggctcagtgcctgacgccgaccggcgcgtcgccgtccagcttcagatccccgacttcgaggagcacgctgcagtcgccggccgcagcggcggggcaggctgctggttggccgtcggagcatcgccgcctctacgactgcctcaagccgtactagtaggtaggcgacgtggagtggcctcaatcctgctgcaatcacggccagacgtggcatgtcgtccaaccgaataagcgcggagacactcctgtggtcaaagcagtgcttctgttgctctgctcgtatcgcggttcagatctgtgccatggccgcatggtcaagtgaactgaggctgatctgctctgttccactgtcatatggtcacagcaatctttgattcagtttcaaggacgacgtccagaactgcccagtactgtttggcctattgtgcatcagaaattcagtaatgcaatagccatttttagttagccccatagaaaacctacctgcttcgatgctgctgctcgttagatagataggggtcttacttgtatttttctctttataaggggttttgaactcctgtatttgtatatgtatttgggctagttgcctaataaataataagtcctatttataacatggtacccgagctagattctactgtt

SEQ ID NO: 2722 - DNA, 908 bp, Zea mays
caagccgcacgagaaggcaggcaggcaggcagagaggaaggaagaggaggaagaggaggagaagcgcgtggaggagcgggatgcggcgggcgaggctgccgccggtcccggtcccgacggcgccgggggacgcggggccggaggtgaagtaccgcggggtgaggcggcggccgtcggggcggtacgcggccgagatccgggacccggctaggaagaccccgatctggctgggcaccttcgactcggccgaggccgcggcccgcgcctacgacgccgcagccaggaccatccgcggcgccgccgcgcggaccaacttcccctccgcgcccacctccgccgcggtcgcgccgccgctgccactccccgcctcaaccgccgccgcggcgggtgcggcgacgtccagcctcagcagcaccgccgttgccgttcgatctgaacgtgccggacccggcggccgacgacatggactggcgctgcgacacgctgctccgcctctagccgccgcagggccgcaaccactcccaggatctcgctcgcttcgtgtgcccgacgctgatccggcggagcggagcaatgcgtgcgtgcgtaccccaccccgccatgaagtgctatcgtgctattttgctattctctccatagaaattgataattttagtctctctctctttttttttaccactgccaagactcggtaattactctgtgataatgtgaataactcattatgtaatccgtggggagtggagggagcctggtctcgcgaaaccttcctgtctcctcctgctgtgtgtgtatctgtagcagcagcagcagcagcacgatgtaatactgtctgtcttgctgtaattctcaagagataatggaattaagagtgatttacagacacaaaaaaaaaaaaaaaaaaaaaa

SEQ ID NO: 2723 - DNA, 2151 bp, Zea mays
aagaagtgtgggtttcagccaaaagggttccttgaaattctggaaaaaaaaccttgccatattgatagaccatagtcaatcatagatgtactttgttggaaacctgagatccccaagatgtttataaggttgggccacactattctgaatatgcatgtcgtagcaggcaaagacgatctctaagtagagattttacaattcatggtgatgaatctgatccgatgtccgcagataatgaagaaaatatggtagttgaacgtgagattcctgtaaattatgaggaaccaattaacggcccccctccaagatgtcatccttaaggttggccccaactattctgaatatgcatgtcgtagcaggcaaagacgatctctaagtagagattctacaattcatggtgatgaatctgatccgatgtccacagataatgaagaaaatatggtagttgaacgtgagatacatgtaaattatgaggaaccaattaatggtactgctgtgacatatacatctgggcagtcacaacatcctacaagtcttgactatgaactagatgcaataggtgtactagataccagttctgcagtccctttcagtaataaaaagtctctttctcctgctggacaggaccagcaagtgcttaagatgaccacaacagcactagataactgccttcttgtgcctaatctcgatgatttgatgcctaagcatgagcaaattgaataccatcaagctgatgattacccagccacttatgatcctcatatagcatcagattctcctgaggagattaatcaccacctaggggatgtcagtgaaaccctttgtattctacctgatgtattagaatcgccagcgaactccaacaaagatgaccagcaaagtccaatgtctgttcttgaatcttccatggacggagaagatgtttactctggggattttgagaagatcagtgcagatctccaagagctcagattgcaacttgggcttctgaagagggagactacagacactagagatggcagcgagctttctatattgagtgatgacgagacagcacgtcgatcacttcctgagacgggggaatcccatgcttttaggaatacggaagaaagggacttctcctacgtgttcgatatgcttgttgctctgggcattcacgcggccaacgaggatgacctccttgacaactgctacttactggagtgctctgcaggccttgatttatacgatgacctcgaacagaagtacgacagcctcattttatggcctgtgcatgagaggaagctcttgtttgatatcacgaatgctgttcttggggacatgatcacctccgtgatgaacggctgctcgaagggactgatggcgaggtgctcgcctggatggaatcgggaagagtttgctgagctcgtgtggcaaagggtggtgcagctccggcaagagatagagttcaaccaggaagccctgctgttgagcgtagagtgggctggctctgaagatggcgccagtctggtcgggcgcgatatcgggaatatgttgcaagatgatctcgtacaggaaattatagctgactttctgggggcaactaaatccgccaagctccgtggctagaattgccagtgtttgcacccgaggccattgcaagcatatgcatatggattggtcgctggtgaactctagtggacgatgagccttcgatgaattgcttaacgaggggactgtaattcaaggaattcacctcatggctactgaagacatgagctaagatggcttaggtgatggtggggcatcaaacaagcagtgtcgaagtttgacctggttgtgtcatgctcgtcagctcatcaccattggctccgaactcagcaatagcgtacaactggatgatttcccccctctgaactttgaaaagcaattttttttcattaggttatcataatgctggaatatagatgcacaattttggtgtaaaataatctctggcggattttagtttgtttatcatgggatgcaataaggacagtgtcagttgagacatctttatctgccaaaaaaaaaaaaaaaaaaaaaaaaagaaaaaaaaaaaaaaaaaaactcgagggggggcccggtacccttttcgcccaatagggtgccgactggcggggggaaaggagt

SEQ ID NO: 2724 - DNA, 967 bp, Zea mays
ccggccggggaaggatgccggccgcaacgcttcgtcctccgcgtccgctttcgcctttcccctcctcctcctcctctcgacaccaccaacacaacaccactccaccgccgttcgaatattccaagcttgagattggaggaggaggggaggggagccgagcgcagaaccctaattacctccatcgattgctaacagctcagatctcagaggcaggggaggtaaaatgccaagagcaaatgagatgttcagggcagattctagaatgatggtggtttttggtgccttgacatcgaaaccagagcagctgacattcgaagaaaccctcagatttgtcaagaaagtgaaggcccgcgattacatgctatacctgtcattgttcgacattcttggcagaatggaactatcccagctcgatgcctaccgagagttacagctgctgtttggaaaccacccggatctgtgcgaagagctcgagaagttcaggccaccggtgcctacaaagcaggcagcaaacaacatctggccctgggtcattgtttgcgccgtcccgttggttgcggtcagcctgatcccggcgctcggaaacccagtgctgtggttcgttcagcaaactgtcggcgagaaaatggccgcctgattgaagaaaccactgcagtacatatgcgtgcagcggatgagcgtgcgggcctcctgtcatttgcgccatggcaactggcaatcgaatcagcattgtctttatatatgtgtgtatatatgttagagtagcattctggaaggatactcgtcttcttggtcatcaagtgccgctgagcaagaaatttatgccggtacatgctgtccgggcgcaaccgtgcaagtgcaagcccaccaaacacatatagcccgtttggacatttgagctgggttctaagtgctaaagatcaaaactacgcccaggaatgttattatgctaatgcggttgccccac

SEQ ID NO: 2725 - DNA, 2590 bp, Zea mays
gcgggcgatcagatccaccgcgcagaccctctgttattagttgtatacacgtactcgacgtcctgtgttggcgcagcgtgcaatggagtgcgagaccggcctggtcgaccgccccctcaacagctcagcgccgcgcaccggcgaccccttgaagtggggcaaggcggcggagggtcttactgggagccacctggacgaggtgaagaggatggtggaggagtaccgcgtgccgctggtgaagatcgacggcgccgtgctcagcgtcgctaaggtggcagccgtcgccggccgggtacaggtggcgctggacgaatccgcacgaccccgcctggaggctagccgcgagtgggtcttcgaaagcaccatgaacggcacagatacctacggcgtcaccaccggcttcggtggcgcctgtcaccgccgcacgaaagagttcgccgcgctccagaaagagctcatccgatacctcaacgccggcgtctttggagccagcagcagcgacggctacacgctgccgccagaggtcacgcgcgcggccatgctcgtgcgcatcaacaccctcacccagggctactcgggtatccgcttcgagatcctcgaggccattgccaagctgctcaacgccaacgtgacgccgtgcctgccgctccggggctccttcaccgcgtctggcgcctgtggtcccgctgtcctacatcgccggcctcatcaccggccgcaagaacctcagtggcggtggccccggacggcaccaaggttgacgccgtcgaggcgttcaggatcgccggcattgagcacgggttcttcgcgttgcagcccaaggaagggctcgccatcgtcaacggcacggccgtgggctccggtctcgcggcgatcgtgctcttcgaggcaaacattctcgccgtccttgttgaggtcctctcggcactgtactgcgaggtgatggctggcaatccggagtacaccgaccacctcatccacgcgctcaagcaccaccctggacagatcgaagctgcagccatcatggagcacatacttgaaggcagctcctacatgaagcttgccaaggagcagggagagcttgacccgctgaccaagatgaagcaggacaggtacgcgatccgcacgacgccgcagtggctcggcccgcaggtcgaggtcatccgcttcgctaccaagtcgatcgagcgggagatcaactccgtcaacgacaacccaatcatcgacgtcgcccgccgcaaggcgctccacggtggcaacttccagggcactcccgtcggggtgtccatggacaatactcgtctggccgtcgctgccatcggcaagctcatgttcgcgcagttctccgagcttgtcagtagcttctacagcaatggccttccctccaacctgtccggcgggcgcaacccgagcttggactacggtttcaatggcgctgaggtcgccatggcgtcctactgctctgagctccagttcctcgccaaccctgtgacaaaccatgtgcagacagcggagcagcacaaccagagcgtcaactctctcggcctcatctcctccaggatgaccgccgaggccgtcaccatcctgaagctcatgtcctccactttcctgatcgcactgtgccaggccgtcgacctgcgccaactcgaggagagcatcaaggccgctgttaagaagtgcgtgtcgcatgtcgccaaaaaatccctggccatcgacgaccacgacctgctcgtcgctattgaccgcgtggcggtgttcacgtacgcagaagacccgtgcagacccagctatccactgatgcagaagctccgcgcggtgctcatggagcatgcgctcatcaatggtgacagcaacaccgagcgacctatggagacctccatcctggccaaggtggctgagttcgagaagcagctcagcgcagtgctaccggacgaggtggaggccgcacgagcggctgtggagagtggcacgaccccgaacaggattaccgagtgccgttcgtacccgctgtacaggttcgtgcgcgaggagctcggcgccgagtacctgaccggcgagaagacgcggtcgcccggggaggaggtggacaaggtggtgatcgccatgaaccagcgcaagcacatcgacccactgctgcagtgcctcagcgagtggaaaggcgcgcccctgccaattatctgaactacagataagagagaagacaaggtatgacggatgagaaaagaagtactatcctgctactgtacacgaataattcacgcggtgtggcgtgcataaactatactattaccatggccatgtgtcttgacggcacacagttatatttgattatcctgatcttacttcacagcttaattccaagaaactaccaaacaacaattatgatatcataattaaattcaaacgaactgctaagaatcaattataataacgtaagagcagcaataatcgcagacaactttactcacatcagagtgtggtcgaggccgcgatgttaattctaaccccctccttcttgagttcttgtcctgttttatcaccttcctccctctccacgtcctccaccagaatatataccttagtaaaaaga

SEQ ID NO: 2726 - DNA, 1537 bp, Zea mays
  misc_feature (1503)..(1503): n is a, c, g, or t
  misc_feature (1526)..(1526): n is a, c, g, or t
ggtaccctccgggttcggccggccggcagcccccagccgtgatcattatatcctatctgtctatgctccaggctttgaggtgggtattcgaccgccggccaactgcttagctcactcgtacatcgccacatcggtgaagtggtgtcgtggtgaccatgacgcctggcctcctcgccgccgccgccgccgccgtgctggtcgcggtggcggcgtcgctcgcggcccacgtcacgctcaactgccccgtgcagccggtgccgtcgcatcgcccgccgcccactccgccgcccaacaacctactccagaggctggagaagctcggggaaggggcgctggacgcgccggaggacgtgtacgtggacgcggcggcgggcggggcgctgtacacggcaacgagggacggctggctgcagcggatgatgaacaacggctcctgggagcggtggcgcttcgtcggcggcacgggcctgctcggggtcgcgccgtccgccgacggcaccatgctcgtctgcgacgccgacaaggggctttttgagggtcggtgacgagggagtgacccttcttgcttcgggggtcgagggctccccgatcaggttcgcagacgcggcgatcgaggcctccgacggcacggtctacttcagcgacgccagcaccaggttcggcttcgatttgtggttccacgacttcctagagttcagctccaccggccgcctgctccggtacgacccgcgcagcggcgagacgtccgtcgtgctcgaccgactcggcttcgccaacggcgttgcgctgccgagggacgaggccttcgtcgtcgtctgcgagaccatgaggttcaggtgcatcaaagtgtggctgaaagggggataaggccggcgaggcagagacgttcgtcgaccttccggggtggccggacaacatccgtctcgggtcggaacggtcacttctggattgccgtcctccagctgaggtcgccatggctggacttcatcacccgctggaccttcacgaagagagtggtggcctcgttccccgcgctcagcgagtggagcaagggggcggcgaagggagccatggtcgctcaggtgtccgaggacggcaccatcctccgcgtgctcgacgactcccaggggaaggtgatcaccttcgtcacgtcggtgacggagttcaacggggacatcttcctcggcagcctcgcgaccaacttcgtcggcaaactatctctggcgcgggtggcacaggaacaggagcagggtgcagtatcttcgtagacgtttgggttcttcatgtcagtttagccctgtttgtttatcctttatattatataatccagtttaaataagttaatatacaaacatacaaaacaggttattagatgtattatataatctagatacctagattatgataatacataaacagataattatgtgcttattatataatccataagctagattatataattctgaaaggaaacaaaaaaaaagaccttaatcaaggganacatatacacatttgagttcttncatgtgagttt

SEQ ID NO: 2727 - DNA, 2231 bp, Zea mays
gtccgtctaacagacatctcaaaactttattagatagatcctaaggctataagtctgaacataaagaaagcacaatttgcaagattattagcgcaacatcctttatatgttaattttttattttttctatgcatataccgtgtatacacttcgtacgcgaggtatggcagggcatacctggcataccctctagatccaccactagcgggaagaagaggagcgggcgatggtgtcttcaggcagcaggaagaggaggacgaggccacagtgtagagagaggtgaagagacggttgtggtagagtgctcagggaaggagaagaggcactagaagtgtagtgcattgggggaggaggtgttacgattcggtcttcataaagtagccctacatgagagtgttttttgggcttagaatgtgcggtatggttacgattcagtctgcagaaagtgttggaaagttggtttcaatttcatgcgaggccaaatggagtaccaactcaagaaagtgattctaattcagcccaattctaaagaaacaaacatgcatgcccttaggtattataggggattgaggtggaaatggactaaatttcccctaaatcttctcgagtactcaagggaatttgtgtttctaaagtagccctacatgaagaatagtaaaaacatctaagtaattaataagtttttttttttttgtgtgtacaagtatatgtatatagattgattttttgagaagagatacaattacaacaccaacacatatcacgcattacatatatctgtatatatatttaataaacggcgtgacttatttattcatcatagaagatgagtacatatatatatatatatatatagtatgtgagtaataaataggtgcgggccggacacatgttgagcatggggttcagcggagaaggccagactacaccagctgctggcatgtgagggggccgccaattaatatacggtttgtagagagaaagcagatgcagactacacctcgcactcccttagccgcagacggcgccattgatgtggtgctttgggtgccccgagacgggaacaatagcagcatagtaccgttattaagaagaaattccttcttggctatctcaaacgcaagtaagttgttgaaaccggcggggcagggattttgggatggcgcaggcgcaggcgtcggagccagtagtgcctgagcccggacagaagccgccaacgtgagtgccaccgctaggaacaggagcgcggtggcagcaatgggcttcttgttggatgccatcgctactggctagctctagctagctgatgccggcggtagtgtgttctgctcttctcaacaaacaaagagcctcccttcgaaccgccgccgcatgtccaccagtatttataggacaatggcaggcgattgctagctctgcaaaaaagctttgcatgggtctgctagctagctataggtcatcactcgggtgacaagtttctctagggtcgttaatggcgcccaagagccagtaccacggaacgtaccattctagacattcgaggtcgcattctatactccgctggttcgtatatctataccttttccgctgttggcctaaaaaaagtttgaaaaaaaaccacagatacaacaatgcacctgcagcatgcttgcgcattgcaccactggattcatgctcctagggacttggagaaacatgcaactcgcaacaagtactgaagactactgcatgcatgcactagaccctgactcacgtaagtgcgtgcgtgtcaaataatgcgcacaactaaacacgcaaactattttatgagacagctcggcgagagcttcgtcaccgcgcttccgattcgatcttcggtacatcgtcaaaaatcgagatgaccaacaacaacgcgaggttgaagggcttgattgtaaggtaagttagtggtaggttagatgtctttccaaaaaaaataggattgacgctttctgcctaatggataaccaccaccataaaccattttacatacaagagtgtcatgcaacatgaatttaaaagtcggtacaatcatgataagttggcaacagctaggttatgtatttgtaaacaaacattttccacctttaacgaacttatttaaccaatcagattgtgtcatgtcacctatttctatgcagccctactaatttatcaaaaatgtgataacttttaggtcaaataatttgttttaatctgttcaagttgtgtta

SEQ ID NO: 2728 - DNA, 1380 bp, Zea mays
ctcgagggccggccgggagggtatacagcgcctaccgcccccgcggccggcaggatatcctatctatctacgctccaggctttgaggtgggtattcgaccgccaagcgccaactgcttagctcactcgtacatcgccacatcggtgaagtggtgtcgtggtgaccatggcgcctggcctcctcgctgccgccgccgtgctggccgcggtggcggcgtccctcgcggcccacgtcgcgctcaactgccccgtgcagccggtgccgtcgcatcgcccgccgcccactccgccgcccaacaacctactacagaggctggagaagctcggggaaggggcgctggacgcgccggaggacgtgtacgtggacgcggcggcgggcggggcgctgtacacggccacgagggacggctggctgcagcggatgatgcaccccaacaacggctcctgggagcggtggcgcttcgtcggcggcacgggcctgctcggggtcgcgccgtccgccgacggcaccatgctcgtctgcgacgccgacaaggggcttttgagggtcggtgacgagggagtgacccttcttgcttcggaggtcgagggctccccgatcaggttcgcggacgcggcgatcgaggcatccgacggcacggtctacttcagtgacgccagcaccaggttcggcttcgaccggtggttccacgacttcctagagttcagctccaccggccgcctgctccggtacgacccgcgcagcggcgagacgtccgtcgtgctcgaccgactcggcttcgccaacggcgttgcgctgccgagggacgaggccttcgtcgtcgtctgcgagaccatgaggttcaggtgcatcaaagtgtggctgaaaggggataaggccggcgaggcagagacgttcgtcgaccttccggggtggccggacaacatccgtctcgggtcagacggtcacttctggattgccgtcctccagctgaggtcgccatggctggacttcatcacccgctggaccttcacgaagagagtggtggcctcgttccccgcgctcagcgagtggagcaagggggcggcgaagggagccatggtcgctcaggtgtccgaggacggcaccatcctccgcgtgctcgacgactcccaggggaaggtgatcaacttcgtcacgtcggtgacggagttcaacggggacatcttcctcggcagcctcgcgaccaacttcgtcggcaaactatctctggcgcgggtggcacagaagcagggagcagtatcttcgtagacgtttgggttcttcatgtcagtttagccctctttgtttatcctttatattaaactcggccggggagggaaagaccgccctcccggtattatactaaaaaaaaaaaaaaaa

SEQ ID NO: 2729 - DNA, 1888 bp, Zea mays
gacagatgacgagaagggatggaagcactcactggggtaattatcttctgttcactaagctaccagaaacaatatcaaataatttttctgctgttagtttattgcactgtttgacatgcttgccagtgtcacagaagccaatccgtaggcacaaaaccatagattgtgtaatttgtgtttgagcgaactataaaatgtaggagtacctgtgaaccactagtaacgaatggcatgcatcagcaggtcataaaaagctcatgtagataatcgacaacttacatatttggtggcagaaatcaaatgcatggtctgaaaaatacttccctttcagtagagctatccagattcaccgatgttacttgtacacacaggtactgggaaaacgagaaggttcgattggcatacaggccagtgcacatgaacacattagacgatgaagtagagtccttcccgccgaaagctcgtgtctattgatcgattcaagcctcacaccctcgggaattccgtgtaaggtgttaataaagcagatgggcgttcctggctgagaacatgatctgaactcgtgacccccctttttctgtggttctgtattttgtctgatttgctagaaataaaaggaacacatgctaatgcctgacagacgtttgtgtacctcggccgcggcctcgctttgttacttgttgatgctgtacctgctgttttgagctcgcatgattcatgaacgttgcctgattcacggtgcattggtgcgacgttggttgacagattactggcctgattggttatatacttatggtgccaaaaattgtcactttttctgccacttaaggttaggcgttcaaattatgttggttaggcgttcaaattatgtaccacaattgggaggtgatgcttaaattgagaggtgatgcttaagcgaatctgtcacacttttataagtcattgactagtgggacttatgtagcagaaaaaatgttgctacaattgtggctataaaccaaacatatgcctaatttgtcaaacttttatcatgtacggtcgcacctataagcgtcgtcgtgatgccaggagggctgcgaagctcgtggccaaggcaggtgctaccgtcagtggctaagttttggaaagttaggatctagtttccttttgcatgtcttaattatagaagagattggagtttccttttgcatgccttaattagaggagagattggagtttcctttagaggagagattggagtttccttttgcaagccggaccattggctatatatatgtcatgtaatcagacttcgagggataagcaagatcaattattctaaagttgctcctctcccttaaactctctcaagccgccggtgagatcttctcacggtgaaggcctggagcacgactacgaattacgtagccacggttcggcgatgttgagcgttgaggcgcttgacaacctggtatcgggtagatcctctcccacccgctccagccctccaccatccccttccacgtccatcgccatggctgaacccaccatcaaggacctcatggagctgatgaagtcgttccagactgagttgtcttccgtgaaggtcgacatggccaccatgatggacaagtcgtcatcgccgtcggacgacggcggcggtgggcacgaggagcctcctcgtgaattcgatcgggccccaagattccagaagctcgacttttcccgcttcgatggcaagaccgatccaatgctcttcctcaacaaatacaaatcctattttcaccaacagtgcaccatgccgcaggagcgcgtgtggatgacctcctacaatctggaggacgtcgtgcaactgtggtacatcccagttgcaggaagacgagggaacgccgccatgggacgatcaaga

SEQ ID NO: 2730 - DNA, 1189 bp, Zea mays
  misc_feature (1109)..(1110): n is a, c, g, or t
  misc_feature (1112)..(1113): n is a, c, g, or t
gcgtggtcgcggccgaggtaacaaactaccatggggaggtagtggatatcaagggtgataatccagatgctgttgttcctggtctaatggctgctggtgaagcagcctgtgcatctgttcatggtgcgaataggctaggcgcaaattcacttcttgacatagttgtttttggcagagcttgtgcaaacagggtagcagatatttctaaaccaggtgagaagcagaaacctctggaaaaagatgctggagagaagaccatagcctggttggacaagctgaggaatgcgaatgggtcattgccaacttccaagatccgtctcaacatgcaacgtgttatgcaaaataatgctgctgtgttccgtacacaagaaacacttgaagaaggttgtgaactgattagcaaaacatgggaaagtttccatgatgtgaagctcagtgaccgaagtctcatttggaactctgacttgatagagaccctggaactggaaaatctgttgataaacgcatgcataactatgtattcggcagaggctcggaaggaaagcagaggagctcatgctcgtgaagatttcacgacaagagatgacgagaagtggatgaaacactccctgggatactgggagaacgagaaggttcgattggcatacaggccagtgcacatgaacacattggacgatgaagtagagtcattcccgccaaaagcacgtgtctattgatcgattcaagcctaacacctcgggaattccgtgtaaggtgttaataagggcttgttcggttagctctcaatccatggattgagtgggattggatgggtttgaatcccaaacaagtcaaatatcttctcaattttttccaatcacatccaatccatatgtattgggaataaccgaacaagccctaaagcagatgggcgttcctggctgagaacatgacctggagttgtgtccctcattttctgtgtttctgtattctgcctagtttgctagaaataaaagggtaagatagaacacatgctaatccctggctgatgtaatgatgtttgtgtacatgaaattttgcatgggttgttatctgttaatgctctgcctggttcattaacccaaaaaaannannaaaagaaaaaaaaaaaaaaaaaaaaaaaaaaaaaaaaaaaaaaaaaaaaaaaaaaaaaaaaaaaaaaaaaaaaaaa

SEQ ID NO: 2731 - DNA, 2320 bp, Zea mays
cattgggaacaaaacgacctcctccgcccgcccgcccgcccgcctgcccgtcggcgttgtttcgtctccaccgccgctctcctttccagtctccaccaccgctcgtctccccgtaccgcccgcaacccccctcccctgcgagatccggggcgcgatgtggcgcagctgcgtctcgcggggcctctccagggccaaggcctccgcctccaggctcctctccacggcgtcgtcgtcctacacggtggtcgaccacacctacgacgcagtggtggtgggggccggcggcgcggggctccgggcggcgatcggcctctccgagcacggcttcaacaccgcgtgcatcaccaagctcttccccacgcgctcgcacaccgtcgcggctcagggaggcataaatgctgcacttggaaacatgagtgaagatgactggaggtggcatatgtatgacactgttaagggaagcgattggctgggtgaccaggattctattcagtatatgtgcagagaggcaccaaaagctgttatagagcttgagaactatggactaccattttcaagaactgaagagggaaagatataccaacgtgcctttggagggcagagcttagattttggcaaaggtggacaagcctaccgttgtgcctgcgctgctgacagaacaggacatgctatgctgcacacactatatggtcaagcaatgaagcacaacactcaattttttgtggaatactttgctttggaccttctcatggacaatgaaggaaaatgtcagggaatcattgccttaaacatggaggatggaactcttcaccgtttccgtgcttctaatacaattctagccacaggaggttatggcagggcatatttctcagcaacctcagcacacacttgtactggagatggcaatgctatggttgcacgtgctggtttacctctccaggatcttgagtttgtacaattccatcctacaggcatttatggtgctggatgcctgattactgaaggttcccgtggtgaaggtggtatccttagaaatagtgaaggtgaacggttcatggaacgatatgctcctactgcaaaagatcttgcttctcgtgatgttgtttcaagatcaatgacaatggaaattagagaaggacgtggtgtagggccattgaaggatcacatttatttgcatctgaaccatctgccacctgaggttctcaaggaaaggcttcctggtatttctgaaactgctgctatttttgctggtgttgatgtcaccaaggagcccattccagttttgcctactgtgcactacaatatgggcggtattccaacaaactaccatggggaggtagtggatatcaagggtgataatccagatgctgttgttcctggtctaatggctgctggtgaagcagcctgtgcatctgttcatggtgcgaataggctaggcgcaaattcgcttcttgacatagttgtttttggcagagcttgtgcaaacagggtagcagatatttctaaaccaggtgagaagcagaaacctctggaaaaagatgctggagaaaagaccatagcctggttggacaagctgaggaatgcgaatgggtcattgccaacttccaagatccgtctcaacatgcagcgtgttatgcaaaataatgctgctgtattccgtacacaagaaacacttgaagaaggttgtgagctgattagcaaaacatgggaaagtttccatgatgtgaagctcagtgaccagagtctcatttggaactctgacctgatagagacccttgagctggaaaatcttttgataaatgcatgcataaccatgtattcggcagaggctcggaaggaaagcagaggagctcatgctcgtgaggatttcacgacaagagatgacgagaagtggatgaagcactcactggggtactgggaaaacgagaaggttcgattggcatacaggccagtgcacatgaacacattagacgatgaagtagagtccttcccgccgaaagcccgtgtctattgatcgattcgagcctcacaccctcgggaattccgtgtaaggtgttaataaagcagatgggcgttcctggctgagaacatgatctgaactcgtgacccccctttttctgtggttctgtattttgtctgatttgctagaaataaaaggaacacatgctaatgcctgacagacgtttgtgtacatgaaattttgcatgggtttgttacttgttgatgctgtacctgctgttttgagctcgcatgattcatgaacgttgcctgtttcacggtgcaaaaaaaaaaaaactcgaaaagagagggcgccggtacc

SEQ ID NO: 2732 - DNA, 2900 bp, Zea mays
ccccgcgtccgacaaaactcccccgacgtcggcttctccagcgccacgctctcctctccagtctccaccaacgccctcccccctccccacacgtcctccccccccccccctccccaccccgcgcgtgcgccgccgccgccgcgagatccggggcgcgatgtggcgcagctgcgtctcgcggggcctctccagggccaaggcctccgcctccaggctcctctccacggcatcgtcgtcctacacggtggtggaccacacctacgacgcggtcgtggtgggggccggcggcgcggggctccgggcggccatcggcctctccgagcacggcttcaacaccgcgtgcatcaccaagctcttccccacgcgctcgcacaccgtcgcagcacagggaggcataaatgccgcacttggaaacatgagtgaagatgattggaggtggcacatgtatgacactgtgaagggaagcgattggctcggtgaccaggattctattcagtatatgtgcagagaagcaccaaaagctgttatagagcttgagaactatggattaccattttcaagaactgaagagggaaagatataccaacgtgcctttggaggacagagcttagattttggcaaaggtggacaagcctaccgttgtgcctgtgctgctgacagaacaggacatgctatgctacacacactatatggtcaagcaatgaagcacaatactcaattttttgtggaatactttgcattggaccttctcatggacaatgatggaaagtgtcaaggagtcattgccttaaacatggaagatggaactcttcaccgtttccgtgcttctaatacaattctagccacaggaggttatggcagggcatatttctcagcaacctcagcacacacttgtactggagatggcaatgctatggtcgcacgtgctggtttacctcttcaggatcttgagtttgtacaattccatcctacaggcatttatggtgctggatgcctgattactgaaggttctcgtggtgaaggtggtatccttagaaatagtgaaggtgaacggttcatggaacgatatgctcctactgcaaaagatcttgcttctcgtgatgttgtttcaagatcaatgacaatggaaattagagaaggacgtggtgtagggccattgaaggatcacatttatttgcatctgaaccatctgccgcctgaggttctcaaagaaaggctccctggcatttctgaaactgctgctatttttgctggtgttgacgtcaccaaggagcccattccagttttgcctactgtgcactacaatatgggtggtatcccaacgaactaccatggggaggtagtggatatcaagggtgataatccagatgctgttatccctggtctaatggctgctggtgaagcagcctgtgcatctgtccatggtgcaaataggctaggcgcaaattcacttcttgacatagttgtttttggcagagcttgtgcaaacagggtagcagatatttctaaaccaggtgagaagcagaaacctctggaaaaagatgctggagagaagaccatagcctggttggacaagctgaggaatgcgaatgggtcattgccaacttccaagatccgtctcaacatgcaacgtgttatgcaaaataatgctgctgtgttccgtacacaagaaacacttgaagaaggttgtgaactgattagcaaaacatgggaaagtttccatgatgtgaagctcagcgaccggagtctcatttggaactctgacttgatagagaccctggagctggaaaatcttttgataaacgcatgcataactatgtattcggcagaggctcggaaggaaagcagaggagctcatgctcgtgaagatttcacgacaagagatgacgagaagtggatgaaacactccctgggatattgggagaacgagaaggttcgattggcatacaggccagtgcacatgaaaacattggacgatgaagtagagtcattcccgccaaaagcacgtgtctattgatcgattcaagcctaacacctcgggaattccgtgtaaggtgttaataaagcagatgggcgttcctggctgagaacatgacctggatttgtgtccctcattttctgtgtttctgtattctgcctagtttgctagaaataaaagggtaagatagaacacatgctaatccctggctgatgtttgtgtacatgaaattttgcatgggttgttacctgttaatgctctgcctggtatcattaacccatgattcatgaatgttttggtgattcatggcatggtgcgacgttgtcaaacaacgtagatttgtacgcctgttccttggatatagtataatatatatgtacacatgtgttggagcagaaaaaagccacttctccagtttagacagtagtagtataatgcagtcttatggagagctgctgctacgtactggcacaactacagctatagactagagtgtattttctggatgctaaataggagagccagagctgttttacccccgaagttttcttgttatatgaaccgtactgtatgagagcatcaaatgctagcagatcttaaagaaaaatgttgagattgtattctttttgtgaaagttgtgagctataagtgtataagatctcaatataatgatatgcagttttctgcgcgtccgagaaaaaaagatcccaccaatataagcacgctaaaatccagtgattctatgactgcttcgctagctctaccatttttacctccgtaaacaatctcatggtattagaacacgagtgaatttctgacatgactaaaagtgcaaaatttgacatgtttgtacatagacaagccagtcagggccttctttcacaagctaagctggaagtggcgaagtctacctcgtttggca

SEQ ID NO: 2733 - DNA, 2152 bp, Zea mays
gtgcggccctcgaggcgcccggttggtaccacgtcgtgtcggtgtcagggacgggggggcaactgtcggcgcggctggagctcaccggcgccggccagaaggcagagctcgggcccgacgttcgcaggctcagcctcaccgcgagccttgagacggacagccggttgcacgttcgcatcaccgacgcggatcaccggagatgggaggtcccccagagcgtcatcccgcgcgaggcgccgcgggacgacgtgcccctggaagcgagcacgggcgcctcgccgccgcgcagccgcgtcctctccgcggcgacctccgacctggcattcaccctccacgcctccccgttccgcttcaccgtgtcccgccgctccagcggcgacgccctcttcgacacctccgcggcgctggtcttcaaggacaggtacctggagctgaccacggcgctgccgccggagggcggggcgtcgctgtacgggctaggcgagcacaccaagcgcacgttccggctgcagcgcaacgacacgttcacgatgtggaacgccgacatcccggccgccaacgcggacgtcaacctgtacggctcccacccgttctacctcgacgtgcgccacgccggcgccgcgcacggcgtgctcctgctcaacagcaacggcatggacgtcgagtacggcggctcctacctcacctacaaggtcatcggcggcgtgctcgacctgtacttcttcgccggccccccccccgctcgacgtcgtcgaccagtacacccagctcatcggccgtccggcccccatgccgtactggtctttcgggttcaccagtgcaggtacgggtacaagaacctggctgacctggagggcgtggtggccgggtacgccaaggccaggattccgctagaggtgatgtggacggacatcgactacatggacgcgttcaaggacttcacgctggatccggtgaacttcccggccggcccgatgcggcagttcgtcgaccgcctccaccggaacggccagaaatacgtcgtcattatagacccagggatcagcgtgaacgagacatacgggacgtacgtgcgagggatgcagcaggacgtgttcctgaagcggaacggcaccaactacctcggcaaggtgtggcccgggtacgtctacttcccggacttcctcaacccgcgcgccgccgagttctgggcgcgcgagatcgccctgttccggcggacgctccccgtcgacggcctctggatcgacatgaacgaggtctccaacttcgtcgacccggcgcccctcaacgcgctggacgacccgccgtaccgcatcaacaactccggcgtgcgccgccccatcaacaacaagaccacgccggcgtccgcggtgcactacggcggcgtgcgcgactacgacgcgcacaacctctacggcttcctggaggcgcgcgccacgcacggcgcgctgctcgccgacaccggccgccggcccttcgtgctcagccggtccacgttcgtggggtccggccggtacaccgcgcactggaccggcgacaacgccgccacgtgggacgacctccgctactccatcaacaccatgctcagcttcggcctcttcggcatccccatggtcggcgctgacatctgcggcttcggcggcaacacaaccgaggagctctgcagccgctggatccagcttggcgcgttctacccgttcgcaagggaccattcggcgatcggcacggtccggcgcgagctgtacctgtgggagctggtggcgcggtcggcgaggaaggcgctcgggctgcgctaccggctgcttccgtacatgtacacgctgatgtacgaggcgcacaccacgggagcgcccatcgcgcggccgctcttcttctcctaccccaaggacgaggccacgtatggcgtggaccggcagttcctgctggggcgcggcgtgctcgtgtcgccggtgctcgagccgggtgccaccaccgtcgaagcctacttcccggccgggcggtggttcagcctctttgaccacgagctcgccgtcgcctcagcgacgggcaagcacgtcaccctcccggcgcccgcggacacggtcaacgtgcacgtggccggcggcaacatcctgccgctacagctgccggagctgacgacgtcgcgcgcgcg

SEQ ID NO: 2734 - DNA, 1176 bp, Zea mays
  misc_feature (1109)..(1109): n is a, c, g, or t
  misc_feature (1112)..(1112): n is a, c, g, or t
  misc_feature (1128)..(1128): n is a, c, g, or t
  misc_feature (1132)..(1132): n is a, c, g, or t
  misc_feature (1134)..(1134): n is a, c, g, or t
  misc_feature (1141)..(1141): n is a, c, g, or t
  misc_feature (1144)..(1144): n is a, c, g, or t
  misc_feature (1154)..(1154): n is a, c, g, or t
  misc_feature (1157)..(1157): n is a, c, g, or t
  misc_feature (1160)..(1160): n is a, c, g, or t
ggcacgactgcacgagtcgcggtcggtcgttgcccgcgccctcccggaacgccgccatttttcttttctccaaaccatataccctagcccgtgcacaggtgggcgcccgccgccacctgcggctcggtggactccggcatcgacacccctggcccccagcgccgcagatcgcaagctctcagcaacgcgtgcttggtaggaacccgtgccgaccgactcttcctctgcgggacggtctcgagtttggtcgggagatgggtgacgggagctgctgcgtctgcaaggaggcgccgcccaagtacaagtgcccttcttgtcgcacgccctattgctctgtcacatgctttaaaaagcacaaagaggaatcttgtcaaaagatattgcatcaggaagaaattagcaagtcagcattgcaggaggaagttacactgcacaccacatgcactgcagaatctccaaatacagcgtgccctacaaaagctcttgaagttgaggacctaagctggcttgttgacaacaatagactaaggtccttagcggaactgaaagggatccaagacgctctcagggatcctgaactgcagagaatgatacttcaaattgatgggtcttccgaatcagaaaaagaattggagaaagtgatggaaggtcaagcttttcgcgagttcactgataagattcttgacattgtcaacccacaagaataaccgtctaccctgtttggtgggattctgacgctagagtaaacagaagcatccgggcaaacaaagcaaaagtggagctcatctctgttttcctttttccaggatggtataattcataacatatcttgagtcgcctgtttttccatgatggggtagactttagaacacatactgtgtcgcctggtgaaaggaaattacgtctgctgaaaaatctctcttgccaaatatagtttttcttctgtattctagtgttgtattctagtgtggtagacagcgactctacactgactactgagggtgtgtttggtttggttttgacttttgctctctaaaaacgaaaagcaaacggcccgagccagaaagcagcttttttcaaaagcatgctttcttgccatgcaaatttgnaangcacaatttttcttgncaangnaaaatgnaangcacaatttnaanctnaaaaaaaaaaaaaaaa

SEQ ID NO: 2735 - DNA, 1388 bp, Zea mays
gcacgagaccattacctagaacatcctaatcgaaaaaaacaaaaaaagggccttcacttgactccacagccacagctagctgctgtggtgaagagtagcaggttcggcggccgggagggggcagccaacacgacgatggagcggttcggcctggacggcggcggtggcggtggcgagctgccgccggggttccggttccacccgacggacgaggagctcatcacctactacctcctccgcaaggccgtggacggcagcttctgcggccgcgccatcgcggagatcgacctgaacaagtgcgagccatgggagctcccggacaaggcgaagatgggggagaaggagtggtacttctacagcctccgcgaccgcaagtacccgacgggcctgcgcaccaaccgcgccacggtggccggctactggaaggccaccggcaaggaccgcgagatccgcagcggccgcaccggcgcgctggtgggcatgaagaagacgctcgtcttctaccgcggccgcgcccccaagggacagaagacgcactgggtcatgcacgagtaccgcctcgagggcgcctacgcctaccatttcctccccagctccacaagggacgagtgggtgatcgcgagggtgttccagaagcccggcgaggtcccacctgcagcccgcaagcaccgcctcggcgcccttagcagcactaccggcaccgccgcgggcgattcctgcttctcggactctacctcggcctccatcggcggcgcgtcgtcgtcatccacgcctggcccgctgttcgcgtcggcggccgccgccgtggccaatgccggcgccgccgacggcgacaccagctcctactgcggcggcgctgccaaccatggcaacctggtcaccggccgtgagctcgtgccctgcttctccactgccaccattaacggccccctagttgccgccgcgctcggcatcgggcagccgtacaacgcagccccgctgccgttcgagcagcagccgccgcctccggccttcctgccgagcctgcgttcccttcaggacaacctccagcttccaccgttcctctcagcaggcggtctgggcggcggcggggctctccactggctccccgccggcggcatggaggtcaaggtcgagggccgctcggcgccaccgcagatggctgtcggccccggccagctcgatggcgctttcggctggagcttctagttcttcgctgcactacatggttgtgcccatctatctagctagtagtggtttcttcatgcgttgtacgttaagcttggttaatcaactgctagtaagtgactgggtcgtcgttctaagtaatgtagtaactgtgttgtagtctctcatctaactgcagtagcagctttatttgttcgtgg

SEQ ID NO: 2736 - DNA, 3851 bp, Zea mays
gagtcaagcgggagcccgtcccccacttttttctgttagggctgcaacccatttttcaattgattttttttttcttggaaaaaatggagttgacaaactagatcttaacgaacttttcatctcattaagtgtacctacaatggctcattagttaatatgacttttaggtcgacactcatatcttggggataggtctaaggtttcatgcactcattgtcatctctaattgaagaggattgtaaacattaaatttctttctattcaattttgattagttagagatttaacccctctagtgccatttaatccacctatgagctatgatcgaacaagctcttatagtgccgtagcagtgtagcgttacagcgtccgaacgagcgggacaagtctcattgttaaaaaaatcgtatctttttaatgacaccagatgaatatatttttatataaaatttgttgctcttagtgagatatacagctttctagttttgatttaagacgcacaaaaatactgagagttctattttagatagtgttgctgaaaaaatactaaaaaaataggtagtgttagaataagaggatgtttaaaaaaagcagaaggaaccaccgcaccgatgcacgtgtaccaacccccggtgctttccaagtttgggccgctggggcttgctaggatacgggctaccaggttacagacactggtgactggtccaggccttgcaccccgatttgcgctgggaaaagtttggtaccaccttctgtcgccgcgttttctatctctcaggtttttcgtgtctccaagagagatctgatgtgttttgtgccgtgtaatattgcgttgtaacaataataatcaccagaaactttaaagagaggagatttaggagtacgatttgatgcagtcaagctaccactgtctacattgttctgggttttcaccttttaccattttctttttcaccagcagtataaagtaggcgccgtagccgtacagtaccgagtacctgccccatctcagaccacatggatgcagtggcagtcaaccttttcagtgtaaaatccatcgccctgagcatttcagagggagcagagaggacaagcgactggcctgacagcttgcctctccgctggattcgcatcggcgtggaggagcgagccgagagacatccatccatccagccagagcgcgacccggccgcgccgcgccggacgtccggaacgggccaaaaccgggggtcaaaaactgtcgccccaccacccactgacccacgtccacgtaccacacgacgcgacacgggcctccgcctctcagggtcgcttccaaaacctgacagcgctgtggttcacgcgcgccgctgccgggcgtcacatgtcgcaagccgctagcggtcgccgcggttttgttctgccagggcgagagcgagacggagggatcggcggcttttgcttttctgcgcgggcgccgcgccccccctcgtcttcttttttttttttttttgagcacaaacttggcttccacagcacggtctcggtcgtacagccagccgctgcgcgcgttggcaaccaaaatggcacgctgcgacgacgccaccaatcgcggcgcgtccacagctcgacaccagacaccacgacaactcacgcatgatgtacactgacacgtcgtctcgccaccgcgggctatttggcggcggcggcggccgccgcctcgagcctacgccaccgggcgtcgcgcacggcggcggcggcctcggcctcggaccgccgcgtggcgaggtcggcggcgcaccgcgcgtacaggtcgggcgcgacctgctccagcagggacttcacgctggccgtcacctgctgcacgcacttgctccagtgccgctccaggttgctctccacgctggccacgaacgccggcaggatcctctccgccacgtccggcgacgccgtcgccagctccaggaagcgctcgttgttccacacgtacagcgccctctccgccacctgaaaacgaaacaccatgagctcgattccctgcagagttcagtagttggttggttcacctcatgacgaggttgtactaaaccagaatccgtgaccgtgaggttattaaaatttcatcatgggttgtgctattattagcgacaacggtgaatgactggattacacgtcacgaaacccgtgacgaaaagagagaaactttataaagcagctttataatcactgaatttgctgagcggaagctgtgcttaatttggattgattactctcagttggaatcatatatttcattagaggagatgggacatggggtatggcgtgtaaaaaaaaagaaggtgtccttttgaaattgaattacacgaacgaacggcgtacgtgaagtcgacaaactttaaagtggcgccactttataaagtcactttatcgaccaaccgctatttcagtgaaaggcctgctttttcttcacaaaccatggtgctgggccgatggggcagtggtggtggatcactgaatctgaatctccaagagtatttaggaaagtggcctgtctaacggtatgttcagtgaccacatttctagaaactgagcgcactcagttgcaaaaattagcggcgttgcaaacaagtatacgtatagaaatatttttatagagtacatgagaagaagaaaaaagaagcactggaaaacggacctgagagctgtagctactgacacagcgggcgatccgggagcagatgggcacggcgagcctctggaactgcaccggctcgagcagctcgacaatctcctcgagctcctcaatgaggagcacctccttctggcagttggtgacgggccagtggcgcaggatgtccgtgaccaccgcgtcggcgagccccggctccttgcgcacgaactggagcacgcagtaggcgagctggcggtggtacgtgtgcgcccagcgcgtgcggtgcagcggcagcagcacgcgcgccaggaacatacggtgctcctccttgagcggaacggcgaagccgttgacgatgctgccgcagatctccagaagctcggcggcgccgcagtggcgctcggcggcgggcgcctcgtaggcgagccgcaggaacgcggcggccatggagcgccgcatgaaggcgcgctcgcaggtgagcttggagtagagctggtggtacacggtcttgagccggtcgcgctcgcgggggtcctcggaggcgaacagcgccaggagggcggagaggaaggcgcggtccacgtggttgcgcagcgtcctggcgtccgacgcggccaccacggagaggaggatgtcgtagaccacctgcaggtgcggccacgacggggccagagccaccgccggcgcctcctcgtcggcgccgtcggggggcagcgccgggtacgccggcggcggcattgcgcggaacaggttggcgccgaccatctccaccagcgccaccatcacgcggtggtccagcggctgccgcttgcccccgctcgaccgcacggcgcccagcacctccacgagccggtcccgcttcgcgtcccgctcctcctcgcgctccgccgcgtcgacgaacgtgaacgcgcggttgcacgacgcgatcttgtcgatcaggctgtccgcctcgggctccggcgacggcggcggcagcttggccgtgccggggagcaggccaccgtccggcttctcgagctcgaacaggaacttgagcgtggtcgacttcctcttggccgacggcggcctcggtgccacgacctctgccgcggcagcgcccatagcttggccttggctgctggtggtggtgttggggccttcacgggagaacagctcgctggctggctcaagtcaagtgcggccggcctcgaggtacccaatg

SEQ ID NO: 2737 - DNA, 6236 bp, Zea mays
gactttacctagtgctcgataaaaagtactcgacaaagaagccattgtcgatatacagttcgtcgagctttctttaccgagtgtcacactcggtaaagccttcgtcgagtgtcacactcggcaaagcgttcgccgagtgttttccaggctttaccgaatgcttcagacactcggcaaagcagtcgtttccggtagtgaaccaatgtgttcccctgtaaatacctgtagaattgatggtattaatttatgattaaaaatcacatcattgcgacatagtcaaatagatcaaaacattgttgccactccaattaaaatttcctttttatgtgcaatccctttatgggattctgagtcctccgtaatatggttaatactaggaggtttgtctatgtggaaggcaaatagaatggttcttcatatgtacactatccctgtccggtgctgttccaactgaaccattgacgtggaatctaatcaaagtttggttgcatgtgaatatcatctttgttggaatgctgatcacaagcatgtttaggtatgtatcagatctttagcgtcaatttggtctaagtactatctgtgctatttttagatctctactcctgatttattatttgttaatggagtatgaaatcatttcttggctttaagcagtcattttatttttctatgcacttgagttatgaatgcatcctgagagtaatgactatgaatgcatctagcagtgttttctcaccttccagtctagaaatacaaatgacacaagtggtaatggtggtttttagaatcagaattgaagttcgatatattctggtaaaaatgcttaggctatttgtcttttaaaaaaataccaagaaattttatttagcggttggttggttgattttgaattttaaaaatgtcttgtctgtctcatgaatctgctccattcagggccatttagttccttgtacaatgaatgaacctgaacctttttggtagttttgttgaatattttgtattgatgttttccatattagctgtgaacgattctcaatttctgactcgagaagtttgggctgaagttgagagctttttataaacttatttactccatttctaaatattttcttcaattttcagtttgaagtacactaatgttgcaatgctgactatactgaagaatgtcgtcaatgtcctgacgaggagttgatttccatcacaagtgttttccaccagataacttttagtacagatggtactagctgattgcctgattcacctgcactgccaaatgtctattcatcactgccagataacttttagtacagattgtacgggtgttgatttgctctagttatttgtagattgatcagcgtcttgaggtacgtacgacgagattgatttggtgatcctcctaatccataacgaagtggcgtgatccgatccataatctgtggttgttgacgaggtactggactcgggcgggaatggcggcggttgatccgcaagggacccccgctctttccatccacacacacagactagctcaacccaatcgctcgcatctttgggctcctgtcggtcgacgacgcttgattggcctgctgctgtaaatgtgaaacacggctagccttctacgccggcgtgttccgttccgtgtgtgtcatcttgggttctgttgcttgctcgatcttgcacgtttccgttctgtgtaaacttggaatgcagtcaaattggactgtgtaaacacatggaagcggcttccgatgactgcagttagtattagggatgttttaagggaaccatgctgctttatgagagtaacatcggagactagcacaatgggagtgcctccttttagtttcagagataaacagcttaaactggccatacaggaaatcaggcgcacacctattccttttgtgtaagttttagagtagtttggtaattcaaagttgaagcatataaagtcagctagctgtttcattatttcgcttgttcactatgttcaaactttggttgacttgatccttatcttcaaattttagtttgaatatcatagctaatatggtttattgttaacacaatataatgctgtctgatgatgcaggcaggcttccgacggacaaatttggttacaacttacaaccattctcctttgtcctgtagagtccttcagttagatgttcctgcagattctgatcacaagcatgtttaggtatgtagcagatcttcagcgtcaatttggtctctaagtgctgtttgctgtgctatttttagatctctactcctgatttattgtttgttaatggagtacgaaatcatttgttggctataagcagtcattttatttttctatgcacttgagttatgaatgcatcttcagagtaatgcctatgaacacgtctaatgttttctcaccttccagtctataaatacagatcacacaagtagtaatggtggttttaagaatcagtatcgaagttcaatatctcaaaaggattggattatctgcaccagaataacattatacacagagatttgaagtctgcaaatcttctgctaggctttgaccaagtatgcacacttaatcagtttttttaagctaataatcattagtggccattctcttcctcctttccaattttctgtacaaaacctggaaagtgcataaaggaaaaccagtaatttgtgtagtactcaatttggttttagttaggtactcaaatggacagttgttgtataatatctttgctttgaatggactaaaagtgatacaaattaggatccacttctggcaaactagaaactgcatgataaatagcatgttcaatggatatcattttaatttccaagaaatcccttgcaagttcctcaatatatatgctatactgagaaataaggccgagcaactgaatgatcatctaattacatttagaaaaaaaaaatgattcttgtaatctctcatcttcaatctctttatctatatacagaattaagctgtgttgatgccagagcttggtaaatgtttgtttttaccattgcattcatctgacctaccaagctggtaacttgtgtatctgcttttggaaataggttgtaatgctcgtagactttggtgtggcgcgacatggaagtcaggagggacagatgactactgaaactggaacttaccaatggatggcaccagaggtttggttgagaccttgtttctttccctcttggagagaagtggtttgtctttcattagtttgtatactgtttcgttgttttcattctgacttgtactttattgttcatctaacagaaactcctaattgtttccaaatgtgcctaaagttcctaattgtttccaaatgtgcctaaagttatatccaatcttttagttttagttaatatcttatctgcaaggtcagcaagtttttactcaagagttgcatgtgaactcgttaagtttcctcaagataatcttcttcatctgcaaggttttgtctagacgaatagacgatttagcttgatatattatgttagactctgtagaaggctgttttagactccatgaaattcagggcccaaccctgcaaattgcattaaatgactcgacttcctgttaaggtcatgtacacattcattttactttctgcatggtttaaagttcagcagatgtgtaccatccctttccctgaaacaaataggcaaacaaatgaagtttattttgtatctctatgtctcaggaattttctgttcccaaagacaacagatcctcttgcccgtgttcgtttccatcataatccatatggaatgtaggggattgggaatgtttaaattactagtaagtcaaaatccctctcaatctatatcaatcccctccaatctatatggattacaaataaccgaacaagccctatataaagtttgaacattctttttttttttttttttggtcacaagtcacaagagttggttatcttggacagataggtttccgtacaaaacttttgcagctatttgaccatcagctcaaaaacacttacctctctgtggatacaaaacatgaatttcaggcagtttgggatggacaggcttgttgagtcgatgtattatagtttgcaaaaaagaagaagaagcactagacctaattaaaagaaatgtggatgaaaatagtcagagacaccagcacaactctgtcaaaccacaagctccggagggaaaaaccatcccgatttctccgctacgcatagccgtggccacccaactgtaatggcacgaacagtgctggatgtggtgtcgaacacgtcgttgatacgtgttgtatagtaaacaaagccttgcctgatgcctctgcgtgcgcgagcgcacttgctgtgcgatcgactgagaaaaatcgcctcgtccttggccaatccggcggccacccacttgcccgcgctaaaatctgccttgaagacctcgagattgcaagtgcggcctaggcaatgcgggcatgcccgcctatggtgcctcacgagcagtagctccccgctcagcgactgcaccaggtatcgacccgtaagtagcaagtccttgtccttggctccaagcacctcgttgtccgagaccatctcgtcgccgttgaagctgtcctccaatgcttgttggtccgctggctcatcatcggctgcctcttcttcgtttatatcctccgggtcctcctcctcatccgtgtaataataatcatcctcctcgttgctagtgtagtcaactagtacttcttctggccacacccatccacattcataataataacaggccaacgggttcttgatgactagctcgatcttggtaacatcaggtatgtcatcctcgccgaggtggaaggcaatgagttcctcaccggaggtgattccgtacagcgtgtcgccgccaaggaacgcgacgtccacgaccctgtaatagggtagcacgcacgtgcccttcccaggacgacacaagatgacgttgcagttccagctgttggtcgtgacggcgatgaggtcgtcgggagccggcgaacgcatgagcactttaagcacccggaaggtctcggcgacatggccaatgacggcgtccaggtccgggaggggcacggtgacgttgctgaaggggttgtgcagcgcgtagacgtgcttgtgattcacgtcgggcctggagtacacgacctcctcccactcgccgcccctgacgaagcgccctgtgtcccggaagggcgtgcgccggaccacgtcgtccgtgcggtcgagggcgagccagcagtcgtaggcggcgccgaggcaggtggtgtcgtcggggaacccggggatccggaaggcggaacaggccgcgccgtggccggcggtgcaggcggtgccgtatgggagcacgatccacgggaggtggctcacgacctcgcgcgcggcggagcgccatgcgcggcacacggcggccaagcgggcacggtcgccggggatcgggaggcgcgcgatgacctcgtccagcatgtcgagtgggaggtcggcccaccctgctgctgctgccatcggctggggcggcgcgatttgctagatctatctatctgtattgccagggcaggggtacctaccagcaattcatatgacggttggcctcctgtcgacgaggcttgcttgggctgctgctgctgctgcaaaaagaatgcatggagaaaagaagcggcaggcccatggcccaaatgtgaagcatggctatcctccaccgcttctacgccacccacagcctccagctcaacctcaatcgtagggcttgctgggatgaagatcctgagaactcttaaaagtggcagtggtaatagggtaaacgaataaagttgcagctaatctggtatatatcttgagatgtcacctagtcgtcgttctaggtcaaagatgcaaaagaaatcagagggatgaaaaatacataccacagggcaaggggttccttcatttactgtttggttatatacggaacttaagtaggtctagtaatgaggtcaccatgtagttagtatatagtatattaaaatattgaggagtattttaaacaaaaaccgaccttagctcagggggtagagcggaggactgtagtgttcgcagtttaatccttaggtcgctggttcgaatccggcaggtcggatcctttttgtgtcaacaattttttttgtttttgttttcttttttatcatgcaaagcacaaagcatgagccaggccacatagtgaggtccaaagtgtcaactccactctgt

SEQ ID NO: 2738 - DNA, 2174 bp, Zea mays
gcacgagaccattacctagaacattctaatcgaaaaatcgtcgtcgtcgtcttccacaatccaatcggtgctcaccccgccggccggccggccggagcacctctataaatactagcctagggtaccccggaccggccggccggccggctgcacgcacgcatcctccgcctgccgcacccgccaccgcaagaagagggttcaaaatactcaagatggctccgccggcacggccgccacgtgttggggaggacttggaggagggcacaggcgagagctccccacctcctcggtcgccacgtgcgtccaaccccgactgccacgaggtgcagaggaagatctgcgagcgcctccgccagacggggcggcacgaccgtacgctcgccgaccccaccttcaacgcccgcttcgcccgccacctcgagaggttgccgcggaggtacctactcgacctcgacctggacgacaagctcgaggatgtcttgctgcactgggggattctcgacgagtgcgccgaccccaataagcgacccgtctttcgcgcgcggttcataaagtataagacagttcctagggaggatgacggcattggtcatgatcaagatcacgaggagccgtgtcaaaagttgttggaggacctcagtttggaaagaagaaagatcgcggacagaaatgattccctgtctatctcctctaggggcgatttgaaaactgtcctccttcatgagatcattttctcctccatcgacaagcccaagctcctaagtcggctaactgcgttgctctctgaggttggactgaatatccaggaagctcatgtgtactccacgaaggatggtttttgtttggatgtttttgttgttgatggctggaagacagaggagactgatgagctgatcgcggcgattaaggagacattaacacaaaaaaatgcatcaccatctaattcaacaaattcttcgacgccggagaaaatagttgacctacaacaacaggttggagattatgaaattgacttaagcatgctaactaggggggacaagatcgcatctggatcatccgcagacttatatcgaggaacttataaaggccatgatgttgctatcaagtgtctcagatctctatatctcaacaatccttcagaagttgagtttctgcaggaagtacttattctaagtggtgttaatcatgaaaatattctgcaattttatggggcatgcacaaaacatccaaactattgcattgtaacagaatacatgcctggagggaatatatatgactttcttcacaagcaaaataacttcttggacctccataaaattctaagatttgctatcgatatctcaaaaggaatggattatctgcaccagaataacattatacacagagatttgaagtctgcaaatcttctgctaggccatgaccaagttgttaagatcgcagactttggtgtggcgcgacatggaagtcagcaggggcagatgactgctgaaactggaacctaccgatggatggcaccagagataattaatcataagccgtatgaccacaaagcggatgtattcagctttgccattgttctttgggagctggcaacttcaatggtcccatatgacaacatgacacccttgcaagctgcattaggagtaagacagggattgcgcttggacattccgggcagcgtgcacccaagattgaccaagctgattcgacagtgctggaacgaagatcctgatgcgcgtctgacttttgcagagattactaaagaactccaagatagtctacaccatatcgaggcacccaagggagccagccgtcgatctagagcaaagatgcagaagaaataagagggcaaggtttcctacttttttttttgggtgtgttacactagttgtagtatgagtgtttaaggtgtatgtcgcggttataaatattttaaggccaaggaagtgttaaaaaccgaccttagctcagttggtagagcggaggactgtagtggattgcagatgaaatccttaggtcgctggttcgaatccggcaggtcggagttgtttttaaaataacatttttgctcaacaatgttaggctactcgcctactcacctgtcgctactctgtactcactacggttaaagtcgtgctctttttcttaacatttttacaaaaaaaaaaaaaaaa

SEQ ID NO: 2739 - DNA, 1237 bp, Zea mays
ggtccctcgaggccggccggggtgttatccagtccagtatcctcgacggtcgacgccggcgcgagcagcaaatggccaccgcggcggtgacgatgaccatggcgacgcacaacccccgcgcccgcgcacccctccgcgtctgcgccgcctgggacatgaacccgggagccgccaccgtggccacgcccaagccctccaaggccaaggccaagccgccgccgccgcccgcgaccacaaccccggcccgcccgcctcctctgacccacgccgatctcttcgcgcgctccagcgaggcgcaaggaggggtgaagaagagcacatatatgggctttgagaaatggtggttgccacctgcgccagtggtgaagaaaccccgatcgctctacagtgcggtgtcactggcttacttgggagactgcatatatgaactttatgctcggaggcacttcttctttccacctctgagcatcaatgagtacaacaaacgtgtgatggatgttgtgaagtgtgagtcacaggaccttttgttgaacaagcttcttggagaagattttctaactgaagaagaaagggacatacttcgttgggggcggaatattgttagcagcaaaactcgcaccaggaagcgtgcaggaattgctgtctacaaccgggcatcttcactcgaaacactaattggatatctttacctcacaaatttcaaacggttggaacaactgatgtttcaattgggcttcacaagtggtgcctcatcacagcatattgcagacgagctgcgctcaagtttccagaaaacaacccccgcttcggccacacctccacaacctgcaacacagtgaacaggtctgaggtgtaacggtattggatcgtgctcccacaaaggttatctttagtcttcgaccctaacgacggagaaaggacgcaagagtcacagcgtattcagatgcaatagcgaggctgggagcagatggttagcgaacaccgtattcatcagcatgagcaacatagatacgcacaaactctggagatacgcgaaaattaagactctgaatgtctgggctgacctggggcttgcgagtaggatagcttgatgtttgcaaagaagctctgagtgtgggagataggcccgacttggggtgttgtaatcgacctaaattcgtgtaggtaattaaccacttcatgttacttgttgcaaaaaaaaaactgtgatgattctgcttgaaaaaaaaaaaaaaaa

SEQ ID NO: 2740 - DNA, 5975 bp, Zea mays
  misc_feature (2517)..(2517): n is a, c, g, or t
  misc_feature (2569)..(2569): n is a, c, g, or t
  misc_feature (5695)..(5695): n is a, c, g, or t
cccacgcgtccgcccacgcgcactcccacgcgtcccagcaaccttcacgagctgcgtggtgaggttgaccaggactccttccggatcctgaaataaggccaccgctcgtttcctctccacctccctcctccttcactccctccccttgcgtttagcctcccgctgttgtggagccgcgggccattcccaaccatcgttgcggtggtggccggtattggccgagacccatgggcatccaggtcgcggcggtcgtgatcccgccgccctgctcttctccttcctcctcctcctcctctccggcgtcgccttcgtcctcggccattgccacgtcgccgcagcatgccgttcttggcgccaggctggcgaggagccagtcgtcgctggcttgctggaacgccgccggtctcggccggcggcgcggcggggagcacacgatcaggcgcgctctcagcgcgagcatcgacagcgtcgggagcgacggcggggacgacgaggagttctcgaggaggatccaggagctcgcggtgggtcagcacccgggcgccggcggctgcgggtggccggcgagcgtggagcggagcgcgagcagcgtcgggctgccgctgtccctgcggatgctcaaacggaggaagcagcagcagctggagcaggggcggtgggacgagcggctggtcgacagcgccggcgagtccgcgcgcgccgcggtggggcgcgccttctcctcgatggtgctcatcatccgggagctccagagcttcacgctgcagatgcgggagacgctcttgtacgaggacctgcagggcgtcctggcgcgcgtccacgccgagatgcacgcctccttcgtctggctcttccagcacatcttctccggcaccccggcccttatggtctccctcatgctgctcctcgccaacttcaccgtctactccatgggcgacagcgtcgcggccgctgccagcctcctcccaccgcacgcagccgtggcggctgtggagatggtggacacccagcaaccggagcaatcccattcccagcagcagcggttcgacacccccgcgctcaagacgttctccactggccgcacggcctcggtgggcggaaacggcggcgggggcggcaaggtgcggccggttgccggcgccacgggcgacggccagtcggacgagtcgtcgtcgtaccgacaaagcggagctgtgctgccgcaggacgtgtcgcaggcgacgcccctgggcgcgggcgcgggcgcggggtcggaggcgtccgtgtccgactcaatggccgtggaggaggcacagcagactgtacaggacgagctggtcatctggaaacggatatccgacgaagccatcaggatgcaggcgagcgtgcgtgcagaggagctgatggacccggagatcctggagcagctcgtcgcgcccgtggaggcaccgaagccagacgtggcctatccgtcggaggagcacgtggccacggcgcagagatacgagcaggccgtgtccgaggagcccaacagctcgctgctcctggcgagcttcgcgcagttcctgtaccaggggcagggcgacctcgacaggtgagtcggctcggcaccgaccgccgcgccgcgcgcgcgcgcgcacgtttacaatacagtaatggctcttatggtgcatgcatgcactcgctgacggaccggagctgtgttgcttttgcgctgcgcgcgttcagggcggagcacttcttcaggagggcggtgcgcgcggagccggcggacgcggaggcgctggggcggtacgcggcgttcctgtggcaggcgcgcaacgacctcgcggccgcggaggagacgtaccaggaggccatcgccgccgaccccggcaacgcgcaccacgcggcagcctacgcgcacttcctgtggaacacgggcggcgaggacacatgctacccgctcgactgatgcatgcgacgccgctaccgtccagcacggttcatcggtgcctcccatagaaaaaaactgaaacaaaaagaaagagaaaagaacactccgccgctccactccctcggcaagtccacgctctttctcacggcatgtgcttgagcggccacccggggcagcagtactagactacaagtgaagctgaagcttatacacttcgcgttacaggaaccgttggttcgctttagtgtctagtctaggcatgttctttctcttccctgtggttgctcgttctgggcaatggccgacggaaatccgcggctcgctgctgcttcccgatccggaaacccggcgactgcgagttgagagcccggccgggaacggcggcaacgctcggttgtcggtgggcccgtctgtccacttggcgtcgcatggatgttttctactggcacttttgcacggtatgccgctttgttcagtggagcaggaaagtatatatatatatacttatatactagcagcaaattgcttcttgtaactgtgcagatcaataaactctataagaagccctccattttttttccactcaagtggcagtgcgctantaggagtgtaggaccaaatgtccacttcctttcgtgaagaagatgagcaccnatgacaagcgagtacattgcatgcttctttaattttttgcattctggaatttgtattgtagccgtatctgaacgtgaacctgtgctgtgctgcgtagactcggaaagatctttaggccttgttagtttatctaggaatggaccaggaatcattccagctgatcaaaacttatataaattatagaaacaaaccggctagaaattgatccatggttccgtttcggaagaaatcaacggccccttagggcccgttcgtttctgcaagattgcaccaagaattgtttttgttgatcaaaacttatacaaattagataaacaatccaggctggaacagttccggtcttctattcactgtcaagcgaacggacccttaggaattcatgtgaaccacgggttgcggcagttgcccattagtggggcgtgtcgcgcatgcaacgctgaattgttatatacaatttgccctgcgctcacgcttttttataagaccacggttaccgagtccatcctcctgatcaaattccgagcgtatattacactgtacagagcaagttaaatttgcgtctttcggctggactcgacaaagtcaaacagataaaaaaaattacaaatttacagtactgaaaccgacgaccatgagaccaaatgtctgaagaaactgaacacatattttatagaatgcgcgacgagcggcttcaacagggagagaaattcaacaagccaaatgaaaacccctcaagtcttctgttcccctggatagtgattcggagtattatactgatatcatctcttgagaatgctagtcgaaagtcgaggggtaataaaaaaaataaagaaggacccttatatcatttgagtaaaacagaatggaaagcgataccatctcttgaggatttgcatatccggtgagcagagcacatctgtgattgatcgtttggtcgttaatggaaacattcatgttccttagcacctaagtctacgtagtaatgctgtacgcctgtacccaataacaggtttcaaatgttttaaaaaaagaaaagcagagaatatgtctgcataaatatattaaggagagaggaaaaaaccacaccttttccatatggatcatttcgtgtatataaacctttttgtaagcacaagagggaaagaaagaggacagccggattcctttcctttctttttcttcttcttcttttagttttaataaagtaagaactaacaatctgcatggcgatccggtaagccatcccgtctgccagtgtccctccctcttagaggccagagcacacaacagaattttcagtggtaacgtccttttctacggacacatactattcgtcgatcgtccttctgatgcgtgatggtcttcatcacttgctgtcaagcgccacgctggacacgaaccaaataccaaccgactgaactcgccaaagacgagcagccaaagccggaagggccatgcccagtgcggacgagaactacaagtccttggggtcgaactcatgtcacctcatcaggaacagtgctgagaatctatgcggctccgatcaagatgtgtctgtgaatggatgcggcctacggggccagtcactcactcagtcttctgtcgttgcgcactgtgttggaggctaccgggcatgatcgagcccgcattgtgccacatgcccggctggcttcgccacctgtggtgtgtaagcttgtgcctgaacttattcggagccgactgttcttgatcgcgtggagatcaagcggtggtgcggtcccgtctctgtggattgttctgctgtgtcccctgacctaactaggatccggagcttgcggtcgtttccaagaggaaaaatccacgatgaagtttggttcacaactttcatattgatgctagctaaagctgttatccataatgggtagattttttttcaaaccaaccaagctatggtcagctgtcagttcgcgttctgatacctttttctgatggtgatcgacgataatctgtttagacataatcatctcttgcactgcctgcatgtccttgaacagaactgtggttatggtgactgatcttagaatctgaacggtatcttttttttaattaagaaactagcaacgacaatttgctgcgctgaaatagtggcggttttagctgacatgggcaaggactgaaatgtgcctgattctagcttcagttctcccaagagtcccaacttccatgtctacgtctaacgaaccctgtgaggtactaccagctagcaccatgtactgaggaatggcgtcttcttgttccttggctccttgccaaatgaatcaaagcttatcggtttattgaagtcgatatatattatatagaggcatgtccgcgtgtgctgtcggcgtccggtatctgccattgccaccaccaaccacaaaggatctgatcttttccttcagttgagggctgaggccactctgggtctgcaagactgggtgcagggtttaggaagatgacgaactgaacgtattataattaagatacacgctcagataggaaaagctcttactgccgaataaactggaatgaatagtaaacactgcaatcaaacaccgaggtaatattcagagggaaaacacacaattaggttcgaacacttttcagagaacaaacttaatagcccacatcaacatcagtgtggttcgggggaaaacctgaataggcgacaaacccaataagttttatgggccatggtattagtttgggccgtttatggagatacagcccaatacaaaagtctagcctagccggactgatgttagtgtgtttggtttgacttttaattttatcttttaccccttaaaagtcaatagtcaaaccaaatacttgatttagaaatagctttttctaaaagctgactttcttgcggtgcaaatatgaaaacaaatctagacctgcttttaacgactttcgaatgaactgtgaaaatatatttagaagaacttttagcggcttttagtgtgttctaccaaacggttttagaatttttaacagctcacagcttatagcaacttttttcacagctcacaacagttttttccacaggcacaatctaaccaaacaggccctaagcctggtctgcctttaagcaaagcacctacggtntgggataggctggaacggcagctagagttagaaattttgaacaaaatttgtcgaattttgaagtttttttaaaaaaaaaattggaccttacgtgaattgttttttctacaaaattcaggatttttggttcactactaaaaaacctcataaaagcgaaaagtaattttcagtcgtgtttcggtgcttttcgatgaatcctatcaaaatttacaattttcccaacatgagaaattttttcggtccgaaacaacaaattgcaccgaaattcgcagagtaaaca

SEQ ID NO: 2741 - DNA, 2176 bp, Zea mays
gcacgagaccatcatcgggcaccgccacctcggcgccggccgggagccacaaatttcacccaaaaccaaaaaaaatcccaaattaaagaaaacgaggagaagaaaaacaactttcatcgccgtccgccaccggagctcccttcgtcggccttccttcagtgtcaacccccttctcaaaacttgtatttgcacctcagtccctgccggtctgcccggtcgccgcctcgccggaggaagcccctcgtctccttgccctgcggcgggttcatggggttctcgctgtaccccatgaagacgtccacgcggatgctctggagcactagcttcttccgccataagctcagctcctcctcctgcttcctctgaggacgccccacccgcctcgatcgcttcggcggcgggccgctgctgctgcgctgtcctagcatccgttcaagtgtgggtttgcgttcttgggtttcaagattggcttttgttgcgttcttggcgagacgaagggactagggcgcggacaaagaatcagcatgcatccgagcgcggtcagtttcgactccggcgacgggcggcggcgcggtggcgcgcagatgctgctcttcggcggcggaggcagcgccaacagcaacggcttcttccgaggtgttccgatggcagtcctggccatggacgacgcgacgcgcgtgggcaagcggcccttcttcacgacacacgacgagctcctggaggaggagtactacgacgagcaggcgccggagaagaagcgccgtctgacggcggagcaggtgcagctgctggagcggagcttcgaggaagagaacaagctggagcctgagcgcaagaccgagctggctcgccgcctggggatggcgccccgccaggtggccgtgtggttccagaaccgccgcgcgcgttggaagacaaagcagctcgagaccgactatgaccgcctcaaggctgcctacaacgcgctcgccgctgaccaccagggcctcctggccgacaacgatagcctccgggcacaggtgatctgcctaacagagaagctgcaaggcaaggagacatccctgtcggcaaccatcgctgcccaagaggtcgaccagccaaacgaacacaccacaggcactgagaaattgctggcgcagcagctcaaggacgacctgcacagcagctgcggttgcactggacatggtgccctgtcttcggaggaagaggatggtggcgtggtcagcgatgagggctgcaactttgatctccccgacgccatgtttgctgttggggtcaccaaccatggtgctgaggaggcgcagctggccaactggacatcttggttctggaactgatcggttgatggatggatgcatcaagtgcaaagagcaaatcctctcctggtttcgactcttttctgcaacatataattactgtgttgattatgtgccgtcagatgttttcaagtaatgaaacagaactgatgttgtaagtttatgtttctgaagatttgtatgttcatatatataataatatgctttgaacatgagactccaaaagttgaaataagtggatgtggagacctgttgtgcactagcagccagcatgcgtttttatgctgctttagacatgaaaatgtatatccaacacaggcctgtgaataagatgatgaaagtatatccaatcgctgcacttcatttggttgtgtgccaaaaacagttactatcctctatgttatcaagtgttacaggaatttaaaaacaaaagggagtttttcatttgccactaaaaggtgatggtacctcttatgccaacagatattctttttcagatgctcagatggaactcagcccatttgtttaaagattttggtgtttgatgattaatataactatttgaactaatatgtttgctagtgtttatatttgtagtttaaaagatatatcgtaaacttagatgaaggcaacaaggtggtcgaaaggatcaacacttcaaagcaagagattagaagagacttatcaggattatacaggagtctaggacaaaaggcaaaagaagccaagagtctaagaccaaaggcaaaagtagctcaaagagaagaaacgcgaaaacatgaaaatcaatacagtagaaaggcaccagaccaaataggaactatggttgaactaaagactgagtgcatcggacaccattg

SEQ ID NO: 2742 - DNA, 2578 bp, Zea mays
cccaaatttgagtttttcgtgcatcatatgatgacacacaggttaattgggaagcttttttttcccaaaacattttgcctggattgagcacttggtggacttgccagcacgcaaaagatgaacagttgtgtgatgcaagtccaatccctccactctcttctgaaaaaacaaagaacagagaaatgcttttcaagctagaaaagtcagcatctgtgtacttaagaaaagtgccgtaccttaaaccaagcttacgtgtccccgatccgccatcaggggcaacttagatcccaaaacagcatcatgttccgaattaaaaaattccctaatcccccaatcaggaggcaacatcacatcctaaccgagagggcattttcgtcaacagacccctcccgcttcctataaagtcccgccatctctaaccctccaaactttagcagcaaaattcacccaaaagaaactcctgataaatagaaaaaggagggaaaaagaaaaacacttgcagcggcatccaccaccggagctcccatcatcggtctatccctccgtgtcaaccccctcctcagaagttctaattgcagttcagcccctggccggtccgccgggccaccggaaggagccgctcgccggaggaagccccccatctccttgccctgcggcgggtttatggggttctcgctgtaccccatgaagacgtccacgcggttgctctggagcactagcttcttccgccataagctcagctcctcctcctgcttcctctgagcccgccccacccgcgtcgatcacctcggcggcggcccgctgttgctgcgcggtcctagcacccgttcgagtgtgtgtgtttgtgttctttgagtttcaagattgggttttgttgcgttattggggagacgaagggactaaggcgcagtgagcggacaagaatcagcatggatccgagcgcggtcagtttcgactctggcggcgcgcggcggggcgatgctgctcttcggcggcggaggcagcgccaacagcaacggcttcttccgaggtgcgtgcgtgactcatcgggagccggtcagatctggatgcgtcttgcggttctcgattccccgattgcttacccgcggcgcggtgccatgtgggcatgtggcgcaggtgttccgatggcggtcctgggcatggacgacgcgacgcgcgtgggcaagcggcccttcttcacgacacacgaggagctcctagaggaggagtactacgacgagcaggcgccggagaagaagcgccgactgacggcggagcaggtgcagctgctggagcggagcttcgaagaagagaacaagctggagccggagcgcaagaccgagctggctcgccgcctggggatggcgccccgccaggtagctgtttggttccagaaccgccgcgcgcgctggaagaccaagcaactcgagaccgactatgaccgcctcaaggctgcttacgacgcactcgccgccgaccaccagggcctcctggccgacaacgataacctccgggcacaggtagctgactcatcacctcgcttcgtctcctcggctgatcgattgttacttgatttcattgattaacacatgcgttgtccagccatcttcgcaccacagttagttacggaacgtttggtttccagttactaatttccagtcactccattttattttattttagttactaaattattaaatataaaaactaaaactctattttagtttatatatttagcaatttaggagatgaaatagaataaaatggagcgactaaaaattagtccctacaaaccaaacaccctcaggctcgtcgccgcactgctgcctcgagtgaataggaaatgccatccggattcttgaacttgtttctattgccgatttaatgatttagctttttttttcaaacggtactttagggtgattttggttgggctatggctatgaaaaaagatgttgtgactgaaaaaaatctggtgtgggttgtgacaactaaaaaactaaaagtcgtctgatgaaagctgttaaaagccactaaacgtttttccatatatatttgcaaagttttcatccaaaagccgcaggtttagagttgctttcaactttgcactgccatgccagaaagtcagcttttggaaaaagctaattgatgaattggaccatttggtttggattttgacttttggggtcaaaagccacaacaaaaaactaaaccaagcacactcttaagcttcatgttaactttaaactggcatttggtaacattgggtatcttttccagtttatgttatttatttgcctctcctctcttaaataaaggtcatcgtctgaagttcgatgtcatggtgcgatgaaaagactgcaagtgcaagcatatccgtaggaaactaggaactagagttaaaactggggaataatgtaaatgagttcatgatcatcgttgtttggatgttttgaaatgccatgtatgtcaaattagtgtcatcaatgttatcaacattactgaaacgtgggctttaagatgagcatgcttagatagtataataactttcgaccatggacccaaaacaatcgaaaac

SEQ ID NO: 2743 - DNA, 1701 bp, Zea mays
catcggggcctccggggcggccggaactttagcagcgaaattcatccaaaagaaactcctgataaatataaaaaggaggggaaaaagaaaaacacttgcagcggcatccaccaccggagctcccatcatcggtctatccctccgtgtcaaccccctcctcagaagttctaattgcagttcagcccctggccggtccgccgggccaccggaaggagccgctcgccggaggaagccccccatctccttgccctgcggcgggtttatggggttctcgctgtaccccatgaagacgtccacgcggttgctctggagcactagcttcttccgccataagctcagctcctcctcctgcttcctctgagcccgccccacccgcgtcgatcacctcggcggcggcccgctgttgctgcgcggtcctagcacccgttcgagtgtgtgtgtttgtgttctttgagtttcaagattgggttttgttgcgttattggggagacgaagggactaaggcgcagtgagcggacaagaatcagcatggatccgagcgcggtcagtttcgactctggcggcacgcggcggggcggcggcgcgcagatgctgctcttcggcggcggaggcagcgccaacagcaacggcttcttccgaggtgttccgatggcggtcctgggcatggacgacgcgacgcgcgtgggcaagcggcccttcttcacgacacacgaggagctcctagaggaggagtactacgacgagcaggcgccggagaagaagcgccgactgacggcggagcaggtgcagctgctggagcggagcttcgaagaagagaacaagctggagccggagcgcaagaccgagctggctcgccgcctggggatggcgccccgccaggtagctgtttggttccagaaccgccgcgcgcgctggaagaccaagcaactcgagaccgactatgaccgcctcaaggctgcttacgacgcactcgccgccgaccaccagggcctcctggccgacaacgataacctccgggcacaggtgatctccctgacggagaagctgcaaggcaaggagacatacccgtcggcaaccactgctgcccaagaggtcgaccagccagacgaacacaccgctgtgtcaggcacggaagaactgctggcgcagcagctcaaggacaacctccacagcagcggcgactgcactggccatggcaccctctcttcggaagaagacgacggtggcgtggtcagtgacgagggctgcagcttcgctctcccggatgccatgttcgctgccgggttcacccaccatggcgccgaggaggtgcagctggccaactggacatccatgttctggaactgatcagcggatggatgcatccaagtgcaaagatcggatcctctcctcgtctcgacccttttctgcagcatataattaccgtgttaattatgtgccgtccgatgtttttaagtgctcatgttttaagtttgtgtttttttgaagattttgtatgttcatatatataataatgtgcttcgaacatgacactcgaaaagttgaataattggacatgtcgacctgctgtgcactagcagctggcatgttttgtttagggctggtttgggaagttcatttttcaaagaattcatatttttcaaagggaaatgaactaattttacttaggaaaacggaaatccctcaagaaaatagagtttc

SEQ ID NO: 2744 - DNA, 3211 bp, Zea mays
aggaataggtaagtcttggaattcaaattttctgaagctcaagggcgtctgcatgaaaaagctgtcttcccacgacaagttactgtgtgtaaaattaaataagtcagtaccacttttgtcagcttcaatttggccataggtagtcatcagtgatgacccactactggatgcattttagctattatccaattaactgctttggattttggaatcttgggtacctatcgtacgcctcccaagtctaaatccaatagatttctccaaactatgtgatgtgaaagagttaattgctctaatctatgcatcacgccttttgaaaaacgtattgtgaattattttttatttttttgtcaactgatgtaaacagattaccaaatactcagtcatgtctagtggttctttgtaatcaaattgatggaatgacttagtttagacttgagtgactattcttatagaggtgcatgtgtaaatattacagcttaagatgtctttaatagaactaaatgcttgagaatgaactggatttaatttaaatataaaaacaatgctagattttagggaagatatgatgtagtatatatgtctaaaagatgtcatgatgtaggaagaaagacaaacacctaatataatattgcaatcattgctctattcactgagtatctgttttctccataccttaacgaatgagattggttggatcttacaaatattcgatgtaataaatatgcctaccacaatatctattatttgctttaggacctctgaaaatactgcgacttgtgtttcacagaatctacaacacgtatgctatctttcatttaatgcatcttgtagtcccttgaaattttcaaatagacagggaccagttaggtcaatcgttatattgtttgttgtactctttactcagatctgtttgtagtgattagctgccacgtataacccatggcatttctaatgaagaatacaacatgggaaatagagatacactactaaattgtttgctggcaagaaatagttaaaatatccaattggactgaacatgacacttgattatttgttctgagaaagaaaacaaatagggaaattacgaaggccttttcaaggataatagttcaacgcatttctaaagctatctggggatgtgctgatccgtgctagtttgtagagcgaatatatacagaattactaggagtttgcagtttaatcatgtttgaaggaaaaatctgaaaaaacattgacacagtgacattacacgttagaaggcactacatctttttcataaggcctctttagatggttcccattaccagatcagatcagatcacaatgccagctaattatgtttcgatgacttcctcgcccacaacgatcacctccgggcacaggtgatctccctgacggagaagctgcaaggcaaggagacatacccgtcggcaaccactgctgcccaagaggtcgaccagccagacgaacacaccgctgtgtcaggcacggaagaactgctggcgcagcagctcaaggacaacctccacagcagcggcgactgcactggccatggcaccctctcttcggaagaagacgacggtggcgtggtcagtgacgagggctgcagcttcgctctcccggatgccatgttcgctgccgggttcacccaccatggcgccgaggaggtgcagctggccaactggacatccatgttctggaactgatcagcggatggatgcatccaagtgcaaagatcggatcctctcctcgtctcgacccttttctgcagcatataattaccgtgttaattatgtgccgtccgatgtttttaagtgctcatgttttaagtttgtgtttttttgaagattttgtatgttcatatatataataatgtgcttcgaacatgacactcgaaaagttgaataattggacatgtcgacctgctgtgcactagcagctggcatgttttgtttaaaaatggtttgggaagttcatttttcaaagaattcatatttttcaaagggaaatgaactaattttacttaggaaaacggaaatccctcaagaaaatagagtttctaaactagccatgagtttattatgctgctttagacatgaaaatgtgtatcgccctgtgaataagatgatcaaggtatatccattacacaacctctgccacttcatttggtgtatgtgacttctgttttctgctacccaagaaaaagttcgagttaactagcctctatgggctgttgagtgttacagattatttttttaaaaaaagaactggagaaaattttttattgccaatacaaggtgatggtatctctcacgccatcagctaagtgttttcatatcaaagcaaaggaaaaaggaatactgtggtcgcgaagaggtatatcatgtgttttatggagcccggcagggatttcttcttcaaagctttggtttgtagaaatatatgtaactctaaaaacatcttgaccttagtttgatttttgatttcggtgattaagaataacatgagattactgtgattaacgtgtattttgcagaaacaaaataagtcagattataacattaaaatgtgattggcatatacctttattgataatatggttgttctttaaagaatggactagaaggctaagtatcgacaagtggtgggatacataaagtagtgatcgaacatttacttttctttatctgtactataacgtaggatacgaaatatgtagcttgacctacgtatgtctagttaggtgtcatggtgcaaatttaccaaaactattgctagataaactcaggagagtcaataaattttttgaaacaaagcctaacatgaaaatcaattaaaacaagttaattgatgatgctgcagtagcatcaaaagtatctagtgcatcaccggataaagcagtggacatgagtgtccctcgatcgggtttagagaaacattaccatataagtcacccagagggtgtgcacaagtggactaaagacacttgtgctcatcgaacatgcctagtattccattatatatggcactaaacagagtactcaagaaactatgtctaagaggttgagtactgattggatgtgtccaacatgacaccagatagggtactttgagagttctgcaattgtgcaattcgagtctatactcctcaaacgtgtccggtgtggcactggtttgagcatcagataccaagtacaataacggatag

SEQ ID NO: 2745 - DNA, 3400 bp, Zea mays
tatctcgacgtttcagacaacagagtacagctaaatgcaggcaaacatggctgtctgaaacgttaattattaatacccgatgtagtagtattctccatatttccagtcagtcagagaattggtagtagtttaaccgtccgttgtgatagcttctaatttatgctacaatttcccgcgcctccgcgcgcgcctcggggcttgaaaggtttggactttcagagcctgtaccattttacagtgggcgctcctgtgcttgacaagaggataatgagtctcccagcttaccctggtcccggaattgacgcatgatatcttgcctcgggggaattttttgtcgacagatcaacaaagaaccgtggagcctgactgttttggtttatgtgtagtggcatgcctgaaatctatgcattgcatgccccggtactacccaccactcgtatttatctagttgttagccacgatgctcctatgttgcaccagcgtacaagtatgtcccgatgttccagtgcgattattctggtcctcaaccaggtatatagtttggtatattgtgcaactaatttttttgccacatttactagaataaggagggcgtacaaaattgtagaagtagagatacaacaagaagaaaaaaaacagggaatgtaaatcctctttgcgactatacacttagaacgaaatttctgcatgtatagaatggtttatgcatcctgtccaaatcagaatggcatctgtaaactgatagtgcctgaatctacctgcttgcttcatcgattcctgttcttgcttttgacgtcttttgaagggaatttgctgcataacgtgctataaaacttcaagtatgccttgccctggtttcgaatatgtaatgtaataataaaattccgtgaaaagctgccagttgcacatacgtctcgtgttcgatacaattaatcaattatgtaggagtatcatgtaaagaaaaataaacattcagtgctagcgtgaggatctctgatggtactatatgactgcttgcttagttcgaaaagagagatctagcctgagtcatggcgcatgaatgcatgcgtccgtaaaagtgggtgggcgccgagccacgaccatgactcccgagccctcattttggttgggtcgtagggcggcggcgcacatgtggcggtgggggcgcagtgaaaagacacagctgcaaagataggcagtgttgcagtgatgaacccccactagcggcgaggcgataatgttgtttgccaggacctgctaaattgcggaaaatgcacgccgagcgcccgagcctatctgcctgtcctttccgtgctctgccacagcaccacttctagtcagccatttcgtccaagccactcctctcttgatggctgaggcggtgactgaggtcacagtcacaggcacttgccatgttcttgcccgttgcgatcgttatcgcggtaggtttattatttccatgtctttgacttgctctctccgtattattaggagtaactgcaatgctcaagctcaacaccagggacaccgtgtcaattgtgggacacgattgttggtaaatacattctctacagttattacgcggtactgcactacactctgggtatccactcgtgcccctgtatgaagctggcgacgctgtacgcgtcgacgtggaccttgggaacctggctgctccacgccaccctctggcccgcggcgccgccggggccggcgctgtcgtactcgccgtagtagagcgtctggagcgcgaagtccccgttccacggcatccacccctgcggctgcacgatctccgcgagcgtgcacccgacgtacacggtgcgggagtactccttccacgggcggcccaggtacacgtggtgcacgccgggcctctcgcggtacagcgccatgtactcctcgctgccgttgacggagcagcggctgagcacgatccccgtgggctgggccgggtcggtgcggccctgcgccgtgacggcgtcgttctcgcccttctccggccgcagctgccgcggcagcacgacgagggcggtgtcgtggagcaccgcggcggagttgccgaagacgaagtcgacggtgcccgccacgcggcaccgggtgtagaactggcgcatggcgtgcgcgtacagcgtgtcctggtgccccagcagctccacgccgtccagcaccgtgcggtcgcccgtggaccggaacgccacggcctggtgcgcgtcggggcccgccgtgttcgcgatcgtcaggtcacgcgccatgaacccgtccgccagcacgcctacggtggcggtgttgaaggtggacacgccggacgtgtcagcgttgagatcgccagtgatgaccgtcttccccatgccgtcgccaacgaggaccacgttggtcttctcccacggcacgctcaccgtctccctgtacgccccctccttcacgtgcaccacgaacgcgccgtcgccgtagtccggcgcggccgccaccgcctcccgcaccgtcctgtagtcgcacccggcgccgcacaccgtcgcgttcgccggcaggcccttgggcacgccgagcgcgtcgacgtcggcccccgagctcgcggcgggcggcggccagtacccgtcgcgctccgtctgcgggggccgccagagggacgtctcgtcgccgtagcgctgccgcgcggcgagcatggagatgtagttgctgttcacggtgatggtgtcgtcgaggtaggccatggcgtcggagatggtgcgggagaagttgacgtacttgtacgcggaccagcagtcgtagaggtggagcagcgccgtggaggcggagagcagcggcggcgccgagggggacggcgagaggcggcgggaggagagcgcgaggaacgtgaggcagttggtggcggcgttggagaggttcacgttggaggaggacgccagcacggatttggccgtggagacggcgggcgggaggcggacgcggagcgccgagagcgtcgcgtcgaggaggtcggcggtggaggcatcgggcgcggcgccggagagcgtggagacgcaggccggatggaaccgggtggcgttgcaggccaggagcaccgctagcggcgcggaggagggtgctggggacggggacggggacggagaagcgggtggggtgctgtgatggtggtggtgggagcagagggagacggggagatggaagaggaggaggaggaggaggaggggaaggagtccaactgcaggaggcattgctgatggttggacggcgttgtgtgggcggcgcgcgaccgagaggagcagagccgctctgcttctcgctactgactctgactcagcggcggccgagtggttaaatcgcggatggagatggcgacggttggagacgggaagggttcttttcgattaggatgttctaggtaatggtctcgtgc

SEQ ID NO: 2746 - DNA, 716 bp, Zea mays
gcgcgcgctggaagaccaagcaactcgagaccgactatgcccgccttaaggctgcttacgacgcactcgccgccgaccaccagggcctcctggccgacaacgataacctccgggcacaggtgatctccctgacggagaagctgcaaggcaaggagacatacccgtcggcaaccactgctgcccaagaggtcgaccagccagacgaacacaccgctgtgtcaggcacggaagaactgctggcgcagcagctcaaggacaacctccacagcagcggcgactgcactggccatggcaccctctcttcggaagaagacgacggtggcgtggtcagtgacgagggctgcagcttcgctctcccggatgccatgttcgctgccgggttcacccaccatggcgccgaggaggtgcagctggccaactggacatccatgttctggaactgatcagcggatggatgcatccaagtgcaaagatcggatcctctcctcgtctcgacccttttctgcagcatataattaccgtgttaattatgtgccgtccgatgtttttaagtgctcatgttttaagtttgtgtttttttgaagattttgtatgttcatatatataataatgtgcttcgaacatgacactcgaaaagttgaataattggacatgtcgacctgctgtgcactagcagctggcatgttttgtttaaaaaaaaaaaaaaaaaaaaaaaa

SEQ ID NO: 2747 - DNA, 2680 bp, Zea mays
ctggccggcccatcttgccccctcccgcttctggcctgccgcgcctcgaggccggccgggaactttagccacaaatttcacccaaaaccaaaaaaataataatcccaaattaaagaaaaggagcagaagaaaaacaactttcatcgccgtccgccaccggagctcacttcgtcggccttccctcagtgtcaacccccttctcaaaacttgtatttgcacctcagtccctgccggtctgcccggtcgccgcctcgccggaggaagcccctcgtctccttgccctgcggcgggttcatggggttctcgctgtaccccatgaagacgtccacgcggatgctctggagcactagcttcttccgccataagctcagctcctcctcctgcttcctctgaggacgccccacccgcctcgatcgcttcggcggcgggccgctgctgctgcgctgtcctagcatccgttcaagtgtgtgtttgcgttcttaggtttcaagattggcttttgttgcgttcttggcgagacgaagggactagggcgcggacaaagaatcagcatgcatccgagcgcggtcagtttcgactccggcgacgggcggcggcgcggtggcgcgcagatgctgctcttcggcggcggaggcagcgccaacagcaacggcttcttccgaggtgttccgatggcagtcctggccatggacgacgcgacgcgcgtgggcaagcggccccttcttcacgacacacggtcgggcggtgccatgtgggcatgtaacgcaggtgttccgatggcggtcctggccatggacgacgcgacgcgcgtgggcaagcggcccttcttcacgacacacgaggagctcctggaggaggagtactacgacgagcaggcgccggagaagaagcgccgtctgacggcggagcaggtgcagctgctggagcggagcttcgaggaagagaacaagctggagcctgagcgcaagaccgagctggctcgccgcctggggatggcgccccgccaggtggccgtgtggttccagaaccgccgcgcgcgttggaagacaaagcagctcgagaccgactatgaccgcctcaaggctgcctacaacgcgctcgccgctgaccaccagggcctcctggccgacaacgatagcctccgggcacaggtagccacctcatcaccttgcttcgtctccacggtaatttttacttgattttatgggtgaccacatgcgttgttcatgcatcttcgatctccacttatgatgcctaggtagatcggataataagaaatgccatcgggatccttgaacttgttcatattgccaacttaatgattaagctacaatttttttgaactgtccttaagcttcatgttaactttaattggtattggtatcatttgtaccttttccactatatgttgtttatttgcctctcttctctgttaaataaaggtcatggtctgtagttgcatgccatggtgcaattaaaagattgcaagtgtgcgcatatccgtaggaagtagagctaagatttaggaataacggatatgagttcatgatcattgttgtttggatgttttgaaatcccagcatgtatgtcaaactagtgtcatcaatgctatcaatattactggaacatggggttttaagatgagaatttttagataatataatacctttcgaccatacactcaaaacaatcgagaacttacaccagtagtgttgctattggtagtaggttctttcttaagtttgaatttaattctcatgaaacagaaatagtcaactcgtctttatgatgcttatgtctgctgttcccatccaagacatttatgtcgagcaattgtcaattggcaatcacaaacccttttaatggaggtcgctaagattataaggagttctgagggtttagctataaaattgtaggtcttggaaatcaaattttctgaagctcaacggcctttgcgcgaaaaagctgtcttcccagaagagggtactgtttagattaaattagtaccacttttgtcaccttcaatttggccatgggtagtcatcagcaatgacccactactggatgtattttaggtattatccaatttaactctgcagttcttaggaatttgggtacctatcgtacacctcccaagtctaaatccgataaactatagaaagcctatgtgatgggaaagagttaatataattgctaacctatgtgttggggaagagttaattgctctaatctatgcatcacgccttttgaagaaaacatattttgaagtttttttggtaaacggatgtaaacagattaccaaatactcagtcatgtcatgtgcaactgtagtggttcttttgcaattaaatcaaagtaatcactcagtttagacttgagtgactattcttatagaggtgtatgcgcaatattgtagcttaagatgtctttattaggtctaaatgttttagaatgaactggatttaatttaaatatcaaaataatgctagattttagggaagatgtgctctcgtctaggggtggataacgagccggctcggctcggctcgtccgagttcgagctggctcgttaagctaacgagccagctcggctcggctcgttaaggtaacgagccacagagtcagctcggctcggctcgtttacgagctcgagctggctcgtttagctcgcgagccagag

SEQ ID NO: 2748 - DNA, 2024 bp, Zea mays
  misc_feature (17)..(17): n is a, c, g, or t
ggaactccagctccccngttttataaaaacaaaacaagccggcccggtccggacctgtcgttgctctccgccgccaccagtgcccgtagcgctcgccgccgccgccgccgccgccaccaatggagagcctccggctcgccgtcacccaccgaccggctctccctctcccgacctcccatagccacctccgccgccgccatctgcacctccacctccactcttaccccaatcccctctccctctcaccccccatcgcctcccacctctcacctatccctcgccgccacctgcccccgctcctcgcctccgcatcggcctctcaagcgagctctaagccggcggcgtcggcggcatctggcggtgctaaaccgctgcccctctttctctcgcttgccgccggcctcgccgtccgcttcctcgtgccgcggccggccgaggtaaccccagaggcctggcagctcctctccatcttcctctccaccatcgcggggctcgtcctcggcccgctccccgtcggtgcgtgggcgttccttggcctcacagccaccgtcgccacccgcacgctccccttcaccgccgcgttcggggcgttcactaacgaagtcatctggctcatcgtcatatccttcttcttcgcgcgcggctttgtcaaaaccggactcggcgaccgcgtcgccacctacttcgtcaaatggctggggcgcagcactttgggcctatcctatgggcttgccatcagcgaggctctcatctcccctgccatgcccagcaccacggccagggctggaggtgttttccttcccatcgtcaagtcgctatcgctctcgtccggaagcaagcccaacgatccatcggcgaagaaactcggctcttatcttgtgcaatcgcagttacaggcagctgcgaactccagtgctctcttcttgacagcagctgcacagaacctgttgtgtctgaagttagcagaggagattggtgacactcctgaagccccagcattagctgccgagaagctaaagaacatgggtccagtaacaaaaaatgaatgggtcatgattgggacgatgcttcttgcagtctcactatggatttttggggaaactattggcgtatccagcgttgttgctgcaatgattggactctcaatacttcttgtgcttggagtgctaaactgggaggattgtttgaatgagaagtctgcatgggacaccctagcttggtttgctattttagttggtttggctgggcagcttactaaccttgggattgtgtcctggatgtcgaattgtgttgccaaggttcttcaatctttctcattgagctggcctgcagcatttgttgtccttcaggcctcgtacttctttattcactatatatttgcaagccaaactgcacatgttggagctttatactcagcatttcttgcgatgcatttagcagctggtgtgccagctctaatgtcggcacttgctttggcatacaatgcaaacctctttggagcactaacacactatagtagcgggcaatctgcagtatactttggagcggggtatgttgaccttccggatgtattcaagctgggttttataacagccgcaatcaatgctgtaatttggggagttgctggtgcattatggtggaaatttttgggtctttattgagtgtcggggcagtgtaagtacgtgaaaatcgtaccatattatcaaacaagtaattcatgatccagcatcggaggtggccaggtgggttcgtttttcttccgagggcctatgaatgcatcataacagaggaacgctcatctttagaagtttttgagcattatcatcaacctagaaagcagatatgttttcgtaggttcttaaatcgacggtcgttatatatcctttgatttgattgttgtaccctcgtatctcctccccaaggtaaataaaatgcatgagggacttttgaattttgatggtccaaatccatgaaaatcaagtgcatgaaaagtctagcacaaggaaactgtgcagtctgctatt

SEQ ID NO: 2749 - DNA, 1737 bp, Zea mays
ctcgcttgccgccggcctcgccgtcccattgggaccctcgaggccggccgaggtaaccccagaggcctggcagctcctctccatcttcctctccaccatcgcggggctcgtcctcggcccgctccccgtcggtgcgtgggcgttccttggcctcacagccaccgtcgccacccgcacgctccccttcaccgccgcgttcggggcgttcactaacgaagtcatctggctcatcgtcatatccttcttcttcgcgcgcggctttgtcaaaaccggactcggcgaccgcgtcgccacctacttcgtcaaatggctggggcgcagcactttgggcctatcctatgggcttgccatcagcgaggctctcatctcccctgccatgcccagcaccacggccagggctggaggtgttttccttcccatcgtcaagtcgctatcgctctcgtccggaagcaagcccaacgatccatcggcgaagaaactcggctcttatcttgtgcaatcgcagttacaggcagctgcgaactccagtgctctcttcttgacagcagctgcacagaacctgttgtgtctgaagttagcagaggagattggtgttagtatcggaaacccatggattacttggttcaaggtttctagcgtgccagcagttcttgggcttttagtgactccttatttgatttacaaaatattcccccctgaaataaaggacactcctgaagccccagcattagctgccgagaagctaaagaacatgggtccagtaacaaaaaatgaatgggtcatgattgggacgatgcttcttgcagtctcactatggatttttggggaaactattggcgtatccagcgttgttgctgcaatgattggactctcaatacttcttgtgcttggagtgctaaactgggaggattgtttgaatgagaagtctgcatgggacaccctagcttggtttgctattttagttggtttggctgggcagcttactaaccttgggattgtgtcctggatgtcgaattgtgttgccaaggttcttcaatctttctcactgagctggcctgcagcatttgttgtccttcaggcctcgtacttctttattcactatatatttgcaagccaaactgcacatgttggagctttatactcagcattccttgcgatgcatttagcagctggtgtgccagctctaatgtcggcacttgctttggcatacaatgcaaacctctttggagcactaacacactatagtagcgggcaatctgcagtatactttggagcggggtatgttgaccttccggatgtattcaagctgggttttataacagccgcaatcaatgctgtaatttggggagttgctggtgcattatggtggaaatttttgggtctttattgagtgtcggggcagtgtaagtacgtgaaaatcgtaccatattatcaaacaagtaattcatgatccagcatcggaggtggccaggtgggttcgtttttcttccgagggcctatgaatgcatcataacagaggaacgctcatctttagaagtttttgagcattatcatcaacctagaaagcagatatgttttcgtaggttcttaaatcgacggtcgttatatatcctttgatttgattgttgtaccctcgtatctcctccccaaggtaaataaaatgcatgagggacttttgaattttgatggtccaaatccatgaaaaaaaaaaggaaaaaaaaaaaaaaaaaagcggcc

SEQ ID NO: 2750 - DNA, 2095 bp, Zea mays
atatcccccaatccccccttcccctccaccattgggtacctcgaggccggccgggaaccaatccctactctccctccttccgtgttccgtctctcaccacctcggcacaccctagctgatctggtggcatcggccggcgcacggcgatgcctgccacggtcttcgcctccccctccatcgccgcgtcgccgttgccgtctccgtcgtccccacgtccgcctcctcgtcgcgtccacgtccgtgtccgcgtccgcccgcccccgccgagaagcggaagcagcgggggcgacgagccctctaatgccaccccgtgggcgagccccgactggctcacgtctctctcgcgcgcggtcggccggagcggcggcgacgactcggggatccccgtcgcgtccgccaagctcgatgatgtgcgggacctcctcggcggcgcgctcttcctgccgctcttcaagtggttccgcgaggaagggcccgtgtaccgccttgccgcggggccacaggactttgtcatcgtcagcgaccccgccgtcgccaggcacgtgttgcgtgggtacggctcacgctacgctaagggactagtcgctgaagtctccgagttcctcttcggctccggcttcgccatcgcagaaggcgacttatggacggtgagacgcagagctgttgtgccttccctgcacaaaagatttctgtccattatcgtggacaaggtattttgtaaatgtgctgagagactaatagacaaacttgagccatatgctttgagtggggaacctgtcaatatggaagcgaggttttctcagttgacattggatgtgattggtttatcattgttcaactacaattttgattccctcacaacagatagtcctgtcattgatgctgtttatactgcactcaaagaagcagagcttcgttctacagatcttttgccatactggaaggttggtttcttgtgcaagataatcccaagacagataaaagcagagaatgcggttacgattataaggaacactgttgaagagctgattatgaagtgtaaagaaatagtggaagctgaaaatgaacagattgagggtgaggaatatgtaaacgaaggggatcctagcattctacgcttcctacttgctagccgagatgaggtaagcagtgtacaattacgtgatgatctcttgtcaatgttagttgctggtcatgaaacaacaggctctgtactgacgtggacaatctatcttctcagtaaggatccgactgcactgaggagagctcaagatgaagtagatcgtgttctacaaggtagactacccaaatatgaggatgtaaaggagctgaagtacttgatgcgctgtataaatgagtctatgcggctgtatccacaccctcctgtacatttcttgtgctagtgacatgcaactttataattggttttgttgactcatggactaattactgataggtgctgttacggcgtgcaatagttgatgatgttcttcctggaaactataaggttaaggctggtcaagatattatgatatctgtgtacaatatacataggtccccggaggtctgggatagagcagatgagttcattccagagaggtttgatttagagggacctgttccaaatgagtcaaacacagatttcaggtttattccattcagtgggggtcctcggaaatgtgttggagatcaatttgctctcctagaagcaatagtggcacttgcagttgtgttgcagaagatggatatgcagcttgtgccagatcaaaagattaacatgactactggagctacaattcatacaaccagtggactatatatgaatgtaagcctgcgtaaagttcagcaagaagctgagttagcgctgagcgaatcgaaatagatggaaacaacttcagacaagaatagagcacctgaactggctacaaatatgtttctccagtttctcgttgaaagctctactgtactatactagatgtcaatgcgtcggcatacagattacagattcgcttctcttgaaacatgaaaggatccttcgctggctgattcgtttggctattcgtgtgtaaaaaaaaaaaaaaaaaaaaccccaccc

SEQ ID NO: 2751 - DNA, 3401 bp, Zea mays
  misc_feature (462)..(462): n is a, c, g, or t
  misc_feature (648)..(648): n is a, c, g, or t
tactgttatcatttacgttatatttttgtgaaccaaacgacaccattaatcatggcaaggccaatatgaatgatgttcataccagcatcgttggcacataagattccaatgctcacagttatatgatttgtagaactagtgtcgattatgtacgcttgcattgcgtagctactaatgcactcttattgttatttgatgtgtagctttcatcaaacttgtactaatagttgagggcatagtattctatctacccacgtacctaggggtgacaatgagctctaaattttacactataaaatttaaggatcagatcggattacgatcgagctctatttctattcattttggaactaaaatatttatagggttccagcaaattttaaaaaatatttggatcatgatctattaccacccctacgcatacctggtagggggtctgtcgttggtgtggttgaagtaacncctcccactaggtattctatatcttcctagcaaaagtccatggccgtgtgtgccgctaaaatgtctgtatgatacatcaagaccacatgaactagtcctagttccgccatgaccatgacaggcaacattggcagagcattgtgctctaccttgcaagagatccatgtggctctcaaatctgaacanttgcaagaataatttgccaattgatattagtccaatttgtgcggctatgatagtcatatgggattaaatcaccatctaatgtcgctagggtttataacattagttcatcatctttgattgctttggtagcagaggccatattatctgcagcagatctcatcttgctcatgtattaatgaattgactaattacctttttgagtttttgtaggcgctatgcatgtattcattgcacgtgcatgtgatttggttgtgtatatctactctaagatgcgatttggtcgtgtatatctactctaggatgcgccaaaccttgcttggcattccatggagacaacttgtattagaatctcttgtgaaatggaggtcataaggaagttaaggacttgctgctcggtgagtagtttggattagcctatttgacttctttatcaccgaccttgatgacgatctctgcgacaaggcaacattagtctcgtcaataaagccgatgagctgcacaccattgagcgcaagcaagacttgtgccctccatagaggataatcgaatctggagaggttcttggtgatgatgaagccaacaagagaagatatggtagcttatggtgttggtaggatggatctagatgtgttgttgtagagaggtggcttcgataccaagtagaaaattatcaaagataagaagcgttttacctcgtataaaaaggccgtgtatttctatttgtgagatatgaatagacaaaaatgtccataatggatttggtctctatctataaaccataattaatttggtttgtatagatcatggtccctctattcttttttgtttgtcgtgttttagtttaaaaataaactaaccgacgataaatattcgatgacggaagtagtagttgtttaataattcaaaatatagaatcacaaactagattaatcacgtgtagatagtacattcaactgggaagacgggaacgaccagccgccggcgcacaacgatatatggcccaagtggagctaatcctgtgcaaataaattagaaagagtgaatggaaattctgactcaaattggttgcttaggccacaggaagtcaagatcgcccattatatttctggtgtttgcttttggtcagaggaataaagcggattcagtccgaacaagacctgccatatgtatgttggtacccaaagtttgcgatagaaaccgaatcagacggtcaattttaccaagtctaaacccaccccctggtggacacgttcaaactatttgatttttgtaatcagaaaattataacgttcggatggttcctcccactagcacagaagaaaataacacctctttctatattccgtggcaattttatatgtgcccaaaaaaattatacataagcacccaatgcgtgcattcacagaccacaaactctcggtccgcaatgattgcaacgttgcaattgcttatcgttcatctgtcttgcattcgccgtctacccaatgccaatgttctaagccagaggcctgaggtccatgataagaatggaagccattgacgggttgcttgcaagtcttctcttgcttgcgcgtaaacacaacacagcatacatgcgttccacaaacctactctttccataacacatcatccaccaaagaacttatatactctctccacaaggatccaatccatcttggttattcgtccgcacgatggcgtccaagaaccaagttgatctcgagtcccagaagcccacgccgatgcacgccgtcgttgcatcggctcccgcagctgccgtgccggcttcttctggtacaggctccgtcgttgctggcatctccgacgctgcgccggagacccagccactcctggctgagccgaacggccacagccaggaggaggggctggaagacggtggggctaccgacgacgagacaacgcagctggagcgagcaatggcgcaggcgttccggagcaccgccgagctggccaagcacctccccaccggcgcggtgctcgcgttcgaggtgctgtcgccggtgttcaccaacggtggcaagtgcgacgatgtgaaccgcgtcatgacgtcctggctcgtggggctctgcgccgcggcgtgcttcttcctctccttcaccgacagcttccatgacgccaaggggaccgtgcggtacgcggtggccactcgccgcgggctgtgggtcatcgacggcacgccggcgccgccgccagtggaggccgccgagaaacggatcaagttcatcgacttcttccacgcgttcttgtcggtcatcgtgttcatgtccgtggccatgttcgacgggaatgtcggggcgtgcttcaaccctgtcatgtcctacgacactcggcaggtgctgactgccgtgccgcttgccggagggctcgtcggcacgctgctcttcgccaccttcccgtccacacggcacgggatcggattcccgatccacgcttcctgagatacgcctgttgttgttgctacgaactagcagctgatttctttgggttgcgtgtctccatgttcttagagctaggtttgttgtgccggggtcgtattgggagggttgacaaacacagacagtaccattggttgggaacttcggatattcctggacatgcattattgtttatatttttagcttgcgacctcaagtaattaataccggtgcaaaggtatattatatgcaattattaatttcatacgttcggcttgctaactcttttctgcgagtagaaaataaaaaaaaaaaaaa

SEQ ID NO: 2752 - DNA, 796 bp, Zea mays
gccggccgggttgcagtgcggcgctcgccgcggcggcgggaaggaatttcttcatctggtggtcttcttgttcaatccccatctcgatcggggaggccaccaaccaccatatggcgggagggaaggtttactcgttcgaggaggtgaggaagcacagcgaccgcaaggactgctggctcatcatcgccggcaaggtgtacgacgtcacgccgttcatggaggagcaccccggcggcgacgaggtcctgctggcgtccgtcggcaaggacgccaccgcggacttcgaggacatcggccacagcgcctccgccaaggagctcatgccccagtactgcatcggcaaggtcgacgcggctaccttcccggccaagcccgcctacgtcgtcaccaaggacgacgccaggtcgtccgagaaggccgcgacgagcgccggcgcttgggccacgctcctgcagctcgccgcgcccgtcctgctgctggcgctggccttcgcgctgcagcagaactatgccagggccaaggcggagtagacaagatacagatagataccatcgttgattccgctgagtcgcggccgtgcggcctctttggaagcatctgaattacattttcttcctggcaaaattaactactcgtggtttcgttactttcgtaataatggttacattttcttcctggcaaaaaaaaaaaaaaaaaccgcccgggtgcataggaaggacttttacgctggttgcactaaaaatcaaaacacttcgagcactactttccacagaaaaaaaaaaaaaaaaaagcggcc

SEQ ID NO: 2753 - DNA, 1374 bp, Zea mays
gcacgagaccattacctagaacatcctaatcgaaaaacactgcaagccattttttccttctgctttcgcctcctgttagcgtctgaacctcccggtagtgcctgtatcttcgccagcgcttagttctccatcctccgcctgcctgtccctgtctcccctgccggtgcctttgcccatctctgctagatcgggcccagatcgggccctgtagtctagacctggaggagtcaagcacctgtcctactgaagctgcagcataccctaatcgatgatcggtggtcttaggactagcctcaatcatacaatctcataacatttttctccactcgttgtgactacaactaacgcatgttagccttgtgttcattatgtaaatttgttgcatgttttgtgaaaactatgatttttttaaacatggggcatctaatagaggatggcgagtaaactagtagcatactgatggagcaaatgatggcaggagcaacaaacagaccccaggaactggatgaagcagcacgcaggcgactcacgaaacgtctatacatcccccttccttcattaggtaacactatttcttttcttttatacttatcatttcagaaaccttagtgcaccatggttgtgaagaagcacgggcttggataattcgcaatctattggagaaagatggacttttcatgctctcggaagaagaaacaagtgccatctgtaaattaactgaaggctactcaggatctgacatgaaaaacttggtgaaagatgcctcaatgggaccactaagagaggctcttcagacgggcgttgaaatcgcaaagctcagcaaggaggatatgcggccagtgatgctgaaggatttcgagaatgctatgcgggaggtaagaccttctgtttcctcaagcgagctggggacttatgaagaatggaacaggcagtttgggagcctatcgatctagtctgtcggcaggcatcagcgaatacaatcatgtcggcactatagaaaaaggagctcaacgattttagccggaacatgacatgcataacacagctctacagtttaacaatcttttgaagcatcaaaatttgaactgtctatttggagtgctgagtaatatccaggagcctacaaatcaaatagtttcaattgtttttaaatcttcacttttctgtaaatttgtttgccttggttttgattgacatatgactagcgcggaagtcaaatactctgttccaaattataaaatgttttagcttttccgcatacagttttttagatgaataaaaaaattaatgtatctataaaaagcaatatgtaaagagatggtacaacattgacaacaaagaagaagatttgtgggtccaaaaaaaaaaaaaaaa

SEQ ID NO: 2754 - DNA, 2530 bp, Zea mays
ggacgctggctaggtcagttataactttcatatatgtgcttccatacactttaatgttagtagtaacattgctgttagcagattaaaaacttagttaaacatatgcgtactcacatatttattatttctctttacatcaaggattcccatggacatgtggttgtccattacacagatgttgatacaaatgttcagctccttttgtcggaccgttgctcatgttgcagcccgaggttgtagctacacaggaacacaaattcagcttttgagcttgcaagaacggatgttggctgtgtttttgcaaatcagggtgacaataatgttgaaagaatccagcgttcgaagtatttccaagctcttcttcagaagtctaaagcaaatgtttctgaacaacggaatgcaacatgtcaagagttctcagttcaatgggctccatgcgtcgatgaaagccaagctgaaatggaaaatgagaagctaagcatcagggcttcaaagttaatgatgcaaacgaagttgacatcattgtatagcagtaagtccttgaagacaaatggcgtacccaacaaaaatatgttcaaatcagagaactcatctaaagtgtgtgccggtgttgaaaatagaacaagtcaaaatagtaacaggcggcatgcttacctggacgttgaggaggatgagaaatcccatgggcaattgcagaatgcaaaggggaaacatacaggggtcagaaggcctatttttgaggttgcaaattctccatcaagtaatgatgaagctgatgctcctgccaatgagtttacgactgccaagagaatgatggggttggatgttgtgcaaaagccagcacaaaatggtccacaaggtgcttctgtatcaccacaatgtgataacaactatagtacacggaattatggcgtgagaccaagttggaattctcgtcgtggaccacgtggtagttttataccccctatcagaaacaatggaggatcaggtacaacgatctcacgggtcactggtaaaaatgacgagtccatggaagattcaacaaggaaatgtattgaaatgctttgtgctcctgatggtgagcttcctgagaagctgaggaatctagaacctcgccttattgaacatgtcagtaatgaaataatggatagggatcctaatgtccgctggaatgacatagctggtttggaacatgcaaagaagtgtgtgacagagatggtgatatggccactgctacgtcctgatatattccgtggttgtcggtctcctggaagaggtctactgttgtttggacctcctggaacaggcaaaaccatgattggaaaggcaatagctggtgaagccaaggcaacatttttctacatatctgctagttcactaacaagcaaatggagaggagttacttctttggagtctggctggggctagaggaatttctcatctcactctagtgccaagtgcaaactagggctcctcagtcgaggtcaagttgtcttttttactgtaatagattggtgagggtgaaaaacttgttcgggcactttttggtgtggccagttgtcgtcaacctgctgtcatatttgtggatgagatagactcattattatctcagcgcaaatcagatggtgaacatgaatcaagcaggagactgaaaacacagtttctaattgagatggaaggttttgacaccggaaatgaacagatcttacttataggagcaacaaacagaccccaggaactggatgaagcagcgcgcaggcgactcacgaaacgtctatacatcccccttccttcattagaagcacgggcttggataattcgcaatctattggagaaagatggacttttcatgctctcggaagaagaaacaagtgccatctgtaaattaactgaaggctactcaggatctgacatgaaaaacttggtgaaagatgcctcaatgggaccactaagagaggctcttcagacgggcgttgaaatcgcaaagctcagcaaggaggatatgcggccagtgatgctgaaggatttcgagaatgctatgcgggaggtaagaccttctgtttcctcaagcgagctggggacttatgaagaatggaacaggcagtttgggagcctatcgatctagtctgtcggcaggcatcaacgaatacaatcatgtcggcactatagaaaaaggagctcaacgattttagccggaacatgacatgcataacacagctctacagtttaacaatcttttgaagcatcaaaatttgaactgtctatttggagtgctgagtaatatccaggagcctacatatcaaatagtttcaattgtttttaaatcttcacttttctgtaaatttgtttgccttggttttgattgacatatgactagcgcggaagtcaaatactccgttccaaattataaaatgttttagcttttccgcatacagttttttagatgaataaaaaaattaatgtatctataaaaagcaatatgtaaagagatggtacaacattgacaacaaagaagaagatttgtgggtcc

SEQ ID NO: 2755 - DNA, 1044 bp, Zea mays
tctgccgctgcacacccctgctgcgtttttaccacaaaaatgtcgaaacatacaacccagtagcaaaaaagcacgaaaaaaaaacggttttacaagacctggggaccgcgagacacccgccgcaagaaatcttccccacttgttccctcgcgtccatggccttgctccagcctactcttctcactcctcccccgctctgctgctgctcgcatggcctcctctacccagggttcctgaaactgcctcccaaattctcaaatggggcctgctgttccacggcgagggcgtcggaccggagcgagctggcgggtaaaagcgggggcttggcttggagagcggcggggagaaaggggcggctgcttggcgtcaccggagctgggcgaggccccttctttggcggcggcgggaggcgtatggacaagggcactagccgggtcgtggggaacctcgccttcgccgccgtcgtgacgtacctcgccgtgaccggccagctccggtgggttattgacgccatcgtctctctctggctcctcacaatactgctgcctgtactggctctcggtgcatttttcttctttgcaggacaagatatactgcagggcgattgtccgaactgtggaaaaagcttccagatactgaagtcagctttgaaggatggcccacaactctgtccctattgcactcaacctttctccgttcaaggcaacaaatttgttagagaatctgctagattttcatctgggagggctgctactgctacaaatggtccagtgttcaatgagttcttcaaccgcaacatgagaggaggaaacgcggcgccttctgagacgatcgtggatgtggaggctgaagtcaaggacgtggagtgatgtttcttctcagcagaagaagagcacgatttgcttctgaatctgtgagaaatggggagaaaactgaaactgtgagagactaggcaaacgtgcatatagatagatgggtatcggggatgggtagttgtgtagtgcccgcgcgcatgagaaactggacaaggcccctgtttgtttc

SEQ ID NO: 2756 - DNA, 1126 bp, Zea mays
ctgctgcgtttttaccacaaaaatgtcgaaacatccaacccagtagcaaaaaagcacgaaagaaaaatcggttttacaagcattgggtacctcgaggccggccggaagaaatcttccccacttgttccctcgcgtccatggccttgctccagcctactcttctcactcctcccccgctctgctgctgctcgcatggcctcctctacccagggttcctgaaactgcctcccaaattctcaaatggggcctgctgttccacggcgagggcgtcggaccggagcgagctggcgggtaaaagcgggggcttggcttggagagcggcggggagaaaggggcggctgcttggcgtcaccggagctgggcgaggccccttctttggcggcggcgggaggcgtatggacaagggcactagccgggtagtggggaacctcgccttcgccgccgtcgtgacgtacctcgccgtgaccggccagctccggtgggttattgacgccatcgtctctctctggctcctcacaatactgctgcctgtactggctctgggtgcatttttcttctttgcaggacaagatatactgcagggtgattgtccgaactgtggaaaaagcttccagatactgaagtcagctttgaaggatggcccacaactctgtccctattgcactcaacctttctccgttcaaggcaacaaatttgttagagaatccgctagattttcatctgggagggctgctactgctacaaatggtccagtgttcaatgagatcttcaaccgcaacatgagaggaacggcggcgccttctgagacgatcgtggatgtggaggctgaagtcaaggacgtggagtgatgtttccacgggatcctacaccacgccagtcctcatcagtaccagttctcgtcttctcagcagaagaagagcacgattttcttctgaatctgtgagacaatggggagaaaactgaaactgtgagagactaggcaaacgtgcatatatagatagatgggggtatcggggatgggtagttgtgtaagtgcccgcgcgcatgagaaactggacaagagcacctactagcacaagttgtggtaaaaaaaaacgtgcattgctttgtggcctacgctccatta

SEQ ID NO: 2757 - DNA, 1080 bp, Zea mays
caatttgcaaaaaaaggtgccccgcgcggggcgggcgattctccgccgcctcgtctcgtcttcgctatgcaccatgcccacgagcgcctccgccgctccaacgctccaacgcttgagcgcctccaacgccactccaacgccacgagcgcctccgccgctccaccgaacaactccaacgccactccagctcttgcagcagtagaactctactgcagccagctacgacaccctgcgcctgccgcactaggtacatttgattctggtttctgccgcacaagatccgctacctcttggacccggacatctacaccgacggcaggatctccgtgcagggcatcgacgccgtgctcttcgcgccggacgacgccaaggccacgcagaccgtcgacccgaacaggaagcctcctaccatcgtcacccacaagaagaagatcaagctccggcgagttcatctattgctcaacctcagtattggccaacgtgaaaacatggaggtgaagtgaagcaagtggtagttgagcatatgctggtggttggttgtcttcatgaacatctctttgatggctgataccattcctgggactgcaagccaacactgtcctttaacccatgacccatgagcaacaatttcttcttaacaacagagcatgatgttagagaaatttggcttcaagcgcaaaattaggttgcttcgtgggagtgatgcatggcctgaacaaatgatatgagcaaatttgacaactgcagttctgttatggtgaatggtgattgtagttcagtttcagctctaacctatgaaaaattgaatggcagttgcactaatctgttggtggaatgattttcccagtaatttcctggacaagcagatcactgagaaccatctaccttatgagaaatgatgccttgtatggttcagtatagttcttgtattgctggtttaaattaattcttgtatggcagttgcactaaactgaatggcagttgcactttgagatattcttctattgttggtttaaaaaaaaaaaaaaaatcttgtatgcattctgtatgcattcttgtttaaaacctggttgcttatgt

SEQ ID NO: 2758 - DNA, 5003 bp, Zea mays
cgctcgtataatcccgcacgttggccgaagatccaacgatccacgatcgctatagccaaaacgcttctgcacatcttatcgccaccgcacaacataaatcggacggtcccaaagtcgtccctaacccgcgacacccctgttgaccgaaccagggcggcgccgccggcatcccacggcggggacaattccggtgatgctgcattcacttccctggcacgccacggttgacgacgagttctatggctccacagctgccccgtcggtgggatggcccacaccgatgaggtcctgcccacggtgcgagtggaacccatggcggagcaccaacctcggcgtgaaatcgcggtttcctcggtcggcaatcccatctagcgaagcaccgtgtgccatccacgcctctaatcgaagctcccatacccactggtggaatctcgagcggtagcgcgggtgagttccacggtggcggacaagttccaagcggcggagccattgccgagcgatacactctaccaagcactgccccaaacctcgattcattgggtcgacacgtggaggaggacatggcgaatgcaatccgaggtctattgatagacgagaggcaaagggcagagctgaccacgcaagcaggcgggtccgaggcggtgtagagctccggtgagtaaattcgatctacggtttgggtaatcgcgagcccgactcgaccgaaaacaaacacgggaagaagggaagcactaagcacccgaatcttaccggcggtcgttgcgcagattgtctggccccggtgaacggcggaccggcgggcaccttcaccacggctaacagcgctaggcgcggctgcgacccccaattcacgacagcaccacagcggcccacggaatgcaggaaggtgatttcggtgtgggtttgcaatggggtgaggctctccctctctctcactttctcaccggcgggactcggagggctcggcgtcacggcaccagacgtggactgaggcgaggttccgatgcgcgtcggggctcgattttattcccaagaccgcgccaaccacccgacctaaatccatggagatcccctgactgttaccgttagcgcggcccgattcaacagccgagtttcgcggacgcgcggccagcgagttcgacggggattgttcagatccacccaccgggaagaaggaacggctgacagcatggtcccgtctgtcagtgtccgggagcggaacaacgagcccgagcttcctggctgatgcgcgcacacacacggtggctgacgagcgggacccaatgtcatccacccgagcagcatggcggctggggttggcggcttggcgctgtggaagcgctggtgggctagttggatggttgttgggccgcacggctgagggagaaatgggccgactgaagaacaatcggcccaatcgcagccagatttgtttatttccttttctgtttttagttttcctttgtattattctccttttgaatttcaaacttgaattcaagcatttgtggcgcattctgtacccaacatttaggtgtatagtttgatcatactacttatagaataaatttatttatttataattttttttgtattgtgtaatatttttctccttctatttttaatcccaatgttaatttgggttccaattcaaatctcaattcattattatatttttttattggtactagtgttattattcaatgcacaatcgaatgaactccaacatgatacattaggtatacatatttattctaattaatttatttgtttgctaaacgtttgaactataaagcacactcatattgccttctttcattttaggaaaatagtattttgcttgtgaaatagggagtaaaagttacttcaaatttattattcatgtaaataaaggattatggtgcattatttgatgatatgcataattatttagttggataggaatcttttctattaattcttttctaaaatatttcttggtttccaaaattgagtcctcaaattcccatactcaaatgtaatttaagtttactattttattacctcatatttttattttattattattatattttttttctatacaccttttaggccttacaggaagacggacggcgttttgcttggagacatgctgcgcaaaacttctgaccgctgccttctcagcccaaaatctcatacgccgacgaacgacctgagtattgatgagtagtcagacacataaatccgtggcgacggtactcatcgcctgctcgaaaaaacgcggcgggcaccgtgaaaagcgcccgaaaacggcagaaatgctcgcgcgccggggacgaaaaccgcggggttgccgcgcccgcccacccgcccgcatgcggcctgggggctctccggcggctacctgggctgcctggcccgcagagagacacggcccgacgcccttcaccttaccattgcgtctcgcgactctcgccattttcctgcttacgcacacgcgaaccttgggcgccctgcagctgggcacaccgacacttccctccgtccggccccgcatgccagcctgtgccctctcgctgtccccacccaccacaccgcgtctcacgtctctctcgctccttccgtcggctggctagcttggctttggctctgcttccccgacctgtcctccatcctctctctctctctctcttcactgataagcaagctctcacacacacacagtcgcacgcctcactctgctctctctctctctctctctctctctccatagtccatactacaaagcaggaaaaaacacacacacacaaaagaaaggctcacaatacccacctccatttagctactactactccctcgctgtcttccccaaccaacaaatcgacctagctaggcacaagagcgctagacgccgcagcgcagcacgcaccacccaccgagcggcggcggaggcagggcaatccgcagggagcagaggccgcgcgcgcaggcatgggcgcgccggtgcacggcgccctcgccttgttcctcctgctcctggtgggggcaggggcggcgcccgaggagacggcgccgcaggaacccacattgccagccaccggctccggcgctaccggcgcagcggcggtcggagtcaactccaactccgtgctggtggcgctgctggattcgcactacacggagctggcggaactggtggagaaggcgctgctcctgcagacgctggaggacgccgtcgggaagcacaacgtcaccatcttcgcgccgcggaacgaggcgctggagcgggacctggacccggagttcaagcgcttcctgctggagccgcgcaacctcaggtcgctgcaggcgctgctgctctaccacgtcctcccctcgcgcctgccctccgactcctggcccgcggcgtcccaccccacgctgtccggcgaggaggtcgagctcggcgccggcatgcgcgtcggccacgccgccgtcacgcgcccggacgccgtgctcaggcccgacggggtcatccacggcatcgagcgcctcctcgtgccgcgctccgtgcaggaggacttcaaccgccgccgcagcctcgcggcgatctcggccgtgctgcccacgggcgcgcccgaggtggaccccaggacgcaccgcctcaagaagcccgcgccgccggtggcccccggcgcgccccccgtgctcccggtctgggacgccatggcgcccggcccctccatcgcccccgcgccggcgcctggcccgggctccgggaagcaccacttcgacggccacagccaggtcaaggacttcatccagacgctgctcctctacggcggctacaacgagctcgccgacatcctcgtcaacctcacctccctcgccaccgagatgggccgcctcgtctccgagggctacgtcctcaccgtgctcgcccccaacgacgaggccatggcgcgcctcaccacggaccagctcagcgagcccggctcgcccgagaacatcctctactaccacatgatccccgagtaccagaccgaggagtccatgtacaacgccgtgcgccgcttcggcaaggtgcgctacgacacgctgcgcctgccgcacaaggtcgtggcgcgggaggccgacggctccgtcaagttcggccagggcgagggctccgcctacctcttcgacccggacatctacaccgacgggaggatctccgtgcagggcatcgacgccgtgctgttcgcgccggacgacaccaaggccacgcagacagccgaccctaacaggaagcctcccgccatcgtcacccacaagaagaagatcaagctccggcgaggcaagttgttagaggcgacgtgccagatggccgggctcttcggtcagcgatcgcgattcgcgagctgccagtagacggagaaaggatctgttgatctccacgacaccgaaagacgaacgaacgaacgaactgatgggctgccgcaggaggagggggagccgtccacattattgcttgtattttttttcactcttttgtttattgttgagaataataatgaatcaggtgggggatgtaaactctgtgggttgttgttggtgtgtcgtccagatggggaaaaaaaggagaaaaagaaaggcagccaaaaaaaaattgtccatacatgaatgaagaagcccaggatcgttgtctttgtataggagaaggaattgaaacgtttttgttttgttttctttttctgtcattctttgcttctgttcccgttttgacaatgagaaatatcgggtaaacacacaaccattcttacttattatccattttccttgtttttatatatggtttttcgtcgagataccaccgcctctcgtcgcgaccagttcggctgtgtgatgtttgtgtacctgcgctgcacttgcacgagtagtggggaggggtgatgggtctggtgagcaatcaaaccagagatgctccagctcagaagctgctgctgctgctattaatcaagcaggatggccaccggcgactgagaactccgtcaggaccatgt

SEQ ID NO: 2759 - DNA, 2008 bp, Zea mays
tacccacctccatttagctactactactccctcgctgtcttccccaaccaacaaatcgacctagctaggcacaagagcgctagacgccgcagcgcagcacgcaccacccaccgagcggcggcggaggcagggcaatccgcaggaagcagaggccgcgcgcgcaggcatgggcgcgccggtgcacggcgccctcgccttgttcctcctgctcctggtgggggcaggggcggcgcccgaggtgacggcgccgcaggaacccacattgccagccaccggctccggcgctaccggcgcagcggcggtcggagtcaactccaactccgtgctggtggcgctgctggattcgcactacacggagctggcggaactggtggagaaggcgctgctcctgcagacgctggaggacgccgtcgggaagcacaacgtcaccatcttcgcgccgcggaacgaggcgctggagcgggacctggacccggagttcaagcgcttcctgctggagccgcgcaacctcaggtcgctgcaggcgctgctgctctaccacgtcctcccctcgcgcctgccctccgactcctggcccgcggcgtcccaccccacgctgtccggcgaggaggtcgagctcgcccccgccgccggcgccggcatgcgcgtcggccacgccgccgtcacgcgcccggacgccgtgctcaggcccgacggggtcatccacggcatcgagcgcctcctcgtgccgcgctccgtgcaggaggacttcaaccgccgccgcagcctcgcggcgatctcggccgtgctgcccacgggcgcgcccgaggtggacccgcggacgcaccgcctcaagaagcccgcgccgccggtggcccccggcgcgccccccgtgctcccggtctgggacgccatggcgcccggcccctccatcgcccccgcgccggcgcctggcccgggctccgggaagcaccacttcgacgggcacagccaggtcaaggacttcatccagacgctgctcctctacggcggctacaacgagctcgccgacatcctcgtcaacctcacctccctcgccaccgagatgggccgcctcgtctccgagggctacgtcctcaccgtgctcgcccccaacgacgaggccatggcgcgcctcaccacggaccagctcagcgagcccggctcgcccgagaacatcctctactaccacatgatccccgagtaccagaccgaggagtccatgtacaacgccgtgcgccgcttcggcaaggtgcgctacgacacgctgcgcctgccgcacaaggtcgtggcgcgggaggccgacggctccgtcaagttcggccagggcgagggctccgcctacctcttcgacccggacatctacaccgacgggaggatctccgtgcagggcatcgacgccgtgctgttcgcgccggacgacaccaaggccacgcagacagccgaccctaacaggaagcctcccgccatcgtcacccacaagaagaagatcaagctccggcgaggcaagttgttagaggcgacgtgccagatggccgggctcttcggtcagcgatcgcgattcgcgagctgccagtagacggagaaaggatctgttgatctccacgacaccgaaagacgaacgaacgaactgatgggctgccgcaggaggagggggagccgtccacattattgcttgtattttttttcactcttttgtttattgttgagaataataatgaatcaggtgggggatgtaaactctgtgggttgttgttggtgtgtcgtccagatggggaaaaaaatggagaaaaagaaaggcagccaaaaaaaaattgtccatacatgaatgaagaagcccaggatcgttgtctttgtataggagaaggaattgaaacctttttgttttgttttctttttctgccattctttgcttctgttcccgttttgacaatgagaaatatcgggtaaacacacaatcattcttacttattatccattttccttcttttttatatatggtttttcgtcg

SEQ ID NO: 2760 - DNA, 2391 bp, Zea mays
  misc_feature (532)..(532): n is a, c, g, or t
tgattcgaatctgctatcacgttcttcccttccgttcgcttttagatctgtggaagaaccttcgagttcttgagttggagattcgtttgtggattgttgggtgctgagatgcacactttggatcgctgcatacgcccccttggtgcagttcttggtcgtgatccaagttgatcttagtttgagtttgtttgagaaaaccccattttaatctctatttttagatctgcgattgatttacaaatccgactgagttaaaatttgtggataccttggaatacctcttgccaaggtctgtgcaaaatttcagctcaatcggagttcgtttggttaagttttgcattcaaaaactgaattttcgagttgctaaaaccagtactagatagtgatatggttttggaccgattcggactttttgatgtccgattgtggtccgtttgttttgttggtctcatgcgagtcttaggaacattttgaaatcatgagatcactggtttgctgatgtgcttttggtttgagcgctttcttcatcccnattgatgttaagtgctcaatttcagttttcagcatcaaaatttgattggctctcattcaccccctctggtcgcgtcatcggtccatcagtagtggtttggaagaattagagggtgtttaaacctctaatagatcaaaatccttctcaagccttgtctggttatttctgttccatgtgaattggaggggattgagtatgattgagatggattttaactcgctatgaatttaaacgactcaatcccagcaaatccacatgaattaacattaagacgaatatgccctcaatacagtcgaatccactcgtatctcccacattcctggctagagtacccaaaatagaccttaattaggctaacaaagcgattagcaattatgcctagctgattaatcatatcttatcgaccgtgtgagattaaatcattacaatatcaaatttgacaactaaactggatcaattaatgaatccggccaaacaaattacctactcaaacaaaaaagcgtcaactttggttaccaaacagatctttttaccggtcgaaagctgagcgacatgttttttgtctttttatttgaattgctaacagggcctgtctcttttaatatctttcactagtctctgaaaacctttaaaccttgttttgatactcttggattataatggattattggaagaattagagggtgtttaaatctctaagggctggtttggcagaccaaaacccaaccagttttccagccttttctccgggaagaaagcccacacgaagattgtccatgggttgttcatctgtgtcatttggcagcccacaatcggactgagattcgtccaaaaaagactattttcgggaaacaaccctggccttgggaggcacgagaccattacctagaacatcctaatcgaaaaatcgaactccatccccacgcacgcctccttggacaccatccccgcgaggtccatccccacacacgtctcctccaccgccatctccgcgagcacctccgcctccttcccgcatgctccttttgatctcgacaaggtttgcgcggggtaggcaaaaccgcctagcaccagtcgagccctcccccctcctcctgcgagtcgcggcaacccacgagcgtgtctatccatcgactttctgtcagaaaaggccactcgcggtttgtcgtgcacgccgcgtccaggttggaatggttcgtttcttggactcgcgacttcagcctttggttactcacttactctcctagatatcatagtgccgcctgtggaatggtccgttgctggtgctacttgctcatggagttatggtggtaggcgtaggccacttcgtctgcctcctggatttctcactgctgcatcggctccgaaagcaaattaggtggctagaataattatgatttatgtaattcttttgttgttgtgtaggttatattatatggtcattaattgtgtcttgtgtcatttgaaaccaacaaatgattcaaatatagtataattaagatgttaggaccaaaaaaaaaaattcgattaccacagtttggtattactaaggtttagtgtatgctaaggttgtggcatggctaacaagtggcaaaatagaattatttttgttcactgttttttctgctgagaacatttaagctactacactttgagatattctagatactatagatgttatttgttcccttgtactaatcttccttgtactaatcttagttgcatgttatctttttttcagacaactatagttctgttatggtgattgtagtacagtttcagctctaacctatggaaaattgaatggcagttgcactaatctgttggtggaatgattttccccagtaatttgcctgggc

SEQ ID NO: 2761 - DNA, 3568 bp, Zea mays
gcggccccgcaccccacgctttccggcgaggacgtcgagctcgcctcggccggcgccggcggcatgcgcgtcggccacgccgccgtcacgcgcccggacgccgtgctccggcccgacggcgtcatccacggcatcgagcgcctcctggtcccgcgctccgtgcaggaggacttcaaccggcgccgcagcctcgcggcgatctcggccgtgctgcccacgggcgcgcccgaggtcgaccccaggacgcaccgcctcaagaagcccgcgccgccggttccccccggcgcgccgcccgtgctccccgtctgggacgccatggcgcccgggccctccatcgcccccgcgccggcgcccggcccgggctccgggaagcaccacttcgacgggcacagccaggtgaaggacttcatccagacgctgctcctctacggcggctacaacgagctggccgacatcctcgtcaacctcacctccctcgccaccgagatgggccgcctcgtctccgagggctacgtgctcaccgtgctcgcccccaacgacgaggccatggcgcgcctcgccccggaccagctcagcgagcccgggtcgcccgagaacatcctctactaccacatgatccccgagtaccagaccgaggagtccatgtacaacgccgtgcgccgcttcggcaaggtgcgctacgacaccctgcgcctgccgcacaaggtcgtcgcgcgggaggccgacggctccgtcaagttcggccagggcgagggctccgcctacctcttcgacccggacatctacaccgacggcaggatctccgtgcagggcatcgacgccgtgctcttcgcgccggacgacgccaaggccacgcagaccgccgaccccaacaggaagcctcccgccatcgtcacccacaagaagaagatcaagctccggcgaggttagtacctacctaccttcagatctggacctttgctcctttgtgtcctactcgtaccattacagattgctcaaaagtatcccaccaccgcattgtcctttttttcaataatagcaccgaaatttacatcaaaaaaagaagaagattggggaggtgtgtagattaatttcacaactaatcgctagcatcaatcaatgcaagttcatctagtggtcagaatgttgccggtgagggttcccatcctagcgtccaggatttaataatttatttatcagttggtgttggtgggtgatgagtcctgggtagtagaataaagacgaacgcgttggcataaaatagaaacagcagttcggtttccttattactgtcctattgacatggccgtattggatttggaggaaggcatatgggcctgtcggtgcccgtctggacattttctaccatcactgaactaaaactactgtagtttccgtaggttttttaaacgatgtgtggcagatgctcaacctcagtattggccaacgtgaggccatcgtgaaaacatggaggtgaagtgaagcaagtggtagttgagcatatgctggtggctggttgtcttcatgaacatctctttgatggctgataccgttcctgggactgcaagccaacactgtcctttaacccatgacccatgagcaacaatttcttctttttcatagtttaggtggacgtctcatgccgaagccttagtcacgtccttgctgtccttgttttcatagtttaggtcgagtggtattggttatgggtagaggtagggctaggccgaaatgtgtgccttgtaggggaaaatagcaatcgttggtagtattacaaactgcagaaactgatagatgagcagaaacaaaaatctgcactgtgctagagagggaaaacctcaaaagcatgccatgccttgttcggtttttcctatgccttacggcaatattggaagggattggaaaaaaaaaatgaagcattttgacttgctatggattggaacccacccaatcccttcaaatccatatggattctgatgaaaccgaacaagcctaagttgaattggacagctcacttcaatccagacccttaaaccttttgtaggccttggttaaattgttgtgaaatcagatggctacccgaggctgggcacttggggtccggaataataccgaaaccttctaggacactgtctgaagggcagggacctaaaactcattaggcaggcccagttggggcttgttcggttctaccccaatccatatggattgagggagattgagggcgtttcaatccctaataagttaaaatcctctaatccatattaatcctctccaatgctttcctgatcagggagattttttctcaatggcattctttggtgcatctcatcttcatcattcactagtgaatcagccttttcgttttggtttacatacatgttttttttataaaaaaaaatctgcgagctttctttcgcctaaaatatttacacggcatcgggtgccgtcctgctgatttgacaggcaatctgtggcggcataatctagcgtttattcttgttactttctacccaagcattccttgcctctgttcggcgccatgtcggtgtcatgatttatcttaattgtgcagttagtcttacgcttttgttccccaacgagagaagatcaagctccgccgaggcaagctgctggaagcgacgtgccaagtggctgggctcttcggtcagcggtcgcgattcgcaagctgccgccagtagacggagaaggggctgtgataccgaaagacgaacgaactgaactggtgggctggggctgccctggagaggcagagggagccgtccacattattacttggtttctttcttttttttgtttattattgagaataatgatgaatcaggtcaggtgggtgggggatgtggctgtaaactcggtgggctgtcggtgtgtccaggggggaaaaaagagagtaaaggcagcgaaagaaattgtccatacatgaagaagcccagggtcgtcgtctgtgtataggaagggattaaagatgttttgttttcttctgtctttctttgctttgcttgtgttcccgttttgacaatgagaaatatcgggtaaacacacaaccttccctattatacatttcccttcattttattatacatatatactctctctctctctctctctctttctttgtcaagaatgcaacagtccgggcagtggggattgaggaatcttcaggaggatctagtttttttttatatcataaatacaatcaggtgaattcctactttagatttattggaggagaatgataaactctacatataaaccagagatgctccaactcagaagctgctggtgctagtatagtattgatgaagcaggagacagctaatccctgatggctttgcatgactgtagtatactagtggcgaacaactataactcaaaaggaacgccatgtttgctgcgagtttaatttagatgtgacttctatagtatcatgttcgctgtgagtttaatttagatgtgatttctatagtattttgtctttatgaattacaatgatagctgaacaggctggaaagcttttgacagtgagaataggctatccctaaac

SEQ ID NO: 2762 - DNA, 865 bp, Zea mays
  misc_feature (23)..(23): n is a, c, g, or t
  misc_feature (689)..(689): n is a, c, g, or t
  misc_feature (761)..(762): n is a, c, g, or t
  misc_feature (764)..(764): n is a, c, g, or t
gtcggctggggtgacgctcttgnacttgataattggcagaacaccttttggtggagatcctgaacagaacatcaaggaaatagcgaagctgaaaggaagtgaagaactatgggaagtagcgaagttgcacaactgcgaatcttcgtacccatcagatctctttgacgtcaaatttcctttgtgctcggtggatctaagggaatggtgtgcagccaacacacgcaggccagatttactcgagatgatacctgactcctttttcaatcttgtggagaagtgtttggccgtcaaccccaggtgcaggctctcatcagaggacgcgctcatgcacgagttctttgctccatgccgcgataacttcaggaagctcaggatgctgaggaggtcagctggttctgatgcagcatgttcatcgtctcaccaggacacaacacttggagcaagacagtcataggtcgttccaccgtacatacttattgacaccagaaagctgattgtgatcatctagtttattacagacatgacaatagccaaatcgtgttcccgtcttgatgtaagtaaacccttgtactaaatacgtactaaaccgttggtcggaaccaagatatattatttttgtcatgcaacgggagggacgaagagtccccacctgatatattacgtttacgtaggacagtatcaaagaggtnaaaaaaaaaaaaaaaaaaaaaaaaaaaaaaaaaaaaaaaaaaaaaaaaaaaaaaaaaaaaaaaaaaaagggnngnagatataaaaaaaaccaaaattaaaaaaggggggcgcccttctaaataacccattttatagtccccgctaattcaaattcattgttttttttttgggaacc

SEQ ID NO: 2763 - DNA, 2515 bp, Zea mays
tggatgagattaaacttttttgttgaataacagcattgtcatagtgatgatcgtgatacggtgatgcgtttcattagcttgatcacctactatgctacacataatatctgagtgacaagtggcatggaaagtttggttccatgctacttttttgctccttggtatactagatcagagatattgaaaattttcaacaatgtatatgtagttaatggtcactatctgactggggaagttatattactcaatagaatgctaggaaatacttattgattttgaaatttcaaattactgcatatatattcttgtgtcctgtgcctgattgatgccaatgaaccttttgtttatttgattaggtaaatctgatgcaacttcaagtgggaaggataccacatctcaatccctatcaactatttccccagtagttcatgtcaaagaaccagttgctgactcaaagcagcctcttcctttgaagaggaaaagatctagtagaagcccagtggatagtgcacgtgcacctatggtcgacagtaaaagtaggcatggtaaccaaactgcagatgtatctggtataacatctgccaaggatcctacgagcactaaaacatcattagataggttaaagcagccaatgccttacaaagggcgaaaagaactaatgaacttcttacatgagaccatgcaaagtccaaacaaaagtactatgcctactcctgtttcccaaaggaagagggtcgctgctccttttggtagtgtggatcgaaagctctttatactgacgccaatgcccctgcgttctggtggcagtgctgttgctggtgctggcatgttcaacaacaaaggtgaatttcccagtaactgtctattccacttcactgctagttgctagtcagctggacattcttagttattagatgatctaactaattggcagtgcaggacatggaaaacatcgaagagaaggtccatgtgttggaactaaaggtttccgagctccagaggtttgattatgatttctgctgtgcgaagagtattccatcctcgaggatacatatactgaagtgatgtttttttttggtataggttctccttaggtccttccaccagggctgtaaagttgatgtctggtcggctggggtgacgctcttgtacttgataattggcagaacaccttttggtggagatcctgaacagtgagttgacttgtaaattacagtgttgtgtgtcctcagttcctcactgaagaatgttactaagatgttgcatttgtccgataaaaggaacatcaaggaaatagcgaagctgaaaggaagtgaagaactatgggaagtagcgaagttgcacaactgcgaatcttcgtacccatcagtatgctaattctcagttctcactccaaagtttcggcatccttcaaatagcttgctgaatgatccctaaaacattcctctttgttttcaggatctctttgacgtcaaatttcctttgtgctcggtggatctaagggaatggtgtgcagccaacacacgcaggccagatttactcgagatgatacctgactcctttttcaatcttgtggagaagtgtttggccgtcaaccccaggtgcaggctctcatcagaggacgcgctcatgcacgagttctttgctccatgccgcgataacttcaggaagctcaggatgctgaggaggtcagctggttctgatgcagcatgttcatcgtctcaccaggacacaacacttggagcaagacagtcataggtcgttccaccgtacatacttattgacaccagaaagctgattgtgatcatctagtttattacagacatgacaatagccaaatcgtgttcccgtcttgatgtaagtaaacacttgtactaaatacgtactaaaccgttggtcggaaccaagatatattatttttgtcaaaaaaaaaaaaaaaaaactcgtccccgcctcgtatatttttattacgtaggacagtgtcaaagaggtacaaataaggcatgtgtagagtacaaagtttgccaggaaggccctaaacttggaacattagagggccgtgtcagggaacatcaaagatctgacaccagttcctatcggtgctaatctcgctgccttttaggcgacagctccacaggcggccttcatccttgcactagcgtcggaggtgcagcaaggaggcacagcttaaatataaatctatttcagagtcatgtattgaagtattagaaatgattttatatatcaacgaaatatacttctactctgtaacttaggcctcttttggtagacctttggctttaaaaaaatagctttggctctggcttatctatccaaactgtttttttttggaaaatacaaatataaaaaacatttggtaaaatggcttctacactgttttgcaaaataaaccctatatatagtacatggtacctttgacttttgatgttccctgaatcatgcaatcatctacgcataggggtgaaaacagattaggtataccctcgggtagata

SEQ ID NO: 2764 - DNA, 1526 bp, Zea mays
gcacgagaccattacctagaacatcctaatcgaaaattttgcaatccgtatcatcatcttggcctcgtcaatccaccaccaccgtcgtcgctgagctcctcctccggcttcgcttcgcttcgctgtcttgcctcctcctcggtcgaagaagaagaagaaaacatgtgtccgggatccgtggagtcgtcgtcggcggcggcggcgggcaagagcgtgtgcgtgatggacgccgcggggccgctgggccacgcgctcgtggaccgcctcctccggcgcgggtacacagtccacgccgccacgtacgcccgcgacggggaggagggcgcggctgccgccgcgctgctcggccacctgtcgcgcgccgccgacgcgtgcaggcaccggctgaagctgttccgcgccgacccgttcgactaccacgccatcgccgacgccgtgcggggctgcgccggcgtcttctgcatgttcaacacgcccgaggatcaggcccaatgcgatgagtcgacggtggagacggaggtgcgcgcggcgcacaacgtgctggaggcgtgcgcgcagacggacgccatggagcgggtcgtcttcacctcctccgtcaccgccgtcgtctggagcggcgccggcgccggcgtcggcgcccacagggaggaggtcgccgacgagaggagctggagcgacctcgccttctgcaggaagttcaagctgtggcacgccctggccaagacgctgtcggagaagacggcgtgggcgctggccatggaccggggcgtcgacatggtggccatcaacgccggcctgctgctgtccgcccccgggcccgggctcgggctcaccgccgcgcacccctacctcaagggcgcccccgacatgtacgacggcggcgtcctcgccaccgtcgacgtcggcttcctggccgacgcgcacgtcgccgcctacgagtcccccaccgcctacggccgctacctctgcttcagcgacgccgtctgccgtcccgaggacgccgtcaagctcgcccagatgctctcgccggccgcgccacgctcgccgccgccaagcgacgaactgaaggtgataccacagaggatccagggcaagaaactgaacaagctcatgctggagttcgccagcggggtatacggggagctggactaggaaggaactgccaggccacagatgatgcgatgcgactagggctgttgtattcttttgtacgtagtactatttgtagttttcgcccccctcacaaaaaaaaggagggaaatctgtttggttggccaaaatgtgccatacgctcgctgtacatggccaaacacgccacgtgtgtagcccctgccagcagcaggggtgggtggggagagcatttcagtgatcggttgccaaagaaataccatatcgtatctaggttcgtgagttacatcccatgcatgtgttacgtgacgcttatattgaactctgacaaacttgtagcgcacaattacaaacatgattacggaagaatcgtttcagggtaaaaaaaaaaaaaaaaa

SEQ ID NO: 2765 - DNA, 690 bp, Zea mays
ccgctgtgtaacgacttctgaaacgggtaatgctagtgctgagctgctgaagacggttgtgctctcaggcaccaaaacattcggatctgaaatcctaaacggaagtgagacgcccaatcggtgatccaccgcttccccgtcggtaccatgtccgctggaagcgagaggccgtacgccttctcgcccccgtcggcggtcccgggccccttctcccgcggctccggctccgctcccaccacggccgcgacagatagcactgggaggagctcgtcctccgtggcgccgacgaagagccgaaagccaccgttccggcccgccgtggacgacacaaagcccgtcctccgcgatccgatatcacgctcggacctggcggtcaccgagcaggtcgtgctgcggctgccgccgttcccctaagttcgcgccacccaatgttctttgctcaaccatattaatctaaagatggtgccctttctgcgcatgttcgtcaactcgacagtttgtcaattggaaactttgcccgtctaattatggttctggaccattagtggtttttgtattcaattagtaaactgagttatatagaagtaatgataattggttatctacatacatgtttgatttaccctggtaaatcagggttaaattactagtataagaatttacacaaaaaaaaaaaaaaaaaggcggccc

SEQ ID NO: 2766 - DNA, 813 bp, Zea mays
aggatcctttggtgcagcatctttgacttgtccgttgggcattccaactttgggactaggtgagcagctgggggcatggaggtaggccttggttaccgggccaagagcgctatccttctctatgtcgagggcctggagaatggcgccctccatgcgggcgtacctgcccttgttgtagctccagctggacctgttcccgctggcgccgagtgtgaggccgttagtgatgcgctgctcgaagtcgagttccccgcagcggaagggcttgacgcgcttgcacctggccaggttacaccagtcgctgtggcgagcgcaagcaagtgttcgttaggcttagagtagctggctgcactccataactctaggacttgaggagtgagcaggagattgactgaacgaaggttggtccgtcggggcgacggccgaggagcatgatgggcgtggcggggcagcgcggcggcgggggcagccttcggggacgtcttgcggcgagatgacgatgctgggccaccaggagccgttggggcggcgcagccagaccagggtaccctccacggagacatccaccgccgggccctcttccttgagcagaccccccatctgtggtggtgctggcgctccaattccaatcccccctccgctccggcaacctgatctctccgcctggacagggggagggactgcagcggcgcggagggcacagaacgcgggctcccgctccccccgtggtggcgtaggcgaggcggagcagtggggtccgcccggttttttttcttcatattttttcccggccggcctcgaggtacccaatcg

SEQ ID NO: 2767 - DNA, 6315 bp, Zea mays
  misc_feature (1)..(1): n is a, c, g, or t
ngactccacacaacggcacgacgagcgtccctaaaaatctcccaaaagccaaaccccacccggtctccgcctccgtctctgcctcctttcccctcgcttcctcgccggctgggatcttgcggcagctacgctcgctagctctcctccaacccgccgtcggctccctccgattccagtcccgtcctgtctcgccgcttcctggccccccgcttctcacgcggagaccggtcggatttcccacctcaaacatcgccggttttatccactcccgcagacctcttcctcagggacgggattggattggtggtggatcttctcctcaggggaggcacaagatccgttcatcatcctcgtcgcctaaacttggccgctcccgctcccacgctgctgctccaccctcgccgctactagaccagaccacggaggaggagacgaagcgccatgaggcggggagccaccaaggacgacgccgcgcccgacaaggtcatgggccctctcttcccccgcctccacgtcaacgacaccctaaagggcggacctcgcgcgccgcccaggaacaagatggcgctctacgagcagttcagcgtcccctcccaccgctacagcgccgccgtgccgcccgcgccttccccggcgcctccatggggcgcgcaacgacccgcctccgcggtcccgtccacgtccgccagccaggttggcggcggcgatagacctatcttcccattatttcgtgtgcctttaactgaacctgttcgatcatcagatcagacgaatgccaactccaatggccaggctgccaatggtacaatagctgaatcttggaggcagaggcaatccacacatcttaagagcaaggatactaatgctgcaggaccacctgccgagggtaataattccgttgggaagaaattggctaatgatgatgattttacagttccctctgtcttgtattctgggaatgcctccgcattccagccaagaaaagctcactctcttccctaccacaagcccatgtaagagtgtgcctgcaaaatattctagcactgacaagagacgcctagaaggaatggatgcttctgatgtgaaatcgaagggtccctcaggtatcaaggagaaagagccagtacaagtgaggatagacttggaagacaaagagacaactccgtcatttcaagtgctaaacgacaaaacatggagtccagacccaaagttatcttcgcacatggacaggctgaagaagcaacatgctgaagctgagagttatcagataaggaccaggaatgagaatgctgtcgagacccaaagccctccaaaaaatggagtgtcgttgttgtctaagccatatgttgataggaagggggaacagaatggtgattctgatctattggggcatggcctaagagagacaggtgtgaagaggaaaagatcacatcatgacgtggagcaaaacgatgatctgtctgattcctctgttgaatctttgcctggaatggagatttctccagatgatgttgtcagtgctattggtcccaagcatttttggaaagcgagaagagctattgtcaagtaagtatacaaaacttgagttcatgttcttgttgtttttacctattattgaacgtcctgtgtgagcataccatctcggcgactcctgtaatcagatagtgtttacactcgcttttgtttaacgtgcatacagtcagcagagggtatttgctgttcaagtattcgagctgcataggttgatcaaagtgagtctgcggcaaataaatataacttctttgggcccatgcttatgggcaggttaatttaaatttgaaaaattggtttaaccgtttttttatgttgacttttgcaatcaggtgcagaagttgatcgctgcatctccacatgtacttattgagggggatccttgccttggcaaatccttggcggtgagcaagaaaaggctggctggagatgtggaaacacagcttgaatcagctaaaaacgatgatggcgtgcgaccaacgcagctagagcactcgaaagagaagactgaagcgaaccaaccttcaccatctcaagacgaacaggccgcaactaatggtgacgttgctgcctcgatgcataccccttccgacaacaaacagaagagctggtgcattcctgcacctccaagtcagtggctgattcctgttatgtccccgtctgaaggacttgtctacaaaccttataccgggcactgccctccggtgggaagtcttttggcgcccccattttttgccagctaccccacctcctcctcctccacagctgggggggatttcatgagttcggcatgtggagctaggctgatgagtgcccctgtgtacttcccgtctttcagcatgcctgcagtgtcagggtctgcagttgagcaagtgagccatgttgcagcgtcgcagcataaacggaactcgtgtagtgaagcggtgttggcatcaagggacagcgaggtgcaaggcagtagtgctagcagtccggcatcttctgaaacagcagctcaacccagggtcattagggttgttccccacacggcacgcacggcttcagagtcggcagcaaggattttccgctcaatacagatggagaggaaacaaaacgacccgtgactggcagataaaaatgaaagaacggagggagtagagtaattttttgaccgataattataatgatcgccgtaaattggctggcccgcccgccttatgttttttgttcagtgtaaatatgctgtgtctgtcagaatgatatggcatctgtagctattttggttctgtcagaatcatgttgattggaattcgtcggtcggttgagtaggatgaaaattgggcacagcccatacgtctacagcaacgtcaaataaaggaagagaaagcaatacatcaccaacaccagaagcagatttttattttatttttattactgtgagtggagtggagtggctcaaccacatgatagatagatagatagatacatcagcaccatgctccttcctagtgacaggccacaacaagcatttcccaaagcaaatgcattggccacaaaaggcacccagctagggcattctcagcgcctcgttgatcctgctgaaaacgactcggagcgggatgcacgcgatggtcgcccccgacgccgctcctcgcgtctttctcgacgacgaggtcactgcccctgcccctgcccctccccttttggcatgcggctgccataacctgtccacctcttctttctccaacgctgatgatggcacggcgcgctgaaaacgactcgtagcgggcagctggacatctctccttgatgaaggacagccaaacagatcatcgctgacctccaccgagactggataccccaccacgggtttacagttcaacctactcataagagagacaaggggcacacggcgccaagtgttgctgctccccagcacactcaactccacatcataaaggctgggattcaaatgcagtggcttttcaaacaccactgacgatactgaaccactctcacagttcgaatggctgcttaaggtttctaatgactcctcaggaccacacttgcttttacagtgttgctgctgaaccgtgccaacacaatccataccactaggaactatggcaatatgcattttagtatcatgttcagccggcttgttcttattcaatgaacgcttctccagcctattctccaaaaggacaacctcatcatctcttgctgcttcgtgctttcctgtctttgttttctggcagccatgatcattattagaatctcttgtcctgtccttgccctcatgaccaacagaccttatggttctcatcttaatacttttacatgcatgtttcccagctttccaggtaggattatttgtcaatccacaaggttgatatctatgcaaatgatctggtgaaaatcactaggtcagtatagcaccctttggaggttcagaagcaggaagaaaacatcacatatgccaggaagtcatcacaagataatatgtcaaattaccacggtgcatcatctaagctataagatcacatccaacctaacatcagttttgcatactgaccaaaaaatccatgccttccataatttcacaagtagccttatgcagaattgtaaataataataaaaaaaagacctgtgtagttcccaacagagagatatattaaaaaaaactacgatcagcagggagcagtcaggcctgatggtctccctgatttctctgtacccatttgtagaattttggacacaagaaaatcgtcatattgttatcatgaacccttaaacaaaacaaacaggctggaggtagcagcaacagagataactgaactagcagtgtaactatctaagtataaagtgatgtgcatcttccagaatctgttgaagataaacacaaacaagcagtcaccaacgctcatgcatctagctagccaacataaatgatagctgccattgttagaagacatggtactgctatcaaaggaatcaaactacccgaaaatacaaagtagcagagcaggtttaccgggttccgagatattttgtgcagcagggggagttccgacaaaatcattcccatgccgtgaatcatcactgagtagccttgccatgcaggatattgctgtgccctttgcttgatctgtggatgctgcgctgcgatgacagctgtttgtgtccaatggagtatccaaggttgaagtgccagaggagctgcttgaacatgttgccacacccaacaagtgttcatcagccttctgaccatttggtctggaaccattccagatatctccattgcagagctctgagagcggacgagacctatccttcttcctggggatcccgcaaggttggtcctgatgtgcagcagcatgcttcctctttgtggtggcctgagagcgcacaattcttctggcctgcccaacattaggcagatcattatacttgggagcaaagattgcggcagcattagacaggtccattgtggggaccgtcttggatccgatgtccctgagatccctcatacggcaggagccttgaggcgtatcgtcctcggagtcatagggcgtcttgcgcttcctcttggaccgcggcggcggcagaggcggctggatggctggagaaggatcctttggtgcagcatctttgacttgtccgttgggcattccaactttgggactaggtgagcagctgggggcatggaggtaggccttggttaccgggccaagagcgctatccttctctatgtcgagggcctggagaatggcgccctccatgcgggcgtacctgcccttgttgtagctccagctggacctgttgccgctggcggcgagtgtgagggcgttggtgatgcgctgctcgaagtcgagctccccgcagcggaagggcttgacgcgcttgcacctggccaggttacaccagtcgctgtggcgagcgcaagcaagtgttcgttaggcttagagtagctggctgcactccataactctaggacttgaggagtgagcaggagattgactgactgaaatggtgtgacatctcgccattaatagtaagtgggggggaaacgaacttgaagagtgcggaaggaaggaaggaagaagcggcatacacgaaggttggtccgtcggggcgacggccgaggagcatgatgggcgtggcggggcagcgcggcggcggggcgcagccttcggggacgtcttgcggcgagatgacgatgctgggccaccaggagccgttggggcggcgcagccagaccagggtaccctccacggagacatccaccgccgggccctcttccttgagcagaccccccatctgtggtggtgctggcgctccaattccaatccccccctccgctccggcaacctgatctctccgcctggacagggggagggactgcagcggcgcggagggcacagaacgcgggctcccgctccccccgtggtggcgtgaggccgaggcggagcagtggggtagtcggccttcggggtagggggagagacaattgcatatacagtactctaaacagtgtgtttcgcaataatgtcaaccgaaagatttaatccgtaaaaaagtactacaaaatgtgtctaattgattattctaccattcaacgtatatccttcctttttataatctgatctcatgtattttctctctgacaagatagttttacctctttattaattatacacatttattatttgaagatatggccacgagaaaacacgaacgaacataacccgattgaatctcctcctgattctctcgccaattgccatggatcccacacatgctgca

SEQ ID NO: 2768 - DNA, 2166 bp, Zea mays
gccggccgggctgggaaaatctcccaaagcaaaccacacccggtctccgcctccgtctctgcctcctttcccctcgcttcctcgccggctgggatcttgcggcagctacgctcgctagctctcctccaacccgccgtcggctccctccgattccagtcccgtcctgtctcgccgcttcctggccccccgcttctcacgcggagaccggtcggatttcccacctcaaacatcgccggttttatccactcccgcagacctcttcctcagggacgggattggattggtggtggatcttctcctcaggggaggcacaagatccgttcatcatcctcgtcgcctaaacttggccgctcccgctcccacgctgctgctccaccctcgccgctactagaccagaccacggaggaggagacgaagcgccatgaggcggagagctcactagtcccccccccccccgacaaggtcatgggccctctcttcccccgcctccacgtcaacgacaccctaaagggcggacctcgcgcgccgcccaggaacaagatggcgctctacgagcagttcagcgtcccctcccaccgctacagcgccgccgtgccgcccgcgccttccccggcgcctccatggggcgcgcaacgacccgcctccgcggtcccgtccacgtccgccagccagatcagacgaatgccaactccaatggccaggctgccaatggtacaatagctgaatcttggaggcagaggcaatccacacatcttaagagcaaggatactaatgctgcaggaccacctgccgagggtaataattccgttgggaagaaattggctaatgatgatgattttacagttccctctgtcttgtattctggaatgcctccgcattccagccaagaaaagctcactctcttccctaccacaagcccatgtaagagtgtgcctgcaaaatattctagcactgacaagagacgcttagaaggaatggatgcttctgatgtgaaatcgaagggtccctcaggtatcaaggagaaagagccagtacaagtgaggatagacttggaagacaaagagacaactccgtcatttcaagtgctaaacgacaaaacatggagtccagacccaaagttatcttcgcacatggacaggctgaagaagcaacatgctgaagctgagagttatcagataaggaccaggaatgagaatgctgtcgagacccaaagccctccaaaaaatggagtgtcgttgttgtctaagccatatgttgataggagggaacagaatggtgattctgatctattggggcatggcctaagagagacaggtgtgaagaggaaaagatcacatcatgacgtggagcaaaacgatgatctgtctgattcctctgttgaatctttgcctggaatggagatttctccagatgatgttgtcagtgctattggtcccaagcatttttggaaagcgagaagagctattgtcaatcagcagagggtatttgctgttcaagtattcgagctgcataggttgatcaaagtgcagaagttgatcgctgcatctccacatgtacttattgagggggatccttgccttggcaaatccttggcggtgagcaagaaaaggctggctggagatgtggaaacgcagcttgaatcagctaagaacgatgatggcgtgcgaccaacgcagctagagcactcgaaagagaagactgaagcgaaccaaccttcaccatctcaagacgaacaggccgcaactaatggtgacgttgctgcctcgatgcataccccttccgacaacaaacagaagagctggtgcattcctgcacctccaagtcagtggctgattcctgttatgtccccgtctgaaggacttgtctacaaaccttataccgggcactgccctccggtgggaagtcttttggcgcccccattttttgccagctaccccacctcctcctcctccacagctgggggggatttcatgagttcggcatgtggagctaggctgatgagtgcccctgtgtacctcccgtctttcagcatgcctgcagtgtcagggtctgcagttgagcaagtgagccatgttgcagcgtcgcagcataaacgaaaaaaaaaaaaaagaaaaaaaaaagaaaaaaaaaaaaaaaaaactcgagggggggcccggtacccaattc

SEQ ID NO: 2769 - DNA, 2766 bp, Zea mays
ttttttttttttttctgcacaaggattaggccaggttcacatacacgtgtgggctaaacgaacgctgcttttttgccgcactggtatttaatccacaccagaaaaatacccatggatcagaccgtgatcccggccaattccaacccgacctcccttccacttaaaccacgccaaaaaccagctcgcgattcctcccactggcctgaatctgacccgccccgccatccccaccgccgcgcctcttccgggcagccatggacgaggccttcgcgcgcgcggtggaggacggcctcaagctcaccaagcgcctcgtcctgcccagcgggggcggggtgccgccgccgccgcgcccgcacctggcgatggaccgcgacgaccccgccgcggcgctgcagcagctcatgccggcggcgcccatggcgtacgccgtcgtcgtcgacccggccgccgtcgacagccccgacgtgcccagctaccagccccacgtctacggccgcctcgacccgcccgcgctcatcccgctccagatgcgggaggtcgagctccgcgtcgactgcgccgccggctgcgccaccgccgaggtcgccctgcgcgcgcgctggtggctgcactgcatcacgcgcagccgcgcgtgccactgccgcatcgtcgtgcccatggctcaccaggtccagcatatgcactcatccttaccttgcccttgggaaaagatcatacaatactcatgtaattgatacagaggataactgttcagtgaagattgcaatgcccgagagtgggggtcttttaaaacaggattttttttccttgacaataccacaggttggaggtggagaagatatatttgccacaatcagatggtcacaaaaattgctatatgacaacggacaattttctgtcgaagtaccatttcgtttcccgcagtttgtgaaccctttgccaaaggttttcatgaaaaaggagaaaatacagttgattgtgaatagtggtgtgactaaggagattttattgcagggaacaagccatcccttgaaggaaaaaagtagacaaggtgagaagttgtctttcctgcatgaagcagttgttgagaattggtcaaccaaagattttaccttcgcatatactgtttattctggtgatttgtctggtggagttcttgtgcagccctcaaccttgcgtgactatgatgacagagatatgttctgtctttttcttttacctggaaataacgagaacagaaaggtcttcagaaaggctgttgtttatatcattgatacaagtggaagcatgcaaggaaagcctcttgagagtgttaagaatgccctgtccactactctctctgatcttattccaggagattacttcaacataataacatttaatgatgagcttcactcattctcatcgcgtttggagcaagtaaatgaaaaaacaattggaaacgctattgaatggatgaacttaaactttgtcgctcagggtggcactaacatcatgcatcctttgagtgaggcaatgactttgctgtcaacttctcacgatgcgcttccacaaatctattttgttactgatgggtcagttgatgatgaacggaatatctgccatacattgaaaactcaacttattaaaagtggatctaagtctcctcggatttctacttttgggctaggttcatattgcaaccactatttcttgaggatgttggcatcaattggtaagggtcactatgctgctgcatttgatacaggatcaattgagggtcgaatgcttcaatggttccagaaagcttcaagcacaatagtgtcaaatgtttccattgatgccataaagcatattcaagattttgaagtggattctgtatatattccagacatttcagcaaaatatccattgtgtgtttctggaaggtacaatggcaagcttccggagacacttatcgccaagggtcacttggctgacatgagtgaaatatctattgaattgaaagtccaacatataaaggatatacctcttgataaagtattggcaaagcaacagatggatcttctcacagcaaaagcatggcttatggagaacaaggagcttgagcgaaaggttgtgaaattaagcatacaaaatagccttccttctgagtacacacgcatggtactacttcaaaccagtctggacaaaatagatccagcacaacaggcgaagaataaaccaacgaaacagagcagtagcccagatgagctgccagcgatgccgctaggtggcctagcggtcggatttggcgacgtagcggcaacaacagagaacctgacaacaggattcggagacatgaaagcagccgagaagtttgtgatgttggagaaggccgctggctgctgcagccgcatggcggactgctgctgctgcatgtgcttcatcaaggcgtgcagcaagatgaacgaccagtgcgccatcgtcatggcgcaggcctgcgccgccctcgcgtgcctgggatgcttcgagtgctgctcagagctgtgctgcggcgggcccaactgagtgaggccacagcaaccgagcaagttggtgagaatgtgttgttgtatagtgatgtaaatgctcccagcaatgtatagaatttggcatcacgtacgtgtttatctaacttggcttgatcagtaaaagcgtcacgtgtgttaatcactgtattaagggacagaacagaagcgcacacgttccgttagctttgtgcaaatccttccgatcaaaaaaaaaaaaaaaaaactcgaggggggg

SEQ ID NO: 2770 - DNA, 1940 bp, Zea mays
ggaccctcgaggccggccgggacgcgctgttatgttcccagttctctctctctcttgcccatcccccacctcggctggctcagctcagctcctaaacccgcacctacctctctgcctgctgccccggcccctgatcctgatttccccaatcgagagtccgagacccgagaggaggcacaggcacctgcgctagctgcagctgcaaatcgtcttccccagatccggcgccgcctagttcgctcctgctcgcgacagcgcccagagccgtccgcgtgcgcccgcagagatcgtttcggggacagccgagcagagcagagcagagcagagctgactctgccgcttgttgcccgttcttggctgctgttgctggcgagagcgcgcaggaggagcggctgatttttgattctctctgtccctccctccctcgcttcgctcgcgcggggtgcgtgcacgtaccatgagaagatgatgcgcgccaggcccaaaggtacattcgccgacgcgatgagggagagctcccctcctcctcctccccctccggctccggcttcggcagcggtgaaagaggacgagtgggaggtgcggcccggcgggatgctggtgcagaagcggagccccgacgccgacgcccccgccggggcgcccgtccccaccatccgcgtcaaggtcaagttcaacggcgtgtaccacgagatctacatcaactcccaggcctccttcggtgagctgaagaagatgctgtcggcgcggaccgggctgcaccccgaggaccagaagctggtgtacaaggacaaggagcgggactccaaggcgttcctggacatggccggcgtcaaggaccgctccaagatggtgctgctcgaggaccccgccgcgcaggccaagcgcctcctcgagcagcgccgcaccgacaaggcggagcgcgccgccaagtccatctcccgcatcggcctcgacgtcgacaagctcgccaccaaggtgtcggcgctggaggccatcgtcagcaagggcggcaaggtggtggacgctgacgtggtcgccctcaccgaggcgctcatgaacgagctggtcaagctggactccatcgccgccgacggcgaagtcaaggtgcagcgacgaatgcaggagaagcgggtgcagaagtacgtggagacgctggacgctatccgcgccaagaacgcggcggcgcccaaggccaaggccaaggccaacggcgacatgaatgggcacgccaaggcccgcgcgccgcaactcccgccgcgcccgccgcccgtgtcgcagaggcggaacttccagcagccctccccggcgccagcgccgcccacgcagggctgggagtcgttcgacctgctgtcgtcggtgccgtccacgtcctcggccaccgtgaccaccaccatggcggccgcgaccaccaccacctcgccggccggcgtctccccgatcccgcggttcgactgggagctcttctgaagccctccctcctcgcggcgcgtcggcgtgccggttggtcgatcagacggtacctacctcccttgtccatggatcttccctgctctcatcagtagtgccattgtttcttctgtggattctttccatttcttttcgcctcattctctcttcttttcttccatttcctttcgaatttgtatatctactatatgtctacaaaaagaacagagagaccgacgcggtgcggtgagtgtgttcactgggtcaaaagtccgtcagttgacaactcctcctcgtgaggatccatccatgcatgttgttcagtcacagcaaataagtggtggtcttattatgatggcgatgaagaagttttcatgacagtacacacacatataaatagcaggtatattttggtaacatttatttatacgcctgtgtatggttacgataaaaaaaaaaaaaaaaaaaaaaaaaaaaaactcgaaaagggg

SEQ ID NO: 2771 - DNA, 2546 bp, Zea mays
ccgctgactcgctgtccaccgcgggccttccaattatcactcccaccgatcggatccggtccgaagccggcacaacggacacttggaggtgaaggcaccggtaccaccagtcagtaccaccaccaccaacagctttgtgccgagtgaaagcaaagcaccgccgccgcccgccagcgctgggcacggaagaaagcgaggcggtcgatgccattgcccagtcgcgcgcggctatgtggcagaggcagcaggctcgcttggctggcgcccgcgccaacggttgcttggctgctaaggtcccagcccgcacgcacgccagcacgggcaagaggcccgtcagccgtggccgttctccgaaagcaagcgtgcccccgcaccagcaccagtactacccacgccacccgccttcacctactactcctgccacggtcaaaaccgcacggcaagaaacgaaccggaccggagccgggcaagaaaacgaaaaaggcttttgctccgcctcggcggcggcgtgcctggtttcctgtgccgtgatcgcgtggcgtcgtcacccgctcgcatgccgcaggcgttttttttatcggtataaatattctgctgccctgtccctgagttgtacgcgctgttcccctccctcctttttttcgtcgtctcgcacgctctctttctctctctctctctctcttgcccatccccccacctcggctggctcagctcagctcctaaaccggcacctacctctctgcctgctgccccggcccctgatcctgatttccccaatcgagagtccgagacccgagaggaggcacaggcacctgcgctagctgcagctgcaaatcgtcttccccagatccggcgccgcctagttcgctcctgctcgcgacagcgcccagagccgtccgcgtgcgcccgcagagatcgtttcggggacagccgagcagagcagagctgactctgccgcttgttgcccgttcttggctgctgttgctggcgagagcgcgcaggaggagcggttgatttttgattctctctgtccctccctcccttgcttcgcttcgctcgcgcggggtgcgtgcacgtaccatgagaagatgatgcgcgccaggcccaaaggtacattcgccgacgcgatgagggagagctcccctcctcctcctccccctccccctccggctccggcttcggcagcggtgaaagaggacgagtgggaggtgcggcccggcgggatgctggtgcagaagcggagccccgacgccgacgcccccgccggggcgcccgtccctaccatccgcgtcaaggtcaagttcaacggcgtgtaccacgagatctacatcaactcccaggcctccttcggtgagctgaagaagatgctgtcggcgcggaccgggctgcaccccgaggaccagaagctggtgtacaaggacaaggagcgggactccaaggcgttcctggacatggccggcgtcaaggaccgctccaagttggtgctgctcgaggaccccgccgcgcaggccaagcgcctcctcgagcagcgccgcaccgacaaggcggagcgcgccgccaagtccatctctcgcatcggcctcgacgtcgacaagctcgccaccaaggtgtcggcgctggaggccatcgtcagcaagggcggcaaggtggtggacgctgacgtggtcgccctcaccgaggcgctcatgaacgagctggtcaagctggactccatcgccgccgacggcgaagtcaaggtgcagcgacgaatgcaggagaagcgggtgcagaagtacgtggagacgctggacgctatccgcgccaagaacgcggcggcgcccaaggccaaggccaaggccaacgacgacatgaatgggcacgccaaggcccgcgcgccgcaactcccgccgcgcccgccgcccgtgtcgcagaggcggaacttccagcagccctccccggcgccagcgccgcccacgcagggctgggagtcgttcgacctgctgtcgtcggtgccgtccacgtcctcggccaccgtgaccaccaccatggcggccgcgaccaccaccacctcgccggccggcgtctccccgatcccgcggttcgactgggagctcttctgaagccctccctcctcgcggcgcgtcggcgtgccggttggtcgatcagacggtacctacctcccttgtccatggatcttccctgctctcatcagtagtgccattgtttcttctgtggattctttccatttcttttcgcctcattctctcttcttttcttccatttcctttcgaatttgtatatctactatatgtctacaaaaagaacagagagaccgacgcggtgcggtgagtgtgttcactgggtcaaaagtccgtcagttgacaactcctcctcgtgaggatccatccatgcatgttgttgttcagtcacagcaaataagtggtggtcttattatgatggcgatgaagaagtttccatgacagtacacacacatataaatagcatgtatattttggtaacatttatttatacgcttgtgtatggttacgataaaaaaaaaaaaaaaa

SEQ ID NO: 2772 - DNA, 2216 bp, Zea mays
ccggcccagggaaccatcgcccgggaaggggacggacagacggacggctcctttcttgtatggaggcgaaggccggcaacgaacgggccgagaccggcagcggcgttccgagcaaggctcgcaggccgcggacaccaaccccggacgggcctgccctggcaccaccggaccggccacgcgcgcacctgtcgcaacaaccccacccaacgcgcgcgtcgatcgactggggacagaggacgccggacgccgctctggcacggcgcgtctgctctgctcgccctcacggcgccagcgccaccggatccggttggcacgtccgtccatccatcctcactttcctgctggctctgaacggtgagacggcacggcatacatacaacgccatcgatccatcaagcttagaccatccgagttcttttcagcagtccagttgtgcagggcggtcgcacacacaccacacacgcgccccgtccattccattctcatcgcgatcgaagtggcctggcactggcactgccctcgctggccccaggccatggcctgtcttcgctagcttccttccttacagtataaatattttggtgcgccagctccggcctgtcccttagttgtaccatcgtgtccttttcctcctacctcctccttggctggccctcttccccgtcttcctccctcttccttcgtctctccgtttcaagccctaccgacaggcatttgcttctgctccagtgatcagccccctcccctcctggcctcctctccacccggccaaaaactgatctttttttttcggttctggtaccatagctattagtagtcgtagcggctaacttgcaagccgattgtctctagcacgcaagtgtttttccctcccctgagcttggtgggcgatcgagagttcgagacagtgtacacatacatactctgctcgtcagctgaggatcgatcgcttggtctcgttgttgcgtagataggtactagaggactatagctactagtaggactaggagaggatccgagggagagagagtaagcaggccaagatgatgcgcgggaaccgggagcagagagtggccttctcgtcgacgaaggaggccgccgcggtgcccaaggaggaggtgtgggaggtccggcccggcgggatgctggtgcagaagcggagccccgacgcggacccaccccccggcggcgcgcccgtgcccaccatccgcgtcaaggtcaagttcaacggcgtctaccacgagatctacatcaactcccaggcatccttcggcgagctcaagaagctgctgtcggagaagacgggcctgcacccggacgaccagaaggtggtgtacaaggacaaggagagggactccaaggcgttcctggacatggccggcgtcaaggaccgctccaagatggtcatgctcgaggaccccgccgccaaggccaagcgcctcctcgaggagcgccggaccggcaaggccgagcgcgccgccaaggccatcgcccgcgccgccctcgacgtcgacaagctcgcaaccaaggtgtcggcgctggagacgatcgtgagcaagggcggcaaggtcgtggacgcggacgtggtgacgctgaccgaggcgctgatgaacgagctggtgaagctggactccgtcgccgccgaaggggaggtgaaggcggcgcggcgggcgcaggagaagcgggtgcagaagtacgtggagacgctggacgccatccgcgccaagaacaaggcggcggcggcggcggcgccggccaaggcccgcagcggcagcaacaaggcgcggccgccgcgcccgcccccggcttcggcgcacgcgcatcagagccagcagcagcgccggcagttccagccgccggcgccggtgtcgcagacccagacggcgagctgggagacgttcgacctcctgtcgtcagtgccgtcgacgtcggcggcccccgtgacgaccatggcccccgcgaccagcaccacgccgtccccgcgcttcgactgggagctcttctagatggctcctcaaggcgccagcctgccacacccccctggcctggcccccatctctcgccacttgtgtgcctgtccattggctcggccagtaccttctcctgttcgccttggccatggtgcatgtcaatcgccattgtttctttctttctttccttcccgctctctttattctgtcattcttgctgtcctttgagcgattgaaagtctgtgt

SEQ ID NO: 2773 - DNA, 2401 bp, Zea mays
actgtctaaaacatttttttctttgcttgaagcaagcaccttcccctttctctgcctccctctcccctccatatatacgccggggccccccccggccggcctcgcgcgacgcccatgggggaggaggggggcctgatctaatgtaggggcaggaggaagcccttccactgttccatctctttcccggagtaggtggtgggcacgacgaaggcccctcgcccccaccagattcgtgcaactcggcgcctcatccgatcagcaccggccgcccaacgcgctacagacgcgctgccgcgtcgggactctggaggacacggcggcggcttggtggattgtgggagggagggccttctcttggatttctgttgtcgaggacagggtcttgtattagctagctattcactggatgttggcgatggggacagaagagtgggagctctatccttgttcctacagcggctcacaggtgatagagtacaggccggtctctgaagacgaagacggcgaggacgaccagaacggggccgacgtggcagtgtcgctggacgccgttctcccagacgatctcctggagaaggttctttccttgttgcccgttgcgagcgtcataaggtccgggtccgtttgcagaaggtggcatgagattgtgcatgcgcagaggcacgcgtggagcaagacggtgcccgagaagccatggtacttcatgttcacctgcagccaggatgcggtttcagggttcgcctacgacccgagcctccgcaagtggtatgggttcgatttcccttgcatcgagaggagcaactgggccacgtcctcgtcggctgggctggtgtgcctgatggacagcgacaacaggcgcagcgtcctggtgtgcaaccccatcactaaggactggaagaggcttcctgatgctcctgctgctgggggcaggacagctgattacagtggcctcgccttctccgtggacagaagcactcatcgctacaccgtggccgttgcaaggagcagccaggttccatccgagtattaccagtgggagttcagcatccacttgtacgactcggtgtctggcacctgggcgactcccttcacgggggtgttgcttgggtggagaggcggcgacgagtgcgtcatctgcgacggagtcctctactacctggtgtactccacgggggttgtgatgaacgatagcgagcatcgccattgccttgtgatgtacgacctcgctgcaaggcatagtagtagcagtagcagccacacctctctgctgagcatggctatcccggcgccgtgcgcccttacgtgcggccggctgatgaacctgagcgagaggctcgtgctggttggcggcatcggcaagcaagacaggcctggagtcatcaagggaatcggcatctgggagctccgtcgcaaggagtggcacgaggtcgcccggatgccccacaggtacttccaagggttcggcgagttcgacgacgttttcgcaagctgcggggcgcgtgatcttatctacatccagagctatgggtcgccggcgctcctcaccttcgagatgaaccacaggtcgtggaggtggtccgcgaagagccctgtttccaagaggttcccgctgcagctgttcactgggttctctttcgagcccaggctggacattgctctctagtttcttgcctcgtgtctacctcccaccagaatcttcgcgttgcattttgtatggttttgtggagcggccaaagcccaggaggtggtgctgctgctgccgttgaagccatttgagcacagaaaatgccccttctttttatactgtagctctattcttttctttgttgggtctattgggcagcagggtatatgcattggaatgatcagttaaacttcgccgatcatttttgttgacctggacactggagggaccgagggagagacgatgatgtgggagcaacttgcctaagaactattcctgttccattgctatgaaggagagtagtccaccattgctacggctttctttgagctattttttgaagagcagagcctgttactctgcttgtgatctcatattaatctcccttcatctgtctgcagatggaaatcaaatctttctaacactgaacaacagacgtgttttagccttattgtatgcaaagacaagtagtagtatatccgttaagaagtacatgctgcacagcggtgctagaatcattgcctcctctctctagccgtcgttcactcgtttggatggatggatggaaaacgatcacattatttcttcatcctgctaccccgccagagctgtctgtcaatctgcaccgaaagcagctaactggttgtacctcctagaaagcagcgcctgcgtatatccatcctgctgttgctgtcactgcctgcgcaaaacctgtgt

SEQ ID NO: 2774 - DNA, 7286 bp, Zea mays
  misc_feature (489)..(489): n is a, c, g, or t
  misc_feature (843)..(843): n is a, c, g, or t
  misc_feature (1079)..(1079): n is a, c, g, or t
cgtcgttcgacgtgtgtttggctctgtatgttcatgtgccaagagttctgctcttagtaaacgtgttcattaccgagagtaggactttgtcgagtgcgaccctcggtaaagcgccgagaattcggtaaaaagtcggattccgatagtgcgtgatccgcttacacaggcggctgtgaagagtcaagactgaagagtacgcacaacggctaagactgtttcttacaaactacgtacttaactctgttaggttaggaaaccgacaagagcgggcagcttatttatgtgattaactactgtacggaaccagcaatcataaatgccgccatctgtacttttcagtcgctggttaaacatgtagtagcttccccttgggcacgtgaagaggacgcacagacggatcaacggctacgcatgactgttaatttaagcagtgagaagtgacagtaccagtagctgtttgttagatgagaaaggagagagtactggaantaataatgaaacctagtgccagtggtattagtttcaaccccgtcctgacgagattcatcactagaactgttcgtacgcagctgaaaacaagctactagtacggggcggggcacacggccatatatacttgcgtacggctacgagatacgtatgaccgatactgatccgtggctgaagaacgacagataggtcagctgtgcctgtgcgcatagagacgtgcatcgtctctcgtcgtcgtttgcgtcttttgcgcgccagatgcgagatgatgtgtacagggatgtggtcgatgcggccgggccacgacgagcgacgacgacgacacgagcgaggctgaaaggatgctccaacgcntgcggtcagctgacgatgccgactgaggccgggcgggggaggtcgcgccggcccgccatgcatgcctggacgccgagcacgcacgcacgccatgtgtgtccggtgcaacctcagctccgtctgtcgatcaacttgctgtgcgaaacgcggctgccatcgtcgcgtccaaatctcgtagaggaaatagaggtaccggcggaggattagttctctgtcaacaagaaggcatccgaagntggccagtggttggttagtggcatatcagcaacttgcatggccaagccgaagcaggcaggccggacgcgcggtggctgtcatgatgatgagaggcgaaggcgagtcaacatcccgctggcttggcaagccgacactactcgcaatcgcatgcagctgcagccatgctctgcagttaccaaataacaatccagggccaaaccgcacgtgctaccgttcgcggttgcagttgcagccgtgggcagacgagtaatttcgtcccgccacgctgcgctgcttcgtcgtaggcgccgcgtcggtcggattcggacgctcgcgagccgtgggtggtgactgggcgagtagtaggtgcagggtcaggtgtcaccgttgcccgggcccggccgcccgtaggttatacggtcgctttccgatcacgtcgccggagccggaggcggggcgggcggcccacacacggtgccgatgtggggggttggcctgccgccgcgtggacctgctgtcggtgcggctcctcgggccaccgacgggtgggctcggcagcaggaataggaatcggcttggcttgctttcttttggcgggaactgggtgggtgacaccgttccgttgggcccaagtggcgtgggcccgcctccttatagggtagtttcatccccatcccgtcgtcatcggtgacaaaagttgtaataaataatccttcgtcgccgtccacaccccaccgtagaatagaacagtcgatgtattcctgcatgcaagcaaataagagctttttaccgcggacgccggaagcggcatgacgaggaagcaattggagaatgcactctcggtcgccagcggccaggcccccgtcgcgccgcttcgattgatttgggaactaggcctgttgccatatacggccatcgcccgcacactacctgatcgacatctcatcatcgtcagccatcatgcagctaggcagctagctacctaccagccttgtctaatttatcaccgaggagatacagatggggccagtcacagggcagcgaagctgccgcctttccatcatacgatgcgacaaccagaacggaaatctctggcatggaaaatactgcgctgtacagctgtactactactctacgtaccgatcgaaattccccccggtgattcgtgctgggtgacatgcatgatgcctgcaggctgcagcctgctgctgaggccgctgactcgctgtccaccgcgggccttccaattatcactcccaccgatcggaatggatccggtccgaagccggcacaacggacacttggaggtgaaggcaccggtaccaccagtcagtaccaccaccaccaccaacagctttgtgccgagtgaaagcaaagcaccgccgccgccagcgctgggcacggaagaaagcgaggcggtcgatgccattgcccagtcgcgcgcggctatgtggcagagccaggctcggtttggctggcgcccgcgccaacggttgcttggctgctaaggtcccagcccgcacgcacgccagcacgggcaagaggcccgtcagccgtggccgttctccgaaagcaagcgtgcccccgcaccagcaccagtactacccacgccacccgccttcacctactactcctgccacggtcaaaaccgcacggcaagaaacgaaccggaccggagccgggcaagaaaacgaaaaaggcttttgctccgcctcggcggcggcgtgcctggtttcctgtgccgtgatcgcgtggcgtcgtcacccgctcgcatgccgcgggcgttttttttttatcggtataaatattctgctgccctgtccctgagttgtacgcgctgttatgttcccagttctctctctctcttgcccatcccccacctcggctggctcagctcagctcctaaacccgcacctacctctctgcctgctgccccggcccctgatcctgatttccccaatcgagagtccgagacccgagaggaggcacaggcacctgcgctagctgcagctgcaaatcgtcttccccagatccggcgccgcctagttcgctcctgctcgcgacagcgcccagagccgtccgcgtgcgcccgcagagatcgtttcggggacagccgagcagagcagagcagagcagagctgactctgccgcttgttgcccgttcttggctgctgttgctggcgagagcgcgcaggaggagcggctgatttttgattctctctgtccctccctccctcgcttcgctcgcgcggggtgcgtgcacgtaccatgagaagatgatgcgcgccaggcccaaaggtacattcgccgacgcgatgagggagagctcccctcctcctcctccccctccggctccggcttcggcagcggtgaaagaggacgagtgggaggtgcggcccggcgggatgctggtgcagaagcggagccccgacgccgacgcccccgccggggcgcccgtccccaccatccgcgtcaaggtcaagttcaacggcgtgcaccacgaggtcggcacctgctcccaggcctccttcggtaagtaatactaataccatagcacaccagtgagattcctggcaattccacgagctgcttctgaccgagatgggcgcgggcgatgctcctgcaggtgagctgaagaagatgctgtcggcgcggaccgggctgcaccccgaggaccagaagctggtgtacaaggacaaggagcgggactccaaggcgttcctggacatggccggcgtcaaggaccgctccaagatggtgctgctcgaggaccccgccgcgcaggccaagcgcctcctcgagcagcgccgcaccgacaaggcggagcgcgccgccaagtccatctcccgcatcggcctcgacgtcgacaagctcgccaccaaggtagtaagggtcgatggagcaaccttactaccacttcttcttgctcacggtggccacgtacgggtgttcaatttttgggctgttcaacttactcgatgcggtggtgcaggtgtcggcgctggaggccatcgtcagcaagggcggcaaggtggtggacgctgacgtggtcgccctcaccgaggcgctcatgaacgagctggtcaagctccccaaggtgtcggcgctggaggccatcgtcagcaagggcggcaaggtggtggacgctgacgtggtcgccctcaccgaggcgctcatgaacgagctggtcaagctggactccatcgccgccgacggcgaagtcaaggtgcagcgacgaatgcaggagaagcgggtgcagaagtacgtggagacgctggacgctatccgcgccaagaacgcggcggcgcccaaggccaaggccaaggccaacggcgacatgaatgggcacgccaaggcccgcgcgccgcaactcccgccgcgcccgccgcccgtgtcgcagaggcggaacttccagcagccctccccggcgccagcgccgcccacgcagggctgggagtcgttcgacctgctgtcgtcggtgccgtccacgtcctcggccaccgtgaccaccaccatggcggccgcgaccaccaccacctcgccggccggcgtctccccgatcccgcggttcgactgggagctcttctgaagccctccctcctcgcggcgcgtcggcgtgccggttggtcgatcagacggtacctacctcccttgtccatggatcttccctgctctcatcagtagtgccattgtttcttctgtggattctttccatttcttttcgcctcattctctcttcttttcttccatttcctttcgaatttgtatatctactatatgtctacaaaaagaacagagagaccgacgcggtgcggtgagtgtgttcactgggtcaaaagtccgtcagttgacaactcctcctcgtgaggatccatccatgcatgttgttcagtcacagcaaataagtggtggtcttattatgatggcgatgaagaagttttcatgacagtacacacacatataaatagcatgtatattttggtaacatttatttatacgcttgtgtatggttacgataaaaaaaaaaaaaaaattccagtgcaattgtgcaaagcttgtgtgtgtgtgagagagggggcgactgagatttgctgtgcaggcgcatcattgattgggttctgggggcttctgttttgtggccttgtgggagccgggcacaattattggtggccaccccgcgtgggcgtgcctgccagtccaggcgcggcgggaccgacgggcgccggccgaccagtgagggtgctctgctcgactgattcgtgactgggtgcgctgtgttatgtctcgccctcgcgaaaccgtgtgtagtgtgtgcttctctatttcagtcaacgcttcagtacagtttcaatttcattgcttcgaatgctaacatctttttccttctcgatttggaaattggcacatctcacctgactcagcaattattttttttactcttacttatgccaatatttaggcggtggtcagaaacatttgttagttttatatgaattgattttacttaggaatgaagggagtatttagagttggtttgtaaccacgttttttttttttgaggtttgagtaaccacgtcttaataaaattcagatgttagtagctttttttttgaacccaggtgttagatacttatcaacatagtttgtattagtgcatagttacgtctaactaaaaaaatacgtacaagcccttcatagaaaagcacaagtcttatcccttcgtctaaaataaaaacatgtcactgtaaaatttgtcgaacaaagtgacttgaggtaaaataatcataatggtatatttactagaacaagactaataacgcagttggtttttagtctacttatatagtagttatctcttcgctattactatatatggcctagatgtcactattataaagttttatttggtttttatgtcaaagcgggttgtaaacatatagtccgtttctcacctctctcctccacttcagcatatagttgacttaatttgtttattgcatttgcacttagagatagttcttataaaaagaacatgtcgcttgattaatcatctacatttacgcttagataatggtagcatttagctaaataaggaggctctatgcaacttagttacagacaaataagcaaggccgttatggaggaaataaattggatagtccgaccacttgtcctgatgatacagtcagtttataggtcaaaagtttgaatcataccacctaggagtatcttaaatgtctttcctaggcttgctctctaaattctcatttaaagagtcgttgtttgaataaacattgccgtctctgtattttcatcgcccaacagtttaaagatctaattagtgaagccgttaaagaaaacatgtttttttaccaacatctttatttctgtcgataggggaggaatataaagagactagttgatctaagacgggacattccggacatagtatggaagaaccacgggggaatataacttttttttttaagttgctctaacatgggacatgtctaagtctcaaaaatacatgggacatgccacatgtggaagcaaaaaaaaaaaaacccgcagagaagctggtttaaacctaggagtgaggcataactcacaaaattagatggctaacaaaagcaagggcttaagagccctttaacacactcgagtggcgttttcagcagtgtaccgcgtgtctcggtccaagctgtttgtaaaactctgatcaaataaatggttgatgagcgtttccaggcagcatcatgcatcgaacaagctcgacaatataaaagggtgccagtttgcctcccagctcgcgtttctcaacaagtctgacagtagaagccacctagcagccgtggaccgcctatgtatgatacccctactactagtagatctgtaggtggaagtcacaggctcacagctgagcaaaatcagtttgtttgtagtagccccgagcccccgatggaacaaggaagctctagagtctggactggagaagagacgaccacgtgcacgttgaaggaccacgaccagtcgtgtccagacctaaagcggttcctagagcgcactttccagggcccaatcgagaaatgccaattgctaggagccgttgcgatgcaagcgacacgccaggccagcaaaagaaagcccatcgatcatctgccgttcgctgatcatccttctctgtagactgtagtcctatcctatagatagatggagattactactag

SEQ ID NO: 2775 - DNA, 3315 bp, Zea mays
gcacgagaccattacctagaacatcctaatcaaaaaactgaaccaaccaaccaccgctccttcttccttccttccttccttccccagttcccctcgtctcaccagtcaccaaggttccgagagcagagaaagataaaaaaaaggtaatccgacggaaacgacaagggcgcggcgagggcggggacagggtcggggaggccctgggcgcgggggcgccaagcgcatggcatcgtcgagggtgatgccgtcgtcctcgccgtcgcacacggcctctgatctcgcgcgcctagcgcaggccgccagcaggcccggcggcgggggcagcgggctgggctccatgaacgtggaggagctcctccgcggcatctacagcgacatgcccaccccggcgccgcccgcgtcggagcccgaacgcccgaggtcgccggccccggcgccggaggtcgccacgcggaggacggcggaggaggtgtggaaggagatcaccggcggaggtggcagtggggaacccgcgccccccgtggcggctcaggctgccgtccccgctggtggggcccccgccggcggcccggagatgacgctggaggacttcctggccagggaggagggcgcggtgaaggaggatggggttagggtttcgggcccctctgcgccggccatggggttcctgggcggagcggagggcgtgggtgtgcctggcggcggaggcgggaggggaaggaagcggcagctcatggatccagtggatcgcgccgcgatgcagcgacagaaacgaatgatcaaaaaccgcgagtctgctgcccggtcacgggagaggaagcaggcttatatcgccgagctagaatcgctggtaacgcacctcgaggaggagaatgccgagttgttgagagaacaggaagagcggcaccagaagcggcttaaagagctcttggaacgggtgacgccagtcattctgaggaaaaaaccatcaggagatcttagaagaacgaactcaatgcagtggtagattggagccaagctcagtcgccgtctctttacagttataacatagaatttgcccctgtatgtcatttttctatttatatatgcgccaactaagttgtagtatcttagctgaaatagcatgggcaattagccgacacaaaggttaaacgaaatcatattatgtaggagtgctcatgaccaagaaaggttgctgttcctgcctgctcgtgtgttcattccgcctggtttatttttaagattttgttgtcaacatggcaggtaggtttggcaaggaagtagacaatcgtactccaataagcaggcctactttaagtgaaactgaaacgtcataatgctacgcagcgtctcggggcgcctacctgtggcttacctgcgtaaactgaaacatcgtaatgccagggagcttccagaggcgtgtaccttgttggtgcttgaatgatcaaaatattcaagataaagcgtgaacttgacgtgatatgatgactgctgagaccccattaataaaagataccaatgattggtacaagccaataccccttctggtgaccaaattcaattcaatttgctggatgaaatctggaataatcatgtttttcaagaaccataatggccaatgggcatgagttcgcatgctacttggtactggagagttaagaacagttcctcctgtaaacatcacattcttacagaaatggcaaaacacaacacatactggtgacttccggggctccagggcaccagatgaaggggatattgatcctatagctgcctagcatcagcaatgaagatacttccagactcgcaccaccctgctatcacatcattgttggcacactgcattgatttgaaaacaaggttgtcacaaacatataatattttttgccgcaagaatcatctgactacatttttatgcaaacatttgctggcaagcctacaatcctacattctgcatttatattatgtttgggcttcaaaaatggggcctgaatatgggagtacctttgaaaaccccaaccagttggaatcccctcgaaatgagaatgctcgctcactttgtttccaatgtcccctgcttgcctgcagtatgtatgtcacacagtcacagcgcctgtattatccatgatcggctaaaatagcataaaatatttttatatgggtcaaatctaaccacattctcaaggctacaagtgtgcagtgcaatctccatgccatggagttatatcccacataaaaagggcagacccagtgccaaagcctcccacatgatggggtctagggaaagaataaaccgaaacaagcctcccactgcaatgaggagaggctacttcgaagccatgagctgatgactccgtgagacagctctcaccactgcaccaggcccgcccttcagttatatcccacataagtaacgtaatttgcagaagtattcaatgaagccaccaatgataaaggaatgccaacattggaattcaaaataaatggcactcatcgtgatggaggcttttgtaatataaataggcattcaactttcaatcacactgctaatagttgaagctgtatgtgttcaaggtccacagaatacaaaccagatgtatacctcataatcaacaccttggacgtagatgaaagattcgtcaactgatgaaaacgcaagacctgtaatctgcacaagagagcaaatagactagctaaaaacttccccatgtgaagtttactgcatgaaaaattgtgttcctatttatgcacttcaagattcttccagtaataaattacaacatgaaatatacatcaagtaaaataagaaggaattaaatcaaacctcaaacttggagcagcccacccatcttgacagagcagaccacctacataaaaaatggaaaccaaactgatcaatcaaaccggactaattcagacagatggccaaaagctctattatcaatctttccgcctattatttgtattggatacaataaaaaatgaacagaaaatactgggataacaaatgcagacagagtgattatttgcagtttcaattccttaaaaaatcatgaaatatcgaaatcacctgcgaggatcatagatggtgacagcacgatcagttccaccactagcaatcagtcctgaaggtgagctacatgtggagtatataatgtctccaactgatccagtaatgcgatgtacgcatcccccattgttattcattcttaggtcccagatgctcagctgcaattatttaccatgaggaaagacaacagaaaaaggaaatttaacagaggctgagctagaatctaacctgagaaccttctgcag

SEQ ID NO: 2776 - DNA, 2964 bp, Zea mays
ggacgtgggcccccgacctgggagtccgtccgacgccaccatcggccatcgcctcgtccgccccatgatgctcctcaaaccgcacgcgcgcgcgcgactcaccgccgttgtcgtcgtcgtgttcgcggagatccgcggggctcgcccatccccctcctccctgctctcctccccagcacccacggcccgctgctgcccctccgcgcgccccctcgccaaaccctagcttggccatctccccccactgccccggcgccaccacctgccctgccctgcgcgtggccggcggcgccgaccgccgccattgtcttacggaggcgtccgagtcccgacgcgttggaatgcgctgactgaagtgtgatcattgaggttctggttaaagaaacttctagtatcgattggcttccctcccatggacaagatacaatctgattgcccttatcctggatgtttcttttgtgtcatgaaggaggcgaaccctagtaaacgaagagcaagtgtgttaaagtactttagggaacttccttcccaagacgatgatggtcaagttctccctattagtggtctctggaacacagcaatggctcacccaaatgatcccgagttcatcaacttgggcatatttgaatgcatggcatctcttatatggaaagggttgaaaaacaggcgttggcttgcacatgatcagaatatttacatcccatattatgcagctcacataattggatcatacacaatgaatatggaggagtttgcagagcgtgctgttcgtgctggtgtaatacctccattagttgaattattaagaggtaggttgacatgggtcgagcaaagagttgctgttagagctttgggtcatttggctacatatcctagtacatttcctgcagttgccgatcatggggaagtacttgaacttgccattcaacttgcttcgagctcgctagaaattgtgtactctcacttttaccagtttgtggatcgaagacttggctaccattgcgaccttcttactcgtggcatgggtggtgtggaaatggagtcccgcaaagctgaggaatgggcaagtcaactgcagcgctggtctttgcaactcattaactgctttgcatttaagcctgaattcctccatgatatttgcaagcctgattttctagtcaagttacctggaatgtggggtggacttgtaaatgagaactcacctgctggtgttggtttgctaagaacaatctgccagagcaaggttggccgaggtcatgttgctaacattcctgctactattgatgctttatgcaacattgctcgttcttcagatgactggcaatacatggcagttgattgtctgatctggttaatgcaggatgcaagtacttgtcataaggttaaagatatagttgcgccaacactgatagatttatcagatatttcggcactgggtgattataaaaagcttggtgacacaattgtcacagtcctccaagaatgtatgcaacagagtgggaactcacgtggtgcaattggtgttcagaccaaagcagaaattgatgagcttttgagatccaagcaaagtctgaaattggaaaagagtatgccaaaggaggatcttcatataaaacaagctgcggcattggttgtcaagttggaaggcaattcactgttctcctcagggaacatcgcaggagctgcagagaaatactctgaagcgcttgcgttatgtccgatgaaatccaagaaagagcgggtggttctttacagcaatcgagctcagtgttaccttctcttgcagcagccattggctgccataaggcgatgctactcgagcattgggccttcacagccccgtgaaccgtcatgccaagagtttgtggcgaagagctcaagcgtatgatatgcttggtcttgcaaaagagagcttgctggacgcaatccttttcataaacgagtgctctcagtcgaacgatcccgacttatccctgaagcaaaacaaagtccctgactatgccgagcggttggtgaagaagcagatgcgctccgcttggctattcagggaagcggctctgaagcacgggggcgtacactgtgaaggagatgctagcgacgcgtttggccaggatgctgacgactctgagtgggaaacggctagcgaaagcgacgccgagaatgatgacacgggagaagcggatgatggaactgaatggaagaacgatggacaccgggaagatatctgtgagaaaagctgaggagcagggcaagctgaacctattcagagggagtcaaactgagcagtgacagaagcagctgctgggccttatgaagtctgctgcgctatcagcctatcaagcatcagatctttctaatgcagcgatctggtaacatttctactgtcctcgtcaaagcaaagccccagttaaactaattccccacgtcttgttgtttggtcagttgagttattgcgcctgcgaccattcaatgtttccccttagatgttggttctggtttggtgtttgtagcatgctctttctttcaccagtttctcaactctttgaatgaacaaaactgtgcattatttgttcttttttttactattatttctgtagtctggcgaagaggccataatactggcacccttccctttccactggacttatctggaacgagaagagcacgtttccgtctacctgctttttttggctataccatgtcaactagcaagtaggggttgttaggttgggtcatgctcttacaatgaaactggcgtgctgggcacttgctctgctagtctgcttgcctgaagcttcttgagagcgttgctgggggcaaaaatgccgacagacgtgttagtgtgtgccagtgcgtgcgtgttacttcttgtgcttgcacagatgctttcagtaagcacatcaatgtttgtgtgtacaaatgtagcatgaatgagtaattggagcgtgaaaaaaaaaaaaaaaa

SEQ ID NO: 2777 - DNA, 3939 bp, Zea mays
gcaagccgggccggtgaattaacagcgactgcggtgaggcgaccgttgcggtgccgtgcattaaaccaccctgccccccctgtccccccccctccctccgcccccgcgcctcgccgtcggcacccgcacccgcgcggcacggcggcgtccggggtccggtgggctgggctgggctgagtcgacgagcgcttgagctgagccgtcccagcgcgggggcgatcgcgtcgcctccggcctactccaggagcttcaactgatcgggcaatcggttgtcttcgtcccgcgttgaagtagattcggtcaaaaagtcaaaccgacgtgaggggaatttttctggtttggtttggcttggtttggtttggtctggatccgaaatgctgtgctggaaagcggttggtcagtaaatcgccgctgctaaagtttctgctccctgagctcagttggatcggagagttttagttcagtgtgcccatcctaaaacagggcgagttctgccgtgaatttgttggcttgtgttgtttgatcacaactgtattaaaaaaaaggatcgatctttgcggctacaagagagtgacaacaaggaggcttggtcagctcgttcctttcacctgtttggcgagtgcttgaggaagaagacgacctgctcagctcctcctttggttgctcatcgaatcaaagaagactagggaaatgggggtaatgtcccggcgggttctgcccgcctgcagcagcctttgctacttctgcccatctctgcgggcgcgctctcggcagcctgtcaagcggtacaagaagatcatagcagatatctaccagctgcaaccggatggagagccaaatgatagaaggattgggaaactctgtgattatgtctcgagaaatccaacacgcataccaaagatcacagagtatcttgaacagagattctataaagatctaaggcatgagaattttacgttggccaaagttgtgccatgcatctataggaaaattctttgttcatgcaaggagctcaggccattgctagccacaagctcattaagcaccattcacactcttcttgatatgaaagcgcatgatgatctacaagttctgggttgtcttatgcttgttgacttcctgaatggccaggttgatagcacacatatgtttaatttggaaggcctcataccaaaactttgcaaaattggtcacgaattaagagaagatgatgaagggctccgtcttcgatctgcagctcttcaggctcttgcttctatggtccaatacatgggcgaccactcacacatttcaatggaacttgatgaagttgtctcagtgatcataagctgttacgaggctaatcaaacactctcaataaaagaggtagtcagatttcaagatgatgatgatttggtcattaatgggaacttggctgtgttaccagtgtctggacaaaatagtgccaaagtggcatctgatacaatgtctgcatctgaaaatccagcatactgggcaagggtttgcttgcgaaatatggctaatattgcaaaggaggccacaactgtgcggcgtattcttgaccctcttttccgcctttttgacagccacgactattggtctcctgaaagtgggattgccctttccgttctgcaagaaatgcagaaactgatggacaaatcagggcaacatggtcatttgttgttatctttcactataaagcacatagaccataaaagtattgccaagaattctgtcaagcaaatcaatattgtaaaagttgcttcacatcttgcaaggcatgcaaagttgaaggcatcagtgacgatagcaagtgctatcagtgacttaataaagcacttgcgcaaatgtatcctcgtggccggccgggccgctaatgcaaatgctgattgtgacaagtggtacagtgcactttatgtggccttggaggagtgcctagtgcagttgacagaaaaggttggggatgttggtcctattcttgatatggttggggtaatgcttgagaatctctctcatactgctaccatcgcaagaacaacaatttcatctgtttatcgcacatcacaaatagcagcatctgtctacaagtcatcataccatcagaaggcatttcctgaagctttatttcaccagcttctcttagcaatgttgcactcagacaataagacaaggattggttcacatcgtgttctatctaccattgtagcaccttcaatggcgtgtccatggtcggacatcagctttcctatcccaatgaagggtgatgattcacataacttgcatttgttggttctctcagctttctcttctgaggccataatcaatgaaacacggaccaaaaacaagatccaagaatccttgcaagaaaacaacaaatcagaagctatagtggatcctgagaatggatacacacagacagaaccagataaaaggaagtattcaggggggccatgtctaaatgagcattatcgtacagcttttaatgatgaaaacttaaagttcatgaagttgaacgaccaccagattgttctccttctttcatctatttggagtcaagcatctctggatgacaacttacctgcaaattttgaagcaatgggccttgtctacagcattgctttattatgttcaaaaccaaaaagctccagtcatgtgacacgtattcgttgtttccagttggcgttctctctcaggagaaactctcttagccctgaaagtgatttgaagccatctcgtagaaggtgtctgtatacgatggcatcagcgatgctcatcctttcagcaaaaattgctgatctccaccagataattcctcttgtgaaagccgcagcaccagagaaaatggttgatcctcatcttcgcttgatggatgactgccagcttgttaatacctctgcagagtcatctaacagcgagatggtttatggttccgaggaagatgaaagtgatgcactggcttttctttcagccatcaacaagcctgacacagagttaatagaaaccgtgatgtgccacttcagggagaagttcgaaaatttaccagagaaggttaacgggatagaagagcaacttcttcaagagttttccctggatgattcgtttcctcttggtgctccactattcatggagatgccacactcttgttcaatgtatgcagaaaaggatgaagaatgttttgacgaggacactgttccttctgagctagacgatgacgacatcatctttgagcatagtgggtctcaatctgacaggaaaacgtcaggttccatggcttcgtcagatgttctaactgtcaaccaactaatagaatctgttcatgagaccgcaaggcaagttgccaacgttccagttcccgccaaccctgtaccgtacgaccagatgaagagtcagtgcgaagccctggtcatggagaagcaacagaagatgtctgtcctcttgagcttgaagcattcgaggactgactcgcatggttcagccggtgtggatgggcttgaaacgaatgagtcttctctgctgtctgagcctgagttacagtcaacaaggaaggggcgcatgcgccgctgcgattcagcgtccagcgaatcagactgttcgttcaggctgccacctgctagcccatatgacaagttcctgaaggcggctggacggtagcctgatgcggttgcggcagcttggcgcttcagttttcaactctctcaagtctgcatgagagttcagtacaagtgattcatcggcaccctctcgttctcggagtccattctttcaagtgtatattatatttacatccctcgacacaaggtgtataaagttctgttactgtttccttcagaataaaccgaagtgtataggcactagcggatgatcatgttcaagacggtatttgttcatttgttggtcgtgaaaagaaaacattttacacaaaaaaaaaaccagcgtccg

SEQ ID NO: 2778 - DNA, 7536 bp, Zea mays
ccttggatccgacgccgtacagagcatcggtccctgccagtgaatttaacaatgtttttttaatatatatatatatatatatatatataagaattaactagcgttgagcagcattccgctcgatcggactagcagtctctgacccacggtagtatggggcgtattcagaatttctgatcgactaaagtttggcccaaattttagatactaattagaaaaggtctaaatatattttaagtataaaattaattgtataattcatagttaatttatgaaacgtatccattaaatttataactaatttatgatcttggctggccctggaggaaagtaggcttttaaggtgacctcacgtcacgtcgcgtcctacgctaacgctagcggtacggtagttcgctaaaaaggtctctaggaaactcatttaccgtaatacaataatttaataaataataggctaagtgcacaggattacattgttctcatccatcttgatcaaataactgtcccacattttaaggggtgtttggttttagaaatcattgtatttaagatgagcttgtgtatcatgagttcatttttcaaatttggtcgtgtaactaactataataaataatctgctaatgaatcagaaaccaaacaaaaaaaatgaggagtgagaagatgataaactaatttatttctcaaactaaacaatctgtaactgcatcttccataaatcaatcggctgtcttccacactacgcataaaaagcaatggcgcgctttcgcggatgggtgcatgcagcatgcaccagggatgaagtcatgaacgatatgagatatgacgcggccttgggcggtgccaccggccgtgcatggctggatcgtaccttcgcctgtcgcaaaccgtggggtggacgctcgtgcagtcgtacgtcctccggacgacggtggtagctgtccatgacgttgcgggccagaggtctcacggccatagactccggggacggaatggagaagtttctttctccatgacgatacaaatgccccgtgaaacaaaattagtaatgcatgaggagatgaaacggagagcacggaccgccacagggaagcagaagctggcggggtagcgcgcggcgccccttgtcaagacgcaaaggaaacgaaattacggcacctcctgccccgcgcgcgtacgaacaggctgacagatacatggaacgaggtgcacgacgcgcagggatggaaagagagagtagtgttgtgtgtctgtgtctcagtatcagcagagcagagggaggagctagtgcttggcggcttgcctgcgacgacgcacgcacccaccctttgccaaacacagcatctcgcgcccccttttttttacgcctccaccccctctgcaaccacatgcacagtccctgcaaacgacgacgcagcgtgacgcgcatcgaagcaaccggttggctgttggccgcgcccgcgcgcgcaaaccgacggcggcgggcgggcgggcggggacacagcgtggcgcggccgcgctgtgccgtgccggtgccgcccccctcgtcgcgtagccggctgtggacgcttgcgttccggctagcgccgcgcggctgatcgggctaaaaagattcgtcggcctgttgaggagatcgcgatcggcgcccctccgccgctgcctgcgcagcgcatatcggtgcgtggtagtactacacaccgagttgcctgcccccggtcggtgcgtttcagcgctcggcggcaggtccggccggggcccccggggcgcaggccatgtgctcacgggaggccgcgatcttggtcgcatcgcatgcccgggtgcgtgcaccggcacgccggtgccgtcgctcgctgcgcgctcgtgtctgacgctgctgctcccgtgtctttactacgtgtgtccacagtgccgcaaaacggccagtccgtctgcggaagcgtagtagtaataaatgtggcgcgtgtggcatgcggcgcgaggatacagtagttccctgccgctgccgatcgggttctgacgcagtgacgctggctgcctccgaaacaatggccgcatctggaatgtcccccgtgagcgtgacgaacggattttgtgtacacattcgatcgagttcgtcctataacagttacctttgtaagcaaataaataaataactactagtacaggtagagtgttgcaataactacaaagttgcggatcggcacccctaatatctacgcagagtgcctatgggtgccaaaaggcgacaccacaggaagagagatcagtggaccagagcaacagcaaagcctatggatcgatcacacaccatcattatcgaatacgaattggtagagtatcaaggtcctttgtggggggtccaaccacacaaaaccacacgaaataattggacccgcctgaaatggaggagaggacagaaaggaagcgggtcatccatcaaccaccagcacgaataaatagtcttttgccgtcgtcgcaaggcctagaacgtccgtccgtccgtctacggagcggggtgcgacggttggaggcacgtagctttcgccgcggctatctccatcaagcagtacgccgagcagagtatggcgcgcggctgcaccgttccatgcactgccaggcttttccgccgtggtcggtccccgccggcctgctagtacgtacgacgtactacgtgctaacagccagccctccctcgctaacccgcgctctcggctctactgtacgaccgaaggcagtaggcagctgttgtgttgactgtttgcctactcggacaggaatcactggcacagctagcgagcaccgaaccctgcaccatgcgtgccgtcagagagttccacagaggaaacggcagatcggcaacgccggtgtcatcttccaggaaggcgccgtgcggtactgtcgaccggtagctgtagatgtgtaggaaatgcaggccgggttgctgttgaaggtggcaacggaagtattgtagcctgtgtgaccacccacccaccaacctcaccggacgagaatgcctggcgatgaacaggcgtgggtgggggtggggcaccgcaccaaggggaggccctggctagcagccactgcggcactgccaggctaacagatcctggccaccggccaatcaaaatcgatggcctggattgctggcttgggtagtagtagtagacgagtttgcgtaggcaagcatgcagcacgggccttcaaaaagcctacgcaaggctctgtttttgtttcccccacccgttcatatcgattcttttcgggagaaggagtgctcatcgagctgtaatgacaaaacactccctgacacttggtaccacatgcttcggtcaaagtctccttatgatgtcaggccacattaaccgccgatcccccctggatcaacgtcatgcccggtacggaaaaaaacgcatggtagccaacattccgagacagctttgacttcccagcatctcatcctcttattttgcactgggcaatgagaatttttttctctctcactctctctcatcacgggagaagctaaataaccggctaagatatgagacgtcaatatatatataattggtactggtaggctcgcgtgccaaatgacgaatcatgtggtataagggtctgttcggtttactcggaacgatgacctggaacgagtcgtagctagattgattgtacaatttacataagtttgatcagatggaactattcgtggatagaatccccgacaaccgaacagggcattagggcatgtacagtggtgtttaatgtggagtctcttaaggtgtttaagggggttatttgcaaaaaaatcttagagccgtctctccgtgaagagacgcctctggctcgtaaaccaagtagcaacagacgcctcacttcccactgtacgaatttatcgtctgttctatcgatctgatgctatacaaatacatttaattctgtatttattaatagactacgtttatagacactccattgtacaatagagtctcttagttgtctcctgtgcttggagaaccgttttgatgtctctccactgtacatgcccttacaaatacggcttgcgtgccagcctggctgaccctccgtttgcgtggtacgaccaatattaatcacaccagacgaaagcccgaagtggccaagactagtttatggggggccaaacaaggcggtgggagcatgcagccaggaagcgcacggacggaaaaatccgcggtggcgcgcgtccccacttcccagctgtgtgtgcgtgactgtggactgtgacggtggcctcggaaagctcagtgtgcagcaggcagccgtcgttgcctcacagcaccggcgttctgcctcgcgcaccagcacaccgacacctcttcccgggttccggctctccgcccaaaacacatgcaaaggtttcgagcgtcgagacagcgagaacgacgttctgtaggagtagtactatcgcttccacatcgttccgttcttcggaacccgggcgtccgtcccgttgcgtcatccgcacgctggctgactggctcgcgcggttaacgatgatcgggggttgcttagctcagtttagctcctcgttctccatgccgccatttgctgtttcacgacggtggttagtacgagccgaaggacgcaactgattgcccaaatgctgagccagctcaagtcgctccaacggctaccggacgagacagctagtaccatttaaaccagtcacagctcaccagataaggcctggacagaccggtcaggacaggcacaccaccacctattggtccaccaccacccatggacaaagtaattagagagacgcttttcgcgaatggagcttacgtagtagtatatcttatcgagccagcatttgcaacaacacattcaattcccatgcatgatttgacggcacatatatatataccacggaaatgtagaggaaaaggttcgtcagcagttaagcacgcattatagcatcattacagctaccagcaactttagacatggctagctacacaaagcaagaaacagaaaaactgttgatggtaatagcacaaccaaggcacggaacctaactaccactagtcgattgcacttcttcgtcgtcgtcctcgctcgagacacagcggcagcacatcatccctggcgcgaattaggcaggatcaggatcaggatcagtacctggccggcaagccaagccgatccagcctgccagagcccgggtacgccttgttggtgaacttggcgtgcagggaggaggccgccgccgccgccgacctctgcgccgccgacgccctgcgtagggagctggacctctcgtactgcggcctctgcttgggcgcgctctgcgaccgcgccttggcgcggaacgactccgtgttggccatgtagttcgggtagtcggagtagccgccgaagaggctgcgcgagcactcgctcttggccgtcggcgtgaacgggccccgcctcgagctcccgggccgcgacgacgtggccgagaagaactgggggctgtcgcagagctcggccacgtccgcgggcacgggcacgcgcagcgggctcagggcctcctcctcggccatgcccaccgacgccgggctcggcaccgactgctgcgcggtcgtcgagtccttggacggcgactccgccatggtcgcgtagctccggctgtttctgctcggaccccatcgtcgtcgagcacggcgactggtggtggtggtggtggtttccgccgccgccgccgcgcctcttggaagcataccggcgccgtggcttgccgttgtccacctcgagaatcttggcgttcttctcgtcgtccatgtacctctcctccacccagcggtccagccagttcctcccgcaggattccgacctctccctgcccagcctctcgccgcccggtgtcctcgaagagttcgcctgcacagaccgcaccacaccacacccatcgtcaccaccatcacgatgcacgaagaaaccttgcaacacacagggagagagagaggcactcgccttcagagagccggaccggccgtgcctgggcgcacccgcctgctcgtacttctccggcgtcggcggatcctgccgtgcacatccacccacccgccataagaccgcgagttactacgagccacgagccagcaagcgaaacatcctcccccctcacttaccggatgcgccgtgacatgctgcgagcgaattgcgcggcaggcgcgcgcgcgcgcctggacgcggacgagcgcgtgcatgcatcgcagcgtctccgccgcctgccgccgcacgatgttgccccggaccagcgcctgcagcttcaccagcccccgcaacgccttcagcgcccgcctcgccttcgcacggaacaacaagcagaagcagaggtgttaatcagcaatggccccttggctccaccatagcccacgggcatctacagtgcaaaactgaggttggcatctctcaacttgccaggcttttgttcaacatcaacaaaaaaaaactttgcataccgaccaccaccgccattactacggctacggcggtagccgcttccaataacagtaacgcagtaactaggcgcaaaacggcaaaataatacaggccttccgatttcctgcgaaggaagcggagttaaagcggccatggccatgccttgcttcctgaaacgaagaagcctggaaggcgcaggcagtaaagacgacggcagagctgacgccacaaggtggcgttctccttgctggaggggaagcggttaccagagcagctcgtaggttacacatcatgagcatagcataccacgcagaagagggagatatttttgttttctttttgaaccaacaaaaggccccttcttccgtttttcaagctagcttttcgtgacaagctgtagcttacacagatttgtttatttattggaaatttgacaacaaaaaaaaagatttagtaactgaagagtgaggtgaggagtctgtgagaagctaaccaggtagccacggaaagcggcctggatccgaacggccgcccactgctcccgcttcgcggcggccggcggcgcgcaccgcccgctgctcgtcagccgcaccacggcggcggcggcctgggcggcagcgacggcggcctctgccaccgccgccgtcgccgcggccaccgcgatagcgcgcttgctctgctcgtcgcccgcctcatccgccgctgcatagccccggcgaggcgtcgccgcgggatgcgacggaggcgtcggagtcggaggccgcgccggcactggcgcggggggcttctcccggaaggacttgccgaacccccagcgcttcttctccttcaccggccttgtgtcggcggccttcctgccgccgccgccgagcagcccgcgcaaccacctgggtgcccagcccatctccgccgctctaccgcacctcggccagccgccgccgcatgaggctttcttggttccagcactagcgcggagcaggtgaagaaagagcgggagatgaaagcagtacagtgaaatgcacacacacgcggacgccagaagagagaaaggcaggcagcagaagagaacggggc

SEQ ID NO: 2779 - DNA, 1158 bp, Zea mays
ttttttttttttttttctttttttttttttttttttttttttttttttttcccaggcatgatttgacggcacatatatatataccacggaaatgtagaggaaaaaggttcgtcagcagttaagcacgcattatagcatcattacagctaccagcaactttagacatggctagctacacaaagcaagaaacagaaaaaactgttgatggtaatagcacaaccaaggcacggcggaacctaactaccactagtcgattgcacttcttcgtcgtcgtcctcctcgctcgagacacagcggcagcacatcatcctgacgcgaattaggcaggctcagtatcagtacctggccggcaagccaagccgatccagcctgccagagcccgggtacgccttgttggtgaacttggcgtgcagggaggaggccgccgccgccgccgacctctgcgccgccgacgccctgcgtagggagctggaccgctcgtactgcggcctctgcttcggcgcgctctgcgaccgcgccttggcgcggaacgactccgtgttggccatgtagtttcgggtagtcgggagtagccgccgaagaggctgcgcgagcactcgctcttggccgtcggcgtgaacgggccccgcctcgagctcccgggccgcgacgacgtggccgagaagaactgggggctgtcgcagagctcggccacgtccgcgggcacgggcacgcgcagcgggctcagggcctcctcctcggccatgcccaccgacggcgggctcggcaccgactgctgcgcggtcgtcgagtccttggacggcgactccggcatggtcgcgtagctccggctgttctgctcggagcccatcgtcgtcgagcacggcgactggtggtgctggtggtggtggtttccgccgccgccgccgcacgatgttgccccggaccagcgcctgcagcttcaccagcccccgcaacgccttcagcgcccgcccagctagggtttccccgagctcccctgcacaagccgcagctccaacatcgtggcggcgctctcggcgacggcggcggttgagaaggaggggagatcggggaaaccctagctgggcgggagcgcggaggtttgagaggggcgtgcggcggcgggagagaaagggaaggggaacgtgggggattaat

SEQ ID NO: 2780 - DNA, 1196 bp, Zea mays
gccgcgacgtcgccgagaagaactgggggctgtcgcagagctcggcgatgtccgctggcacgcgcagcgggctcagggcctcggcagccatgcccacggacgacgggctcggcacggactgctgcgcggtcgtcgagtccttggacggcgactccggcatggtcgcgtagctccggctgttctgctcggaggtcatcgtcgagcacggcgactggtgatggttgccgccgcgccgcttggaaccgtgccgccctggcttgccgttgtccacttcgagaatcttggcgttcttctcgtcgtccgtgtacctctcctccacccagcggtccagccagttcctcccgcaagattccgacctctccctacccagcctctcgccgcccggcgtcttggaagagtttgccttcagagagccggaacgggcgtgcctgggggcacccgcctgatcgtacttctccggcgttggcggatccggatgagccgcgacatgctgcgagcgaattgcgcgacacgcgcgcgcgcgcgcctggacgcggacgagcgcgtgcatgcatcgcagcgtctccgccgcctgccgccgcacaatgttgccccggaccagcgcctgcagcttcaccagccccctcaacgccttcagcgcccgcctcgccaggtagccacggaaagcggcctggatccgaacagccgcccactcctcccgcttcgcggcggccggcggtgggcaccggccggcgcccgccgcccccgccaccgccgccgtcgccgcggccacagcgatagcacgcttgctctgctcgtcgtccgcctcatccggcgccgccgcaaacccccggcgaggcgtcgccgtgggctgcaccgaaggcgtccgaggccgttccggcgctggcgcggggtccttttcccggaaggacttcccgaatccccagagcttcttctccttcgccggcttcgtcacggcggccttcctgccgccgccgagcagcccgcgcagccacctaggcgcccagcccatctccgcctctctaccgcccgtcggccggccgccccatgaggctttcttggttccagcacttggccggagcacggggtaaagaaagagcgggagatgaaaccaaaacagtgaaatgaacacacgcttcaccgagaagagagaaaggcagcaggagaggaagggactgggagatctcccggccggc

SEQ ID NO: 2781 - DNA, 477 bp, Zea mays
tcagccgcaccacggcggcggcggcctgggcggcagcgacggcggcctctgccaccgccgccgtcgccgcggccaccgcgatagcgcgcttgctctgctcgtcgcccgcctcatccgccgctgcatagccccggcgaggcgtcgccgcgggatgcgacggaggccgcgccggcactggcgcggggggcttctcccggaaggacttgccgaacccccagcgcttcttctccttcaccggccttgtgtcggcggccttcctgccgccgccgagcagcccgcgcaaccacctgggtgcccagcccatctccgccgctctaccgcacctcggccagccgcggccgcatgaggctttcttggttccagttccagcactagcgcggagcaggtggtgaagaaagagcgggagatgaaagcagtacagtgaaatgcacacacgcgagaagagagaaaggcaggcagcagggcaggggagagtct

SEQ ID NO: 2782 - DNA, 2562 bp, Zea mays
taagctcggaattcggctcgagcacgcgtccgcccgtttcgctcgctgtctcccgcggcacgggggctccagcgccgaacggaaaaccccaccccaccaccactggctactcccgatccccagtccccatccctctcctcgcaaaaggccaccgcgacgcgaccgcgtactgggggcgagacgccagtgcaggcaggcaggcagaagaggagtcgccaggaagcaaccgcgagggagctgcaagcgagcacagcagcagcgcagaaaaaaaattctggaataatttttcttccctttggctccgtgaggttccggtgctcgctcgctcgcctgagcttcgatcgagcccggtcggcgaggcaggcgcccgatcgccgctctccgggagcttccggggggccgtcggatggagccgtacgcggcggcgaagagcggcggggccgacgccggcaccggcaccggactggaagactcgatgcggaggctggggctcggcgacgacggggaagcaggggaggagaagcttccggagcggccgggcgaggcggactgcgcctactacctccgcacgggcgcctgcggctacggggagcgctgccgctacaaccacccccgcgatcggccggccccggttaatggagttggaaagaccgcagttacagtggagtacccagagcgtcctggacagcctctctgtgagtactatgcaaagaatggcacctgtaaatttggttccaattgcaagtttgatcatcccagggagggtggttttgtacctgtcacattgaacagcggtggattccccctgcgtctgggtgaaaaggaatgttcctattacatgaaaactggacattgcaagtttggagctacatgtaaattccatcacccagaacttggtttccttacggagacgcctggcatgtacccaccagttcaaccaccacctatttcctcctcgcatccatatccacatcttgccaattggcaaatggggaggcctcctgttgtgccagggtcatttttaccaggctcgtatccaccaatggtgcttccacatacagttataccaatgcagggatggaacccttatgttccacctatgaaccaagttacaccagctggaggacagcaagctgttccagtaggggcatcttatggtttgtcgcaccaggggcctacctctgccatgacttatggcagtcattatgcgcaattatattcttcatctgggacttcaagcagcaacatacaagaatatgcctttccagagcgaccggggcagcctgaatgtgaacattacatgaagactggaacctgtaaatatggggcaggcctgcaaatatcatcatcctcaatacttcagtggaccaaagtctaactgcatactgagccctctgggtctccccctccgtcctggttctcagccatgtgcttactatgcacaccatgggtattgcaagtttgggccgacatgcaagtttgatcacccgatgggtactccaaactatagtatttcaacatcttcacttactgatgtgccaatcgctccatatcctcagagtttccctgttactcctatgccttcatatctgccatcttctgatctgcgtccacaatacactcaagtcaaggattcctctgctaatccaccaccatcgcctggaactacttatggtcctgttgggtctatatcaaaggtttatgctccccacacgcttatccgatccccggcttctgcagctgctggcatgcaagcgtcctaatgagacacggttgagagcattagtcctctctgtcatgaagatagttcttgggcaatcttctcaggtttttctaccattggcggaatgaggtctcgattcttttttgctccagttcgacttcccagcaattgtgaataaaggctgcagctgacatagaaaagtctcaataaatgcaaagataggaattggcaagctcattcacttgccatttttctgtccatctcggaaatgagaggagaaaattctgattgtagtaggatccagagctacgttattatcctgtataagatgcaccgatgcaagggattcgtatctgaaagctgatgggttctgtagctcaaaaccttttgtttatctcaccatcatatatatagagagggcagattaccctaggtgatgattatccacgctggaatggtttaacaaatcttcaataattgttaaaccattcgtgctttttgttaaaccatttcaggatgggtgatcatcacctaggtgatgaatagccatatatatgaatatgagcagcagctatgatttcacaacatgtatatctacctatatatatgaactgggaacacggcatgttgtagcgagacgctttggaacccttaattgaatcatctgaaaccattcgctggtcatcccctgattttcgggtgttttagttctgctaactttcagatttcttgtttatatgaatcggttgggtttaacgtcttgtttgtaaaccgtggaatttattgcctgcctgtttttttttttacctcggagcaacatctttgctatgctactacgt

SEQ ID NO: 2783 - DNA, 2197 bp, Zea mays
gccggccgggctgctccagcgccgaacggcggcccccggcagcactgccactggccactcccgatcacccgtcccggcgtccccccaatccctctccctgcaaaaggccaccgcgacgcgaccgcgtacgggaggtgagccgcgagtgcagtgcagtgccaggccgagagaagagtcggcaggaagcaaccgagaccgcgagggagcagcgagctgcactgcagcggcgcagagaaaaaaaaattctggaatagttttttttttcttccctttggctccgtgaggttcctgtgcttgctcgctcgctcgcctgagcttcgatcgagccgtacgcgggccgtcgggagctcaatcaccgctctccgggagcttccgagggccgtcggatggagccgtacgcggcgacgaagggcggcgagtccgacgccggcaccggcctggaagagtcgatgcggaagctggggctcggcgaggacgacgaagcgggggaggagaagcttccggagcggccgggcgaggcggactgcgcctactacctccgcacgggcgcctgcggctacggggaacgctgccgctacaaccacccccgggatcggccagccccggttaatggcgttgggaagaccacaggtatggagtacccagagcgccctggacagccactctgtgagtactatgcaaagaatggcacatgcaaatttggttccaattgcaagtttgatcatcccagggaaagtggttttgtacctgtcgctttaaacaacagtggattccctctacgtctgggtgaaaaggaatgttcctattacatgaaaactggacattgcaaatttggaggtacatgtaaattccatcacccagaacttggttttcttacagagacgcctggcatgtacccaccagttcaaccatcacctatttcctccccacatccatatccacatcattccaactggcaaatggggaggcctgctgttgtgccagggtcatttttaccaggcccgtatccaccaatgatgcttccacctacagttatgccaatgcagggatggaacccttatgtttcacctatgaaccaaactacaccagctgggggccagcaagctgttccagcagggccatcttatggcttgtcgcaccaggagccaacctctgcagtgacttatggcagtcattatgcgcaattgtattcttctgggacttcaagcagcaacatacaagaatatgtgtttccagagcggcctgggcagcctgaatgtgaacattacatgaagacaggaacctgtaaatatggagcagcctgcaaatatcatcatcctcaatacttcagtggaccaaagtctaactgtatactgagccctctgggtcttcccctgcgtcctggttctcagcgatgtgcttactacgcacaccatggcttttgcaagtttgggccgacatgcaagtttgatcacccgatgggtactccaaactacagtcttccagcaccatcacttactgatttgccagtcgctccatatcctcacactttctctgttactcctattgctccatatctgctgccccctgatccgcggccgcaatacactctagccaaggatccctctgcttatccaccacaagcgcccggaactacgtacggacctgttggggcgatatcaaaggtttatgcccgccacacgcttgtccgatccccgacttctggagctgctggcatgcaagcgtcgtaatgagacacagttgagagcactagtcccctctctgtcatgaagatagatcttgggcaactttctcaggatttttctatcataggtggaaggaggtctcggattctttttttttgctccagttcgacttcccatcaactgtgaataacggccgcagctgacatagaaaggtctcaataaatggaaagatagggattggcaagctcattcacttgccatttttctgtccatctctgaaacgagaggaggtaattctgactgtagtcggattcagagctccgttattatctcgtgtaacgtgcacaattgcaggggattcgaatgggaaagctgatgggttccatagctccagaccaaatgttttgtttatctcgtcatcttattatatatatgatgtgtataccccgtcggaacagcaacatgtatatctatctatatatattactctaaacacaaaaaaaaaaaaaaaa

SEQ ID NO: 2784 - DNA, 1089 bp, Zea mays
gaaaaacataatatgttcttctgtaaatcttgcccacttgagagtatcaggaacgagccttcaccagagctttgcaggggccatattattaggaattttatcaaggaatgcgggagtaaatgtggctgtaacgcgcaatgtggtaaccgtgtagttcaacgtggtataacttgcaatctgcaggtgttttcgacacgggaagggaaggggtgggggctacgcacacttgatgaacttccaaaaggagcttttgtctgtgaatatgttggagagttgctaacaaatacgaagctacatgaaatgactactcaaaacatgcacaatgctaggtactcagtgctcttagatgctggttggggtcctgatggggtgctgaaggatgaagaagctttattcctggatgcgacattttgtgggaatgttgggagattcatcaaccacagatgctatgatgcaaatttagttgagatccccgttgaaaaggagacgccagatcatcactattatcattttgcatttttcacaaccaagaaggtggaagcatttgaggagctcacatgggattatggtattgattttgatggtgataagcatcctgtcaaatcatttgaatgcctgtgcggaagcagatactgccgtggtagaaagcattcgaggacgcgaggcaaagctgcttcgaagtgaagtgttgactgaaagcagcggtgcatggttggtttgggaaagcgaacggactaatcagttttagaatgctttgttaacctaggtagctatgcattcataaagtgcccgctgtgcttgactgcagaacgtgaaattcaattagacagactgaaatgcaatgtacgtacgctactcctaaaccctaagccatctggccatgatctactgatgatgaggtgaatttgattactgttctgtgcatcattgacagacaaaaacagcacataatcatgcatgtgtcgttaacgaccagtttagcacatttgtttgccaagtagtagtaggagtgtaatgggatacggacggaatattccatatttgttttcatattttcttttcggattcgaatcagatacggatgttatt

SEQ ID NO: 2785 - DNA, 1427 bp, Zea mays
aatgcatattatacccagtaattacaatttcacccctccaaacagtggatgcgcccctgccccccatgccccaggtcgagtcggccactgcctcggaggcgccgccgccgcaggacgcatggctcgtcgagctcggcagtcgcctcccgcagtgggagtcgctgcgggattcctccaaggtcattatcccgatttcaatatctagggtgaaccagtttgatgctgcaaggctagatgttgagatgtcggccatgttgaaagagcagctagtcaaagtgttctctttgatgaagccaggactcttattccaatatgagcctgaacttgatgctttccttgagttcctcatctggaggttctcaatttgggctgacaagcctacccctggcaatgcactgatgaacctgaggtacagagatgagcgggcagcacccatcactggaaaagaagttagaacaggtttggaaggacctgggctttctgtttctcaaaagatattttattgtattagctttgttggtggccaatatgtatggtcacgattacaatctttttctgctttccgtcgatggggcgattctgaacagagaccactagctcgccgtgcttgggcgttgatgcggaatgctgaagtattttatagggctgcttcattctttaacctattattgtttctttatggtggaaggtacaaaactgttgtagaaaggattctgaaggcaagacttgtttatgggagccccaacatgaatagagctgttagttttgagtacatgaatcggcagctggtctggaatgagttttcggaaatgttgcttttgcttcttcccctcctaaactcgtcttcggtaaagaagttccttctccccttctccaaagataagtcaggaggttcttctggtgatgaagcagattgtcctatatgtcggtccagtcctagcattccatttattgctcttccatgtcaacacaggtattgctactattgcctacgcacacgttgttcggctacgacttcttacagatgcacacgttgtgacggggcggtggttgcaattcaaagactaggatcaggttagttttacgacctagttgggttaaagaattctcgcccgtttctacagagaatcagcacttcggtgtttcatacggttacaagtttggatacgcgtcattcactgtatgtacatgtaattgccccaagtgtggacagttcggatgccatgagcccataactgacttgttgtatatcgaatgaatagtccgtcacaaaactaacacggattcactatgcgttttcttttcgattcgtctatttcaaaaatcgtgtattgaaaaatgccaaaacaattattggaaagagcaactgattcactgattatgtattgaaaagagattaggtttttaagtcaaaaaaaaaaaaaaaa

SEQ ID NO: 2786 - DNA, 2266 bp, Zea mays
  misc_feature (1036)..(1036): n is a, c, g, or t
aattcggcacgagggtcgcgccctctataaaccaccactcttctcccccacagcccgcgctccctcccatcccctccctcgtcgtctcgccactcgcaacaccccaaaaacctcacgggctctcgacccctcgcgctcgcctcgtcgccacgccggcgtgaggggcgcccacccccgtgcctatataacgctgccggagcggagggtataagctggtatcatggcgtccagcgcagtagcaccaagatggttaaggggtaaggtgaaggctgtgacatctggggattgtcttgtaattatggggtgcacaaaggctgagatcgaacctgagaagtccatcaccttatcctaccttatggccccaaggctggctcgtcgtggtggagttgatgagccgtttgcatgggaaagcagagagtttctgaggaagctctgcatagggaaggaggtcacattcaaagtggattatacagctcctaatattggacgagaatttggaactgtttttctatgtgataagaatgttgcatactcagtagtttctgctggatgggcaaaggtaaaggagcaaggctccaagggtggcgaacaaaacccgcaccttggtgagttgttgaggttagaggaagttgccaagcaacagggtgttggtcgttggagcaaggaacctggtgctgctgaagagtcaataagatatcttccaccatctgcaattggtgaagcaagtggttttgatgcgaagggttttgcggttgaaaataaaggcaagagtttggaggccattgttgaacaagtacgcgatggcagtactggtcgtgtgtatttagtccctagttttcagtttgtccagatatatgttgctggagtacaggccccatcaatggggagacgcccatcggcacctactggtatttgctgaaactgatgatactgctaatgacacgaacggtgaagattctgagggaacacctgcccaactgactacagcacaaagacttgttgcatctgcagcttctgctgaaattccaccagatangtatggaagagaagccaagcacttcacagaggctagagttctcagcagagatgtgcgtatcggtggtggaaggcacagacagctttagtaatataattgggttctgtgtattaccctgatggagagactgcaaaggacttggcccttgagcttgtcgaaaatgggcttgcaaaatatgttgagtggagtgccgaggtgcccccgggtgaagtacaaataacgttgctgtcggcagaactacaggctaaaaaggatcaattgagaatctggacagggttcaagccacctgtgacaaactcgaagcccatccatgaccagaaatttactggaaaagtggtagaggttgtaagtggggattgcattattgtggctgatgattctgctccatatggcagtccttcagctgaacgtcgggttaatctgtcaagcattagggcccctaagttgggcaatgctcgtacagatgtgaagcctgaccattttgctcgtgaagctaaggagttcttgcgcatgaggttgattggcaagcaagtggctgttgaaatggaatactctcgaaggatcagcaccgtggatggacagagtgttgctccaacagcaaacattgctgatacaagagtattagattatggttcagtttttctgggttcaccatcacagactgatggagatgacatatcttctgctccgagctctgccagccagcctggagttaatgttgctgaacttttactctcacgaggctttgctaaaacatctaaacacagggattatgaggaaaggtcgcactattatgatgctctattagcagctgaatcacgggctgagaaagcaaagaaaggagtgcattctcaaaaagaatctcctgtgatgcatataacagatttaacaactgtatctgcaaagaaggccaaagatttccctcccttcttgcagaggaacagaaggcattctgccgttgttgaatatgtttttagtggccatcggttcaaactaacaattcctaaggagacttgcagtattgccttctcattatctggtgttcggtgtcctggtaaaggcgagccatactcagatgaagctattgctttgatgaggagaaggatactacagcgtgatgtggagatagaggttgaagcagttgacagaacaggaacattcataggttcgttgtgggagtccaagaccaacatgggctctgtacttctggaagctgggctggtgaagctg

SEQ ID NO: 2787 - DNA, 1099 bp, Zea mays
ccctccgggtcgacccggccggccccccccggccgcccactcgcccgtcgtctcgccagtcgctacaccccaaaaacctcacgcgcgcgctcgcgacccctcgcgctcgcctcgtcggcacgccggcgagaggggcgcccatccccgtgcctatataaggacgccggattggaggtgcccgtcccttatccgcgcggccagatctacctctgttccacgcctccgtcaccgccgcgtcggggcgatcccaccgaggccacaggtataagctggtaccatggcatccaacacaggagcatcaggatggctcaggggtaaggtgaaggctgtgacatctggagattgtctactaatcatggggagctcaaaagctgagatcccacctgagaagtccatcaccctgtcctaccttatggccccaaggctggctcgccgtggtggagttgacgagccctttgcatgggaaagcagagagtttctaaggaagctttgtatagggaaggaggtcacattcagagtggattatacggctcctaatattggacgagaattcggaactgtttatctaggtgacaagaatgttgcgtactcagtaatttctgctggatgggcaagggtaaaggagcaaggcccaaaggggggcgaacaaaattcgtaccttgccgagctgttgaggttggaggaagttgccaaacaacagggtgttgggtcgttggagcaaggaacctggtgctgctgaagagtcaataagagatcttccaccatccgcaattggtgaaggaagtggttttgatgcaaagggttttgcggtttccaataaaggcaagagtttggaggccattgttgaacaagttcgtgatggcagtactgttcgtgtgtatttactccctaatttccagtttgtgcagatatatgttgctggagtacaggctccatcaatgggaagacgtccatcggtacctactgtaattgctgaaactgatgataatgctaatatcgcgaacgctgaagatcctgagggaacacctgcgcaactgactacagcacaaaggctagttgcatctgcagcttctgctgaaattccaccagataggtatgg

SEQ ID NO: 2788 - DNA, 2578 bp, Zea mays
gtggtggaaggcacagacagctttagtaatataattggttctgtgtattaccctgatggagagactgcaaaggacttggcccttgagcttgtcgaaaatgggctggcaaagtatgttgagtggagtgccaatatgcttgatgttgaagtaaaaataaagctgaagaatgcagaacttcaggctaaaaaggatcaattgagaatctggacagggtttaagccaccagcgacaaactcgaagcccattcatgaccagaaatttaatggaaaagtggtagaggttgtaagtggggattgcattattgtggctgatgattctgctccatatggaagtccttcagctgaacgtcgggttaatctgtcaagcattagggctcctaagttgggcaatgctcgtacagatgtgaagcctgaccattttgctcgtgaagctaaggagttcttacgcacgaggttgattggcaaacaagtggctgttgaaatggaatactctcgaaggatcagcactgtagatggacagagtgctgctccaacagcaaacatggctgatacaagagttttagattatgggtcagtttttctgggttcaccatcacagactgatggagatgacacatcttctgctccgagctctgctagccagcctggagttaatgttgctgagcttttgctctcacgaggctttgctaaaacatctaaacacagggattatgaggaaaggtcacactattatgatgctttattagcagctgaatcacgcgctgagaaagcaaagaaaggcgtgcattctcagaaagaatctcctgtgatgcatataacagatttaacaactgtatctgcaaagaaggccaaagattttcttcccttcttgcagcggaacagaaggcattcggccatcgttgaatatgtttttagtggccatcggttcaaactaacaattcccaaggagacttgtagtatcgccttctcattatctggtgtccgttgtcctggtaaaggcgagccatactcagacgaagctattgctttgatgaggagaaggatacttcaacgagatgtggagatagaggttgaagcagttgataggacaggaacgttcataggttctttgtgggagtccaagaccaacatgggctctgtgcttctggaagctggacttgccaagctgagttcatttggcttggataggacctcagatgcttatatcctaacaagagctgaacagtctgcgaagcaacagaagattaagatatgggagaactatgtcgagggtgaaaatgcttccaatggatccacacctgaatctaaacaaaagcaaattctcaaggttgttgtcacggaagttcttggtggtgggaagttttatgttcagacaatgggtgaccagagggtggcttcaattcaacagcagcttgcatctttgaaacttaaagatgcgccggtcattggtgcttttaatcctgtgaagggagagatagtcctcgcacaatttagcgttgacaactcctggaacagagctatgattgttaatggacctcgttctgttgaatctccggacgacaagtttgaagtattctatattgactatggcaaccaagaggtggttacctacagtcgtttacgacctgtagacccatctgtttcctcgtctcctgctcttgctcagctatgcagccttgctttcataaaagtgcccagtcttgaggatgactttggtcaggaagcagcagagtatctaagtgaatgtttgctcagtagctcaaagcaataccgggcaatgatcgaagaacatgatacttctggggggaaatcaaaaggacaaggaaccggaaatgttctcattgttactcttgttgatgcggagacagaaagtagcataaacgctaccatgcttgaggaagggcttgcccggctcgaaagaagcaagagatgggacactagggagaggaagacggctctccagaacctggaacagttccaggacaaggcaaagaaggaaaggctgcggatttggcagtacggagatgttgaatcggacgaggacgagcaggccccgcctgcaaggaagcctggaggtcgtcggtagagactgggcagtgtaaggctgcagtctggcatgctatgaaagttttggacaaccacaaatgttggactctgccgggagttatagatgaggacttactgaggggtaccgtatttatattcggttagaagaagggaacttagcgaggcgaaatcacttttgatattccgtttttacaggcgaaactttctctgttttagcacttttgatattccgtttttacatcgcaagttataaggttaaagatgcattgtttctttttctctcaacttaataaggttgtgtctatgcgctgcggttctttgtagtcagaatataatattgagaagtgcagtgaattaagttaaggattgcatttaattaaaaaaaaaaaaaaaaagacccgacggctgtcccaacaggtaacaaacaaaaacaataataaaaggggccgccgatctaacagatccaggcttccatcccatacataccaactaaataaaaataaggggggggc

SEQ ID NO: 2789 - DNA, 2107 bp, Zea mays
aatctgtcaagcattagggcccctaagttgggcaatgctcgtacagatgtgaagccttagggcccctaagttgggcaatgctcgtacagatgtgaagcctgaccattttgctcgtgaagctaaggagttcttgcgcatgaggttgattggcaagcaagtggctgttgaaatggaatattctcgaaggatcagcaccgtggatggacagagtgttgctccaacagcaaacattgctgatacaagagtattagattatggttcagtttttctgggttcaccatcacagactgatggagatgacatatcttctgctccgagctctgccagccagcctggagttaatgttgctgaacttttactctcacgaggctttgctaaaacatctaaacacagggattatgaggaaaggtcgcactattatgatgctctattagcagctgaatcacgggctgagaaagcaaagaaaggagtgcattctcaaaaagaatctcctgtgatgcatataacagatttaacaactgtatctgcaaagaaggccaaagatttccttcccttcttgcagaggaacagaaggcattctgccgttgttgaatatgtttttagtggccatcggttcaaactaacaattcctaaggagacttgcagtattgccttctcattatctggtgttcggtgtcctggtaaaggcgagccatactcagatgaagctattgctttgatgaggagaaggatactacagcgtgatgtggagatagaggttgaagcagttgacagaacaggaacattcataggttcgttgtgggagtccaagaccaacatgggctctgtacttctggaagctgggctggcgaagctgagttcttttggcttggataggatgtcagatgctcatgtcctaacaagagctgaacagtttgcgaagcaacaaaagattaagatatgggagaactatgtcgagggtgagaatgcttcaaatggatccgcacctgaatcgaaacaaaaggaaatcctcaaggttgtcgccacggaagttcttggtggtgggaagttttatgttcagacagtgggtgaccagagggtggcttcaattcaacagcagcttgcatctttgaaacttaaagatgcaccagtcattggtgcctttaatcctgtgaagggagagatagtcctctcacaatttagccttgacaactcctggaacagagctatgattgttaatggacctcgctctgtagaatctctaaacgacaagtttgaagtattctatatcgactatggcaaccaagaggtggttccctacagtcgtctacgacccgtggacccatctgtttcctcttctcctgctcttgctcagttatgcagccttgctttcataaaagtgcccagtcttgaggatgactttggtcaggaagcagcagagtatctaagtgaatgtttgctcagtagctcaaagcaatatcgggcaatgatcgaagaacgtgatgcttctgggggaaaatcaaagggacaaggaaccggaaatgttctcattgttactcttgttgatgcggagacagaaagtagcataaatgctaccatgcttgaggaaggccttgctcggcttgaaagaagcaagagatgggacactagggagaggaagacggctctccagaacctggaacagttccaggagaaggcaaagaaggaaaggctccggatctggcagtatggcgatgttgaatcggatgaggacgagcaggccccagctgcaaggaagcctggaggtcgtcggtagagctccccaaatgtgagactctgctgggagttatagatgcaacttagagggtaccttatttattcggttagaaaacagaacttagcgaggcgaaactttctcggtttgagcacttttgatattccgttttttacatcgtaagcttataaggttaaaggtacattgttttttctctgaacacaataaaggtcgtctatgcgctgcagttctttgtgtagtcagaatataatatttgttgatactaagaaatgcagtgaattaaagttaatattgcatttaaaaaaaaacaaccaataaaaacctccctcgtacgtaactcgaaaaggggcgggg

SEQ ID NO: 2790 - DNA, 3454 bp, Zea mays
  misc_feature (3308)..(3308): n is a, c, g, or t
gatgcatataacagatttaacaactgtaagtgatattcttttattccatcagttcgattttgatattctctgcgtcatcattaacctatcagtgtggtccttatatggataggtatctgcaaagaaggccaaagatttccttcccttcttgcagaggaacagaaggcattctgccgttgttgaatatgtttttagtggccatcggttcaaactaacaattcctaaggagacttgcagtattgccttctcattatctggtgttcggtgtcctggtaaaggcgagccatactcagatgaagctattgctttgatgaggagaaggatactacagcgtgatgtggagatagaggttgaagcagttgacagaacaggaacattcataggttcgttgtgggagtccaagaccaacatgggctctgtacttctggaagctgggctggcgaagctgagttcttttggcttggataggatgtcagatgctcatgtcctaacaagagctgaacagtttgcgaagcaacaaaagattaagatatgggagaactatgtcgagggtgagaatgcttcaaatggatccacacctgaatcgaaacaaaaggaaatcctcaaggttgtcgtcactgaagttcttggtggtgggaagttttatgttcagacagtgggtgaccagagggtggcttcaattcaacagcagcttgcatctttgaaacttaaagatgcaccagtcattggtgcctttaatcctgtgaagggagagatagtcctctcacaatttagccttgacaactcctggaacagagctatgattgttaatggacctcgctctgtagaatctctacacgacaagtttgaagtattctatattgactatggcaaccaagaggtggttccctacagtcgtctacgacccgtagacccatctgtttcctcgtctcctgctcttgctcagctatgcagccttgctttcataaaagtgcccagtcttgaggatgactttggtcaggaagcagcagagtatctaagtgaatgtttgctcagtagctcaaagcaataccgggcaatgatcgaagaacatgatacttctggggggaaatcaaaaggacaaggaaccggaaatgttctcattgttactcttgttgatgcggagacagaaagtagcataaacgctaccatgcttgaggtttgtgctaagaactaccttgatgctgacacatacaagtgcttgctagtacataacatttgctcatgttttggagaacatacctactgctcatgtttgaagacaaatagctgcttactaactaggcagcaaagatatatatgccacacgaaatgcccataaacatagaacacacattactttctactttactaagtaaagaaacataatgttcatttgttgacggatgatgtgatcaatttattggaaaacctgtgtgaagctgtattatggctatttggccaggaacatgttatttctaacattacctactcaccctgcgtttacaggaagggcttgcccggctcgaaagaagcaagagatgggacactagggagaggaagacggctctccagaacctggaacagttccaggacaaggcaaagaaggaaaggctgcggatttggcagtacggagatgttgaatcggacgaggacgagcaggccccgcctgcaaggaagcctggaggtcgtcggtagagactgggcagtgtaaggctgcagtctggcatgctatgaaagttttggacaaccacaaatgttggactctgccgggagttatagatgaggacttactgaggggtaccgtatttatattcggttagaagaagggaacttagcgaggcgaaatcacttttgatattccgtttttacaggcgaaactttctctgttttagcacttttgatattccgtttttacatcgcaagttataaggttaaagatgcattgtttctttttctctcaacttaataaggttgtgtctatgcgctgcggttctttgtagtcagaatataatattgagaagtgcagtgaattaagttaaggattgcatttaattattccagtgtccgtgcagtgacgatttctctcgtacgcatttactgattgttttttttttttggcttgatggtagctttcttcttggacaaaatgtctatttgcagtatatacttagcctgcctctgctggcgctgttgcttgatattccgtttttacaggcgaaacttttgaagctatgcttcgctctgagatagaacatcaatcctttcaagtgctaaacttcacggaggctcgatctcatgaatgaccgaatcactgacctcgacaaactcaaagaggccaagggcttggcggccatgcaagacacgtctgagataaaagttgtgctgttgacgatctagtgctacgcaagatccaaagtatgaaggacaaacataaactgtcacccccttatgagggtcctttcatcatctctgaagtacttcggctcgacgcttattgactccagctagaagatgacacaatcaaccgtttttacgtgtaacttctccatttttttgcaataagtccatctcgaacaactccaccgccatgactgagatgttgggggcctaacatcatgtatcaatacattcatatggagctgttacaagaaaattcatatctcgcaaatttcgtcttgaatacttcttgaagggtaaattggcttggccccctaactttgtcccattcggtcttcactacaagggtgctaggcgttggtcctattgttagaaatacctatacaattgactcagccagagttagggcccctcaagggaaggacgcaatatcacctctacaatttgatgtcccttcatcccacatagcagtcactgcaagggcattgaggtgatttgatcaacccgaataaaacagtacttaaacaccgagtcttaatgaactaaggtcccttagagcagtggcggagccagatgacaattagagcctgggcactatcggtccatcgccggttgccttggctttgtcgttggtttcgtccatggatggcccaatggtggcctgatgtgtatactagtaggttgccgtgtctttggccgtttgcttgcttgccaatcatcatgagtcaaatgatcatcagctgcaaaaaaacatactactactggatatctgtggcatatatacttcctagcagagtacttataaatgtacatataaatgcaacaagaggaggaagaggaactctaacttggtggtgcttgctgaagctggatgctgctgacctgcatgcatggggtgttgttgtcttggnaactgctccatcggcatcactacatgggattggtgtgctctggtgtttgtgtgcgagagggagggggagggaccgagcacgtagtccaagcatcccaaggacaaaaaaccccatgtcacattgggtaaaatggggtagggtatggt

SEQ ID NO: 2791 - DNA, 1956 bp, Zea mays
  misc_feature (49)..(49): n is a, c, g, or t
aaggcttcgttagtacttgaagatgcagtccggaacatatacactgtantagcattctgtgctggcgataagatcatggaactctacagactacatcttgggaagatactaaaacaaagtcttgtgcaaggtttggctataggctttggttttggtctctcccagttcctcctttttgcctgcaatgccttgcttctttggtacactgcaatttcagttgaccgacaacgtctgacaatagccacaggactaaaagagtacattctgttttcgtttgcatcattcgcgttggtggagccatttggactggcaccttacattcttaaaaggagaaaatctcttacgtcagtctttgaaattattgaccgggagccaaaaattgatcctgatgataccaccggcttgaaaccacccaatgtctacggaagcattgaattcaagagtgttgatttttcttatcctgttcgccctgacattcttgtcttgagtaattttaatcttaaagtgagtggtgggcaaacacttgcggtggttggggtctcaggatcagggaaaagcaccattatttctttgattgagagattctatgaccctgtttctggccaagttctgctggatggtcgagatctgaaatcatttaaccttagatggttgcgtagccacatgggcctgattcagcaagatccagttattttctcaacgacgataagagaaaacattatttatgcaaggcacatcgcaacagaggctgagataaaggaagctgcaaggatagcaaatgctcaccatttcatcagcagcttgccacatggatatgacacccatgtgggaatgagaggggtcgatctaacacctgggcaaaagcaacggattgccattgctagggtgggtttgaagaatgcacctatcctcgcgtccgcccacgcctccgctgcaatcgagtctgaatcaagtagagtggtacaagaagctctcgacactctggttatgggtaacaagacaacgattctcattgcgcacagggcagcaatgatgaagcatgtggataacattgttgtcctaaatggtggtaggatagttgagcagggcacacatgactctctgatggatcagaacggtctatatgttaggttgatgcaaccccattttggcaagggccttcgccagcatcggctagtgtaattattattgagcttgttaggtgtaaattatcctagggcatgatcaggtttacttccgctcttggtgcagccactcagggcccgttttggcacatgaaaaatgctgggaagttgccgccttgctggtgttgttctgagtaagcggaatgcagacctgatcttgacaaaaaaaacctagcttggagattcaggtaagtaactgttggaactgtagggcacaactcattctggaaatagttagcaagtttggatggcattgtaattgttgtaatatgagttgaaacattctttcagaggctcgtgcttgtgatctctcgcatctgtaatgttagtgttttgatcatttaatgtgtgtatattgttcgattcttggtcggtccgagtcttgtagccgtgatgaaaagctttttacatggaaattctgagcttggcgttattttcgtccacgagaccattcagactacgagttgcagatattgaaaattataaccaatttctttttgtttgcaattgattacgaggctcgagcaggccacctcgaggccagccagcctgattccttccaaagaggttccaagcacgcggtcacttgagtttgtaacgccagtacatcacccatcaacttgtgctcgaaggtaataaatccatgagttgtccatgcacaatcatttatacttgaatgaactttgtcaattatctatcatgggcatgacaatttgttagaaaaaatatgttttttttcttgaataaattaatggtaattatatcacgtgtc

SEQ ID NO: 2792 - DNA, 2096 bp, Zea mays
acaattggtgctgctgtattggctcattttaatccactgctgctttacacaatagcacttatagtgtcagcatactatcaaattgaaatccgtgatatgcgccttcccgccagctcctgccgtttattcatagtaggcatgggtgttattacagtgctggtcaactggttgcaacatttctattttggaataatgggggagaagatgactgagcgcataagaaggatgatgttctcagcaatgctacgcaatgaaattggatggtttgacaaagaggagaacaatgctgatacactgtcgctccgcctcgcaaatgatgctacatttgtccgtgctgccttcagtaaccggctttccatatttatacaagacactgctgcagtatctgtggctctccttattgggatcttgttgggatggcgggtggcacttgttgcactcgcaactttgccagttcttgtcatatctgctattgcacagaaattgtggcttgctggcttctcaagaggaatccaggaaatgcatagaaaggcttcgctagtgcttgaagatgcagtccggaacatatacaccgtagtagcattctgtgctggggataagataatggaactctacagactacatcttggcaagatactaaaacaaagtcttgtgcaaggactggctattggctttggctttggtctctcgcagttccttctttttgcgtgcaatgctctgcttctttggtacactgctatttcagttgacaaacaacatctgacaatagccacaggactaaaagagtacattctgttttcatttgcatcattcgcattggtggagccatttggactggcaccatacattcttaaaaggaggaaatctcttacatcggtctttgaaattattgaccgggagccaaggattgatcctgatgataccactggcttgaaaccacccaatgtctacggaagcattgaattcaagagtgttgatttctcttatcctgctcgccctgacattcttgtgctgagtaattttaatcttaaagtgagtggtgggcaaacagttgcagtggttggggttttaggatcagggaaaagcacccttatttctttgatcgagagattctatgaccctgttgctggccaagttctactggatggtcgagacatgaaatcatttaaccttagatggttgcgcagccacatgggcctgattcagcaagatccagttattttctcaacgacaataagagagaacattatctatgcaaggcacaatgcaaccgaggctgagatgaaggaagctgcaaggatagcaaatgcccatcatttcatcagcagcttgccacatggatacgacacccatgtgggaatgagaggggttgatctgacacctggacagaagcaacggattgccatcgctagggtggttttgaagaacgcacctatattgctgttggacgaggccagctctgcgatcgagtctgaatcgagtagagtggtgcaagaagctctagacactctggtcatgggtaacaagacaacgattctcattgcgcacagggcggcaatgatgaagcatgttgataacatcgtcgtcttgaatggcggtaggatagttgagcagggcacacatgactctctgatggaccagaacggtctatatgttagattgatgcaaccccattttggcaagggccttcgccagcatcggctaatgtaattattcttttgagtttgtttaggtgtaaattatcctaggggatgatcaggtttccttgtgcggccactcagtcaggggcccttttcggcacatgaaaaatgctgggagttgccgccctgttgctgttccgagtaagccgacctggtcttcttgacaaaaaaataaaaaaaaatagcttgcagatccaagtaattctggaaatagttagcaagtttggagggcattgtaattgttgtaatatatgagctgaaacattctttcagaggctcgtgcttgtggtgtctctcgcctctgtaatattagtgttgcaccgacatgttcacggagcgtgtaattttgggagccacgaaccgacagcaatgcaaccaccattccccccccccccc

SEQ ID NO: 2793 - DNA, 1367 bp, Zea mays
gaactttagcctcatttcttcccgtcttccccaaacaagatctcgcctctccctgtcatggcggataatttaatcccaccactcccatgctctgttacattattgcctcctcctcgccgcacccatcccaccatgtcctctcctctgttcctctccatccccccttttcaacctttgacgctgtagcttgagagcgagattagttcctaccatattctcctcctgagcgactgagcgctggtctccgataggctcgccatgcaggtgctctgcgacgtctgcggcggcgcgccggccgccgtgctctgctgcactgacgaggccgcgctctgctccgcctgcgaccgccgcgtccaccgcgccgacaagcgccgccgcatcccgctcgtccagccctgcggcgacgactccgccgccgccgccgccgcgccgctctgcgacgtctgcaaggtgacggtgtccggtgcttcgatcagccggaggggatctgattcggagctgctgctgtctgctgacatggttgcgttctgcaggagcggaggggcctcgtgttctgcgtggaggaccgcgccatcctgtgccccgactgcgacgaccccatccacagcgccaacgacctcaccgccaagcacacccgcttcctcctcgtcggggccaagctctccgccgcgctcgtcgaccaggcgcctccctccccagacgacgacgacgtcgccgagcccgacgctgtccccgccgcctgcgcggccaaggcctcgtctcttgagtccggcggcggcagcagcatctccgactacctcaccaacatctgcccgggctggcgcatcgacgatctcctcttggacgactggtcgttctcagcgccatcgaagacgtgctacagcgacggccacgatcaggtgccgtccgtggatgccgacctcttcgacgtggtggccagcggccggccagggaagcgcgtcggcggcgcagcgctgggcttcgacaaggccccggcctccgttgtggtcgtcccgacgcaggggtgcgtgacggagaggacttggaacagcgacagcgacgtgttcgtggtgccggagctcccgcagccgccgccggccaagaaggcgcggccggcgccggcgccaactttctggtgcttctgagctgtactgtatcagtccggcccggccggacagtgtgtgtacctgtcgtgacttctgtgaccgctgtgtgtgagcttgctgttgttacttacataatactcaccgctagtggttagcagggctcaatcccaattaattaggtttgctgtgtcgtgtatcactcactgatcatgaggcggcaaaaaaagcttcgaattaccgatcgcaaaaaaaaaaaaaaaa

SEQ ID NO: 2794 - DNA, 1245 bp, Zea mays
atctcgcctctccctgtcatggcggataatttaatcccaccactcccatgctctgttacattattgcctccgcctcgccgcacccatcccaccatgtcctctcctctgttcctctccagcccccttttcaacctttgacgctgtagcttgagagcgagattagtgcctaccatattctcctcctgagcgactgagcgctggtctccgataggctcgccatgcaggtgctctgcgacgtctgcggcggcgcgccggccgccgtgctctgctgcactgacgaggccgcgctctgctccgcctgcgaccgccgcgtctaccgcgccgacaagcgccgccgcatcccgctcgtccagccctgcggcgacgactccgccgccgccgccgccgcgccgctctgcgacgtctgcaaggagcggaggggcctcgtgttctgcgtggaggaccgcgccatcctgtgccccgactgcgacgaccccatccacagcgccaacgacctcaccgccaagcacacccgcttcctcctcgtcggggccaagctctccgccgcgctcgtcgaccaggcgcccccctcccctgacgacgacgacgacgacgtcgccgagcccgacgctgtccccgccgcctgcgcggccaaggcctcgtctcttgagtccggcggcggcagcagcatctccgactacctcaccaacatctgcccgggctggcgcgtcgacgatcttctcttggacgactcgtcgttctcagcgccatctaagaccggctacagcgacggccacgatcaggtgccgtccgtggatgccgacctcttcgacgtggtggccagcggccggccaggcaagcgcgtcggcggcgcagcgctgggcttcgacaaggccccggcctccgttgtggtcgtcccgacgcaggggtgcgtgacggagaggacttggaacagcgacagcgacgtgttcgcggtgccggagctcccgcagccgccgccggccaagaaggcgcggccggcgccggcgccaactttctggtgcttctgagctgtactgtatcagtccggcccggccggacagtgtgtgtacttgtcgtgacttctgtgaccgctgtgtgtgagcttgcttacataatactcaccgctagtggttagcagtgctcaatcccaattaattaggtttgctgtgtcgtgtatcactcactgatcatgaggtggcaaaaaaaagcttcgaattaccgatctcaaaaaaaaaaaaaaaaaaa

SEQ ID NO: 2795 - DNA, 656 bp, Zea mays
  misc_feature (656)..(656): n is a, c, g, or t
gcaaggatggttttcagcaactagtttctgaacagcgtgtccgctgtctggtctgtcaaaataatcttggtaaccagtgccaaaatgattgctgggggaggctattttgatggttctcatgaccatattctcatggaaggatcaatgatccatgattcttcacaatcttccatctatgacaatacagatgttgaacagcagaacttcagatttgcgccctttatcatagaagatcactccaatccagccaaccttacctctgaggctgcaagggtgatagaccaaattcaacaccagctggggattgacatcgagcaggaccatagtgatcacatgatgcaagaagttcctccagcagaaactgaaaatttggttcctgctgtctatggtgttcaagatcatatccttagccaccagatagaaggtccgcataacataactgtggaacaacaggtcctgggctatgaccctgcatcatatcgaaatggcacttatgcagctgcacatgatcttctaaattctctacatatccaaaggtgcagtttgattcctgaatttccttccacagaacatatctttagtgatccagcacagaacatggtcaacaggttggacattacaaatgatcttccaggagtagcacatcatgaaagtgn

SEQ ID NO: 2796 - DNA, 832 bp, Zea mays
attgggtacctcgaggccggccggggacacgactctcggcaacggatatctcggctctcgcatcgatgaagaacgtagcaaaatgcgatacctggtgtgaattgcagaatcccgcgaaccatcgagtttttgaacgcaagttgcacccgaagccttctggcggagggcacgtccccctgcgcgcccctccggggaattacaccgaatcaccctctcgcccaccaccacaccacaccaccggcggcggcggcgacccagtcgagaacacgaaggcgatggcgacagcgctgaaccgcgggctccgctccgggctccgcctcctcgccgccggcgccgaggcgtccaagccagcttctcgtggattccatgccaccgtcgtgaagagaatgggagggcatggccatgatgagccatactacatccatgccaagcacatgtataacttgcacaggatgaagcatcagggtttgaaggtgacactctccgtgctgggagcggttggcatcggtgttggagtccctgtgtatgcagtcatattccagcagaagaagactgcctctggctgagatgatgcctctcgctgcctgcatatggagacttattttgaacgacatttttttgaagttaaaagcttggacttcatcctatcttggttgttgcctgatactgcattttcttaccataagttgtaacctcgtttcttgcggtttggtgtaggacacgacttttctgttaataatgttgtggcttgaactttccaggctgtggagattggggaaaacccgaaaaaaaaaaaaaaaaaaacggcaaaaaataaaaaaaaaaaaaaata

SEQ ID NO: 2797 - DNA, 877 bp, Zea mays
acaaatgataatggccgcccgggcccggcccggcgtcgaagggcccgaccgcaacaaatcacaccgaatcaccctctcgcccaccaggccaccaccacaccacaccacaccacaccaccggcggcggcggcgacccagtcgagaacacgaaggcgatggcgacagcgctgaaccgcgggctccgcctcctcgccgccggcgccgaggcgtccaagccagcttctcgtggattccatgccaccggcgtgaagagaatgggagggcatggccatgatgagccatactacatccatgccaagcacatgtataacttgcacaggatgaagcatcagggtttgaaggtgacactctccgtgctgggagcggttggcatcggtgttggagtccctgtgtatgcagtcatattccagcagaagaagactgcctctggctgagatgatgcctctcgctgcctgcatatggagacttattttgagcgacatttttttgaagttaaaagcttggacttcatcctatcttggttgttgcctgatactgcattttcttaccataagttgtaacctcgtttcttgcggtttggtgtaggacacgacttttctgttaataatgttgtggcttgaactttccaggctgtggagattggggaaaactcagcgctgataccatttgttacttttctgtttcttgtcatgcttcttgtgttgactgctgagcatgtttagctggtgtgttgccttttgaggtgtcacttgcttttgtatcaggatgcttaacatttaatggaaattactgtgtagtagcaaaaaaaaaaaaaaaaaacgcccaaaaaaaaaaaaaaaaaaaaaaaaaaaaaaaaaaaaaaaaaaaaaaaaaaaaa

SEQ ID NO: 2798 - DNA, 837 bp, Zea mays
tatcaaacccgttcaccgcccgtccagcacatcgtcgaaggcccgaccgcaaaaaatcacaccgaatcaccctctcgcccaccaccacaccaccggcggcggcggcgacccagtcgagaacacgaaggcgatggcgacagcgctgaaccgcgggctccgctccgggctccgcctcctcgccgccggcgccgaggcgtccaagccagcttctcgtggattccatgccaccggcgtgaagagaatgggagggcatggccatgatgagccatactacatccatgccaagcacatgtataacttgcacaggatgaagcatcagggtttgaaggtgacactctccgtgctgggagcggttggcatcggtgttggagtccctgtgtatgcagtcatattccagcagaagaagactgcctctggctgagatgatgcctctcgctgcctgcatatggagacttattttgagcgacatttttttgaagttaaaagcttggacttcatcctatcttggttgttgcctgatactgcattttcttaccataagttgtaacctcgtttcttgcggtttggtgtaggacacgacttttctgttaataatgttgtggcttgaactttccaggctgtggagattggggaaaactcagcgctgatatcatttgttacttttctgtttcttgtcatgcttcttgtgttgactgctgagcatggttagctggtgtgttgccttttgaggtgtcacttgcttttgtatcaggatgcttacaatttaatggaaattactgtgtaataaaaaaaaaaaaaaaaaggcccctaccgcccccctgcgttgttaccactgct

SEQ ID NO: 2799 - DNA, 780 bp, Zea mays
gccggcccgggcgggacatcggcgccgcccggaccgcaacaaatcacatcgaatcacccctctcgcccaccaccacaccacaccaccggcggcggcggcgacccagtcgagaacacgaaggcgatggcgacagcgctgaaccgcgggctccgctccgggctccgcctcctcgccgccggcgccgaggcgtccaagccagcttctcgtggattccatgccaccggcgtgaagagaatgggagggcatggccatgatgagccatactacatccatgccaagcacatgtataacttgcacaggatgaagcatcagggtttgaaggtgacactctccgtgctgggagcggttggcatcggtgttggagtccctgtgtatgcagtcatattccagcagaagaagactgcctctggctgagatgatgcctctcgctgcctgcatatggagacttattttgagcgacatttttttgaagttaaaagcttggacttcatcctatcttggttgttgcctgatactgcattttcttaccataagttgtaacctcgtttcttccggtttggtgtaggacacgacttttctgttaataatgttatggcttgaactttccaggctgtggagattggggaaaactcagcgctgatatcatttgttacttttctgtttcttggcaaaaatcttgcgatgactgctgagcatggttagctggtgtgttgccttttgaggtgtcacttgcttttgtatcaggatgcttgcaatttaatggaattactggggtggacg

SEQ ID NO: 2800 - DNA, 956 bp, Zea mays
agggccttgcattttttcctccgctttgccttccccgattacgttccctcgctactcgctagtcgccacttctcccgttgccccccgcgtctctcttctcgttgcgacgactgggcgatccctgccgccccccgtctcccgctccccgccgccaggtgcccaggttgtcgccgggcccttcgccggcgatgagcacccaacaggaggttactgagaactacgcaaatcctaagacatgcttcttccatgttctcttcaaggcatcggcattggcgttctacatactgtccacactgttcgtgaacaacttcgtcatcatctttgtcatcactgtgctcctcgcagcacttgacttctgggtcgtgaagaatgtcagcggaaggatactggttgggctgcggtggtggaatgagattaacgatgagggagagagtgtctggaagtttgagtgccttgatggagagtccctggctaggatgaataagaaggactcatggctgttctggtggactctatatttgactgcggctgcatggattatacttgggatattctcgctcatcagacttcaagctgattaccttctcgttgttggagtttgcttgagcctcagcattgcaaatattattgggttcaccaaatgcaataaagatgcgaagaagaacatccaggattggacaaggaatgcacttctatcaggtagtgtcagatcgcatctgcagtcagcatttggtgtctgaacaataacctatgaccttgttatacgtgtagtgctgtataatttacagataacatgattggttactagagtgcgtctgtttttttttttgttggctatgtgcatcttgctaggcagagtcggaagaacattttcagagccgtgtatcaactcgatgtataatgcagtttgaataaaatcttcctttaacaaaaaaaaaaaaaaaactgcgccctcc

SEQ ID NO: 2801 - DNA, 854 bp, Zea mays
ggcgggccttgcattttttcctccgctttgccttccccgattacgctccctcgctactcgctagtcgccacgctcgccaggttctcgcgttgcccccgcgtctctcttctcgttgcgacgactgggcgatcgctgccgccccggcgcccccgccgccaggtgccaggttgtcgccgggcccttcgccggcgatgagcacccaacaggaggttaccgagaactacgcaaatcctaagacatgcttcttccatgttctcttcaaggcatcggcattggcgttctacatactgtccacactgttcgtgaacaacttcgtcatcatctttgtcatcactgtgctcctcgcagcacttgacttctgggtcgtgaagaatgtcagcggaaggatactggttgggctgcggtggtggaatgagattaacgatgagggagagagtgtctggaagtttgagtgccttgatggagagtccctggctaggatgaataagaaggactcatggctgttctggtggactctatatctggctgcggctgcatggattatacttgggatattctcgctcatcagacttcaagctgattaccttctcgttgttggagtttgcttgagcctcagcattgcaaatattattgggttcaccaaatgcaataaagatgcgaagaagaacatccaggattggacaaggagtgcacttctatcaggtagtgtcagatcgcatctgcagtcagcatttggtgtctgaccaataacctacgaccttggtatacgtgtagtgctggataatttacagataacatgattggttactagagcgcgtctggttttttttggttggctatgtgcatcttgctag

SEQ ID NO: 2802 - DNA, 1669 bp, Zea mays
ccggccgggaacatactatacggagatgaaatccccagatgagactgcaaaatgatcgaccacgtcaacctcgaacgttccacgcacacgctatcgaccagcgggcagcggctccccggtccccaacaaccgcgcgacgacctcctcctctccccgtgctgccattacatatagcgtagctggactttccctccttcaccagcgcttcagctccgaccaagcctgcttgcttccttcgtccatcaagtatccatggcgcggttcctcctcctcctcggggcctccgtgctgctgctcgcgtccgccgtcacggcgcaggactgcctgtccgcgacgttcagcggcgggcggaccttcggcaagtgcaacagcctgccgtcgctcagcgccagcctgcactggacgtaccacccggagaacggcacggccgacgtggcgttccgcgcgccgtcggaccccagcggctgggtcgcctggggcatcaaccccgacagcggcggcagcatggaagggagcagcgtcttcgtcgcctcgcaggacggcagcggcgccgtgtccatcctcatgaccaacctggagagcaccagccccagcctcaccaacaccaccgccctcaagttcaaggtgcccgccggccccgccgccgagtactccgaccgcgcgtacaccatctacgccacggtggagcttccccggaactccacgcagcagttcacggtgtggcaggccggcccggcgaccagcaacggtggcatctcccctcacccgacggcgccggccaacttggccagcacccagcggctggacttcctctccggctccagcaccgccgcgtcaaactccaagcttcaccgccgtaacatccacgggatgctgaacgcgattgcgtggggcgtcctgatccccaccggcgccatcatcgcgcgctacctgcgcgtgttcgagtccgcggacccagcatggttctacctccacatcgcctgccagtgctccggctacgtcctcggcgtggccggctggggcctggggctgaagctgggcagcgagtccgccggcgtcacctaccagccccaccgcagcatcggcatcgccatcttctgcctggccaccctccaggtgctggcgctgctgctcaggcccgacaagaagaacaaatacaggctctactggaacatctaccaccactccgtcggctacgccgtcatcgtcctcagcgccgtcaacatcttcaaggggctccacatcctcgagccggccagcggctacaagaccgcctacattgtcatcctggccacgctcgccggcatcgcgctctgcctcgaggccatcacgtggcccatcgccatccggaagcgcaggcgcaacgccgacaaggcgtccggcggcaacggctggcagcagggtgcgtagtagggaccagatcgcccggcttgtgcttagttttgaatgcgagagagggatgtgatatcgatgtgctcatttcgttgttcagacttcagagggatcgttgctgcctgtgctttctttctcttcctgttattactacctctctagtctgtacttgtacgtagaagagtagctccttattttttttaattattagggttctataatggcatttgtacacattttttccctattcttattattgattacgattactttgatt

SEQ ID NO: 2803 - DNA, 3025 bp, Zea mays
acacaccaaaaaaagaagcagcagccgcatcattgtgttgtttcacatagatatatcatgcataagatactatcggagacgaaatccccagatgacactgcaaaatgatcgaccatgtcaacctcgaacgttccaggcacacgctatcgaccagcggctctccggtccccaacaaccgcgcgacgacctcctcctctccccgtgctgccattacatatagcgtagctggactttccctccctccccacgcctgcagctccgaccaagcctgcttgctgccttcgtccatcaagtatccatggcgcggctcctcctcctcctcctcggggcctccgtgctgctgctcgcgtccgccgtcacggcgcaggactgcctgtccgcgacgttcagcggcgggcggaccttcggcaagtgcaacagcctgccgtcgctcagcgccagcctgcactggacgtaccacgcggagaacggcacggccgacgtggcgttccgcgcgccgtcggaccccagcggctgggtcgcctggggcatcaaccccgacagcggcggcagcatggaagggagcagcgtcttcgtcgcctcgcaggacggcagcggcgccgtgtccatcctcatgaccaacctggagagcaccagccccagcctcaccaacaccaccgccctcaagttcaaggtgcccgccggccccgccgccgagtactccgaccgcgcgtacaccatctacgccacggtggagcttccccggaactccacgcagcagttcacggtgtggcaggccggcccggcgaccagcaacggtggcatctcccctcacccgacggcgccggccaacttggccagcacccagcggctggacttcctctccggctccagcaccgccgcgccaaactccaagcttcaccgccgtaacgtgagttcctcgtcctcctccgacgacgatccttttcccctcctgcttagcttgtttttctgttcaattttcatattctttaggcttcaaagattgccttccttccttgcctaattgttcagacggtaggtaagtttggataggtggtgtggtgatcaagtagacgacggcgacgttgtgtgcattaatagtcagctgggttggggtggaggtgaggaattgaggatgactgggattatgatcaggtcgagttacttgattgatcagtttaatttagatgtgacgtgacatatagaaaaagaatctgcaaaaattaaaactcgatttgcttgcttcaccaaccggatagatatatgacgatggaaaaggctgttcggattcccagtccagaagcaacatctttctgggggagctatactgcgtttcagatttcacaaagagctgtacttaattacgctagctatattagacatatgtttgaatttgtttttttagattttttagtattttttcaatatctctagatacagtctttatatctgagtgacatatatgttttaatttaaattttcccatcatcttttgtaacaaacagatccacgggatgctgaacgcgattgcgtggggcgtcctgatccccaccggcgccatcatcgcgcgctacctgcgcgtgttcgagtccgcggacccggcatggttctacctccacatcgcctgccagtgctccggctacgtcctcggcgtggccggctggggcctggggctgaagctgggcagcgagtccgccggcgtcacctaccagccccaccgcagcatcggcatcgccatcttctgcctggccaccctccaggtgctggcgctgctgctcaggcccgacaagaagaacaagtacaggctctactggaacatctaccaccactccgtcggctacgccgtcatcgtcctcagcgccgtcaacatcttcaaggggctccacatcctcgagccggccagcggctacaagaccgcctacattgtcatcctggccacgctcgccggcatcgcgctctgcctcgaggccatcacgtggcccatcgccatccggaagcgcaggcgcaacgccgacaaggcgtccggcggcaacggctggcagcagggtgcgtagtagggaccagatcgcccggcttgtgcttagttttgaatgcgagagagggatgtgatatcgatgtgctcatgtcgttgttcagagggatcgttgctgcctgtgctttctttctcttcctgttattactacctctctagtctgtacttgtttatttattttatttatgtttcttctgttttgtttatttattttattattagggttccatattgccatttgtacacagtttttctctcttcttattattgactacgattactctgattagtgtatatattgtttccatcagatgaaggcttgataatcgctctcaagtctcaagttaaatcgacagattattgagtcttgtgcttatggtggatgcttttctgtccctgcggcaaaaatgacacccaacagtcgctttctgccaacttctccagtcaacctgcagcccttgcaccgcgtcgtgtccaacagttcatttatataattaactaaaatactgttttgtacagtaaactaaactattagtagattagtatttgaatatagatatagtgataggtaagctactgagatttgatttgtttcatactcatatgctcaccggaagatctgaaagcaacggctggggagttttctagacggataccatcacgcaaccaaaactatgccatgtcttttgtcctttggatttgacggcatcgtagcataaacaacaatgcttaatgatgtaaccgatgcaaaaaattagatattttttccaacgcccggtttgtatccttgatattgaattttattctaataataataattcagaaaaaaattaagctaatatacgtggaagatatttatgtgctacatttttactatagagaattaagctaaagaacgtctctaaattgcaaagtaaattcatattctattgatacataaaatcatttcacatacccatctcataactttaagatagaattatatcttaggct

SEQ ID NO: 2804 - DNA, 2790 bp, Zea mays
cccagatgagactgaaaaatgatcgaccacgtcacctcgaaccttccacgcacacgctagcagtagcagccagcggctctccggcccccaacaaccgcgcgagcgcgacgacctactcctctctccgtgctgccattacatatagcgcagctgcaggctgcagctccgaccaagcaagccttcatctatcgagtcgcccgtcaccacagctgatattgaggcgacgcgccggccgtccagatcaaccaaaaaagagaaaaaaaaacagtagccatgtcgcggctcctcctcctcggggccgccgtgctgctgctcgcgtcggccgccacggcgcaggactgcctgtccgcgacgttcagcggcgggcggaccttcgggcggtgcaacaacctgccgtcgctgagcgccagcctgcactggacgtaccacccggagaacggcaccgcggacgtggcgttccgcgcgccgtcggacgccagcggctgggtcgcctggggcatcaaccccgaccgcggcggcagcatgggcggcagcagcgtcttcgtggcctcgccctcgcaggacggcagcggcgcggtgtccatcctcatgacccacctggagagcacgtcgcccagcctaaccaacaacaccctcaagttcaaggtgcccgtcggccccgccgccgagtactccaacggcgcctacaccatcttcgccacggtggagcttcccggcaactccacgcagcagttcacggtgtggcaggccggcgcgaccagcaacggtgccatctcccctcacccgacggcgccggccaacttggccagcacccagaggctggacttcctctccgggtccagcaccgccgcctcaaactccaggcttcaccgccgtaacgtgagttccacttcctcctcgtcttttccctcccgcttcgcttgttttctttttcaggtctcggtttcttatgtttttttaagaaaaagattgccttccatgcccaattcttcagacggtaggtaaagtttagtttggtagtgatcaagtagaggacggcgacgttctgtagattaagagtgagctgagttggagatggctgcaaccaagctactttcatcggttgtttaatttagggcgtgtttggaagcacacattttctaagaaactggtagtttataaaaaactgatgtggttccaaacataccagtttatatctcggtttgtagaaattagattaatagttttttaaagaaagctggcctttcctagctaaaaataaaaaccaattttttaaaaaccgagttgcttctaaacaagacattagacggacattacatacatatataaaatctgccaaatggcttactaagctttaaaatccatttgcttgcttgcttcaccaaccggatagaccgtgtcatatgaccctgaaaaaagagatgttcagactcctagtcccagaagcaacatctttcattttcagatttcgcaagggaatactccgtacttaaaaattgctacatatatttgggccagtcttaaattttgataattctaaccaaatgtatggtacaacaaaacagatccacggcatgctgaacgcgatcgcctggggcgtcctgatccccgtcggcgccatcatcgcgcggtacctgcgcgtgttcgagtccgcggacccggcgtggttctacctgcacatcgcgtgccagtgctccggctacatcctgggcgtggccggctggggcctggggctgaagctcggcagcgagtcggccggcgtcacctaccagccgcaccgcagcatcggcatcgccatcttctgcctggccacgctgcaggtgttcgcgctgctgctccggcccgacaagaagaacaggtacaggctgtactggaacatctaccaccactccgtcggctactccgtcatcgtcctcggcgccgtcaacatcttcaaggggctcgacatcctcaagccggccagcggctacaagaccgcctacattgtcgtcctggccacgctcggcggcgtcgcgctctgcctcgaggccatcacgtggcccatcgccatccggaagcgcaggcgtaacgccgccgacaaggcgtccaacggcaacggctggcagcagggtgcgtagggggccaggtcgatcgccgggctttgtgcgcgtgtgtcgttgtgctatagttttgatgcgagagagaggtctgatatcgatgtgctgatgccgttgttcagagagagagatcgttgctgatgtgtttctttcctgttactactgcctctgtagtctgtactcctacctagaagagtagctcctttgattttttttcttctgttttgttgttgaattttattagggttctatagtgccatttgtacacattttttcccttcttattgatgtacgtacgactgctttgattactgtatggtttcagtcagagatgacacggctttccttactgctcaagttaaaaactgacagattgtcgttgagtcttgtggatgcatttctgtccccgcggcaaagataacaccgaaccgaacactcgctttcgttctgccaactccaatcagcttgcagccgttggaggtttgatttggtttggtcagatgctcaccagaagatgtgagaacaacacagctggggggagttttcctttggatatcgtcatgcaacgaaaattatgccgtcctgtttgtcctttgcttttgatggcatggtagcatacatagagcattgattttttttattattatgatctgaccaaatcaaatccataggcaatgagacaaaaccataagca

SEQ ID NO: 2805 - DNA, 1655 bp, Zea mays
gcacgagaccattacctagaacatcctaatcgaaaaaagcaagccttcatctatcgagtcgcccgtcaccacagctgatattgaggcgacgcgccggccgtccagatcaaccaaaaaagagaaaaaaaaacagtagccatgtcgcggctcctcctcctcggggccgccgtgctgctgctcgcgtcggccgccacggcgcaggactgcctgtccgcgacgttcagcggcgggcggaccttcgggcggtgcaacaacctgccgtcgctgagcgccagcctgcactggacgtaccacccggagaacggcaccgcggacgtggcgttccgcgcgccgtcggacgccagcggctgggtcgcctggggcatcaaccccgaccgcggcggcagcatgggcggcagcagcgtcttcgtggcctcgccctcgcaggacggcagcggcgcggtgtccatcctcatgacccacctggagagcacgtcgcccagcctaaccaacaacaccctcaagttcaaggtgcccgtcggccccgccgccgagtactccaacggcgcctacaccatcttcgccacggtggagcttcccggcaactccacgcagcagttcacggtgtggcaggccggcgcgaccagcaacggtgccatctcccctcacccgacggcgccggccaacttggccagcacccagaggctggacttcctctccgggtccagcaccgccgcctcaaactccaggcttcaccgccgtaacatccacggcatgctgaacgcgatcgcctggggcgtcctgatccccgtcggcgccatcatcgcgcggtacctgcgcgtgttcgagtccgcggacccggcgtggttctacctgcacatcgcgtgccagtgctccggctacatcctgggcgtggccggctggggcctggggctgaagctcggcagcgagtcggccggcgtcacctaccagccgcaccgcagcatcggcatcgccatcttctgcctggccacgctgcaggtgttcgcgctgctgctccggcccgacaagaagaacaggtacaggctgtactggaacatctaccaccactccgtcggctactccgtcatcgtcctcggcgccgtcaacatcttcaaggggctcgacatcctcaagccggccagcggctacaagaccgcctacattgtcgtcctggccacgctcggcggcgtcgcgctctgcctcgaggccatcacgtggcccatcgccatccggaagcgcaggcgtaacgccgccgacaaggcgtccaacggcaacggcaacggctggcagcagggtgcgtaggggcctgatcgctgggcttgtgcgcgtgcgtgtgtttgtgctatagttttgatgcgagagagaggtctgatatcgatgtgctgatgccgttgttcagagagacatcgttgctgatgtgtttctttcctgttactactgcctctgtagtctgtactcctacctagaagagtagctcctttgattttttttcttctgttttgttgttgaattttattagggttctatagtgccatttgtacacattttttcccttcttattgatgtacgtacgactgctttgattactgtatggtttcagtcagtcagatgacacggctttccttaaaaaaaaaaaaaaaaaaaaaaaaaaaaat

SEQ ID NO: 2806 - DNA, 2427 bp, Zea mays
  misc_feature (874)..(875): n is a, c, g, or t
  misc_feature (2406)..(2406): n is a, c, g, or t
agtcgtaggttgttttttgttaccaaaaaattatgtaactgtgtcatgtcgaatacgatttcaatagttatcatatcatatttgtgttgagcttaaccaatataatttgaataggtcttgagcagaataacaattatgggtcaacatgagctgtattgttcagatcccatcatgttaattttaatgataaacacctaattttctcctgattagtgtgtgtttgtgctgacagcaaggttctgttgtttaccaaagtaaaatatcatattttactagctgtcaaaatcaacagattagagaaactaataaacatttgtcggtgtggacagaatattaaactatattattgaaaattcacatttttgaccaactggtttttacgaaattttctcccagaaatagcaaatagctccacatactacttgtgttgattttcaactaaaaatccttgtcttcacttaacacctgtgtcatagctataaagctgcaagggcctaatgggacaattttgtattactaagggccttaattgaggaaaattgtatactacagcgatttaaatcaagattaaatttgatgggcttgcttgatgcataaatgtagacttgatagtttacataattaaattagacaactttgtttcacaatatcttattcttaagttattatttgtcatttgtgatctgtcatcttgtagcaaccatgcttgatggggaaccgatcatatccttaccacccaagactgtttcacttaagacggtggacttcactagcgaggagcgtggtttttataacactttagaagttgaatcacgagaacagttcaaggaatatgcagcggctccctcggggccgcccgggtatgtcatcattnnctattgatgcttttgcggctaagacaggcatgcgatcaccctcacctagttagaggctatgactcctgttctagttggatgtcttcgttggagatggtgaagaaacttcccatggaacggcagcacaaattacttatttgcttgcaatcttgttctgcgttttgtgctctatgcaatgatgcgccagaagatcctgttgtcactctatgtggtcatgttttttgcaaccagtgcatactggagcaactcactggtgacgacagtgtatgcccagtgtctaattgcagagtccgactaaacacatcctcactcttctccagaggcactcttgaatgctctctgagtaaattagcctctgatttcaagtctgatgatacatgtatggaaatgatacatgctgaaaagcgccctgggatggattcatcctacgcatcttcaaaagtgagagctgcattagatattcttctctcattgcctaaaatagatcccactattgatagcaaatgttcaatcgggattgaatctgagaagtttgatggaaagggtatttcagaacaaactgacaccaagttgacagagaaggccattgttttctctcaatggactagaatgctagacttgcttgaagtccatttgaaagcttctcatgtgacatatcgaaggcttgatggaacaatgtctgttgctgcacgggataaagctgtgaacgacttcaatatggttccagaggttactgttatgatcatgtcactcaaagctgcaagtcttggcttgaatatggttgctgcctgccacgtacttatgctagatctttggtggaacccaaccaccgaggaccaagctgtggatagggcacaccgtattggtcaaaaacggcctgtcacggtatcaagattaactataaaagacaccgtggaagatcgtattcttgctctccaggagaaaaagcgggagatggttgcttctgcgtttggagaagacaaatctggttcccgacagactcgattgaccgttgaagacctgaattatctgtttatggtgtagaatcgctcctgagagtgaacagttttgctcattggattggtgttagacgtggtagataaaaatgttctctgaaaaaataacaaaatgctttcatttagggattattagttcttgtagcttgtacagttgcagagatttaggggttgctagcgacgtgtcttccaattctttttgcacgggaagcagtaagatgctgaactaggtgaattcttcagatagctgctatagtgcctgttaacttggggggtgttttctatgtactaatttctagttcctccattttattttcttttacttcctaaattgtcaaacacagatactaaaatagagataatctctcttttagtctatgtgtttagcaatttaggggctaaaagggactaaaatagagagactaaagacaccccttaatgtaatgaagataacgacaatgaagctcagatgatatatatgtacatattcttctcgtatccgataaaccatcganaaaaaaaaaaaagaaaggggg

SEQ ID NO: 2807 - DNA, 972 bp, Zea mays
gaacttaccaaatatgatgttgtgcttactacatattctatagtaagcatggaagtaccaaaacaatcaaatcctgatagtgatggagaagagaaagggaagcctgacccgtatggtgcacctgtgtcctcttcagggagcaaaaagagaaaggcatcctcttctaagaaaacaaaaaataaaagtgttgcagagagttgcttgcctgaaaaacctcttgcgaaagttgcttggtttagggttattcttgatgaagcacaaagcattaagaactaccgaactcaggttgccagggcttgctggggtttgcgagccaaaagaagatggtgtttgtctgggacacctatacagaatgctgttgaggatctctatagctacttcagatttctcagatacaatccttacgctgtatataagcagttttgcactctgataaagattccaatcagtaggaacccaaataacggttacaagaagcttcaagctgttttaaagccggtaatgctacgccggactaaagcaaccatgcttgatggggaaccgatcatatccttaccacccaagactgtttcacttaagacggtggacttcactagcgaggagcgtggtttttataacactttagaagttgaatcacgagaacagttcaaggaatatgcagctgctggtactggaaagcaaaattatgtcaacattctattgatgcttttgcggctaagacaggcatgcgatcaccctcacctagttagaggctatgactcctgttctagttggatgtcttcgttggagatggtgaagaaacttcccatggaacggcagcacaaattacttatttgcttgcaatcttgttctgcgttttgtgctctatgcaatgatgcgccagaagatcctgttgtcactctatgtggtcatgttttttgcaaccagtgcatactggagcaactcactggtgacgacagtgtatgcccagtg

SEQ ID NO: 2808 - DNA, 2329 bp, Zea mays
gccggccgggttccaaagcaacacttttcctctgagccgcgacctgtctctgtctctgtctctgtctctgttcttctgccccgactccgcccacgcatctctttctcctcttcccccgcgcggcggccgcgggagtgttcgtgttcctcacttctcccgcttgcgtccccgacactccctcagatccgcggccgtttcccgatccgaggggcattccagccctaaatagcggccggtgagcaggtctccttccgccggcgcggaccacctggagggagtttatcctggagccgtcttcctcctcgcctccttttgcggcgcggcgcggaggccggagtcgcttggaggcccagctgtgtttgggttgatttcttcgtttgtcgtggttagaggcacctggtttgttttttgctgaagctggtggtacatgtgaatagcagggcctgtcttctgcctctgcttttgcttcgaagcaatggcgaatgcaagcaagcacttgcaaccttcaagtcaagcaggcaatgacaagaagtatcagggcacgctggttgcttcaccagcaaaggccatttcacctaagtgtgtgaaccgcattgtgccatcgaagcaactgatcttgggtgggggttcaataggccatgtggcatcatttctgatcaaggtcgttgctcttgaggcagtcagaagagtttctaaaacaagatgccctttcatatggaattctgttcaagcattgcagatccttgtgtatcctccatttagctggatccaaagatgggcaccgctcggatttctcgtgcagggaattcagaaactatccatgccactgttgtttctgtcagtcacaacaacagtaagtgagctgtcttccaagcatgatgatgaaccagataacaatacagaacattctgagacaccttctgaaacaaatgaattggcgtcaacttctggcacaagcgatgctgctgatggcacaaaggaaatcatgcaagagaactggcttgtgttacttttcagggagcttgagaagcaaggcatcactttgcctgagaggtttactgaagatgagttacgcagattttatgttgctgcaaatggtgactttcaaagtttactctcttcggttaagaagacaattcattggagggaaacatttcacatacttacattgcaagaacttgatagatggtctcacttagtcttttggcatgggtttgacacgatgcttcggccttgtttagtagttcgtcttggacttgcatgctctagcatacctcctcatgatagaccccgtttcgggcaagcagtagtttctcaaattgaccatggcgttgtaaatttgatcaatgaagaagattcaaggattaccgttttactggattgccatgggatttcgccattcagatttccaatgcaaatgatgaggtcgttcatcactgtggttcaagaaaactacccgaatcgtcttggggtattgtttgtcatccgtcttcctccagttgtcagagttattgcacagacatttcttcaagtcttgaaaccagctacaaagcagaagttgcgttttgagggagattcgtacaagaaggcattggcggagttcctgcaggctgtgccagcgtttctgggcggtaaatgcagctgcccgcgatgtgagagtcctcgtgatgattcagtgatacaggcaggggaagggagcaagaagcagccccgcttggtcagcgttgatgacgggttacctgtcacagacttggacttcgacttggatgaagagatcccatcaccttatagctgcgagaacgccatcagggctgcgataatcggcctgctgatggtgtgcatcttcgtcgcgtttctggctgggatgatcgaccctgcatccgttccagccagtgcctgagagcttgtggaatagagcatgcacgtacatgtgttgctaattaggatgcagggtgctgtatttcttggcaggcttcttgtatgttgtcgtcagaccgccatagagcgctttctcccagtgtgagcgcgcgcatgaataatatatatcctctgtgtcaaatgttggttagcagttcaattcgggcctactagatttcactattttcttttttatcttgatcgggcctactgaatttttgctcctctttctcaaaaagatcacttggcccctgggcccatagagcttatatgagctacgctctggccacggcctgggtggaccgcgtcatagatccgcccctgcctgccagttctgcttcacagtgaatccattaacagtgcgtttggatgttggaatttagactcggaattcagaattggaatttagact

SEQ ID NO: 2809 - DNA, 4282 bp, Zea mays
  misc_feature (1312)..(1312): n is a, c, g, or t
  misc_feature (1392)..(1392): n is a, c, g, or t
  misc_feature (1422)..(1422): n is a, c, g, or t
  misc_feature (1460)..(1460): n is a, c, g, or t
  misc_feature (3049)..(3049): n is a, c, g, or t
  misc_feature (3054)..(3054): n is a, c, g, or t
  misc_feature (3152)..(3152): n is a, c, g, or t
gacatttgctttgtgtaggttaccataattcttactgcttgcaagcccttttagaatattactgctgcgaggttcttgcaagtccttgatgaagaagtcgaaggtgacgaacgccgaggccgtcatcctgatcgacgccaagaacctcacagcgcacctccttgtgatgctcttttctccaatgtcttctcttatctacatgcaggaaaaaatctacatgttgatggcgtggatcagaaaaatggtaagttttgcttcatagatgtattaatatttggaatctcaataaacccctcttgttttccgtctgctaacatattcgtatggaacccagcacaaagctcaacgagaataatgatgcaatgatacatacatgtccacagtccatacgttttttttgaagaaataacacttttctagatgagataattagcacatgtgcaattagccaattactgtcttgtgttatgtgagccattggatttgatttttatatcctagaaagtgattcatgttacacttgacctgagattcatggaaccaattggttgagctgcacattcaaatttgatttgttttaatctaatgaataacaatttgttagcagtggaaggacaagatttaagatgcactgccatggttggcggtctatttactgcatctcgaagcggcttgcattcaaaggttctgcacctctaaatattcctggtcgtgaagctgtctatgaaaggaagatgaaaattcagcaagttggattgatttatctttcccccctatggctgattcagcaacctgtattaattagtctatttgacatttgatatttcaatgctgttataggactatattgtacatgaccttgaaggagctgaccatgtgacagaccttgatcataaccatgttgcagagttgaagatattaggactatattaaacattgctgcatatagcatcaggtacacaattttgctatcatttttataaaataaatatgtaccaaaggtctcaaacaacaatactcaatttgaatggcacatactttggaggatatgatgacatcagacttagaagtcaaacaacatcaaacttatcatcaggtatgttttgaattatcttacgttttttagattgaaaataactatttctgaaaccttattttcactctgagcctgtgaggacagtttatccttagttaatcagcactttatatctgttatttgcctattagaagttatatctgtgatccagcaacaacttggtttccgtcgctgcccaaacttcagcagaggcgatctaagaagaagcaagcgtancggctcatgttctgacggccgtgttcacgtggtgtaagatctgcattgtggaatccttcgcccggacaagaggtgatagncactgcttctcctgcgacttttgatgacanaatatattatgattcacacacgctcttacgccttttgntgtactttcttttagattgaatttgacatacttgagctacttggctgcagagattggatcctcccgtccagacaacctgatagaacgacagtgtataagaacagggctcttaggacgccttttgtcaaggtcagtccttttgcatcaaggatctttctgttaccacggaacagtagttactaatgtccataactgtgcagttgggtcataactctaccctgagaattgagatagatgatcatgtggtgcaagatattgagtccctcatctttgatgacacacataacaaatggtaatgctgctgtttggattactgtgtaccactgcttgtttgtttcaatgcacaagatatcaaccatttgaaccctactttggacagttttaaaaacaatggccagaattttcagattcagctccagttgagaaaataatgtggtgcacgctatattaagggcaccatgcttaccatggtactgttgggtatctatattaatcactgtgtctgatcacttcacaggtaagcgtctccgtggatggagcctgaagtatattcaaattcaaggcatgccacaaagcatctcgcgtgtgggatgctccggcgtgtggaaagtagaaaagccaaataaatgggtacatgtacagcaggcgtgagttcttaaatactcagattccttgtccataggcaaatgcatagttcatacgaatcagagtgcacgatgcacgcaacttgacgtctctatcgttgttttcaacatgatgaacatgcgaatttcgtggtattaattgggaccgtctgatttctcatggatccatagttctattctacaagcatttgagataaagggatcatgcaaactgaaaaatgggagatgacactactgtacaacttagtataattcataaacggggatgtttggctggcataactccggtgttgactctggattttttgagagccgtagtatatttttgtttttgttttggaatacctcatatactgcttcggcagtcttggtattcaatcttgaaatacctcatatattctggagaaatggtttcggttcgccgtgcgtacgtttggggttgtggctccctcgcttcttcctggcggcggaagatatagaagggcgagtggccgcgcggaacatcgacgaccgagaaaccccctcgtcagcaactccatctgctattctccctgacggtgttcctggcagcaagatacctgatgcttttgccttcattcttctcactaggtgagtgcccatgcgttgcaagagggacttatgtattatatgtctccgttgcaacgcacaggcatatacctagtactattgaagccctttcttttgtccttggggtctagatgagaagctttcctccaccattccgcgaaacaattatctcctctctttatgactctatatgcccttgtgtttgaatcataaccgagtaaaaactcttcaattgctttggcagcaaacatggaattcatacatttctttaccaatatgtaacatttgctcccaaatactcaaaaatatgaaacatttggtttgttaccatagaggacttcgtatgaagtcttcttnaggangtggtgtaggtacaaccgatttatggcatgacatgatgtgttgatagcttctgcccaaaattggtctgatgtcttatattcttcaagcatcgccctcnccatgttgatcagtgtcctgttcttccttgccattctgttgtggtgtataaggagcaaggaattcatgtttcatgcattcttcctcaagatactcttctacttgcaagttcttgaactctatgccattatcgtttctgatcttcttgatccttaagtcaaactcattttaagctctccttaagaaccgcttcagagtcccttgggtttcacttttatcttgcaagaaaaataccaaagtgaaatatgtatagtcatcaataattacaagaccatacttactcccgtcagtgctaagataagcaacagggccaaagagagatccatatgtagaagctctagtggtcttaatgttgtcattatattcttcatgtgatgactcgagccaacttgctttcctgcttgacaagctgcataaggcctgtctttctcaaaacaaacattcgttagtcctaacacatgtttgcccttttgaagtttatgaaggttctttatcccaacatgtgctaagcgatgatgccatagcctacccatgttagtctttgcaaataaacatgcatcatgttcaacattatcattcaaaaaaatctactagataaagttttccattcaatacacctttaaatataattgaaccatcacttctttgaaagactgtaagatcgacatcagtaaataaaatgttatttctaatagagcattgtcgtggtttcggaactgaggacaataaggtttgtgttcggaggtggatgctagcgcgaactcacattgaatggttaatatttaggactcgaacgaagagcttgggacacagggtttatactggccggagccctagtccagtgtagtgctaatcatagtattgcaatggagtgtgttacatttcatgtgctcacgtgtaagaggaaggagagctttgtccttttatagctcagggagaagacctcacagaggcgacttgttctctacgggcatatgggcgatttgttatctcggtctggcgtagcgctcctaacatagtccgtagggtcgtgcttagccgtactcctggtatgtcatattgccttgcttgttcatcataagggtccctgtagcgagtcctctgctgacatatttgtggtagtgcatggcg

SEQ ID NO: 2810 - DNA, 8126 bp, Zea mays
  misc_feature (4125)..(4125): n is a, c, g, or t
  misc_feature (4159)..(4159): n is a, c, g, or t
  misc_feature (4202)..(4202): n is a, c, g, or t
tacccctgtcggaagcaatgggcacctgggtatgtcaatcattcattctgggctggcacctctgctatcaggaagtctgaaaaaactgatccatactttgatagtgttgtgagtaaaaccacccttccagttttccttgagcaatatgagactaccctgaaagagaagttggaaagggaagcatatgatgatttgcgctcatactattctagactcactttgctgtcgggattgccatttgaggagcaacttgtggagctctatacagtaactatgtttcaaacgttccaggacgagattaagcaattgatgcatgttatttgtaaagaggtagacagaagtgggaactcaattacttacatggtcagtgagttaatacagggaaagaaggttgactatacagttgtttatgacaattctgacaaggatgtttggtgcatttgtcgctcctttccctcgaggggtattctttgcagtcatgctctggctgttctgaagcaagagaatgtactgatgcttccgcctaagtacatcctgaaccgctggaggaaggattttagaatactcaattcatctgcaaatgttaattgtatggaatcagataggaatttgggtttttatgatgatctctattttcgtgcacatgagtattttgaagatgtcattgacattggagcaagagaacctgagctgaaggagtttgtgttgtcagccatgaaggaagcaaaggacagactgattaggcctgatcacagccagcaaagtgatcaacggtttgatgtcaatatgactgtgattggtcaggtgtctgcagatacaggagttgatatgaacatggcatcacatacctcagctccgattcacggggatagaagggttgatgcggatatagcaccaaatgcgccagccttagtccatggtgataccatgacatctaatacaactgccctgattcacagggacagaagagttgagataaaaatgccgatgactcaccttattcatggagagggaagacttgacatgaacatgacatctcctcacttgatacagagggaaagaagagtggacatggacatgaacatggcatcacctcacctgatacaggggggcagaagaattgatatgaacttgtcatcaccccacttcatacacggtgacagaagagttgatatgaatctggcatctccgcatttgatacatggggacagaagggttgatatgaacatggcatcccctcacctgatacagggcgatgccagagtggatatgaatatggtatcgacttctcagaatgggatgcacactttcgatttggtggatataaacctggagagtggctctatgccgatggccgcaacagattttatgcaaatgcacccacacccagcagtttaccatcccaaacagcttgttatgagagatcaggtgatagatgcaaataagagaccaaatatggaatctgacacttattttatgggaggcagtatgcatgtggggtagtttgtctacttctgtgatcctttatgttcggaattcagagaggcatccttcctttacatcgacatgtaatcatgcatgttcttagagctggcagtacaactaaacagctaggccttagtattgcagatcaaacttgactgttggtagttctattgtaaccttttacctttttagcagttgtagcaagctggatgcccattatcttgtgcatagtgaataacctatcttaccatctagttagaactttggaaatgagatggctttagatgcaagattctgctgacatttctggtttcttttgttgactgataatatacatttgctgcatgcctatcttgcaacctattccttatggttagtgcatggtgtcatttgcatttgtcatttttcatttactgaagtctgagctcatcatctgtgcatgggaaatggatgactattttcatttattgaagggcaggcctggtgcagtgagctgtctcgttgggtcaccgaatcttgggttcgaactttgaagcagcctctcgccctctcttgcatttgtggggggacggtttggcttggtttattcctttctcagaccccactcatgtggtagcctctagcactaggtctacctttttttatataattatgcaacatgatattgttctggcagtctgttaaaatttgtctggcttctccatctctttcttggtaatgcacttttttgagataattggtgagatcaggaaagggaaattttggctgtagctgtgttacaacaagatgtaccttgctaattttattgtttagagatggtgatttttacagctctctgttgcacgtaaaggcgctagatcatcagtggacatgtcctgctattgcttgttgctgattgctttctttttttaatgagctttgacatgttaggcaatatttgccctgtttatattgacatgccacttttgatccatttgcagttaatcatggctgcagttttcaatgtttggttaaaactattgtcctggactcctttggtttaaacatgttgaatgtattgtgatgtccttgatctctcgctggttccttctgggattttccgaagtcccattgaaactttcttggcaatttgtgtttttttaccgttgatgttgcagcgagataaaaatggatgatcatcgttatgatatgctctttattagtgccacgtaaatcaccaaaaatattttaatgttcctgtaaaaatatggaaataggaccatagaagtggcatgttgcaagattattttaaatcctcggtgaataagtgtcaaccaagagaatctgcaacaaaaatgttgtaattttaaccagtgatacctttatgaatatttacctaggccattgggaaagtcatttatatatttgattatctgactcacaaatgctctttcatcggttatattatgtttacacagtacatcagagatcagtaaattatgaagcgataactgatgttgtatcagggtgattgtgtgccttcgtatcattatatgtgggctattctggcttgtgaaataattttgtaactatttctctgcaacttgttgtgtgggttcaaaaatcacagctacttgaacttgtagagcgtgattatattgcacgtgttgatttaacagctaaggtcacggtgttcataaagcagaacagcatactcagaaaattcctgcatcttataggggtgagattgtgtatagaacacttttccccggttccccttttgtgttcctgcagccacataaaaaatcagagcatttttttaataggatgacctcccctgacccctgggcctggcagcgcactgccatcagcgcaagcacgatggcagcaggtgaggcggagggatgagcagccttgccatactggagaagaagtcgacgctgttccccgatggcggtggtatgggcggtgttctcttccaactctgagctccaggtgcgaccacgggattccaggttcattcaccatttgctctgtaacactattggtgtattgtgtggagcaggtttcagtgaactcagggccgcagggtttggtttggtgtcaaagatcggcctggaggcgaccaacacaagtggttccctgattctgcattgtggaatccttcgcccagacaagaggtgataggcactgcttctcttgccacttttgatgacaaaatatattatgattcacacacgctcttacgccttttgctgtactttcttttagattgaatttgacatacttgagctacttggctgcagagattggatcctcccgtccagacaacctgatagaacgacagtgtataagaacagggctcttaggacgccttttgtcaaggtcagtccttttgcatcaaggatctttctgttaccatggaacagtagttactaatgtccataactgtgcagatgggtcataactctaccctgtgaattgagatagatgatcatgtggtgcaagatattgagtccctcatctttgacgacacacataacaaatggtaatgctgctgtttggattactgtgtaccattgcttgtttatttcaatgcacaagatatcaaccatttgaactctgctttggacagttttaaaaacaatggccagaattttnagattcagctccagtcgagaaaataatgtggtgnacgctatattaagggaataagggcaccatgcttaccatggtantgttgggtatcatatattaatcactgtgtctgatcacttcacaggtaagcgtctccgtggatggagcctgaagtatattcaaattcaaggcatgccacaaagcatctcgcgtgtgggatgctccggcgtgtggaaaggagaaaagccaaataaatgggtacatgtccagcaggcgtgagttcttaaatactcagattccttgtccataggcaaatgcatagttcatacgaatcagggcttcacatacatatccatttttgtgttggtagcaatataatgtttgatctcaagcttaccacaaccaagctcaattttatatgtgtgcacaccaattggattgatgaaacaaaatgtagatgacacaatacttctttagcattttatatattgagattggattatcgagggtcttgttggatgaatcctgttaaaatttgaaatgccttaagcatatgttcctgttttttatacactaggtatatttgatatatgtcgaatagagtgaatgtctcatgtgtcccttatcgaactgacctttttgtcaacagtttgaaggtgttcctaggaagggttattgctattgctgtctaaatagttgtgtctaaagatgtctttttaattttccccagatcttacaggttaattctcttcgtcattccttctatagatttctgtacagaagcaaatcacgtgctagatgcttttccttttaccaatggcttgctccaacaaaatcctgacatcacaagaagtgcaggaatttgggttacagaaaagcaattagatctctaacaattatcacataatccatctatggaatgtttggccatggtcgcagagcaggtttatattgcagggcgcgcaaagtgtgaaccatgaaatgataaaatgtgtctagttgatccatgctaacgtgacatactgacacgctaggatcccctaacataaaactttacggtattggtaaggtcaaacatttattttgtcctgctgaaatgtgttattgttatcgtcaaacatttatttttgcgttttaggtatatgcctgttctaaggatgctattatatttcgtgatatttatcattattcggtcaaaaaatttggtccgtgtaattatctactttacattagcattactaaggctgcctccagcagcgaacgctaaagcgttctgttcgccaaatctaacgaatggagacgttctggaccagtccagcaaagacctgtaaagcattcgctaaaatagcggagggtcctggcacacgttattgttggcggtttactgtgcgtcctctatccattcactttcagctcagtcgaggcacaacagaagacatgggtcgccgccggattgtggaggcacggtggtggcgggcgtggcagtgatgacttggtctacctcgagttgccacgagcagatggcggaggattggaggttaggttgtttggtcgagcgccatggcatgtgtggcgatgacaagttctgctgcttgtatagcgaggacggaaacctccagcgatgctgctacggacatgagcaagaactgagcgacacctgtgctcgctcacgagcttgaagataacaactcccgagcgacgtattcaacatgttcgacgaaatgtgtgaaaagaaatatagtgaacagaaaattattttttaaatactatacgttcacaaattgtagtagtgaaatattaaaattatgtattgttttattatgggcgtgaccacgaatttaaatatatgaaaaccaaggaataagtaatgttggatatggattatgttagcataggtatatataggtatagaggatgtgatttagaggacgttgttggagaggaaagagatatagaggatgaaatcttttagaggagactgtaaatgatagagaatattctcttagaggatgaattttaggggacgttgctggagacagcctaagatgaggtccacgcggccgggctaggatcactatgagagtacgacttcgtgccttgctctatacgcgtgtactaacgtgggcgtggatttggctatctgtgccactatactcttggtatgcttcttttgtatcaaaggcacttctttaacacaaaactatataacacagctctcttagtaaattcttaactttgaaataagtagacgggttttattttattaaagagaaaataggcatctaaatttgggctggagaggactctaatcaagatggttagatgaatagctcgccccccaccttttttttttgccgtcggcacctcgtctcttttcatgggaatcctgtgatgcctctgctactttcactaatgttgtgcttgtacttgagtgtgaggctaccggcagtgcaggttactccatattcttactctacactgttatttatagtctagtcagcaagattttttactctatactgcaatcctccgtgttcatatccttatatgtattccctctatatcaactaccacatactatattcaacctaaatctgaatattatgtattttcttctgtatataacacataattattcatagtactgtgtgatgacgggatagttagcggaggaaacgagttacgctgtatttggcggactcctgttcttgcagaagcatacacagcgtgcagcgctgcaggtgtatttgcgattttgcgtacagggctcgtagcgtgagttttaccgaacactagtgcggatagtgctatctacggtaatcgattgcactataggaaatgcccccaacttcactagtcaaaagcatgctttctagtgttgctcagtggctatgcatctaatctatccccgtacgtccatcacgttgacctgtccgaaactagctagttcgagcggtggccatagatatggacaacagtgtcactcgtcaaacgtaatctgcattcgacgaagcgctggggattcgagcacagatcacagaggaggaccaaactgcccaagcagacgtcgtcaacacaaattgcaatgtgcaatgtgcctactgcaactactgcaaaggatcaaggagtcaacatcggcatctcctgcgacattcaggacatgctacacatgcaaccagaagctattaatccgtagcgatacatgcttatgctgcttttacaatattttattattttgtctctataaattacaactacaacaatctaaacagctacctttaatcagaaacgaacatgctgattgattatgccctaggtggagtggaccatgtgccattggcattctagtaccacatgtgatattagatgttatttggttcatgaaaatgcaatataaatgacaacggtaatgattcacgctcgaataacagtggtaacaagtttgaatagaccgatattagctcctagtgtgatatttgattacggttgatcctaaataaacatgatctaacgttattaattatctattacattacaaatatgtgaaccaaacagcaccttaatattatcgctcacaccaaatcaagtgatgtactatattccaatgagtacaataagggatcaggcgattaataatccaattaggaaatgacgaatgaccaaagccccatttagtagtaaagtcgcactaattgttccagacactactggctctgggtcacggccttccacagccgaggccagtttctccttagtccttagataatggaaatggatagccgaagcagacgacgattcgccaatcaacagtgcactaataggctgcacattatgagacgacaatgctgacgcaacaactcgagagataccaatatcacagatcaggcgtagcaacctaagtaaggtattcttctcccagttcctatcttgcaaacgcgatcagcattagggagaacggactgtaatgttccaaggtgacgtgatgtccatccaaaagaagactgatgagatattatctcatatgg

SEQ ID NO: 2811 - DNA, 2829 bp, Zea mays
gtctctctctgttcttctgccccgatcggccgatcccacccacgcatatctctcggccgcgcccgcggtagtgttcgtgttcctcactcctcccgcttccttccccgacactacctcagctcagatccgcggcggtttcccggtccctggatctaaagcggccggtgagcaggcctccttccgccgacgcggaccacctggagggaatttatcctggagccgtcttcctcctcgcctcctctcgcggcgcggcgcggaggccggaatcacttggaggtctagctgtgtttggattgatttctttcttcgttcgtggtggctagaggcacctgcgctgtttcttgccgaagcccgtggtacatgtgaacagcagggcctgtcttctgcttgtgcttcttagcaatggcgaatgcaagcaaacacttgcaaccttcaagcaaatcaggcaatgacagaaagtaccagggcacactggttgcttctccagcaaaggacatttcaccgaagtgtgcgaatcacattgttccatcgaaacaactgatcttgggtggggattcaataggccatctggcatcgattctgattaaggccgttgctctcgaggcagtcagaagagtttctaaagcaagataccctttcatatggaattctgttcaagcattgcaaatccttgtgtatcccccatttagttggatccaaagatgggcaccactcaaatttcttgtgcagggaattcagaaactttccatgccactgttgtttttgtcagtcacaacaacagtaagtgagctgtcttccaagcgtgatgatgaaccagataacaatacagaacattctgaaacaccttctgaaacaaatgaattgacatcaacttctggcacaagcgatgctgctgatggcacaaaggaaatcgtacaagagaactggcttgtgttacttttcagggagcttgagaagcaaggcatcactttacctgagaggtttactgaagatgaattacgcagattttatattgctgcaaatggcgacttttcaagtttactctcttcggttaagaagacaattcgttggagggaaacgtttcacatacttacactgcaagaacttgataaatggtctcacttagtcttttggcatggatttgacacaatgcttcggccttgtttagtaattcgtcttggacttgcatgctccagcataccaccttgtgatagaccccgttttgggcaagcagtagtttctcaaattgaccatggtgttgtaaatttgaccaacggagaagattcaagaattaccgttttgctggattgccatgggatttccccattcagatttccaatgcaaatgatgaggtcatttgtcactgtagctcaagaaaactacccaaatcgtcttggactattgtttgttgtccgccttcctccagttgttagagttattgcacagacatttcttcaagttttgaaaccatctacaaagcagaagttacgttttgagggagattcatacaagaagacgttggcggagttcttgcaggccgtgccagcgtttctgggcggtaaatgcagctgcccacgatgcgagaagcctcgtaatagttcagtggtgcaggcaggggaagggagcaagaaccagcctcgcttggtcagcgttgataccggatcacctgtcgtggacttcgacttcgatgaagaagagatcccatcaccttatagctgcgagaacgccatcagggctgcgataatcggcctgctgatggtgtgcatcttcatcgcgtttttggctgggatgaacgaccctgcatccgttccgcccagtgcctgagagctatggaatcgcctaatctcccatagtagagcttagattgtcagttgagtatatacacatatgtgttgctatttaggatgctactagggtgttgtaatccctggcagcttctttctcggttgtcgtcagatcgccatacagtgttctctcctaatgtgagcggagcagatgaataaatatcctgcgtgtggcaaatgttgttagcagttcaattagaccttcgatagtgcctttctttgcgtgattgctgcagtagggcagtgtgatttctcgttagtgtacgtaaactcaaagttgtcaaccacaaggcaacaacacactgactctagtggtttcagctctttaatctttatacatctcactggtcactaatgacaatcctttgggtacggcgacgaaggacctgtttgagcttatagattatggggcggtttgtttccttacgcgatcagcttgtttttgtactctctccgtcctaaaatataatttgtttaaaattaattacatattcattaagtaatatataaatatagtttaaatgtatgtctatattcattattattttaatgaatattaatagaaaaaaatgagctagaaagagctatattttacgacgatggagtttataattatacttcctccgtccaaaacaaattttgttttatcattttattttacctttttagttgattcatataaacataatatatttattatatatatatatatatatatatctagatttatcgtcattcatttaaaaatcgacataaaaatagaaagctaaaatgactaatattttaaaacgggggagtactatagatgtttgttttcataactattagtaggtaaaaagtcaaataataatctaaaataagcatctaatgacatgtttatggattatcataatctaggtacctaaattatataattcatttgaataatgtatattgtttgtttgtctcttaacttatttaagctcaattatataatttacaggac

SEQ ID NO: 2812 - DNA, 2430 bp, Zea mays
gaaaaaaccatttcttcagtcctgtaatgttgttccgattgcgtcaatgaaaaaactgtaatttttgaccggggagatggtagcactagcatgtggggattaaagttcctaaatgttcagtactgtcctaaacacttgttttatcttttttgagtggaagtccgacgtccgagaggggctcgccattgggcttggcatgggcacagtcatgctgctcctcttctgcggctactcgctggtgatttgatatggctctaagctgatcctggagatggtgtacaccggagccaaggtcacaacatgatctttgtagtcctcactggttctcttttctcaaattgaccatggtgttgtaaatttgatcaatgaagaagattcaagaattaccgttttactggattgccatgggatttcgccattcagatttccaatgcaaatgatgaggtcgtttatcactgtggttcaagaaaactacccgaatcgtcttggggtattgtttgtcatccgccttcctccagttgtcagagttattgcacagacatttcttcaaattgcaatatcacatggtatccgtggagatgaggacgacattgcctccaagtctgctccaccggcatccatcgacggtgcaagatccagcagatagattgatggcaaagaggacgactccatgtccaggcgtactccccgccttgcatcgagattgctaggtcataatcgaagggtttacagggaggagatctgaacatagctcttcaatcccaaagttaacatcgttggttaccataattcttactgcttgcaagcccttttagaatattactgctgcgaggttcttgcaagtccttgatgaagaagtcgaaggtgacgaacgccgaggccgtcatcctgatcgacgccaagaacctcacagcgcacctccttgtgatgctcttttctccaatgtcttctcttatctacatgcaggaaaaaatctacatgttgatggcgtggatcagaaaaatggtaagttttgcttcatagatgtattaatatttggaatctcaataaacccctcttgttttccgtctgctaacatattcgtatggaacccagcacaaaactcaacgagaataatgatgcaatgatacatacatgtccacagtccatacgttttttttgaagaaataacacttttctagatgagataattagcacatgtgcaattagccaattactgtcttgtgttatgtgagccattggatttgatttttatatcctagaaagtgattcatgttacacttgacctgagattcatggaaccaattggttgagctgcacattcaaattttatttgttttaatctaatgaataacaatttgttagcagtggaaggacaagatttaagatgcactgccatggttggcggtctatttactgcatctcgaagcggcttgcattcaaaggttctgcacctctaaatatttctggtcgtgaagctgtctatgaaaggaagatgaaaattcagcaagttggattgatttatctttcccccctatggctgattcagcaacctgtattaattagtctatttgacatttgatatttcaatgacgagaattcagctaggactatattgtacatgaccttgaaggagctgaccatgtgacagaccttgatcataaccatgttgcagagttgaagatattaggactatattaaacattgctgcatatagcatcagacttagaagtcaaacaacatcaaacttatcatcagaagttatatctgtgatccagcaacaacttggtttccgtcgctgcccaaacttcagcagaggcgatctaagaagaagcaagcgtatcggctcatgttctgacggccgtgttcacgtggtgtaagatctgcattgtggaatccttcgcccggacaagagagattggatcctcccgtccagacaacctgatagaacgacagtgtataagaacagggctcttaggacgccttttgtcaagttgggtcataactctaccctgagaattgagatagatgatcatgtggtgcaagatattgagtccctaatctttgatgacacacataacaaatggtaagcgtctccgtggatggagcctgaagtatattcaaattcaaggcatgccacaaagcatctcgcgtgtgggatgctccggcgtgtggaaagtagaaaagccaaataaatgggtacatgtacagcaggcgtgagttcttaaatactcagattccttgtccataggcaaatgcatagttcatacgaatcagagtacacgatgcacacaacttgatgtctctatcgttgttttcaacatgatgaacatgcgaatttcgtggtattaattgggaccgtctgatttctcatggatccaaaaaaaaaaaaaaaaaaaaaaaaaaaaaaaaaaaaaaaaaactccaaaa

SEQ ID NO: 2813 - DNA, 2581 bp, Zea mays
  misc_feature (371)..(371): n is a, c, g, or t
atgaggtcgagggcgactggcggcgtgagggtggcgtcgcgggtgagtggggcgacctccaagcgatttatagcgggcggagctaggggagcgggtggtcgttgccgagtttagtggcacagagtacgcggaggcggttgtgcgggcgacgacgcgacgtgcagctggcgtggaagtcggtggggaggggccgcagggcggggtggagcgcgtggggagatagacgacggtgaaaacggttccgtgcacgattctatctgaaaatgtgtattataatagtagatatagagatagagaaatatatttttggttcatttgtaaaacaggccaaggaacagatcatccgacacccgtacgtgattttttccctnctaccaaaacatccggtttttgggccggcccgaaaaatttcaaaggtctaaccgttgctgtattgccaatgatgaactgggctctgtctacgttcgcacgtcacgaccgcgacgaatccagctccgctccagcctcggagcatccatccagtaccctacgggtccggcggaacccactccagtgttcgtctggtatggtatggtcctctgggctaggccacgccgcagcgcccgcggacgaaccaccacgcccacgcgtagcacgagaagggacacgatcgcacacttttcctctgagccgcgacctgtctctgtctctgtctctgtctctgttcttctgccccgactccgcccacgcatctctttctcctcttcccccgcgcggcgccgcggagtgttcgtgttcctcacttctcccgcttgcgtccccgacactccctcagatccgcggccgtttcccgatccgaggggcattccagccctaaatagcgggagaagtgaggaacacgagctctctctctccgtatcctggagggagtttatcctggagccgtcttcctcctcgcctccttttgcggcgcggcgcggaggccggagtcgcttggaggcccagctgtgtttgggttgatttcttcgtttgtcggtaaggaaggacggctggatgctggatcactcgggatggcggattgttccacgagtgcgttttttttgtgtgtgcatgcttcgtgagatctcatcttagtgtataactgtatacgatgtgaccattcagcgatctaatctagatcagtcttgccgggatgtatagtggaatccctccatcattgcggttagctaagcatttgtttggtggatggtggctggtggctggcgggtttgtagtaatagctgttattttccaaatagattgggtctcaaccaactgaaaccccaccccctcgttaagtccgcctttctgtgtgctgagcgagtgaacaatgcgcacttcgtgtgaacctctaattcagcttatactaggacatcataattgctcggtttaggcctgaagacaccttttattacttgtttcttttggtggtcatcatgtatttaggtgtattcggtatgttcttccttggttgctaattcagctgttggtatgcattgtgcttattgctacacatttattatgctcctgttcatgattttctccgcagtggttagaggcacctggtttgtttttttgctgaagctggtggtacatgtgaatagcagggcctgtcttctgcctctgcttttgcttcgaagcaatggcgaatgcaagcaagcacttgcaaccttcaagtcaagcaggcaatgacaagaagtatcagggcacgctggttgcttcaccagcaaaggccatttcacctaagtgtgtgaaccgcattgtgccatcgaagcaactgatcttgggtgggggttcaataggccatgtggcatcatttctgatcaaggtcgttgcccttgaggcagtcagaagagtttctaaaacaagatgccctttcatatggaattctgttcaagcattgcagatccttgtgtatcctccatttagctggatccaaagatgggcaccgctcagatttctcgtgcagggaattcagaaactatccatgccactgttgtttctgtcagtcacaacaacagtaagtgagctgtcttccaagcatgatgatgaaccagataacaatacagaacattctgagacaccttctgaaacaaatgaattggcgtcaacttctggcacaagcgatgctgctgatggcacaaaggaaatcatgcaagagaactggcttgtgttacttttcagggagcttgagaagcaaggcatcactttgcctgagaggtttactgaagatgagttacgcagattttatgttgctgcaaatggtgactttcaaagtttactctcttcggttaagaagacaattcattggagggaaacttttcacatacttacattgcaagaacttgatagatggtctcacttagtcttttggcatgggtttgacacaatgcttcggccttgtttagtagttcgtcttggacttgcatgctctagcatacctcctcatgatagaccccgtttcgggcaagcagtaggtaatttctcaaactgttgtgtctgtaattttgtctatgttcgtgatgattattattctttatacaagggcagacctggtgcagtg

SEQ ID NO: 2814 - DNA, 1805 bp, Zea mays
  misc_feature (785)..(785): n is a, c, g, or t
cctcgaggccggccggggtcgttcctgtctgccctgagggctgcctgatttgctcggatctgcggtctgcctgcctgtgcgtacaacagacagggccagtgccgccggcagagtggtagacaacagactgccatgcgtgcctcacgttgtatccatggagatgaggacgacattgcctccaagtctgctccaccggcttatccatcgtcggagcagaagcaactggtgagctcactgagccctcaatggtaggtggccggacctggtggaccgaagatcctgagccgttctgcataccagcacatggtaaatgaagtgatttctagattgctctcatttcaggctttgctgaatatttcgttctccatggagttatggaggcatatccgttcttgctgttagttggtgcttattctcttctaaattccttaatcaactgcatcatgtttacaaattcattagtccctgattcttagtaaacaacgaacaaaccttctacagtaccacattgtttttgcagcgcccattgtgttgtgcaacaaccaaaatcaatccacagacatgctaattgtggtaaggacataagatttgaccaaatccaccagtccaaaaaagggggagaatctatctataaactggattagaaatatagggacacataatagctgaatattagatagagaaaacaatatcttgtgagctaatggtttcttaggatgagcatacatgtacactgaattcgttcaactggaacatcaaatggcctaagttaagcccaagcacgnaaacataaacgtgcagttcctcaagcattagaaagcagtaatgcaaacacctgctttgaagatatcacatgaaacacctttcatatgcattcatgtccaataatcagggaataagtaatctgttagcaaatgctaccagtagatcttcaaatttcttgctgaattctgcttcagtattagatgaatcccattcaaaattgtactcttgggcaatagccttcatgacttcagctttgatccatttgatggagcattcaccgagagcttttcgattatctgtatgaaagagatcttcacttttgtgagcaaacaattctgaattctgaaatagaaaaggcacatgttggagtttccacttactgtgcggttgacactgctgtcagggcgcaattccacagcgccaacaacaaactcctttccatacttggtggtaataaattacggagatgcattagctcaggcaagtctgaacatcttcctaatgcaaagattatactagcaattgcttcacgcagttctaaggggcattccctgctccatgataaaactaataggtgctgatcatattctgttaagtgaaaaaagaatcttgagccatggcttagaaaattgtaattcaatcacagttcataaagcagaacctacttttggacctcaacagtagggacttttgccaggacaaattcaccgaaaagctctaaaatctcgtaggcagccaatatattttgctccctaataatgtgctccagctatgattaataatgatattattagaaaatgttaagaagaaaaagggaaaaggccaaattacctgcccccaccccacgcacgcgtgggagggagtgtgcatctggtactatgtatcctttttattcatcaatctccatgcgactaaggaggtgaggttaatatgtcctttaataagatttgtcttcttgtttctcctcgtaagttcaaattctatagttggagaacatcaaaacttatcttacaaaaatacgttgaaagtttcatcattat

SEQ ID NO: 2815 - DNA, 7107 bp, Zea mays
  misc_feature (948)..(948): n is a, c, g, or t
  misc_feature (1001)..(1001): n is a, c, g, or t
  misc_feature (1252)..(1252): n is a, c, g, or t
  misc_feature (1648)..(1648): n is a, c, g, or t
  misc_feature (1651)..(1651): n is a, c, g, or t
  misc_feature (3272)..(3272): n is a, c, g, or t
  misc_feature (3441)..(3441): n is a, c, g, or t
tgactatatctccttatcggtcgaagcacaacgcgagcgtgcaacctatctatctagcatcgagaattagcgcattgcctactacgggaaagaccaactttaccaagtatcaaataatttgccgactattttctttcaaccattcgacaaaaaagttctttgtcaagtgccaaactaaaaaatacccggtaaaaaaaatactcggcaagaagcgttttctcgagtgttttatttttaatactcgacaaagattttatttgacgagtgttttttgtcattttcgtcatatgataaaataaaaaaatacatttattcacaaaacttgtatctctctcaaaacttatgttgaaacaattatgttggatgaacaatgaccaaacaaccaaaataaactttgtagatcttgaaaagttaaagaattttgtggttggtaactttttgatttaaagtcatcttatcaatgaaaagtacggttgtatttaaaatttttaaaatttgaattttccaaactacctcggataaaaccaacaaaatgaaagatgtaggttttgaaaagttatgaaaccttttaattgacaatttttaattcgaaataatcttatcatgcaaaactatgtttgaatttcaaattttgaatttttcaaacgatatcggatgaaaaaaaaccattaagattaaagttgtaggtatcgaaaagttataaaagtttgtgattgacaactgtttgatttgaaatcatctggtcataaaaatacgtttgaagtttttaaaattgaaattcaacttttgtaaacgatctcggataaataaactaccaaaataaaagtcgtagaacacaaaccgttgtgtaactttgtagttgacgactttttaatttaaatttatttagtacctaaaataattaatttacacttgatttgttataatacgtggacaagaaaaatatantgtagatataattaagcttatagtgtagtggtagagtacgcccgtgggagtgnaggtcgtggttcctaaacgcatcggtcacattttggaaaaacaattccgaaaaaaatgacataacaagtgagacacgcgagcggatggcacaattaattaaataaataaaaatctgttttattgtcgggctccatcaattaaataaaaaatatgttttattgtcaggctccattaattaaaaaaatacatgttttattgccgagtacttttctttgtcatttgtgtttctaacattcggtaaacgcttgcngagtgtccaataaaaaacacttggcaaagacttcttcatcgataatttgtttattgaatggtctttgtcgagtgtaatacttggcagagctttgctgagtgtaaaaaaacctttatcgagtgctcgagacacaaggcaagaaggcgagtccagtaatttatatactatcattatcgtgctttgtttttgcaggggcacacctttattaaaaaaagtcatataatatatttattactcattctgttctaattccagcacggactacatttattactcattttgttctaatttataactcgtttgattttttattctagatttaacgaactcgtgttaataaaaaatcataattattattatttttactatagtatcgtttattatatattttaagtntgncttcgaatttattattttttcaaaaaaacggttgaataagatcagtcgtgcaaatttggttaaaaaaggcaaacgaagtaattagaacgaagggagtatttatttggaaaaaaatacacacgtactaccaatgaacgagctagtttctgatttttgcgtgtgttagttcaatttaactagtcaaaccccccaaaattagtatttttttggaaggggtgggtgggggtggggccagaaggagcagtagctaaaagggttttcatttcgttctctcttttttttgacggcaccactaaagctaattaaatgcagatatttatccatcctgatactgtagcggcatatctccagctagcactagcaggagcagcacagtgacactgatcctggaatgacgccggagctgttgaggaagctacggctggatgccaagcagatgtcacacgtgattgatgagcatgcatatgcatatttgacaaagagtttatttgacaagtgttttttgtcattttcgtcatatgataaaataaaaaaaatacatttattcacaaaacttgtatctctctcaaaacttatatcttttgtagtttatgaaactacaagagagatgtataaaatttatgaacaatgttaaaacaattatgttgaatgaacaatgaccaaacaaccaaaataaactttgtagatcttgagaagctaaataattttgtagtatgtaactttttgatttaaagtcatcttatcaatgaaaagtacgtttgtatttaaaaattttaaaatttgaatttttcaaactacctcggataaaaccaacaaaatgaaagatgtaggttttgaaaagttatgaaaccttttagttgacaatttttaattcgaaataatcttatcatacaaaactatgtttgaatttcaaaatttggattttttaaacgacatcggatgaaaaaaaaccattaagatcaaagttgtaggtatcgaaaagttatgaaagtttgtgattgacaattgtttgatttgaaatcatcttgtcataaaaatacatttgaagtttttaaaattgaacttcaaattttgaaaacgatctcggataaataaactaccaaaacaaaagcgtagaactcaaaacgttgtgtaactttgtagttgacaacttttaatttgaatttatctagtacctaaaataatcaatttatacttgatttgttataatacgtggagaagaaaaatatagtgtaggtataattaagcttatagtgtagtggtagagtacgcccgtgggggtggaggtcgtggttcctaaacgcatcggtcacattttggaaaaacaattccgaaaaaaatgacataacaagtgagacacgcgagcggatggcacaattaattaaataaataaatatctgtttcattgtcgggctccatcaattaaataaaaatctgttttattatcaggctccatcaattaaaaaaatctgttttattgttgagtacttttctttgtcatttgtctttttggcattcggtaaaggcttgccgagtgtctaataaaaagcattcggcaaagaccctccaccgataatctgtttatcgagtggtctttgtcgagtacaatacttggcagagntttgctacgtgtaaaaaggcctttatcgagtgcgtgagacacaaggcaagaaggcgagtctggtagtttatatactatcattattgtgctttgttctaattcccgcacggactacacctattactcattttgttctaatttataactcgtttgatttattttatcctanatttaacgaacttgtgttattaaaaaataataattgttattaatttttactataatatcgtttattatatatattttttaagcatggctttgaatttattatttttcaaaaaacagttgaataagatcagtcgtacaaacttggtttaaaaagtcaaaagaagtataaattagaacgtagggagtatttattatttggaaaaaaacacacatactaccaatgaacgagctagtttctgatttttgcgtgagttagttcaatttaactagtcaaaccccccaaaattagtatttttttggaaggggtgggtggggtgggaccagaaggagcagtagctaaaagggttttcatttcgttctctctcttttttcacggcactaaagctaattaaatgcagatatttatccatcctgatactgtagcggcatatctccagctagcactagcaggagcagcacagtgacactgatatcctggaatgacgccggagctgttgaggaagctacggctggatgccaagcagatgtcacacgagattgatgagcatgcatatgcatatgtgctagctggcagcatgccatgccgcacgagcggcggcggccggccggccagtcatcacctctgccgctgcaacgacctcctccgatcgatccggccgcggcccttccgtccctgatgacgcggtggcgccgccacacccgctgccgagtcatgccggacgtgaggaataacgaatcggacgacagcccagcaggccagcaataccgcttctgcccccggaatgcccagcctgccacgtcacgcgggcgctagaggacaaggcacgcgcgcgcgcgaacatgatataaagtggcccgccccccttcgtctccgagaggttcagttcagcagccagtcagtcagtcctcgatctgatatcctctcctccctgcagcgactccagctccgatcgattccattccatccatcgagctgcagcaggtggtctagctccgaactcgatccaccgtacacatccatcgtcggattcttaattaattagttaggccgtccattgacgattgttgattgctccatccatccatcagggccatgacgatggcagctacgacgacgatgatgtcagcagcagcgcaggcggcgacgtcgcagctgccgccggggttccggttccacccgacggacgaggagctcatcctgcactacctccgcaaccgcgccgcgtcggcgccgtgccccgtgcccatcatcgccgacgtcgacatctacaagttcgacccatgggacctgccgggtatacaaataataatctaaataagctgtcgtgcatgaacagggacgtagcagatactagttaattaatagctttatcgttgttcatggcagccaaggcgctgtacggcgacggcgagtactacttcttcagcccgcgggaccgcaagtaccccaacggcatccgccccaaccgcgccgccggctccggctactggaaggccaccggcaccgacaagcccatccacgacgccgccaccggcgagggcgtcggcgtcaagaaggcgctcgtcttctacaagggccgcccgcccaggggctccaagaccaactggatcatgcacgagtaccgcctcgccgccgtcgccggctgcaccagccccctcgccgcctaccgcccgccctccaagttcaggaacgtctccatgagggtaagtcaatcgacctcgatcatccctgaatcatatccattgcatgacctgtacatatgttcttcccattatctatcctatccatggtgtcatgttgagctgagctggtggtcacacgcatgcacgggccgctttcatctgattcgttcgtaacgaccgcaacaatattcgtgggtcacgccggtcgcatgcacgccacgcccgcccggcggtgtgcagtgtgcggcggcatgtcgctcgtcgtgcaccgccagccgccgttggtttggctgcttttccagatcgatgaccaaactgccctcaccggccgaattcgtcgttctccaaaagcgccgtagctagagctaggcagctagccatgcatcaatcagccgccaaaccagcagcgcgtcacatctaccggcactagctcgcatcgcctcgcatctcatcgccgtgaaggtgaatggcagcttgccggcgcacgcaaaggaaaagacgcatgcattatacattcacacgactgctctgctggccatggtggctctatagctggctgtacgcgttgacagcgacggccatgacggtgacgaccacgataacgtttccttgtttgcatgcccttgctggtgtcgccggggcgtgcagctggacgactgggtgctgtgccggatctacaagaagtccggccacgcgtcgccgatggtgccgccgctcgccgactacgagcacctcgaccgcgacggaccttctcccggcggcttcttcgacgactacttctgcggcagcaccagcttgtacgccgccgccgcgccggccatcggcggcggtgctgctgctgctggtactacaaacactactacgacgccggccgtcgtcatgcagcagcaccagcagccggcggcgctgccgaggctccccaagatcccctccatctccgagctgctgtgggacgagtacgcgctcgcgcagatcttggaccccccggccgacgtggccgccgaccacgcctcgttcgccgtgcacccgtccctcaaccagctcctggccgtcggcgacgacggctccgatctcatgatgttctcgccgcccccggccgccgcagcaggcgggaagcgcaaggcgatggtggcgatgaacatgagcccagctgacgagtgcgccgccactgcccaccagcaccagtctccggcggccaagcggctcaacggtggctcctgcttcgacgacgcgccgcagccggccagcggcttgccggcgacgatgtcgtccgtgcttggcggcggcctcaaccaccacatgctcccacagttctagatagacgacttctggtagctgactttgttgggggcacatcttccgtgcatgtactgcgtcatcaactgatcaatatggtggatcgtctacgcggaatagctagcaacctgcggcgacatggaaagcaaggatcgagctcgtggattggaggccattaataaagatgggtcgtgcggtgaagaacaattgtagcagtacgtagcactatttgtactggagccagtgttgatcaacgttaggcgtaaccatggtatgtatcccatttttttccctccgttgtagagtacaggtactctatattcatttcaggcgcagtgcgaaggtagctggagcttgatgggtccatgtactactacactagtactcttatttattattcaatatgaagtatatattatattgtcttgctagataaaaaaaaaaaaaaaacagcggccttttaattccagatatatagacagattattaagtatccggcttgtgaagaactaactgaagaccaaataagagtataaatgaagcttatatatacagttgatgaagtcgtacgtgtgtatatgtctaaaccgggccacgcccgtcatgcagcccacggcccggcacgacacgtaggtagtcgtgcccgtgctggccaggcccggtgtgcgtgccatgcttggcctagcgg

SEQ ID NO: 2816 - DNA, 1835 bp, Zea mays
acacacctggcaacctccctagacctggagcgcacgagagagagatagaagagagacggaccgacgaccgacggcgatctcgatcggtaggcagccgttgcttcttcttgcttggcgggcggggcggccaccatagccctctgtagctcttgccggctttccttgtgctccttggaatctcgccctgcatatcttgtactacagtagctagctcctctgctactgtagagctacaggcaagagggaagcaggcagcgaccgagctctagctgccggctgtgcgactgcgagctagagagagagagagagggtgcgggcgacggacggaacggaacagaggagcctagtacttgttgtccgctgtctttcgtccgtgcgactggaccttattccctcacacctgcagctttgaggctcggccgtcacgtagtagtacgtgtacgtttcagggagggagccttctgacctcttgttcccttgccgccttttggtcacctcgggcaccgcgaggcgcagaacctgtgcttccttccgtcgtcttcctgcctcctcttctgttcaccgctctggcgctctcctatactcttctctctctctcgctgaggcaggcgggggcagcctttcctccccggtcgccatcctcgtttatatacacacaccctctcttgccgaaccactgctcgcttctctgcctgcttctgcttgagtcgtgccagtgacccgtgaccgtgaccgcgagcttcagggacgcgggcggcggcgatcatggcgtggcgcggcccgctcggagccggagaggaggccctggacagcggcctcgagctcagcctcggcctcccggcatacttcgcccggccttcaggtttggacgccgccagggaggagcccgccgaggcctctgtctacgctatccaggccgccagtgggagcaatgtctccaaggcaagggtcaggccagcgggcgcggcgccggtggtggggtggccgccggtgcggtcgttccggaggaacctggccgcctcctcctccaggccgtcgtcggggaaacacacccgccaggagggcagcgccaaggacggcctgttcgtgaagatcaacatggacggcgtgccgatcgggcgcaaggtggacctcacggcgtacggcggctacgccgacctctccgccgccgtcggcaagctcttccgcggcctgcttgccgctcagagggaccgagcggccacggcgggtggcgaggaggaggaggagggggagggccccgtgatcggcggcgactacacgctggtgtacgaggacgacgagggcgacagggtccttgccggcgacgtcccctgggagatgttcgtggccaccgccaagaggctgcgcgtgctcaagagctccgacgtgccggcctcgtcggtgacgctgggagctgggggcccggagaggtctgcagccgactgctgctgctgaaacgtgctctgcttcgtcagctgcttgtaaaaagtcccgagtggaggagacgaggagtggccctatccctggcctcttttttgtgtgttgctcttgctgcctttctgctagtggtactagtattgggtgccagtaaaaagtaggagaacaaagtcatgacggtattaaggatgtaatgtgcaagattagcagtggtagtagtcgtaaggtgtttaatgaatctacggtctctgttttggggcatattcgaccgtttaaagctgtatgcacgcgtcgaatttcggtgtggtttctgcatgccggccttaatgtttttcagcttttgtttgcacacgaacgctttagagcaagtttaataatagttggctctaactaaaaaa

SEQ ID NO: 2817 - DNA, 2550 bp, Zea mays
agaggtctatttcttccttgatggttgacactccaagcgtagtaaagcagactggtttgactggaaagagaaccaaagctaaaagaagggcagcagcttctcttgcaacttctcccgttaataatggaactatgaaattaccaagtaaatctgaaaatggggatcagaagactgataaaagctgtccatcacaatctaccaaggcggcaacaagtgcaaacaaaactgaaaatcaagaccaaaagaagaccaagaaaatttcggcaaaacagtcgaccagagcagcaacaccagcaaagaaaaaacaggtaaatgtgaagaaccatctgacgtttgtaacatcacaatttgatgtcaaagttctgtatggattctcttgtaaaaatggcttgttctcacaccattatgctgcaaaacagcgaaatacagatgcacaagtttcaagtaagccatcttccgaaaaaagaaagaacagcaagacagctgacaaagatgggctccgtaaatcttcaaaagtacctaggtcaactcccaaaatccatgccgtcaatgaagagcaaataaaagagaaagagggtgaaccccctacaaggaaaggagaagcagacaacaaagtggttattcctgggacaagtgtgagagaacattcaaataactcaaatcttaaagagaaaaatgatggcacttctccagaaccttcgccattaaaagataaaacagcaacagaagattcataccgaggatcgctgggtagtgcaaaaggtttgcatggtccagtaactactccggtgtggttctcattaatttctttgcctaaccagtaagtattcatagtgaactgttgctttcttaaaatctgaggaaactctttaaaaaaaatactccctccattataatcttatgtcattttctgagttttaagtcacatgcaaactggttttcaggaaagaagatccacaactgcctcagttaccaaagacttacatgagaatcaagtgagttccatttagtcctgtaatttattttgactcttgccatgctcggaagctcttgtgcatagtttagagttgtccaattctttgcccgattagtctgctccaggctgctcaacgtagtgtgatgctcataatatttcctctcagacttacatgactgtagtaatgttacaatcccggcatctcctgattagttcgagctctggtattttgttcagcgtaccatgatgttttttttctcgaacgacgcaggagagctgcgtgttcagcgtaccatgatgtacatatcttaggaacttctttgggccattccaacttgttttctgcattggaaattatttttctcggtactagcatgtgttctgttccctgacatttaattcctttctccggtttacgttttgtcattgtttcagagacggcagtttgcagatttcctcgatacagaggtacatcatgaagaaactggatctagctaatgaaaatgaggtgatttactcagatgttggtacacttccattttttttgacaatatgacacttccatttttgttattaataaaaaaaaactgagctggccacttgttgacttgttttagagtaccggatctgacatagacaatttgacagcagccatgcaaatgtgaaagaccactagcaatacatttagttagtttcagagttagccctgctgtggatagagccacaagattcgcatggcgaatcatgttctcctgtccgctggaaattagccttttttgtcacctatttcacattccttctgcgtatcaacttcagttggaaatctcctagagaaaagctcctgtaaccatggactgatgacatccatatacttgaacgccttagtatctttctgttcttcttcgcactaatgctttgagttcgtgcacagtgagaaggcgctaataattctgctgtagatggcaggtattctgattgattccatccttttttttgtttctgatctctgttcctctccaatccaactgcaggtggagatcatctgccatggcgaaccgatctgcccctcgagcacgctgcgtgggctgatggagctgtggcatcgtagacagccgacggagccccgtggaggcgtcggtgggtgcgccagccgaggagttcgtcatggtgctgggctaccgctgccaccgccggcacccttatttggcgcccggcaccaccgtcgccgtgcctccagagctgccctcctgatcaggtcggcaaggttgactgcaccgccgtggagcctcaactgcactgcactgctccgctcgctgtcgtccaatccccagtcagtctagccgtttaggatggaacagaggaaagaaattactcctacagttttttttacacatttcttagactttcttttggatcgtactcgtttcttaaacttttgtaaagatagatagagagggaggagagaagttagtgtaccagaagtctgtggcaaatgattaagcaccttaaaccatcgtgtttactctaacgatatttctgggggggggggggggggggggctacatcctcaccta

SEQ ID NO: 2818 - DNA, 2618 bp, Zea mays
gaaaaatgatggcacttctccagaaccttcgccattaaaagataaaacagcaacagaagattcataccgaggatcgctgggtagtgcaaaaggccggccgggtccagtaactactccggtgtggttctcgttaatttctttgcctaaccagaaagaagatccacaactgcctcagttatcaaagagttacatgagaatcaaagaccgcagtttgcagatttcttctgtacagaggtacatcatgaagaagctggatctagctaatgaactccaggtggagatcatctgccacggcgagccaatctgcccctcgagcacgctgcatgggctgatggaactgtggcatcgtagacagccggcagagcccgtggaggcattggtgggtgcgccagccaaggagttcgtcatagagctgggcttccgtcgccgccgccacccttatttggcgcccggcaccgtcgcggtgcctccggagccctcctgatcagcttgcaagggtggctccgctccgctgtggagcctgagctgcactcttccgtccgtcgtccgctcttgtcctcggtcctccatccccaaccagtttagccgtgtatgataaaacagttttcttttactcatttcagacttttcttttactcattttatgtatacaagcgaggcggcttttgttctgccttttccttgtgccaagctttgccgccgcagcggtgttgactttgaccatctgttgttgaagcccggataccataagcgtactagttagctaccaaaaccagcttttagtggatttaaacacctcagttaaccaagtttttagtgatgccgtcgcagctgagatttgctgggttagatgttagcctatgaaacaactgttgccctgacgacaagctgttcgtttgtgcaggatagagaaattcagcaaaaccaggacaatagtacgtacgtattgctgctagtagatcgaaatatcagagcgttgatgcattagaggctatagtatagagagatgatcagccagtattgaatcagccttttgcctgtaaaactgtttacaaaaagtgaatagcatttgaaaatggaatcccaccaccctttcgcctctggaattatgcagaaggaacgaactcggagatttgacttgtaattgctgctcagaaatagataaccgtcacagcaagcaaaatgtccgatgacacaactaactgctacagtacataagaacgaataacagcatgacgaataactgcacagaactacagacgagaacacaagtttaccagtgaggccatgacatgatacttcatagagatacagtgaaggtccaaggtgctggacatgcactgcagggtagtagaaggacggatctatgcaagtcagatcttgaagcatcgaaaccagtatgtgcgcgatatcgctgttttcttttagaacaaatatagatctttacacacccacaaccaataccagacatcatcgtgatggttaattacaaggaaaattgctactgtctgcaagcaataacatcaagattgatgaatgacaccgcccagctgcgcgaatcaatcaaacgatgcggacataggtgggcaagatgggcccggcggccaccagcccgtccccggcggcctcctgctccgtgaggaagaggtcgtcggtggtcctgagcgcggcgtgcgcgccgaccagcgcgcccccgaccatgacggatcccacgacgttccagccgacgctggtgaagagcaaggcgacgacggtgaccccgcagagcgcggcgagcacggtcccgtcgtcgaactccgtccccaggaccctgagcggctggttcccccgcgcgaagtagaggaagaaccaggcggcgcagaggaggacgagcgcgagcagcgtgccggggtgccagagcagcgaggccgccacggcggcgagcacggccagcgcgtagttggcgcggaagtaggcggcgttgcggcgcgtccgggcgagcgcctccccgagcgacggtggcctggagaaggccgccgcgcggaagacctcggcccagggccggcgcgccgcgatcagcgcctggccctgctcgcggagccgcgcgacgagctcgcccgccttggccagcggggacggcggcgccgtggggtcctggaccggggcgttggtggagacctgcggcgtgggagggttggtggcggggtacgccgacgggggcgcggggtaggtcgggatcctggcgtagccggcgctgcccccggaggaggccggcgccgggtaggtgtatccgccgccgacgggggtggaagaggccggcgccacgtaagcggggcctgagccggacatggcgggggcggaggagggagtagagggctgggcggcggtggagttgcgcatgattgcggccttgcggggagatcggatttgaaggagggaggagaagttggggaaaggtcggggagggaagaagaataggacgcgtccacgcacccctccctggctccggctgccgtcattcctctccttggctttacgaaacgggccacgtccacgacccgcccgtcgctgggcgggctctatttgtggggaggaaactggttttgcttcgtggcaaagcaccccggacgcgtgggcgc

SEQ ID NO: 2819 - DNA, 1407 bp, Zea mays
ctcaacaccggcctacgaaaacgctggcgtaatcacttttaaaaaacatctaatagccaccaaaaacaattgtaaagttaagctcgctcagtagacaacattgccaccccatagcatcccacccgtccatctgccatccaacgctcgacctcagcgccgacaccacccaccccgccacacaagcgccgacagccgcagaggatcccgcggccgcacctaatccactccgcctcgccgcgccatgcccatccggccgcaccacggggcccaccccgagcgcagggcagggcagggcagaggtcgcttaaaacccaagcaatctaactaaccacgagggattattcattttccgaccaaaaaacgaaaaaggcaaatccaaagacggagaagaagaagagtcgcgaaggaatggggaagggcaaggtgcatccctcgccgccgccagctgccgcggccgcggccgcgggcggcggagccggggagacgacggcggaggcggtgctgatgcggctgatgccggcggcggtgctcgcggccgcggcgccgctcggggccgaggggaaggaggtgctggcgtacctggtgctggcgtcgctgcggtcctcggccccgccgacgccggcgcgcggggacgggcaccgcccggagctcgggtgcggctgcttcgggtgctacacggcctactggtcccgctgggacgggtcccccgagggcgaccgcgaggccatccaccgcgccatcgaggcgttcgaggagcacctggcggaggaggagaagggccgcgggaagggaggcgggccccgccgcgggcggaagaagcgcgccgagggcaaggggaggtggaaggtgaagaaggaaaaggaggtggaggtcggcgtcgatccactcccgcccccgtccgatctccccgccccggaggaggcccccaaggcggaggacggcgcggagtacctgacggcggaggacgagaaggaggaggacgctccgaccgcggccgccggcgccgaggatgagaagcggcggcgctggtggggctccgtgctgagctggaaggcgtggggcctctgggggtcccactagtcaggtccctcccctcgctacgcttcgccctgttcaattagttaggtttggtgctttctttgcttgctgctatcgctggggtttagctgctgctgctgctgctgcaggtggattagttggtgatggttagtactcctacgctatttggcagtctggatggggatgttgtgttttagtatctgttggtgcggtgtgtcacgtgttaggctcttctcttgtgtactgtacatacacgcaggcatggagtgtgtggtttggttggtgtaaattatcattgtaatgtactcctctcctactaatgtaaatgcggcagtagttgtgataacc

SEQ ID NO: 2820 - DNA, 483 bp, Zea mays
agggattattcattttccgacaaaaaaacgaaaaaggcaaaaccaaagacggagaagaagaagaagagtcgcgaaggaatggggaagggtaaggtgcatccctcgccgccgccagctgccgcggccgcggccgcgggcagcggagccggggagacgacggcggaggcggtgctgatgcggctgctgccggcggcggtgctcgcggccgcggcgccgctcggggccgaggggaaggaggtgctggcgtacctggtgctggcgtcgcttcggtcctcggccccgccgacgccgacgccgaccccggcgcgcggggacgggcaccgcccggagctcgggtgcggctgcttcgggtgctacacggcctactggtcccgctgggacgggtcccccgagggcgaccgcgaggccatccaccgcgccatcgaggcgttcgaggagcacctggcggaggaggagaagggccgcgggaagggaggcgggccc

SEQ ID NO: 2821 - DNA, 1270 bp, Zea mays
catggggaccctcgaggccggccgcctcgcgtgacctcgcaaatcaaaccgggaccgggtggcctcttgccctcttccgttccgtctcattctcatccccgacccccgcaccgcagcgtaaaccctagtccccggcggcgaccttgcggcctccgctgcgctctgactggtgcgcgtttagacgaggagctgcggcggccaagaccaatcgaccatggctacccgtatccagtttgagaacaactgtgaaattggtgttttctccaagctgacaaatgcttactgtctggtagcgattggagggtcagagaacttctacagtgcctttgaggctgagcttgcagatgccatccctgtggtcaagacctctattggtggcactagaataataggccgactttgtgttggaaacaagaatggacttctattgccacatactacaaccgaccaagagcttcagcatctgaggaattgcttgcctgatcaagtggtggttcagcgcattgatgagaggttatctgcccttggcaattgcatagcctgcaatgaccatgttgcacttacgcaccctgaccttgacaaggagactgaggagttcattgcagatgtgcttggggtcgaggtgtttaggcagactattgctggaaatatccttgtggggagttactgcgccttctctaacaggggtggtttggttcatccccatacatccgttgaagaccttgacgagctctccacgctcctccaagttcctcttgtcgcaggaactgtgaacagaggaagcgaggtcattgctgcaggcatgacagtgaacgactggactgccttttgtggctcggacacgacagccaccgagctctcagtcatcgaaagcgtcttcaagctgagagaagggcagcccactgcgattgtggaggacatgaggaagtctctgatagacagttacgtgtaactggggggccagcagatgtgggtcagagtttgcctttgctaaaagatgtattgcaagctatagtcgaattatcagtagcacaacataaccctctgatatgttcgtggtttatccgtggtttctgaattgtagacttctgcgttgaagctcgtgctactgtttgttttccattgtttgttaaaaccctccccccatctgctttatgcagatacatggcttctcagtgttacgccggcagacgaataagcttggggaataaaagaatgttatcttgaaaaaaaaaaaaaaaaaaactcgagactagttctctcctcgtgc

SEQ ID NO: 2822 - DNA, 1260 bp, Zea mays
cctcgaggccggccgggccgttccgtctcattctcatccccgacccccgcaccgcggcgccggcccggggccccggcggcgaccttgcggcctccgctgcgctctgactggtgcgcgcttagacgaggagctgcggcggccaagaccaatcgaccatggctacccgtatccagtttgagaacaactgtgaaattggtgttttctccaagctgacaaatgcttactgtctggtagcgattggagggtcagagaacttctacagtgcctttgaggctgagcttgcagatgccatccctgtggtcaagacctctattggtggcactagaataataggccgactttgtgttggttaatatctgaaatttggttttgctatttggcttattctctacttgttttcaccttccttttcactttgtttgcccaggaaacaagaatggacttctattgccacatactacaaccgaccaagagcttcagcatctgaggaattgcttgcctgatcaagtggtggttcagcgcattgatgagaggttatctgcccttggcaattgcatagcctgcaatgaccatgttgcacttacgcaccctgaccttgacaaggagactgaggagttcattgcagatgtgcttggggtcgaggtgtttaggcagactattgctggaaatatccttgtggggagttactgcgccttctctaacaggggtggtttggttcatccccatacatccgttgaagaccttgacgagctctccacgctcctccaagttcctcttgtcgcaggaactgtgaacagaggaagcgaggtcattgctgcaggcatgacagtgaacgactggactgccttttgtggctcggacacgacagccaccgagctctcagtcatcgaaagcgtcttcaagctgagagaagggcagcccactgcgattgtggaggacatgaggaagtctctgatagacagttacgtgtaactggggggccagcagatgtgggtcagagtttgcctttgctaaaagatgtattgcaagctatagtcgaattatcagtagcacaacataaccctctgatatgttcgtggtttatccgtggtttctgaattgtagacttctgcgttgaagctcgtgctactgtttgttttccattgtttgttcacaccaacagctatatgcagatacatggcttctcagtgttacgccggcagatgaataagcttggggaaaaaaaggatgttatcttgaaaaaaaaaaaaaaaaaaaaaa

SEQ ID NO: 2823 - DNA, 1239 bp, Zea mays
gggtacctcgaggccggccgggccgttccttctcattctcatccccgacccccgcaccgcagcgtaaaccctagtccccggcggcgaccttgcggcctccgctgccccccggctgcgtgcgtcggttaggttcttgggaggtgggggtgtctcggggattcgtcgtggcgtgcaccggcgtctgcccccacccgcgcctagccgcgaaggtgcgcgtttagacgaggagctgcggcggccaagaccaatcgaccatggctacccgtatccagtttgagaacaactgtgaaattggtgttttctccaagctgacaaatgcttactgtctggtagcgattggagggtcagagaacttctacagtgcctttgaggctgagcttgcagatgccatccctgtggtcaagacctctattggtggcactagaataataggccgactttgtgttggaaacaagaatggacttctattgccacatactacaaccgaccaagagcttcagcatctgaggaattgcttgcctgatcaagtggtggttcagcgcattgatgagaggttatctgcccttggcaattgcatagcctgcaatgaccatgttgcacttacgcaccctgaccttgacaaggagactgaggagttcattgcagatgtgcttggggtcgaggtgtttaggcagactattgctggaaatatccttgtggggagttactgcgccttctctaacaggggtggtttggttcatccccatacatccgttgaagaccttgacgagctctccacgctcctccaagttcctcttgtcgcaggaactgtgaacagaggaagcgaggtcattgctgcaggcatgacagtgaacgactggactgccttttgtggctcggacacgacagccaccgagctctcagtcatcgaaagcgtcttcaagctgagagaagggcagcccactgcgattgtggaggacatgaggaagtctctgatagacagttacgtgtaactggggggccagcagatgtgggtcagagtttgcctttgctaaaagatgtattgcaagctatagtcgaattatcagtagcacaacataaccctctgatatgttcgtggtttatccgtggtttctgaattgtagacttctgcgttgaagctcgtgctactgtttgttttccattgtttgttcacaccaacagctatatgcagatacatggcttctcagtaacaaaaaaaaggaaaaaaaaaaaaaaaaa

SEQ ID NO: 2824 - DNA, 2343 bp, Zea mays
tggtaagacactcaactacacctacatatgtaacatatccaaatggcaccccgaaaagcctatctgcagaaatggcagaacatgccggtccagaagactttgcagtagagagtgagagttcatatgccactgaggacgatgaattcaacaatgtgactggacttgattctcctgttaccagagtttgggaaagcaaaagtaaaggaaatgctaccttatcacatatacatcacccactcgaatctcctggtttccatagagcaaagaagaacagaagtcatgtgggaaaactgaagatgtcaagaacttcttcaggaagaaaaaggtcaaggtcaaatgctcagaagcctcctatctggcaagaagtggagagatcctctttctctgttggtgatagtatggacatactaaatacatctgcaaatgatctaaagacgcatgagctagacgaggatcctgaggtggaaagtatggctaggatgtttagtagttcaaatacttcatctttattgttgccatcaagtgactctgcatattcttcaaattattgtggtgccaatgtgctacaagactcttatttgaagttaagatgcgaggtggtaggcgctagcattgtcaaaagcgggtctggcatgtttgctgtgtattctatttccgtgaccgacgccaatggtaatagttggtccattaagaggaggtttcgtcattttgaagacctgcatcggcgtctaaaagagtatgctcagtacaatcttcatttacctccaaaacatttcctctcatcaggtttagaggtttctgttgttcgagagagatgcaagctgctcgacatatatctgaagaaccttctgcaaattcctattgtttcaagctgcatagaagtctgggattttctgagtgtggattcacagacatatattttcacggacactctctcagtcatccaaacattgtcagtcagtttagatgaaagatcaaatgggaaaaatataaaagcattgaactcttctggagctttgaatggaaccggccgggattctatctctggaggtcaatctttgcatggacatatagacgacaccgtacataaggattcagacatcgcttgtgatggtttgagatttaggaaagggaatgtgaacaagaacttgggaaacggtgttagccacacaacagatagtgttagcaacacaactgccaatcattatcaggacaattctggaagtgatccagagcagaatgatcattccttttcaatagattcattaaatcctaagaagttgcgttcaactgaaaccaatgacacatctcaaattccagagtctggaggattttcagtatctcctaatgattggatggccccgaatcttagtgttcccttgtttcatcttgttgatgtggtctttcagctccaagatggaggctggataaggcgtcaagcattttgggtagcaaagcaaatactgcaattgggaatgggagacacgtttgatgactggcttgttgacaaaatccaattacttaggaaagggaggataattgcttttgctgttaagcgcattgaacaaattctctggcctgatggaattttcatgacaaaacatccaaagagaaattcgcctccacctcctcctggtgctcagagcaatggcatgggaaactatctaagcgatgaacaacggatagaagctgctcatcgtgcaaattttgtccgtgaactgataatagataaagccccatctccactagtgagtcttgttggtcgaaaggattatgaaagatgtgctcatgatatctatttctttcttcagtccccggtttgtttgaagcagttagcgttcgaactccttgagctgcttgttctttcttcatttccggagttggatggcactgtgaggaagtggcacgaagataaagagcaattctgcgcccagtaatgtttatcaaacgtttgaatttgtcacggggcggtgtttgtttccaacacatatcgtctttccagagtggtgtggcctgtgaattctgcgaaaataaggtggtggcttcagaggagtgcccgtggatatctcagtttgaagtgggtggtggctttgtgcagtgtgaatatggttagatagtgcgaggatatggtccctttttccaccgggccatggcagaacggtttttgtgcccgatagagttcatttttccccctccagatttggtatacgtaatgctgctgcctgaaaggaaagagatggtggcgcatttttttttcccggcacccgttttggtggtacactggtacccgtcttgtgtaaatctgcatagagataaatgaagtttcgaggtggtcaatgaatg

SEQ ID NO: 2825 - DNA, 1945 bp, Zea mays
tattccttaaatttaatattagggtctcctgtaaaaaattcttaaataattctaaacctgcggtaggctgctaataaattaatcctaaattccttcagccatgcgtaagcagcgtgtgagacaaaaaaaaaatagttggaaacaattggatggacgtgtgctgagacatggaaatttgagggagaaaatgctatgtattcggggcgccaagataatggaggataaaaaggagagctgttgaagggctcattttgcattttttccaacaatttttttacggtttgctttaggggttttagggtttagggttttttaacatgtggcaggcgctaataaaatcagaagataaagtggcaggcgcatgcggcatggtatattggtatcgggcctccctcctgccgtagcccgcagccacccagagcctcttatcggcgttcccttccttctactccgatcccctctccaagcggcacatctacatccttccagcgcaccaaatgctttggattgcgttgcttagcactaaagactagatgcccttatgcgattatatatgctcaaaagcctgtggtgatagctcaagccacatgaatgtattagatcaggtgaaagggcaagagtttcgatcagtgggcaggccgcaggcgcaaacaaacagttgacagggtagactcaaggcaatagtgaggaagtggccgatctgttgaggccgatggaggcagataacatggtggccatgggctgcggaggtttctactggcagtcgcctccgcgcttcctccttgaacccctcgacctagccgacatcgtcgacagcagcatgtacgtgccgacgaacgaggctgatgagcccgtatccgggctctgctcatcgaaccggccggcggaggattactccagttcggccgagggcgccaactcctgctccgcggcggtggttccgtcgccgccgccgcctctgggcgtgacgacgacgacgacgaggaacatggccatggagaggacccgccgcaggaagctcaacgagaggctctacgcgctccggagcgtcgtgcccaacatcaccaagatggacaaggcgtccatagtcagggacgccatcgcccacatcgagcatctgcaggagcaggagcgccggctgctcgccgagatatccgtcctccagtcctctgacgacggcgccgccgccgccgcctccgtcaagacggaggacgctgccgccactggaggtgccgcgtacgacgtcgacagcgtcccctggaggaagaagccgagggcggtgccactgccgtccgtgtatttcaccgacaacctgacgagctccatctcgtcatctccgccagtccgaatcctggaggttcaggtctcgcaggcaggggagagggtggcggtggtgagcctctggtgcagcaggggcaggaacgccgtgggcaagatttgcctcgcactggagccgctgcgcctccgggtcgtcacggccaccatcgccgccagcggcgacactgtcttccacacactgttcgtggagacaggagaaacgggtggtgctcggctaaaggaggcgatactggctgctctcgctcggttcaacgtcctcgctaacgctgaccaagtcgtccatgagttactgggatgattgatgcggtggcatctcggacagcaacacctggtgttgttgtcgttgtcaccactctcgactgtccgattcaataatgatgtacctagggctgacaataggcctcaaattttacactataaaacttaaggattaaatcggattaggatcggctttgtttctattcatttttgaactacaaattatttagggccttaacaaatggtgaagaggcatttggatcgtgatccattaccacccctagatgtacctcaggaatgtttgaatatgatgtcattgccatttcttggcctaaaaaaaaaaaaaaaa

SEQ ID NO: 2826 - DNA, 869 bp, Zea mays
gggccgacccgacatgggctacttattcttcgcccgcagcatcgtggccggcgagcccgtcacgctgttccgcgccgccgacggctccgacgcgcgccgcgacttcacctacatcgacgacgtcgtcaagggctgcctcggcgcgctcgacaccgccggcaagagcaccggctccaggtccggcagaaaaagcgggcccgcgccgctccgcgtctacaacctcggcaaacacctcccccgtgcccgtcacccggatggtggccatcctcgagaagctgctcggcaggaaggccaacaagcgcgtcgtcaccatgccaagcaacggcgacgtgcctttcacccacgccaacgtcagccacgccgcgcacgacttcggctaccgccccaccacctccctcgaggccggcctccgccacttcgtcgactggttcgtcagctactacaagctcgacgccaagatcgccaagcccgccgccgccgccgacgacgacaagcccgcgaaaaagaagaagaagaacaaagccatgtcggcgtcgtcgtgatcgtacgttcatcgatcaagcacgggcacacagaaacagagcaccgccaccgccaagcacagtcaccaagtgtgtattctctagctagttctcggaggcctttttggttttttgtctgtaaccatgtattgttgaagccgtcgctacatacttgctcctcctccttatgctgatagtgcttagtaggaaggaaggaataatgatgcaaataattgttgcattcatattggtacgtagatatatatatatataaaagattgggagaggtatagatgacggcaagatcaaacagaggaggagtgaggacagattgaagaaagatcagtc

SEQ ID NO: 2827 - DNA, 1328 bp, Zea mays
  misc_feature (1129)..(1129): n is a, c, g, or t
cgaaaaatataataagcagagagggtatgcgctggtggtggtggcgactggcgacggccgcgatcgaccatggctacgacggcgccgctcgttctcctcttccccctcgtgctgctgctgcaggcgaggtggtcgtcgcagcagcagcagcagcaggctgtgacggcggtgatcgtgttcggcgactccatcgtggacccggggaacaacaatggtttgcacacgctgatcaaggccaaccatccgccctacggcatggacatgttgaaccacgaggccaccggacgctactccaacggcctcataccaacagacctcattgcccagcagctcggcgtcaagcagctgcttccgccctacctgggcgtggacctgagccccgatgaccttctcaccggcgtcagcttcgcgtccggcgccaccggattcgacccgctcacgcccgtcgtggtcagcgtcatctcgctggaccagcagctcgcctacttcgacgggtaccgggggaggctggtggacatcgccggcgaggccgagacggcgcggatcatcgacggcgcgctgttcctggtgtgcgccggcaccgacgacgtggccaacacctacttcaccacgccgttccgcagcgccgagtacgacatcccgggctacgtggacctgctggtgggccatgccgaggagttcctccgcgagctggtcgtcagctccaggggcgccaggaggatcggcttcgtggggatgccgccggtaggctgcgtgccgtcgcagcgcacgctcgggggcggcctcgccaccagggcctgcgagcccaagcgaaacgaggcggcgctgctgtacaacgccagggcccaggagatgatcgccgccttcaacaacaacaacgccgacgccgatgtgctggtcgtgttcctcgacatctaccgcatcctggacgacctcatggagcgcggggaggagtacggcttctccgagaccaccaggggatgctgcggcaccggcaccatcgaggtcacggggctatgtgactcccgcttcgtctccgtctgcgacgacgtctcgcagcacgtcttcttcgacagctaccacccaacagagagagcctacaggatcatcgtcaacgacatctttcttntaaactacgcacacgtgctcttctcatgactatatatcacgtactctctgtctctgtctctgtctctgtctctgtctctgtctctggtagctggcccaatcgacccaacagcatccaaatataattaaatgagctagcccatcctccaaataccgcagcccattgttacactactactttcctaacaaaaaaaaaaaaa

SEQ ID NO: 2828 - DNA, 1625 bp, Zea mays
cattgatgtgttgtggggttgaaggtgggtaaaaaatgggagggggattgctgtacggtcaggtcttgaatggctagcacactaggtaggagcagcgaccgcattgcattctctttgtcacctgtccagcaagcttctgttttggacggcatcctgcactgcaatagggcaccaacagcagacttggtacgtagtagtaaagccagtaactgttttgtgcatccgtgtcggtgcgttgccatcatagacgtacctttgcctctgctgtttgtacgtcaaaggaatcagtcagggcgttcgttgctttgattgctggctggatcggaatatatatcgtctcggcagctagggtggccagcaccagccatgactccttcgcttctcctctccctcctgctggtggcggcgaggtgctgccatggctggtcgtcgttccagaagccggcggtgactgcggtgatcgctttcggagactccattgtggacccggggaacaacaacgggctgcatacggtgatcaaggccaaccatccgccctacggcaaggacttgttcaaccacgaggccaccggacgctactccaacggcctcattccaaccgacctaattgcccaggagttgggtgtgaagctgctgcttcctgcctacttgggcgtggatctgagcccggaggacctgctcaccggcgtcagcttcgcgtccggcgccaccgggttcgacccgctgactcccctcgtagtgagcgtcatctcgctggagcagcagctcgcctacttcgacgagtaccgcggcaagctggtggatatcgccggcgaggatgagacggcgaggatcatcgacggcgcgctgttcgtagtgtgcgcgggcaccgacgacgtggccaacacctacttcacgacgccgttccgcagcgcggagtacgacatcccgagctacgtggagctgctggtgggcggcgccgaggagttcctccgcaacgtcagctccaggggcgccaggaagatcggcttcgtggggatgccgcccgtggggtgcgtgccgtcgcagcggacgctgggcggtggcctcgccagggcgtgcgagcccaagcggaacgaggcggcgcagctgtacaacgccaggatccaggagatggtcgccgacgccgaccgagacttggcgacgaccacggtggtgttcctggacatctaccgcgtcctggacgacctgatggagcgcggggacaagtacggcttctctgagaccaccaggggatgctgcggcaccggcaccatcgaggtcacgggactctgcgactcccgcttcgtctccgtctgcgacaacgtctcgcagcacgtgttcttcgacagctaccaccccaccgagagagcctacaggatcatcgtcaaggacatctttgacaactacggacaagtgctcatcggatgatatatatatctaccttgcttgagcgatcgagcatgcatgttcatcttcttcatctttatgtacgttcggctagctggcccaaagcctcaaggaggcccatttatcttcttcttactcctcctcgccccaagaataattaattgtaagcatgatctgcggaatcagacggggatggtctggtaaaaaaaaaaaaaaaa

SEQ ID NO: 2829 - DNA, 1737 bp, Zea mays
gcacgagggacgttgatattgggggtgttaaaccgcatcgcatcgtcttctagggtttcctcctcccgccgccacttgctgccccacgagcccattcccctcagcccttcaccatctccggcggtcgcagtggcatcagcagctccggctcacgcgcagtaaaggaacgacaatatggcgaccatcgtaaacacgacggaggaggagccgatgctggccgtggtccgcttcaccgctgagctcgcctgggccgacgcgggcccggaagtcgccgaccccgaggtcgcccgcctatgtctcgaggcgcaggagcatatcctcgcggggcggtggctcgacatggcctcccttatgctcgcctccgccgacctcctcctcacctccccgtcgcgcgtctcggacaaagacctggagtgcgttctctccgtcatctgcagcctcgtcaccaaggccggatccgaggaccaggcgctgcagatcaccgaactcatctgcgctaagctcacccagcaacacggtgacaagccagcgctgcgcctcaaagttcttttcagcttgtacaatctgctcccgagcccgtacggcaaggcatttgtttacaagaaggctcttgagctcgccacggctggaaaggctgctgagtacatcatcccatctttcaagaacattgacagttttgtcagtgagtggggaattgacaatttggagaagagggagctataccttgctatcaccaccatcctcaaagaccacaagggcatggctaaggagtactttaactttctcaataagtaccttgccacattcaaagggtcagatgatgaatcagctacaattggtgatgcgaaggaagaggctgttgcggcaatcatcgagtttgttaaatcgcctaatctctttcagtgtgatttgctcaacatgccagctgtttcacagcttgagaaggacgaaaagtatcagttggtgtatgaactactaaagatattccttactaagaagcttgattcctacttggagtttcaaagtgcaaactctgacttgctgaaagattatggtctcgtccatgacgaatgtgtaaccaaaatgcgcctcatgtctttgctcgatctgagcagccgatgctctggtgaaatcccttattctgcaatcactgttgaactcaggatcaatgatgacgaggtggagcaatggattgtgaaggcaattgcatccaagatattggattgcaaggttgaccagcttaaccagactgtcattgtcagtcggcacacagagaggatctttgggatggaacattggcatgctctgcgcacaaagctcggagcttggaggggaaacattgccagagctatcaacacaatacaagctaacaaagtcaccgaagagggggcacaagggatgcaaggcttggcgatccactgattcggggcgggtcagcgggttcgtgaattgagattatagcgtgggagattagaagggcaaccttttttgtatgagacaagttgtaatggtttatttacttagatcccgtaaccatgcctggttattccttgtatttggtcagacacgccgcgcagtgcaaggcagttgttacacatcccaagttttcactctcgacgtggtctgtcctgataaatttccttccctgatatttttttgccctttccaagctctgatcagtcatgtgtgttaaaaaaaaaaaaaaaaaaaaaaaaaaaaaaaaaaaaaaaaaaaaaa

SEQ ID NO: 2830 - DNA, 943 bp, Zea mays
  misc_feature (935)..(935): n is a, c, g, or t
gcacgccgttgatgcgaaggaagaggctgttgcggcaatcatcgcctttgttaaatcgcctaatctctttcagtgtgatttgctcaacatgccagctgtttcacagcttgagaaggacgaaaagtatcagttggtgtatgaactactaaagatattccttactaagaagcttgattcctacttggagtttcaaagtgcaaactctgacttgctgaaagattatggtctcgtccatgacgaatgtgtaaccaaaatgcgcctcatgtctttgctcgatctgagcagccgatgctctggtgaaatcccttattctgcaatcactgttgaactcaggatcaatgatgacgaggtggagcaatggattgtgaaggcaattgcatccaagatattggattgcaaggttgaccagcttaaccagactgtcattgtcagtcggcacacagagaggatctttgggatggaacattggcatgctctgcgcacaaagctcggagcttggaggggaaacattgccagagctatcaacacaatacaagctaacaaagtcaccgaagagggggcacaagggatgcaaggcttggcgatccactgattcagggcagatcagcgggttcgtgaattgagattatagcgtgggagattagaagggcaacctttttttgtataagacaagctgtaatggtttatttacttagatcccgtaaccatgcctggttattccttgtatttggtcagacacgccgcgcattacacatcccaagtttttaccctcgacgtggtctgtcctgataaatttccttccctgatattttttttgccctttccaagctttgatcagtcatgtgtgttccattggagcatctgatgtatcctcctatcactggatggagtgggggtggaggggggctggggggtagagagaaaaaaaaaaaacncccccccc

SEQ ID NO: 2831 - DNA, 2912 bp, Zea mays
gggtcgcccagctccgctaatgtcctcaacagtgcgggggggggctgcagacttttgaggggggcgtgaaacgatggagaaagacttggagaacctatgagtgatctatttgcgtgttttgtgctagaccctctcgcaaccgcatcaatagcacaagttcatcgtgcaactctggcagaggggggagaggggttgtcaaaattcagcatgatggggtgaaggagatcatattagaggagctgaagaatgcaaaatcattgattgaatggatagcgtgggcagagcctcagtatgattttaatccgatgattgatgaatggggcaaggaggctccaaaggagcttgagttggaccatgaagcagagaatactagggctgtgtccaggaatcttagtcgcaaaagtgactgtgggagtggcagtgtttccagtactgtggatgtactcattccagaagttattcagtcaactggcaaggtgctaattttggaatatatgggtgggattcgtttaaatgataatgattcattgggaagcgtatggtgttgacaagcaaaaactgggcgaagagataacccgtgcgtacgctcatcaaatatacattgatggcttctttaacggcgaccctcatcctggcaattttcttgtgagcaaggaacctccacataaaccgattctccttgattttgggctcactaagcgcatatctgaatctatgaggcaggcactagcaaaaatgtttttgtcatgtgcagagggtcactagtcccccccccccccccccttttcagagatggggcttaaactgcgggttgacatgcctcagcaggctatggatattgccacagtattctttcgtcagtcaaccacagcaagtgaagcaaaggagaacataaaaacacttaatgaccaaagagagagaaatgtcaaagctcttcaagaaaagatgaaattgaacaagaaggaggttcaacgctttaatcctgttgatgctttccccggggatgccataatatttatgagggtcttgaatctcctcagaggtctttcagcttcactaaatgttaggatagtttatctggacatcatgaggccatctgctgaatcaactttgttagggagtttgacacacggacaaatacctaacagtcagtggatttttgactcacctgctaactctgatgtggagtctaaactgagaaattatctgcttgagttgggaagcgacaaaattttaggaatacaagtctgcgcatataaagatggaaaggtcataatagatactgctgctggtatgctggggaagtatatccccgacctgttcaacctgattctctttttcctgttttctcagtgactaagggtatcactgctgggatggtacattggcttgtggacaaagggaagctgaagtacgaggaaacagttgccaacatatggccgaattttggaactaacggaaaggagttaataaaggtccatcatcttctaaatcacacatccggtttgcacaatgcactgggtgatgtggtaaagaatgatcctttgttggtatgtgactgggaggagacactaaaccagattacgaagagtacacctgagaccgaacctggttcagcacaaatttaccattacctctccttcggttggctgtgtgggggagtcatagagcatgcatctgggaagaagtttcaagagattctagaagaggctattgttcgtcctcttcacattgagggggagttgtatgttggcattccaccaggtgtcgagtctcggctggcagcgctgacagttgacaccgaggagctccagaagctatcaggaatcagggcaggtgcagatgtgccagcagctctgctgaacaacatcgcgcagatggcgtccggtgtgcccgctattttcaacacgctaaacgtccgtcgggccatcatccctgccgccaacggccactgctctgcccgcgcgctcgctcgatactacgcggcgctagcggccggcggttctgttcccccgccgcactcttcgggcgccatgccgcccctcggcagccacgtgcacacccccaagttcccgaccgcgccgctcaagaagaagaagaagggcgccggaaagaagaagggcgccggcggcggctccatgggagacctcaaggtccaggatataagcggcggcagcagcgacaggaacgggtactgccagctgcgcaccagcgacgccgacagcgaggcggggagcggcagcggcggaggcggcaggatgttcggcagcgacaggatcctcgacgcgttcatgggcgtcggcgagtacgagggcatggcgcaccgggacggcaagttcgggctcgggttcaggaggtacgacgacgccggcagcggcagcggcaggctgaggtgctttgggcactccgggatgggcggctcgaccgggttctgcgacgtggagaacggcttcgccatcgcggtgacggtgaacaagctgtctctgggcagcgtcacgcgcggcgtcgtccggctcgtcctcgaggagctgggcctgcccgtgccggacgagtactcggccaccggggagaaggggcctgacatgatgctcaacctgacgacaacgacgacgactacgccgccgcaactgagatgacgacggcgaaactgagattaccaggttgggttcgtaataatctgtggaacaagatatatagcgagcagaaggaaggtggggtacagggatttggtggacagtatatatacgcgtgccattttgattttgacgtggcatgtaaaactcggcaaattctggtatattacgaagcaagctgggtgctgggaattgtggccagcagtacaagaaatggacatgctagtttgttgaccaaaaaaaaaaaaaaaaaaaactcgagggggggcccggtaccca

SEQ ID NO: 2832 - DNA, 2994 bp, Zea mays
ccggccggcgccaaagccggccaccccaaacgcgagaaagcttggcttcgccgcgcgcagaaagtcaagcgaaaaaaaaacagtacaggaagaaaatagtagataaaaaaatcctcttcaccgtttcctcttccttctccccgtgcgagctgtgactctgaagccgccgccgcctcccgcctgcctctccatctccgtccacgccgcgtcataaaaatcccccttcaaggcccgacctagcacctaccctcgccacccgcccattccagttcccaatccgatcggtgcacgagctccgaatccactatccctgttgttggcggcctccagctcccgctgggaccatttccgtttcagggaggcggtctactctgtatttagatccgccccctccttgcggtagtcgggggagcggatttaggtgaacaagcatcttgattttttttgaccccccaatctttgctctacccaccgcgtggtcttcgcctttaaatcctctggaggtggatagacggacgaggcaaagccgaaggcaagaacggtcgtttcaagtatcctgctaccggcgtccgaaggaaccttcaagtgttccagtggaggtattaggcgtggtggggaaaaagggattgtagaggtaacaatgttgagacagagctctagtagaaatcagagatccagaggtctgaagctgaagaaagctcttcagattagtctcttgcttctggtttctgtttggttgctctaccaagttaagcattcttacgagaagaaggcggcgtacagcgaaggtgaagtgaatgatttgcataaagatgacaagggccagggagaggcagtcagattgggcaggaaggatgtgcctccaaagatggaggctgattcttcaacactggatgagcgggttgaggatgaagagaacgatgaagtggagcaagaaatgaagcatgatgagaacgatgaggatcccatcgatgagcaagacctggagaaggacgaggatcttcccgagcctggcgagcattcttctgaaaaggatgaagatgtgggtgtgtttgaggacgaagagcggaaggagcggtcacaggaggatcaagagaagagcttccatggtgacgatgtgtctagtgctgttactcatgatcctcaatcgtccgagcaagatgagctgttccatcatgcccaagacacggtcctattcgtggatgatgcttcaactgcagtgcccaatgaaaaccatgtggctggaaacgacgaggaggaagtgcagagggctagggaaaggagtttcagaggcgatgatgtgtcaagctccgtggatcatgacgccaaggtggcaaagcctctcccagaggaacaactgaacagcatggataagatatttgaaggcaccacaaacttgtctaacggaatttcgtttcgagctcctggaataaatggatcatatgccggcatggacaatgtggctacagtaccaactaattcaccttcacagaaaaacgcaggcactcctagcaatgacatagaaagcaagacccacccatctccggcaaatttgaccggaccagagcaaagtaattcgactttgaaagatcacccagatcaacaagtgaattcaacagcagtgctgggcaaccaagtacggcctttgactaaccagacgccgtggcccgagttggattctccaaatggcaccttggctctggtaacagatgtccaaaagtccacatctggagctggagatgatggcagcagcacagtggacaagaggacggacggtagagatggtcccaaagaagacgtggatgtgtccacgaaaataatgaacagggcaatcagtgaggatgaagtcgttccagagtgacaaggagatctctcttgccggcttctggtgtaacctgtaagtttgtaggacttggtttcgtctcctagactagacttggagatgcgcaagcagactatctcgttgtgcacgccttttgtgtaagtttgatagatgtctgcttttgtactggcagttagtagtccatcacaatgatctgggtcgagtggagaacaagaagcatgtgtacccacaggaatatgtgtagcgattctgcagctcttgaagcttcgctgctcgaatcaaatgccaaagtaggcagctaaataccatctatcaatgaaatgtccatgcccatcgctgcccaaaaaagtgtctgaatatgtgtaggtgtgaatcgtggtgcttgactgcttgcaaagtggaaatgtgcccgatgttgtagtagtagtaacagtgcgctgttcgatgttactgtcttgagttcatgccttcagggtcccgagagtgaaggcgccactgaaatccttttttccgtttctcccgaatctggaagtcctttcgagaatgagaatgccacgacagcctgttcgcttgatttctgtgtagcagtctgaacagctagatttaatctaaagtgttcagattaaaaccaactattcaaactgctgtagttgtaattcataaaaataaaatactgtagaaacaatagaagcccatacgaatcattttattggcttccatagttgcatgtatcatggaaatcttagtgctacagaccgatgctattaagtaatgtcaccatcctagtagtagtcatttgatggagtacaatgtagtagcacgcatgccattgtaagtgtggaatattagtgagaaaattttctcgctacaattgtgacgtgaatcaatcacgtctaaaaaattatggggcactaggcacgggcacgtctcaattccagcctcacaagacgtgtcgcaactaaacggtggttcccgggacgccaaagtaccaaaccccacgtcgctcccactacaacagtgcattaaattaaaatataggactacaagtataaaaaaatactctaacaatatttcatttcataaattttatttaaaaaattaaatagcaccatctcaaatgtcttaaatatactataccgttgttgcagcag

SEQ ID NO: 2833 - DNA, 1448 bp, Zea mays
  misc_feature (56)..(57): n is a, c, g, or t
cctcgaggccggccgggtgccgttgctttgatggtccccatccatgcgcgacttannaaaaaaaaaaaaaaaaaaaaaaaaaaaaaaaaaaaaaaaaaaaacccatcgtggccaagagaaggtcttatttgtggatgatgcttcaactgcagtgcctaatgaaaatcacgaggctggaaacgaggatgaagtgcgcagggctagggaaaggagcttcagaggtgatgatgtgtcaagctctgtagatcatgacggcaaggtgacaaaacctctcccagaggaacaattgaacatcatggataggatatttgaaggcaccacaaacttatctaatggaatttcatttcgagctcctggaataaatggatcatataccaccgcaggcaatgtggctacaccaacgaattcatcttcccagaaaaacacagacattcctagcgatgacattgaaagcaagacccatccatctccaacaaatttgaccagcaaccctgagcaaactaattcaactttgaaaggtcatccggatcaacaagtgaattcaatggcagtgctcggcaaccaagtacagcctttgactaaccagacgtcgcttgagttggattctcctccaaatggcaccttggctctggtaacagatgccaaaaagtccacatctggagctggagatgatggcagcaacagcacctcaccctccactcatgtggacaagaagacggacggcggagatggtcccaaagaagacgtggatgtgtccactaaaataatgaataaggcaattagtgaagatgaagttgttccagagtgataaggagatccaagatctcgtgtcagcttctggtgtgacctgtaagtttgtaggacttggtttatctcctagacctggagatgcaatgcaagcaggctatcttgttgcaccctttttttgtataactagtaactggcacgtgccctacgcttgtagatttttttttgcaatataagtagaaaaaatcgcaatataagtgataacagtgctatattgcttgtaagatgcacattaagtaagctattcatatatattacaagagctagaacaaaggctagttccgaccgagtcaacatctgaaatcagcggcctatatttatataaattatcttcaaaaggttgatgatgcatccatacataattacacagagcttacaaaataaacacccaagtgtcaacacttgggaatatttctcggtaggttcttctgggatgtgcacgggttcttgcttgaacctgttggtcagttatgaaaaaacagtgagctattatatatattttacttatgaattgattatctaaacagcctgtctcttgagctttgtatttaagtatgggggttattcagcaaactggctaagcatgacaaaagaactgggggttgtttgtgtgaaatgaagggctgtaaatattggttgtg

SEQ ID NO: 2834 - DNA, 2761 bp, Zea mays
gatttcctaccttggaaaaagaagagaatcccagagaaaattaagtttccaaactagccctaagagcaattaagagtccactgtatccacattcttatgtgtgtgcattgctctattttccacaatgtaagttttcgcaatcaagaaacttcgtatcagctctatgtcatgcatttttcttaggaaataggagtaaattggacgcatgagtcaattaagaaaataaagaatttcagataaaaagcggtaaacaacttaaaaaataaatagttctagatgataaagcagtaaaaagaaaaaggattagtaaaaaatatgattagtaagaaatagtttcgagttctgataaaaaatgtttaaggctaatttggcaacccattttcttaagggatttatatttttctaagagaaattagttcattttttcttaaaaaatggagttgtcaaactagttcttagaaaattattattataaattgttggagaatgataaaaaattcaaggttgatacgtcttctaatatttgctagatctattagtttagcaagtaaactatgtcaagttttcttaagatgtgagctccaaagtgccctattttaaaatataaggcttaaccaatggtgtagctaatgggtggtctatggcataccctaggccggctcatcggatcatcagtccatcgaggccgaaaaaagtttaacactaacagtgtattttgtgtttaatatttagacatttttatattatatttgcgatctaatgtatgcacttacaaacttagagtctgtttgagaacttcgttttgtaaattaaatttggttattattagaaaaaacgactaataaattatgtaaataactctttaaatttagtagctctacattctttcacattcactctatttttatatagccagtcttttggtgtacagagtatgttagattaacctaattttactcttggattaatctaattttttgtaaagtctattgtagagagtagctatatttgctctaagttagtactttttcagaaactgtagaccggagcaatggaggaagagaaagcggcggcgtactacgacgagctcaatcgcaagggcgagggcgcccgccgcttcaagcaggggcttggcttctcctcctcatccgccactgccttcccttccaagcccaccgcctcctccttcctatccggttttgttcgcgcgggcgcagcccctggccccgccaaacagccgttaccgcattccaggaccccatccagtccgcaccatcgctcaagttcaccgcctctttcgcgtcccaggatccgctccaggtccaggtccaggtccccgtctcgctccagccggcgccaatcgagatcgaggtcccggtcgagggagcgcaggcgccgctccaggtctagggagagggaccgcagggcatcctgtagacgctctaggtcgcgggggtcgagatcgccttctcgccggagcggcaggagcctgcacttggaagcccggcgggaacggcatggggatcagcggcggcggcacgacgacggccatcagagctctaagggtcgcagtgatagggacgggggcaaaatggactactcgcggctcataaaaggatatgataaaatggttggtcacgccattctcgtactgtacaattgttttgttactttccttgttttggaatgatgaactattggttctcttgcagactccagctgagagagttaaagcaaagatgaagtttcagctttcagagacaggtgatcactctttcagttcttatgagctaggatggtgcctttcttaaaggctactagtgtgagtgtagtctgtctatattgaatttgtgattctgcagtgtagagaaatgtcggaaactgattgtagataaatcagtgcattttgtcttgaccagtggaaattgattatacataaatcttggtactgcagtgcttatgtgtattttttgtttggatttatagctattccttatatgatgtaatgtagctccaaaactcaaaatcgactcttgggtacactagcataatatcactcaaatgcgcatgtagctgcaatttcttctgttgatcatggagtttacaatctttatggtttttggtgatattttcattgttctaaaagattgtattgctttccttttcaatgttgggcagctgcaaaagattccactcttggaactgcaactgtggggtgggaaagatttcaatttaataaggatgctccacttgatgaagataatgacgatgttgaaggttagtgttgacaatgctgcattgtcttagctattgcttcatatggcttttcattagtttggttcttcgtcatgtcagtcttgattattccttatgatgctttgcatgacatggctattcatctagttattgttcaacttggtgtgttattattttagacatctgcctacaattggttttgaagtggctctaggattagaatttgtgatttagcactagagcactttagcactattaaagcctacacaattaattttatgtgcccaagcacaattaattttatgtgcccaaggtcattttcttttcaccatatcatgatttttcttgctaaagtatattctgtactcaataaagctaagatatactattactaaccttagagaggttcttgttattttggtaattgccctcttaattttcagttcctatgctcaacaaaatagcactttgtatattatatatttaagtttgaatctagagtgcc

SEQ ID NO: 2835 - DNA, 1615 bp, Zea mays
cggacgctatcccacctacccgttgtcctgccctgccccgccccgtccgtctcccacggtttccgcgtcccacccatcccttccacactttctcacccccgcccttctcaccccccgaaaaaattcccccggaaatcagagacgcgaatccctccctcgccccacgtccgaggtcgctcgccaattcgatccgcctcatcgtcgcccgcccgcccgtccgccggtcgaccttgactgctccgtcgcacgtggcgtttcgcagcgcggaatctaccctgggttgggttgggagatccggggaaacccttgttcccgggcgctccgggctcgaatctcgctgcagacgggcaatgtgagcgctctccatcggagagggacgatctgcggggcggttgttggccgggtgaatcgtgcggtgcggggttgcgggaatggagcacgtgatcggagggaagtttaagcttgggaagaagatcgggagcggatctttcggggagctctatctcggtgtgaacgtacagagcggcgaggaggtggctatcaagttggaatctgtaaaatcaaggcatcctcagcttcattatgagtcaaaactatacatgcttctccaagggggaactggaattcctcatttgaaatggtttggagtggatggggagtacaatgtcatggtcattgatcttcttggtccaagcctcgaagacttgttcaactactgtaacagaaagttttctcttaaaacagtacttatgctagctgatcagatgatatctagggtagagtacatgcacacgagggggtttcttcatcgtgatatcaagccagacaacttcctcatgggcttaggccgtaaaacaagtcaggtttatgtcattgactatggccttgcgaagaagtatcgggacctccaaactcatagacacattccatacagggagaacaaaaacctcacaggaacagcacgatatgctagtgtaaacacccatcttggagtagaacaaagcaggagagatgacttagagtctcttggttatgtgctgatgtacttcttaagaggaagccttccttggcaaggcctgaaagctggaacgaaaaaacaaaagtatgacaaaattagtgagaagaaaatgctaacctcaattgaggccctgtgtaaatcttatccatcagaatttgttacatatttccattattgccgctctttgcaatttgaagataagccagactacagctatttgaagaaaaattttcgggatttattcatccgtgaaggttgccagcctgattatgtatttgattggactgtatcaaggcaagctgcggacaataacagattgcgactgagtgggaagacaggtgggttggtgggaccatctgtggatcgggctgaacgagctgcagcaaaacaggatgttccacatagattcactggtccagctgatgcattggctaaaagaaccggctctggttctggtcattatggagaacacacaaagcacagaactctgttggattcccttatggcatccaatatgggtgttgactcggataaaagaaggcattcatcgtctcgcaatggaagcacatcaaggaaggctcgtctgtcaagcaaccg

SEQ ID NO: 2836 - DNA, 1129 bp, Zea mays
ggtgcctcccctatcgctggtatccgttgtccagcactcccccccccggccgtttcccacgaattccgcgtcccacccggccacactttctctacgagcgccccccatctcacccacccaaaattaaaatcctcccggaaatcagagacgcgaatccctcgccccaggccccgaaacctccgagttctctcgccaattcgatccgcctcaccgccgccgcccgtccgccggtcggccttgactgctccgtcgcacgtggcggttcgcagcgcggaatctaccttgtgttgagagatccggggaaacccttgttcccggtcgttccggctcgaatcttctgcggactggcaatgtaagcgttctccatcggagggcgacgatctacggggcggttgttggcggggtcgcgggaatggagcacgtgttcggagggaagtttaagcttgggaagaagatcgggagcggatctttcggcgagctctatctcggcgtcaacatacagagcggcgaggaggtggctatcaagttggaatctgtaaaatcaaggcatcctcagcttcattatgagtcgaaactatacatgcttctccaagggggaactggaattcctcatttgaaatggtttggggtggatggggagtacaatgtcatggtcattgatcttcttggtccaagtctggaagacgtattcaaccagtgcaacagaaagttttcccttaaaacagtacttatgctagctgatcagatgataactagggtagagtacatgcacacgagggggttccttcatcgtgatatcaagccagacaatttcctttgtgggcttaggtcgtaaagcaaatcaggtttatatcattgactatggcctttgcgaagaagtatcgggacctccaaactcataaacacattccatacagggagaacaaaaacctcacaggaactgcacgatatgctagtgtaaacccccatcttggagtagtaatagaggtgtacccagtgctagctcccacacaagaacaaagcagaagagatgacttagagtctcttggttatgtgctgatgtacttcttaagaggaagccttccttggcaaggcctgaaagcggaaaaaaaaaaaaaaaaaagcggcc

SEQ ID NO: 2837 - DNA, 1852 bp, Zea mays
  misc_feature (59)..(59): n is a, c, g, or t
ggtgtgcttggtttgtatttagaattgtggcaagattttttctctagctagctacatanatattactcgtcaataatttataaaagtatgatactatttttttagacgtgactaactgtgacatataatttaaacatatagagtgtgacaaaatatatgataatttttggtattttaggtttagaaccaaacaggccttagactatattcaacggtgcacccttggctccccctcccctaccactgtagccgttttaggggctacagtccgcccctatccccttcaccggcttcctcctcctcctcctcttccctctcgattccttctctctcccgctaaatggatgggcacgctactgcgccggatttctccccagccggttccttcggccacgcgaccgcgcgctcggaaaactccacggacagcgaaggaggtgaaccaaggacgacgtatctgtcgccggagaaggtaagcatcgatccgccgtgtcctacgattcgtttgtcttgctccaggcggcgagcagcagtgggggtcgtcctcgcggatccgccttcaagcttcgcggatcccacccaaaattaaaatcctctcggaaatcagagacgcgaatccctcgccccaagccccgaaacctccgagttctctcgccaatttgatccgcctcaccgtcgccgcccgtccgccggtcggccttgactgctccgtcgcacgtggcggttcgcagcgcggaatctaccttgtgctgacagatccggggaaaccctcgttcctggtcgttccggctcgaatcttctgcggactggcaatgtaagcgttctccattggagggcgacgatctacggggcggttgttggcggggttgcgggaatggagcacgtgttcggagggaagtttaagcctgggaagaagatcgggagcggatctttcggcgagctctatctaggttagcatctcgccgggttcttcattgaatctctcacgcgtctctgcggattcctacgcgccgctgttttgttttgctcgtcgttccgcatttgttgctgatgcgctgacgtttgtttttggctgcaggcgtcaacatacagagcagcgaacaatatcagattattgcaaaaatgtggtacatctttcttcagctggatgtcatcactcacgaatgggttacccatgctagatggagccactgctgccgttccacttgaacagaagttttcagcaagtacaggagatggatctgcagcaccttcccagccacttcaaaacaaccgcagcgttcctatgcaattttttggcttcaatttgctcttccagtccctgtatactcgtaatgttctgcatgtaattgctttaaaaaagactggcatggtcccgagctatatttttagctgagtaataacaagattttaaaaccttttcttggttgtccatgcgaattgacctgtgcatccagttctaattccaatcatggttctgttacctttcattagtgataactgtataacagtatctatttttataaagaaagtaacaaggcatattttcagaacatatgaagaaagcacttgcagaatgttgatatcttttggtctatgataagagaatttaaagttttacattctattctgtatatatgtcatgatcatggattgactgaagcaaaaaaagaagtgctgagaatgttagattaccttttgagacagtatgataagaaaagtcttactcttggtagttgagttagttgagttagttgatgatgaaagtataaaatattggtgtggtggggtatagaggtttgatatagggggaaccgctgtagagcgtgaagatatagggggaaagagaacactg

SEQ ID NO: 2838 - DNA, 1720 bp, Zea mays
  misc_feature (1669)..(1669): n is a, c, g, or t
agaaaagctcgcagaagtgacctccctctgtgtctctccgctcggcgctcggaccaccgcggaacggcggaaccctccgatagaatcatagaaccaaaccctcctcctcgcaccgcgccgctgcagctgaccaccctacttgaccggccggggagagagatagagataaagacatagacaaacagacggcgggcaggcatgggcggcgtcacgtccaccatcgccgcgcgcttcgccttcttcccgcccacgccgccgtcctacaccgtcgtggtcgccgacgctgcgacaggccgcctcgccatcccggagatctcacgggccctctcgcgccgccggaggcgggacggcgccggcgctgggggctcctcctcggcctcctccgtcgcggccgccgagaacgaggagggcgcggaggtggtgcgcctccggacccgccgcgggaacggagatcgtgggggtgtacgtgcgccacgcgcgggcctccgccacgctgctctactcccacggcaacgccgccgacctcggccagatgttcggcctcttcgtcgagctcagccgccgcctccgcgtcaacctcttcgggtatgattattctggttatgggagatctacagggaagcccactgagtgtaatacatatgcagacattgaagcagcatataactgcctcaaggaaaaatatagtgtcgcagatgaggatataatcttatacggccagtctgttggaagtggtccaaccattgatcttgcttcacgattgccagacttgcgagctgtggttttgcatagtcctattttatctggagtaagagtactatatccagtcaaacggacgttttggttcgacatttacaagaacatcgataaaattggtttggtaaattgtccggtgcttgtcatccatggtacatcagatgatgtcgttgactgctcccacggtaaacagctatgggaacattgcaaagtaaaatattctccactgtggttaaatggtggtgggcactgcaacctcgagctatatccagattacattaagcacttgaagcagtttgtgtcaagcgttagcaaaaaaacatcaaagccggaccagaaagagataatggcaaaggatggcactaccagtaaagaaagagaggaagcatactcggagaaacctcagccggcagctaagtgctcacagtcacagatctcacgtaagagcctagatagccgagttgggaaatccaaaacagtggatgttcctgataaatcacggatgagctcagatgacatcgacaagttccggaggagaaggtgcttggtttggtgatgcctatgttgtgcacagattgtcgaacagtacctgagtgaggatactatagcatggaaatcaagcaactttattacatacatcatgctgcgaggaatggcatcagccgttcctgcagtggagaggaaagaactgttaaataagaaaaggaaccagaaagctaccatcatcatccatcagagacaaagccacttgactgaaagctggtagtttcccagttaatttaacactgacactgacaccgtcgacatgttttgcagcaccggttagggtttccccatcatctaaaagtgtacaattattgtatgtaatcacgagggacctatacaaacatttacagccgctctgtgcaaagtntgaaagcctaggagcaccatagtttatcctcggtgcatcagcatcgggccc

SEQ ID NO: 2839 - DNA, 1570 bp, Zea mays
ttttattttgatcgcttaactaataacttatgtagtaactataatcttctccctaaccatatcttaatagacagtttattcttccattgaacagcccactgagtgtaatacatatgcagacattgaagcagcatataactgcctcaaggaaaaatatggtgtagcagatgaggatataatcttatatggtcagtctgttggaagtggtccaaccattgatcttgcttcgcggttgccagacttgcgagctgtggttttgcatagtcctattttatctggactaagagtaatatatccagtcaagcggacgttttggtttgacatttacaaggtatatttggtccttttgtttcctggagtcattggttggttgctaaataactgatatattttccctccttactgtagaacatcgataaaattggcttggtaaattgtccggtgcttgtcattcatgtgagttctaatattctatcccccaatccctttggtcctggtggaattacttctgatacaatacaatagattgagcatgaaaatgggtgattcctattctgtgataagggtatgtacagtagaatgagtaatacccactaatcactactcaccccaatccaagtatgttaaaaatgatcatttcagatttgtcaaagttgtagacagctatcaagtgccatcttaagaaaccaatgtttgttaattcagtatcatagttgctttggtagattattgctgctctgactaacatagcctgatactttcttgcaccagggtacatcagatgacgtggttgactgctcccacggaaaacagctatgggagcactgcaaagtaaaatattctccactgtggttaagtggtggtggccactgcaatctcgagctatatccagattacattaagcacttgaagaagtttgtgtcaagcgttagcaaaaaagcatcatcgaaacctgacccaaaagaaacaacgacaaaggatgacactaccagtaaagaaacagaggaagcgtacccggagaaacctcaagaggccaagaagtgcccgcagatctcgcgaaagagcctggacagccgattcgggaaatccaaaacagtggatgttcctgataaaccacggatgagctcggacgacatcgacaagttccggaggagcagatgcttggtctggtgatgcctgtgttctgcacagattgtcgaacagtacctgagcgaggatactatagcatggaagtcaagcaactgtattacatcatgctgcgaggaacggcatcagcggttcctgcagcggagaggaaaggactgttaaataagaaaaaaaagaatcaggaagctaccgtcagcatccatcaaagacacagctacttgactgaaaactggtagttcctcagttaatttagcacttacaccgacaacatgttttgcagcatcggttagggtttccatattgtaaaagtgtaccgttattgtctgtaatcacgagggaccgatacaaacatttgcagagtctgaaagccttaacggaatcacgagcaccatagtctattctgggtgcaccagtattcgggctc

SEQ ID NO: 2840 - DNA, 2837 bp, Zea mays
  misc_feature (95)..(95): n is a, c, g, or t
  misc_feature (2735)..(2735): n is a, c, g, or t
gtttgctagtgatgaattagtccactgatcgaatgcttcgttttctcatgagaactttaaaatttctatattttgctaggatgacttgcctgagnattaatgagaagacaacaaagtcaaagacttgattcaataataataagagtttttatggagtcaaaaccaggagcacaacaaacctaatcccttgttcagtgacaaattttgtgatctaggatgaacataatatgtttgaaacgttcaacgacaataatccacagtgtcattgatgtgctgcattttgagagagcatttttaggccttacaattctcattcctccctatggactctctacctcatgtaatctttgtattgcagtgtaatttgatatgtaacaatttagttctgtattggttgtggataaaagaatttgtgagatattgaggtcgatgatatgtgtcgttcattttcatttagtcgttatgctgcaatattgtatcgaataatttgtgttccgttgcaacgcacggcatcgtactagtagatactctaactaatattacgtactaatctttaggttaactaataattggcccaagctcgtgaagcaacagattgcggcccatgcgcttgccgctttattttgttcatgcattatttgacagcagcagcccaataaagcccaggccctactgatccggcaggcgcacgatttgctcctaggaatatggaaccgtcgctgatcttcacgcagaggcagagctatataaggtactagccgctagggttccaaattcaccgcatagttattgtgttgccagggacagagagggtcgcgccgcgcgccgaggagaactcgccaccgcaaaggccgtcgtctgtagcctcgcctcgccgtcgttctatactcccaataaagtcctcctccgccaggcgcacgatgtcgtgggccgacctcccactcgatgtgctcgtggacggggtgatcgcgcggcttcctatccccggcgaccgcgcccgcttggccgccgtgtgccgcgcatggcgcgccgccgcgcgcgaggtggtgagccacatccagctcccgtggatcgtgctcccatacggcaccgtctgcaccgccggccgcggcgcagcctgttcgtccttccggatccccgggttccccgacgaggccacctgcctcggcgccgcccacgacggctggctcgccctggaccgcacggacgacgtggtcgggcgcacgtcctggttccggacgacatggcccgtcgtcgtcggagacacgtggaagcacgtcatgttgggcaagtccgacgtgaaccacaagcacgcctacgcgctgcacaaccccttcagcgacgtcaccgtgccgctcccggagctggacgccgtcatcggccgtgtcgccgagaccttccgggtgcgtaaagtgctgatgcgttcgccggctccagatgacctcgtcgccgtcatgaccaacagctggaactgcaacgtcatcttgtgccgcgccgggaagggtacgttcgtgctaccctactacaggatcgtcgacgtggcgttccttggagaagacacgctgtatggaatcaccaccggcgaagaactccttgccttccacctcggcgaggatgacgacggcagacctaatgttgccaggattgagctggtcatcaaaaacacgttggccaattattattatgatgaatttggatggttgtggccagcagaagtagctaacgacactagtagcaacaacgacgaggatatggatatggatgacgatgattatatggaggaggatgatccggcagtcgtcgatgatggtgacgacgaccaagctgatagcttcaacggcgatgagatggtctcggacagcgaggtgtttgatgggtacggcgacggcgaggaccttcaagtcaaggacgagttatatctgggtcgatacctggtgcggtcgcggagcggagagctgctgctcgtgaggcaccaatggcaatcatgcccacgttccccttcctacactcgcaaggtcgagttcttcaaggcagattttagcgccggcaaatgggctgccgccggtggattagccaagggggaggcgatctttctgagtccatcgcacagcaagtgcgttcgcgcaagcggaggcgtccgtgaaggctttgtgtactacacaaaacagatggacgacgtgttcgacacgagatcgggcaccgttcgtgccgccattacagctgggtggccagaactatgcgcactggagaaatcgggatggtttttccctccggagctagtggtttgacagatagagagctgtctatgattatatattttcatccacatttctttttaattaggtctagagtgcttcttctttttctttttctttttcttttttctttttacaaaagctaaggttgtaatggagtatctttattcattgttgtttatttattttaatttggtataataaaaaaacttttaccacatctcctcctcctttgtaatatccaaaattagtgaataatactgggaataggttataaattctatgcgatgtattcttctatttatttattggtcaattggaatcatatggaaccaaccataacaataaatctgatacacgcggaaatttacatcccccatcgatccaaccaccatgactttacaggctacaatacatcaactcaaccaccatgtccatcccaaacagcctgaaattcagttgcatccatgttttgtatcntacagtaagaacgaagacgtataccagtattccaccaccagaagactaataacaactggggtccaggtcagcttgtggcgataaaagaaccagtgagttcca

SEQ ID NO: 2841 - DNA, 2029 bp, Zea mays
catatgctcgctccccctgcagcatacggttcctgaccatggcatgacccaggccggcactaacaaccatcctatataaacaggttgcgagtcccgtgctgcccctcaagctagctagttaactgtgcaattagttgagtcagtagataagctgttccgtcttagcttatctaccgatcgagctcgcggcaatggcgatgatggcatgcaataacactcgaccccgcaagctgtcgctgccatgccgcacccgtactttccaagccttaatactaagcacagcagtcttcctggctgcttccacggccgtcgtcgtcggcaaggagccacaaccaccgtcctcctccggcggcggctgtcactaccgcttcgagctcacccacgtagatgccaacctcaaccttaccagcgacgagttgatgcgtcgtgcctatgacaggagccgcctccgcgcggcgagcttggccgcctactcggacggccgacacgaagggcgcgttagcattcctgacgcctcgtacatcatcacgttttacttgggcaaccagcggcccgaggacaacatctccgccgtcgtggacaccggcagcgacatattttggacgaccgagaaggagtgtagccggtccaagacaaggtccatgctgccttgctgcagccccaagtgcgagcagcgcgccagctgcgggtgcggacgaagcgagctcaaggccgaagccgagaaggagaccaagtgcacgtacgctatcatatacggcggcaacgcgaacgacagtactgcaggcgtcatgtacgaggacaagctcaccattgtcgccgtggcaagcaaggcggtgcctagctcccaaagctttaaggaagtcgccatcggctgctccacctccgccacgctcaagttcaaagaccccagcatcaagggggtcttcgggcttggccgtagcgccacgtcgttgccgaggcagctcaacttcagcaagttctcctactgcctcagcagctaccaggagcccgacctgcccagctatctcctgctcacagccgccccggacatggccactggcgccgttggcggcggcgccgccgtggccaccactgcgctgcagccaaacagcgactacaagaccctctacttcgtccacctgcagaacatatccatcggcggaactcggtttccagctgtctccacgaaaagcggcgggaacatgttcgtcgacacaggcgcctccttcactcgattggaaggcactgttttcgctaaactggtgacggaactagacagaatcatgaaggaaagaaagtacgtcaaggagcaaccgggcagaaacaacggccaaatttgctactcgccgccgtcgaccgctgccgatgagagcagcaaactgccagacatggtactgcacttcgccgactccgctaacatggtgctgccctgggacagctatttgtggaagacgacgtccaaactgtgcctggccattgacaagtcaaacataaagggcgggatctcggtcctgggcaatttccagatgcagaacacccacatgctcctcgacaccggaaatgaaaagctttccttcgtgcgggccgactgcagcaaggtgatctgaagtatgcagcatgcaacacacagctaataataataagcgtcgcatgaagtaacaactatatatttatctgcttatatatgcagcatgcaatatccgtatgtaataagagaatgcatgtgcttgccgctatatatatactgccatgcatgtctgcatgcagcaggtactgtaagctgcttcgatcctgtattattgtgagattttctgcgaaataaaagcatattatatgctaaacccctcgcttagttgcctagctagctatctcttgtgtcctcttgatttacaacaacacttaaatcagatactcagatctgacgtataccatcatcgcatcgcataatttgttctaactcgtatgactaccacattaaatataagatacgtactgaaattaattagactctgtactttgtcacactaga

SEQ ID NO: 2842 - DNA, 2523 bp, Zea mays
  misc_feature (262)..(262): n is a, c, g, or t
gctaggagacgtcgtatgggtgcggcatcttcatgctgtagaagagggtacccctgatttagggtactgacagttcattataagaaccgacattaaagtaatttgagtgggaatctaaaacttctagcgagaatagaaaatagtatgagtatcagttagaacggtacataaagactatttttcattctgtactagaactgacacttaaggcgtcactgtttttgtaccaacttgtacatcttgaatatatctgtgacatttntaccggttagtgtcttcaaccgttactaaagatttgatattaatattggtcagagacaccaaccgatagtaatgtcctgtgcacggacgctatatttaaaaccagtactgatgtttatattaataccagttttaaaacaactagaacaaatgttaaagatagaagctccgtcctccattagtgacgactattgagagtgatcaatcatcaacataatctgcatttagtgagttactttaagtggtaatgttcttttgaattctgttatatccactaattacatgtaatatatatttatatgatataccagtaaggtcttgcatataaagatcttcacaagctccgttatacctgtgaattattcgtgtctccgccatgccattgaatgcaaatggacaataacttaggtacttaaagtctcaaacagtattggactcaatacttcatttattttaaaataattattattcacgttttgtacaagtcaaaattttaaattataattaaatatatttaaaatagcaatatttacaatatacaattaatatcattagatagaacatttaatttttttatacttaatctatttacgaatataaatattgttaatattttaaaattttaataagcattaaaatggtcggtaatttggagaaaatggtcggtataaatattaaaatattttattaaataacaatagttctcactgtcctgtatcaaacacgtcgaatttggcactagttgccacgtgccgagcaacaaggtcttgcgtcgcttgctcgttctctgattcaagcggcaagttggctcgggactacttggctccggacgtgtcgctttacgtgtcactcatgcacgtctacatcaccttttttggtaatacagattctgtggagagccgtttaattttattttttccatcccaagttgtactgcattgattgtacatgcatgtcgagagagcgacagttgaagataaaataaatgaatgcataaattattttctaacccaaaatgagcggtctcgatttgcctcgggagtcggacggcgaccgcccaggtctaccggtacgcgaccaccaggcaccagccacaagccgcgactagtccagcctttgcagcttcgtgcgtcgcaccaagaagcctcgtggaaccaccttgatgtcatcttatccccacgggccacccccccccccacccccccctccgtaatccgtatacatatataagccatgcgtgcggtcgcgggacgacgcacgcgtccggcgagatccaggcagtgcgcacgccgtgcagccgtgcaggcctctcctccactcaaccgcgcgtcatggccatgttgcgcgagcatctcgacctcatccgcgctcacctcctcgacgacaaccacgacgccgtcagctccgatgactcggcgccatcgccatccccatcgccgccggggcgtaggccgctgccagcgctttccgtctcgctgcccccgaggccggcagtcgtcctgcagcagcagcacctgagggcggcggcgccgccgttgcagattcctcagcaggagcagcactgctgcccggaacccgaggaggacgatttccggcggtaccgcggcgtgcggcagcggccgtggggcaagtacgcggccgagattcgggacccggcgcggaagggcgcgcgcgtgtggctgggcacctacgacaccgccgtggaggccgctcgtgcctacgaccgcgccgcgttccgcctgcgcgggtccaaggccatcctcaacttccccaacgaggtcgcgttaagcaccgctgcatggtgggcgacgcctgctcctcctcctcagcccagcgcgaccgtggccggtaacaagagggcgaggtcgccgcaggagcaggacgctaggtgcatggttagggaggtgaagaaggagcggattcaggagcccgcaagcggaggggcggactacttctgggaggatgagtcgctgaagggggcgatctgcagcctgccgccgctctcaccgttgtcgccgcacccgcacctggccgtgccgcagctctacgtcagctgactgcctgacttgatgtcgtagcaagacagggacggtggtcttactcttacctgatgatagtcttctgagttctttgatatgctagaggagtatagctccaaatattctttcgttctttatttttaaacacaataaaaagggaacgtggatgtcctggcgtagcatgactgcatgagaatactataatggacaatttttaaatata

SEQ ID NO: 2843 - DNA, 3234 bp, Zea mays
tgggaccctcgaggccggccgggcccccatttccattcctcgctcaccaagccaacagccaaatccaattcgccgacgactctctttattcctcccgctcgccgccgccgccaccgcctgagggcaagaagcgagcgagcgcaccgcggatctccctcccggccccgccgcgcgcaccggtgaagacgacgagcccctcgtgaatggtgggagcccgcgcgacgtccgtcgcctcgcagccgcagccggaggaggcctccttccgcggcttcggttactgcatgcagggctggtaccaccgctgcatcggtctcgacccctgaaccccgccgccacttgcttctttgatttgatttcattcggttcgttcggtgcccctcccgtcctggatctgttgcgcgagagcgcggcagcgcgcgagattcgcccccttctcttctcataggaagcaggaagcaagccgatcgctcgctgagcgccgccgccgatggccgtcgcggtgccgatgaagctctggagggtggagacccgcggcaaggccgccgccgcggggcccgacgaccccctgcgcgtcctggtgacggtgaccgtcctcgggagcgccggcccgttgcgcttcatcgtcctcgagggcgacacggtcgccgcgctcatccgcggcgcgctgcgctgctacgcccgcgagggccgcatgccgctgctcggcaccgaccctgccggcttcgtcctctccaccgccaacggcggatccggcgcactcggagaagacgagaggatcagcttcaacgggtgccggaacttcctgctttggcagaaggctgcggctcacgtgcatctgtttactcatctgtttgccatgcccgtgcagcactcggagaagacgagaggatcagcttcaacgggtgccggaacttcctgctttggcagaaggctgcggctcagggtgccgccgccaaccacgccgggtccgatgctctgacggcaaccctgagccccggcaggaagggcagcggtggattcaaggctactgatccgagccctggcaggaaaggcggcggcggctggaaggctggactgaacaagttcctcctcagcttcagcatcaaggtgtgatccatacgtggacgagagaaggggggcgtttcttggtgtcgaggcaccgcgcaacaataaaaatgcattgcattggtttgtctgttttttcaattaatcaggattgtttgttgccgccagtgagatggcgaagtgtaattcgtcatgcgaatccgagtcgagtcgaggcaatgtgattcatcgtatgtttgagtcgagtcgtgtcagttgcttagtttatttggctgttctatttccaaatcatcggatcgggttcctctgatctcttgttaaaggttcttcattcaataatccatttgtgcgtgctggtctcatcgtggtcacaaggccctgtttggccgattagctaattaatcggatgatcacgcggcgttgacgcggacgcccccgtgcccgtttgtttggtttatagcttatacaaaccgctggattattaagtacaatagcttgaacttgaccagcctggagttgctaaacagtgtgaacattgttgttttgcccaaggagacagatacaatgaagatgataggcttaattcacagcagcatagcaaaaatccttttggccatcttccttgaactcggttcaggatgaactcgaggcactgcaccacatacttgtttcattcagacaggtgtcaaggctcgccataaactacttttagagctgatctggtaaacagggatccatgggataatagcgacgagatttctctctatatatcctctcatgatctctgatcaccaaatcaatccttagaaaaagaaagcaatgtccatctaataagatacaatgtcaaagcttgatcacatcttgcaactctaagttgcaactcttaaggcctaaggaaagaggaaagccttcccctacaaataagtggagtttgagacaagagagagagtggaggttgagataagacagagagagcctttgaaaggatggatgcctactcaacgaggctagcaggtttaccttggtcacttcggtgtagttcgctctacccactcactttctcagcatcttctcgcttggagaattcactgccaagtctatctaccaaatccaacccaatgtgcactttgagtcattacataacaatttgatttagaaagcaaaagcagaaaataaacgaggagttttttcttatgcatctgacccaaaacaaaatccggatctggtccaaaacaaaatcataagagcatcttcaaaagtctttctaaatttcactctccaagttattatctttctaaatttcactctctaagttattatttagagagtcatttactaaaaacactttttatatctttttaatcttaaacagtctttctatatcttatttgcattctaaagagccattcacattttctatattctatattcggctagcaataaatctgaaaaaaagataattatatttcaatagctatttaaataagttattagaagatattttttttaaaaaaatctttatttatatagatgaagaagaatatagacaactcttaaagttgctccaaagagacgacaatctagcgaagggaagacggcctcaccagattctgtacgcatctttcatgggcaacaagacacatggctccatcattgtctattatgctcttttagtctgtggtagttctattttgcgtgctaatatatacttgtcatccttcagggtttaactttacatttttcgcaacggtagtcggtagacctcctgccatttttcttccaaaaatccaaggtaacatattgcatatacctgagctctcaggatgtatgttatctcaagtttgaaattagattttgtcatcactgaaactgttgctatgagagctgaaatctacgaaaaggatttatgatttggaaaccggactgagcatataacatacatgtgccaacgagctattaactttgaattttggagttgggatgaacaacataattatttgactaatgttatttgcaaagaggcatgtataacccacattaaatgagtggcttcttaaggtctcagggttgtacataacctaatacacaatctccattatataaaatatcagtttcaacgaccgtctcgtgtcaccctttccgcttaatgcaaaagtaaagtaaaatttg

SEQ ID NO: 2844 - DNA, 1294 bp, Zea mays
gcacgaggctcaccaagccaacaaccaaatcgaattcgccgacgactctctttattcctcccgctcgccgccgcggccgccgcctgagggcaagaagcgagcgagcgcaccgcggatctccctcccggccccgccgcgcgcaccggtgaagacgacgagcccctcgtgaatggtgggagcccgcgcgacgtccgtcgcctcgcagccgcagccggaggaggcctccttccgcggcttcggttactgcatgcagggctggtaccaccgctgcatcggtctcgacccctgaaccccgccgccacttgcttctttgatttgatttcattcggttcgttcggtgcccctcccgtcctggatctgttgcgcgagagcgcggcagcgcgcgagattcgcccccttctcttctcctaggaagcaggaagcaagccgatcgctcgctgagcgccgccgccgatggccgtcgcggtgccgatgaagctctggagggtggagacccgcggcaaggccgccgccgcggggcccgacgaccccctgcgcgtcctggtgacggtgaccgtcctcgggagcgccggcccgttgcgcttcatcgtcctcgagggcgacacggtcgccgcgctcatccgcggcgcgcttcgctgctacgcccgcgagggccgcatgccgctgctcggcaccgaccctgccggcttcgtcctctccaccgccaacggcggatccggcgcactcggagaagacgagaggatcagcttcaacgggtgccggaacttcctgctttggcagaaggctgcggctcagggtgccgccgccaaccacgccgggtccgatgctctgacggcaaccctgagccccggcaggaagggcagcggtggattcaaggctactgatccgagccctggcaggaaaggcggcggcggctggaaggctggactgaacaagttcctcctcagcttcagcatcaaggtgtgatccatacgtggacgagagaaggggggcgtttcttggtgtcgaggcaccgcgcaacaataaaaatgcattgcattggtttgtctgttttttcaattaatcaggattgtttgttgccgccagtgagatggcgaagtgtaattcgtcatgcgaatccgagtcgagtcgaggcaatgtgattcatcgtatgtttgagtcgagtcgtgtcagttgcttagtttatttggctgttctatttccaaatcatcggatcgggttcctctgatctcttgttaaaggttcttcattcaataatccatttgtgcgtgctggtctaaaaaaaaaaaaaaaa

SEQ ID NO: 2845 - DNA, 1264 bp, Zea mays
gtccctcgaggctcggccgggattttccattcctcgctcaccaagccaacaaccaaatcgaattcgccgacgactctctttattcctcccgctcgccgccgccgccaccgcctgagggcaagaagcgagcgagcgcaccgcggatctccctcccggccccgccgcgcgcaccggtgaagacgacgagcccctcgtgaatggtgggagcccgcgcgacgtccgtcgcctcgcagccgcagccggaggaggcctccttccgcggcttcggttactgcatgcagggctggtaccaccgctgcatcggtctcgacccctgaaccccgccgccacttgcttctttgatttgatttcattcggttcgttcggtgcccctcccgtcctggatctgttgcgcgagagcgcggcagcgcgcgagattcgcccccttctcttctcataggaagcaggaagcaagccgatcgctcgctgagcgccgccgccgatggccgtcgcggtgccgatgaagctctggagggtggagacccgcggcaaggccgccgccgcggggcccgacgaccccctgcgcgtcctggtgacggtgaccgtcctcgggagcgccggcccgttgcggttcatcgtcttcgagggcgacacggtcgccgcgctcatccgcggcgcgctgcgctgctacgcccgcgagggccgcatgccgctgctcggcaccgacccggccggcttcgtcctctccaccgccaacggcggatccggcgcactcggagaagacgagaggatcagcttcaacgggtgccggaacttcctgctttggcagaaggctgcggctcagggtgccgccgccaaccacgccgggtccgatgctctgacggcaaccctgagccccggcaggaagggcagcggtggattcaaggctactgatccgagccatggcaggaaaggcggcggcggctggaaggctggcctgaacaagttcctcctcagcttcagcatcaaggtgtgatctatgcgtggacgagagaagggggtcgtttcttggtgtcgaggcaccgcacaacaataaaaatgcattgcattggtttgtctgttttttcaatcaattggtattgtaattcgtcatgggaatccgagtcgagtcgaggcaaagtgtgattcatcgtatgtttgagtcgagtcgtgtcagttgcttagtaaagttggctgttctctttccaaatcatcggatcgccttgatgggatctcttgttaatgttcttcattcaataaaaaaaaa

SEQ ID NO: 2846 - DNA, 1386 bp, Zea mays
tacccctccggccccatttccattcctcgctcaccaagccaacagccaaatcgaattcgccgacgactctctttattcctcccgctcgccgctgccgctgccgccgccgcctgagggcaagaagcgagcgagcgcaccgcggatctccatccctgccccgccgcgcgcaccggtgaagacgacgagcccctcgtgaatggtgggagcccgcgcgacgtccgtcgcctcgcagccgcagccggaggaggcctccttccgcggcttcggttactgcatgcagggctggtaccaccgctgcatcggtctcgacccctgaaccccgccgccacttgcttctttgatttgatttcattcggttcgttcggtgcccctcccgtcctggatctgttgcccgagagcgcgagagcgcgcgagattcgcccccttctcttctcataggaagcaggaagcaagccgaccgctcgctgagcgccgccgccgatggccgtcgcggtgccgtccacgctgccgatgaagctctggagggcggaggcccgcggcaaggccgccgccgccgcggggcccgacgaccccctgcgcgtcctggtgacggtgaccgtcctcgggagcgccggcccgttgcggttcatcgtcttcgagggcgacacggtcgccgcgctcatccgcggcgcgctgcgctgctacgcccgcgagggccgcatgccgctgctcggcaccgacccggccggcttcgtcctctccaccgccaacggcggatccggcgcactcggagaagacgagaggatcagcttcaacgggtgccggaacttcctgctttggcagaaggctgcggctcagggtgccgccgccaaccacgccgggtccgatgctctgacggcaaccctgagccccggcaggaagggcagcggtggattcaaggctactgatccgagccatggcaggaaaggcggcggcggctggaaggctggcctgaacaagttcctcctcagcttcagcatcaaggtgtgatctatgcgtggacgagagaaggggggcgtttcttggtgtcgaggcaccgcgcaacaataaaaatgcattgcattggtttgtctgttttttcaattaatcaggattgtttgttgccgccagtgagatggcgaagtgtaattcgtcatgcgaatccgagtcgagtcgaggcaatgtgattcatcgtatgtttgagtcgagtcgtgtcagttgcttagtttatttggctgttctatttccaaatcatcggatcgggttcctctggtatcttgttaaaggttcttcattcaataatacatttgtgcgtgctggtctaaaaaaaaaaaaaaaaaaactaagaataaataatcatcaaaaaaaaacaaaaaaaaaaaaaaataa

SEQ ID NO: 2847 - DNA, 1874 bp, Zea mays
gtgttcggggacatgattcgattcggtcccactggccaacatttgtggtggctgtagctgctgctataattgcaagccaagctatgatatctggtgcctttgcaattattgctcagtcccaagttctaggttgctttccacgagttcgtgtcacccacacatcaacgaagtttgaaggacaggtctacatcccagagatcaactatgtcttgatggttttgtgtgtagctgttacagctattttccattcggcccctcggggccgcccggcatatggtattgctgtgctcgtggtcatgtttataacaacacttctagtcactttagtaatggttatgatatggaagacaagcctgctgtggattgcactctttctagtaataattggtggagcagagctcgtatacttatcttccgcattctacaagttcactcaaggtggctacttgccattagcttttgcaggaattttgatgtttataatggccacatggcattatgtccatgttcatcgatacaactatgagctccagaacaaagtatcaagtaactatgtggcagaattgtccgcaaggagaaatctggccaggttgccaggaataggctttttgtactctgagcttgtacaaggcatcccacccatacttcctcacttgatagaaagggtaccttccatccattcagttctcgtgattatctcaataaagtacttaccgatcagcaaaatagaaacaagcgagaggttcctcttccggtatgtggagccaagagattacaggctattccgatgtgtggtgcgctatggatacaatgataaagtggaagacccaagagaatttgagggcttagttattgaacatctgaaacaatttatccatcaagaatcattttacagccaaggagataattcaacagaagaagtagaagatgcaaatgagccttccgtcagagttcaaggggcaacattgtccgatagttcttcagatagaagcactgctgctccatcaaatggatgcatctatgagatccaaacaatacaaagagagatggaggatggtgttgtccatatgctaggagaagctaatgtggtggcagaaccaaatgcagatttcttcaagaagataatagttgactacgcttacaatttcatgaggaagaacttcagacaaccagagaagataacatgtgtccctcataacagactgctccgggttggaatgacatatgagatctagggcgatgctgaactttgtggaacacagcaatttaatcaaagcaggcaggtggttagctacttgacaatggagtcggtcttctcagtatcaagtcaggaaatggaagggttctgttcaaagaggtggagaaattaactagagtacatctaatgggtccttatgtcataaacctgttagaaatatttcgttttaacttactcatgccaaactaggtacgaaatactctgtattgttctaatgacagtaaacggtgttatactgttgctcaaaaaaaaaaaaaaaaaattcatgggtgaagatcctcacctagaaaatttgtattacacaatcgtaacgtccaagtaaatagctaagattggcataccgagggtagaatgcatgaggggaacttcatagcaagcaagacaaatatgatgctatattgtggttacttcagagcaagcaaaacaaacaaggtaaaatagggcagtctgcttgcgcgtttgagatattgtactattgacacagataaaaacacccatagcgaaggcaggcaagcattagcacgttggtaaaacagagcgtcgaggccgggcatttcgtcaaacagaacaaggggagcaaaagagagaagctaaaaacgacgggttccgaagtgaa

SEQ ID NO: 2848 - DNA, 1259 bp, Zea mays
ggccgcttttttttttttttttttcggagtaacagttgctggcttgctgcagacttcttgttgtaatgtacacgctacttaagatagaagtgtgaatgcatatcatcacagatatggcaccgtaatctgtaatccgtaaaacaaaacttccatagctttagaaaaactcaaaggtcataacaaacttatgcatctagagcctatataagccggcagaacaaacagttcgaatagaactgagatctcttggcgtgctccaaagatgtagcacatctttgcccgctgcctatatctaccacagttcaagccatccagaagttactcggttggcttgtccgggtcatcttcctcaggttcttccttgtctggatcatcctcttgtggctcctcctgtggtggtggttgttcttcctcttcctcctcttgatcatcatccagaggatcatcagctggtaacggatgcggtaatggtgtcttcattgggctgaacttagggaagatatcaggtctcctcccaggctttggtctctcccattcgatggggaaatcgaggggcgaccgcttggtaatcttctcctcgtcgggggccgcgcagaccacgagcgtgctccacctgcgccgcctaccggacggaaccggcacacgcgcgagggcggtgacggacgcggatacgccaaaggggccgggcgcgggcgccacaggcgggacggcggccggagccgagaggcaccacgggaacgccatgcgggagggagctcaagggccctaggttcgcttgggctgcaggctggaggagtcgtgctggaatttgggttccgtgtcctccttgcggtttgggttgagtacctaccggctgcttgtgaaccaccggcggcggtggcggctgtctggagagagtggagaccgccttcggggcgataagaatacgagtcgagtccccgccgccagcgtgtacgggactccgatggttctacacgcggtgcatattgcagcccacagcaaattgggcccaagcacccactcgggccgactcgtgtccgcatatcctgggcctcttgctcgggccggagtgaaccagcaactaattcagcacgactcgtgtccgctcgagagacccgtgggccgtggcgaagtgccgacccgccatgcaacagtgacgcgcgccgcgcgcgggtgcagccgtgcacacgcgccgcgaccaagacccaccatgcctcccgggaaatggccgggggccgcatggcggctgccacctgcag

SEQ ID NO: 2849 - DNA, 1409 bp, Zea mays
cggttcgtcctcgccctcgcgtgctcgcgggcgggcggagcgaggaggcggatcggggagcagagatcccggccggagggatggcgaagggtggcgggcacgagggcacgctgctgccggtctcggcggacgacgggaagggcaacgacggagggggaggcggcgacgacgccgtgctgttcaagggttccgccatgacccgccgaggtggcgccgctgcgctctcctacatggcatgctccgtgctgctagtgatgtttaacaaagcagctctttcttcatacaaattcccttgcgcaaatgtcatcacgctccttcagatggtgtgctccacgtgccttctttatgttctgagacggttaaagatcatctccttcacaaatagtgatccatcagtgccttctgattcactattctttgtgccgtttaggttattgttgcgcaccacacctctttccttggcttatttactctacatgctagcttcgatggaatcggtccgtggagttaacgttcctatgtatacaactctacggcgcacaacagtcgtgtttacaatgacaatggagtatttcctggcaaagcagaggcacaccccacctataataggcagtgtggctttgattgtattcggagcatttgttgctggagctcgagacttgtcatttgatgctcgtgggtatgctattgtctttgtggccaacattacgacagctgtttatcttgctaccataaaccgtataggaaaatctagtggccttaatagctttggcctgatgtggtgcaatggtcttgtctgtggaccttcagtactgttcttgacttatattcagggtgacctaaagaggaccatggaatttccataccttcattctcttgggtttcaggttgtgcttctattttcgtgcatcttagcatttctactgaactacaccatcttctggaacacaatcctgaattctgcactcacacaatctatgtgtggcaacttaaaggatttcttcaccgttggaattggttgggtgctatttggtggtcttccttttgatcttcttaatgttatcggacagggactaggctttctgggatctggattgtatgcctactgcaagatcagagggaagtagacggaaattccattcaggggccagtgtgcttaacaaagtagcgttgtttatgctatttgctcctacatatgggagagaaattttgtaggtgtcctatatgtattgaacttcagtcctcatgaacactacaaaactgacaaggaaatagagtataccgaaattttgctgttgctttatgatcgtttctcgtgtaaactcgaatagacgtttacaatgaataacgtatgtataaggcgagagacttgcagaatacaatgaacttatgtaaaaggcacgtgatgt

SEQ ID NO: 2850 - DNA, 1077 bp, Zea mays
ttcattacaataaacatattaataatagattaattaggcttaataaatcatcaaaccatttatttttctaattttacaattagactatatttagtcattcaaacattcaacgtgacatgctaaactttagttcctatgaccaaacacacctgagccggggttcccgaggctcacttgctgcagacttcttgttgtaatgtacacgctacttaagatagaagtgtgaatgcatatcatcacagatatggcaccgtaatctgtaatccgtaaaacaaaacttccatagctttagaaaagctcaaaggtcataacaaacttatgcatctagagcctatataagccggcagaacaaacagttcgaatagaactgagatctcttggcgtgctccaaagatgtagcacatctttgcccgctgcctatatctaccacagttcaagccatccagaagttactcggttggcttgtccgggtcatcttcctcaggttcttccttgtctggatcatcctcttgtggctcctcctgtggtggtggttgttcttcctcttcctcctcttgatcatcatccagaggatcatcagctggtaacggatgcggtaatggtgtcttcattgggctgaacttagggaagatatcaggtctcctcccaggctttggtctctcccattcgatggggaaatcgaggggcgaccgcttggtaatcttctcctcgtcgggggccgcgcagaccacgagcgtgctccacctgcgccgcctaccggcgagaaccggcacacgcgcgagggcggtgaccgacgcggatacgccaaaggtgcccggcgcgggcgccacaggcgggacggcggccggagccgagaggcaccacgggaacgccatgcgggagggagctcaagggccctaggttcgcttgggctgctggctggatgagtcgtgctggaatttgggttccgtgtcctccttgcggtttgggttgagtacctaccggctgcttgtgaaccaccggcggcggtggcggctgtctgtagagagtggagaccgccttcggggcgataagaataggagtcgacttcgagagttc

SEQ ID NO: 2851 - DNA, 915 bp, Zea mays
caggagcacaaaaatggtgcatcgcttattttatgcatacctgacacaaatcaatgatgcggctacacatacaccgcatgcaggtcttgtagcactgtacacgttactcactcaaaccacagaaaaagtgagaacacatgtcatcacagatatcgcacggtaatctgtaatccgtaaaacaaaactttcatagctttagaaaagctcagaggaggccataacaaacttatgcatctagagcctatataagccggcagttcaaatagaactgagatctcttgcgtgctccaaagatgtagtacattttttcccattggctatatctaccactgttcaaggcaatcctaaattactcggttggcttgtctgggtcatcttcctcaggttcttccttgtctggatcgtcctcttgtggctcctcctgaggtggtgcttgttcttcctcttcctcttcatcatcatccagaggatcatcagctggcaatggatgcggtaatggtgtcttcattgggctgaacttagggaagatatcaggtctcctcccaggttttggtctctcccattcgatggggaaatccaggggcgaccgcttcgtaatcttctcctcatcaggggccgcgcagaccacgagggcgttccacctgcaccgcttacttccgggaaccggcacgcgcgcgagggcggaggccgacgtggagacgccgagggcgccgggcgcagccgccacgggcggggcggcgggcggtgccgagaggcaccatggcgacgtcatgcgggaagggagctcaagggccctcgcttcgcttgggctgttggctggaggagtcgggttggaatttgggttccgcctccgtgtggcttggtggagtagcggtggcttgtgaatggttttttttgtatttatgcgtttttttt

SEQ ID NO: 2852 - DNA, 1491 bp, Zea mays
ggtacgggctgccatcccagttatcccacgcaaaacattttcttcagccagtgatattcatgcgcgatgtttctgcaggatttcttcacccgttggaattggttgggtgctatttggtggacttccttttgatcttgtaagttttgggtcttgtttctatgccacttatctttgtataatctcccagtgaatactgaacccaaagttttcgtgtgcagcttaatgttataggacaaggactaggctttctgggctctggattgtatgcctactgcaagatcaaaggaaagtagacgctgatgtctagtgggatcaactgggggtagacggtggtgtgacttggtgtttcattcagggccagtgtgcttaacaaaagtagcgttgtttatgctgtttgctcctacatatgggagagaaattttgtaggtttcctgtatgtattagacttcagccctaatgaacactgcaaaactgaaaaggaaatagagtataccgaatttttactgttaccttatgagttatgaccgtttctcttttaaactcgaatagacgtgcaaaatacaatgaacttatgtagaagacccattttttttttttttttgctcaaaaatctcagtatccgtttcacaaatcaatgatgcaactacaccaaatacaggttttgcaatgtacacgttgcttactcaaaacatagaaaaagtgagaatacatgtcatcacagatatcgcactgtaatctgtaatccgtgaaacagaactttcatagctttagaaaagctcagaggtcatataacaaacttatgcatctagagcctatataagccggcagttcaaatagaactgagatctcttgcgcgctccaaagacgtagcacattttttccccattgcctaatctatcactgttcaagccaatcgaaaattactcggttggcttatctgggtcatcttcctcaggttcttccttgtctggatcgtcctcttgtggctcctcctgaggtggtgcttgttcttcctcttcctcttcatcatcatccagaggatcatcagctggcaatggatgcggtaatggtgtcttcattgggctaaacttagggaagatatcaggtctcctcccaggttttggtctctcccattcgatggggaaatccaggggcgaccgcttcgtaatcttctcctcatcgggggccgcgcagaccacgagcgcgttccacctgcgccgcctacttccgggaaccggcacacgcgcgagggtggaggcagacgcggagaagccgagggcgccgggcgcagccgccacgggcggggcggcgggcggtgccgagaggcaccatggggacgtcatgcgggaggggagctcaagggccctcgcttcgcttgggctgttggctggaggagtcgggttggaatttgggttccgcctccgtgcggtttggtggagtagcggtggcttgtgattgtgaaccaccgccggcggcggcggctgtctgtac

SEQ ID NO: 2853 - DNA, 4108 bp, Zea mays
  misc_feature (285)..(285): n is a, c, g, or t
  misc_feature (518)..(518): n is a, c, g, or t
aatatgtatagtaattttttaagatctgcgaaggaaactttgtaataaaaaaggcgtactattttaggtgaagtaaaaattaatatacaccatattttaatatatgatatataaatgatatttttctgtgcgcgttctatacggagaaaggaatgtagaaaataaagtccggtaacattgtttatatagaggataaaatttagagaatattgctgaagtagaaaaaatatagaagacaaatgttttacatagaatatttatttagaggattaaatttagatactnctcatctcctccatgcatcagctcctatctacattttttttgttttgtgacagcagtagctccaacctttattatcttcccgcatacccacgcgcgttgttcaaaacaaaaatcccacaaaaatgaaaatcaaaagaaaatccattcacgacccacccaccacagaaatcagtttgctttgagtttaaaataaaaactttgctttgctttcttctgctgttgctgtgccgcgngtccggcgccggcaggcagtgtccccacaaccacaacacatacccgggcagaggtccccaccccagcatagataaaatgattatatcagggccatcgtccatatctcttctttgtattagtttttttataaaattccttatctatagatcttttatatcatcttttacatattagagattcatattaagctgtcttgagcggatggtgaatatgattgtgtaaaacattacataaattatactatttataagtgaagttttaaataaaggagaataaaagaaatccatattaagttgccttcgacatagatggtgaatatgattgtgtaaaatatcatgtaaactgtattatttataaagtaaagttttgaataaaagagaataaaagatagtatgagtaagctgtgccagatacctttataacctaatttcattttcttatatatttattgtatccttaaatattttatatatttttagttctaaaatataaagataaaaatgtgaaggtgtatatgtttaaacccccgccccccggccctccgccccgaacccttcgtcagtttcagtttggcacctccgaagcttccgtccgaatctctgctgcctccttcctcggccaggcttgcgggcgatggcggcggagcagaccgccgagcagttccggggccaggcgcggctgccccacttcgcgtccccgcggcgctacgacctgcgcctcacgcccgacctccccgcctgcgtcttcactggctcggtggcggtttccatcggcgtggccgcgcccacccgcttcctcgtactcaacgcagccgagctcgacgtcgcgaccgggggcgtcagcttcgcgcctcagggctccgaccaggtgctacaacctttggaggttaccaacgtgccagaagatgagatcctgattattcgcttcaatgaggtgctttctatcggggagggaactttgacgattgcattcaaggggactttgaatgataagatgcatggattctacagaagtgtgtatgagcttaatggagagaagaaaaacatggctgtaacacagtttgaaccagctgatgcaaggcgctgcttcccttgttgggatgagcctgctttcaaggctgttttcaaaattactctagaagttccttctgagacgattgctctgtcaaatatgccagtaattgaagagaaggtcaatggccctaccaaaatagtctacttccaagaatctccgataatgtctacatacttagtggctgttattgttggcaattttgactatgtggaagatttcaccacagatggtactagggtccgtgtttacacacaagtcggtaagagtgcgcaggggaggtttgctctagaggttgccttgaagacattggtcctgtttaaggagtattttgctgtgccataccccctccccaaaatggacatggttgctattccagattttgcagctggagccatggagaactatggcttggttacataccgtgaaacagcattgctatttgatgagatgcactctgcagctgccaataagcaacgggttgcagttgttgtagctcatgaattagctcatcaatggtttggaaatcttgtcacaatggaatggtggacacatctgtggcttaatgagggctttgcgacttgggtgtcttacttagctgcagatcagttctttcctgaatggaatgtttggactcagtttctagaggaatctacagtaggtttcaagttggatgctcttgcaggttcacatccaattgaggtggacataaatcatgttgatgaaatagatgagatatttgatgctataagctataggaaaggagcttctgtcattcggatgctgcaaaactatcttggggctgaggtctttcagaattctttggctgcatacatcaaaagatttgcgtattcaaatgcaaagactgaggacttatgggctgcccttgaagaggggtctggtgaaccagttagaacattaatgcattcatggaccaaacagcaaggttatcctgtcattactgtgaaactcaaggatggaaagttccaactggagcagacacaatttctttcaagtggatctacaggagttgggcaatgggttgttcccatcacactatgttgttgttcctactcgcgccaagcgaagttcctttttcatgggaaacaagaagattttgatttgtcagcgtccgggtttacggactgccaaaagaaagatggcttctggattaaacttaatgtcaaccagaccagcttctatagggtgagctatgatgaggaacttgcagcccgacttcgatatgcaattgaaaccaacaaactgggtgcagcagacagatatggtgtacttgatgatgcctatgccctctgtatggctggcaaacaaaagctagtctccttgctgcatttgatttctgtgtacaaggatgagactgagtatactgtgcttgcacacataatcacgacaagtctgcacattgccgagatgatggctattgctgctccagaggagttggttcatctgaagaagttcctaattgatttcctggagccatttgcgctgaaacttggctgggatgctaagagtgacgagggccatctgaacgctttgttaagaggtacactcttaaccgctctggcagaacttggccatgaggctaccataaatgaagctgttcgtcgatttaatgtctttctggaagacagagagacaccactccttcctcccgatgttcgaaaggcagcatatattgctttgatgcagacagtgagcaaatcaaacaaaactggctatgaatcactactgagggtatatagggaaaccgatctaagccaggagaaagttcgtgtgttaggttctttggcatcatcccctgaccatgatgttgtccgtgaagtattgaatttcatattgtcacctgaggtgaggaatcaggacgcaatatttttgctaagaggggtgagttcaggggcacacgaggtagcatggcaatggctgaaggaaaactgggattacatattgggagcctactctggaactctgctcacctatttcgtcaacataactgtctcgccactggccaccgatgaacatggtgatgaggcggaggagtttttcaagagcagaaccaaggcgaacatcgcgaggactgtgaggcagagcatcgagagggtgaggatcaatgcccaatgggtcaagaacatcaaggccgaggctgacctcggcaatgttctcaagaagctggcttacaagcactgatcagagacggtccactttcatttctgtgttagtcctagtaccgagatgtaactttgttctctggaataagtggattaataaagggcactttcgtttgtgtgtcgtcctgagctgccttgtccgtagattcttacaaactgttgtgcgaaagctatcatgatagatatgcgtcgaattgattgattctatatcctgataattgattgcgtatcgcccatgtcgcacaggagaacgataaatttgttccaataattgactgactgcgtgttggctttcaaaaaaaaaaaaagggaagaaaaggaggaacggaaaaaaa

SEQ ID NO: 2854 - DNA, 2393 bp, Zea mays
  misc_feature (1622)..(1622): n is a, c, g, or t
agactaatggagtctgtcagtaccaggctcaatcgctgcaagcagaagttcttttgatctataattttgggttagattttttagctgaagaaaaacatatatatagaagaagactttaaaattgagtcccaggccacggtacaggtggtccgcggcccaaatcggccctgaaggtatgtaaatatctttcgattaaaagaaagagagctcccgaccatccatgcagtttgctttagattaatgttggttgtttagactgctgcatctataatttataaaaacaaatatacaataaaaacagtaaaatctggtacggatgaaagaaacacgaacttttcttttcggacgtagagttcgtgatccggtctcatacgtgcgccagtcacttttgcttatgtcgaagcaaaccactcagcattcacatcagtattaatcgttttcttgaatcacttattaattaactttctttgacctgcctgcccgcagaaaaaggcgaccctcggggccggccgggccgaattccacggaatctctcccagctgtcctgtttttccttccatggatccccctcgctagctgagcccgctggtgctcgcggtcgcgggtggtgagcgcggcctcgccggcggcgcagcggcgatggacctcccgtggctggatctgcccttcaccttcctgacgctgctccttgccacccgcctcgcctacgactactatggcgacgtcgccgccgccttcgccggcggcttctcgatccaggtcttcctcttctactgcttcgcgcgctggtaccgctacgccatcgccggccgcgccgccgccgccgctggggcccgcgacgacccgtcgccgtcggcgcggccgccgccgcagcaggaggaggacgcggacgccccgcccgtcctgacaccgctgctggggtcgccggacggcgcgcggccgtcgacgctggccaaccgttgcttcgccgtcgtgttcatggtcttcgtgccgctggtcatcgtcgtcttcgagcggagccaggccgacgtcgtggcctacgcgctctgcctcgccaacatcatcgtcatggtcgtctggctctcgccggacaccgggtcaacggtctcggccgccaagtcgctcctgcgtctcagcgacgacgaggatgaaggcagcgggggcagctccggcgcagaggacaagtgctgcgtctgcctcgccggcatgcgggaggaccaggcgcttcgggcgctgccgcggtgcggccacagcttccacgacaagtgcatcggcaagtggctcaaggcgcacccaacgtgccctgtgtgccgggccaccgccgtgccgccgccgctccacagcgggggcggcgatccgctagatgacgatattagccccgtctagctagcttcccctcagtgattcatccatcttatcttatctaacgaattttgtggacatttgttgggaaatttggtgaaaacctgtatagtaatccaaaacgttgtcaaggctcaattcaacatgtcaggtaggtgatttgtacatacggtcccgtttgtgcactctgagaaaagcaaagccatgtctctcttgcttcatgacaatcattgaacattttgttcgagaaggggaggaanactgtatggttttcttgaggagtacaagccgtcggtggatcacaaaatgttaacatgccactgccaattactacactccactttgatgccggtttgtgtagctaggaactacataaaacatatagaaatatctctatactgattctctaaaataatatagattctgaaaatagaccagtccacagcagattctccaaatcgtgttttttatatttataagttacaattgattaattcaaaacagatagaataaagaattaattatatctcgtaaactcagtggaaccttaggacccctaagtacttcgtggagacatatttaagtctacttctaatgcaacaaataacgtgtcatttggacccctaatcaacagtaatgactattttcctacaaaatgtgagaaggtaaatagattgtaagaccaccctcgactcagtgcagacttccataaagaattaaccacatcacctaaactgagtggaatcttagagcctctaaaagcatctccaaaagttatgtaaacaagtctctaaatatgaatttaacaagttaaaaaaaactcttctccaatagttatataaatcagtccataaatttacaaagtccctataaaacctaatgttatccctacatttaccaaccttgttaggactccctaaatctatgttgatactaaatcatgaaaaccatacttttgccactgttttgcgctatcctactctcctgttgaccacaaaatccatctctagcgtccagatgtctgagccgcc

SEQ ID NO: 2855 - DNA, 1581 bp, Zea mays
tcgtatcagtgcattgccatttcctgagtacactgatcctcgatatggtccgctgaatcttacagtcaagctacctgatggtgcattgaagccagatcttggaccaaaaacttacatcgcttatggattttaccaagagttaggcaggggtgattctgtgaccaagcttcactgtgacatgtctgatgcggtaaatatattgacacacacagcacaagtgccctatgcgcgttatcaacttgagaagatagaggaaaccagaaagaaaatgaaagaacaagatcttcaggaactttatggtgtttcagaactaaacctatcatcaccttttactgattccaggaatataagtgctgatgaaatgtcaaagacctcatgtttggacgtcaatgatgtaccacctgttaatactgaatctgaggtacaaagtggggcaggccagtgttcagattacattgacaaggatagaagttatgctgggatgcataacggggagagaaccggtggtgccttatgggatattttccgaagagaagattctgacaagatacaagattatcttaggaaacatgccacggaattccggcacatcttttgcaatcctgtgaagcaggttattcacccaattcacgatcagactttctacttaaccgaggagcataagagaaagctcaaggaagaatatggtgttgaaccctggacgtttgagcagaagcttggtgaagcggttttcattcctgctggatgtcctcaccaagtgaggaacttgaagtcttgcattaaggttgcgatggactttgtctccccagaaagcgtcaacgagtgcatgaaactgactggagagtttaggcggcttccacctgatcacagggctaaagaggataagctggagatcaagaagattgctcttcatgctctgaaccaagtagtaaatttcttggatccttcctcggagtggtcgaagagttggtttgcccaacccaagaacaaaaaaaaggctggagctgaagaacaggagaagcctaaaaggaagcgtggccgcccatgtcgcaagtccaacgatgaagctgctggcgataggcacagaaagaagggcggccgccaaagaggtcggaagaggggatacggcaagtccaaagatggcgctggcgctgttgatgtgaagcctcctaaaaggcagcgcaatctcctgaaaggctctggcaatcgtgtaggtggttgattgtttcactgctgactgggaagatggaaggcgtaagggctgtaccgacccaaccttgacgtggttattttggtaccaggttgtaagtgtagactctagattgtagaatagaccaggcatttcgtcacccctgggcgccattatggcgtcttgcttttgttcatatgtggcgattgccggttgacaccgttttggaagaataatatgctagatgctcgttgtaccagactcttcatgtagcgggctatggtgaattgctgttcagcatgtctgatgctgatgttggtaattgacctgaatagatgtggtcatttgaactaaaaaaaaaaaaaaactctggattctgattttacatatcc

SEQ ID NO: 2856 - DNA, 8629 bp, Zea mays
  misc_feature (3675)..(3675): n is a, c, g, or t
ttaggaagtaagtgttttttactatattttacatttgttatcttataaacatcaaaaagtggcataataatttttatacgtcaaatattcgatattgtatatataattatatatatttgtgtgtggatagatcctccatattcggattttgtactgggcccctgaaaagtcaggaacggcgtcgagtatccaccgttgttttatcaaacaattcgaaattttcttttatccgagttcatgacgggcatgcagattgcagaagagcgaagttgtagcctggcttggatggctgagtccaaaatccaaatgaaaaaccggatatttggttttggtgacagcttctttttttagtgtgttcgtttcatattaaagccaactatttgaaccgtcaaacgaatatgttgaaggtgaaacaatagattcgagttcagcagaagctttatatagcttattatcctactggctgactcctgtagccaccaaaaggcacttggttggacctgcaactgccgcgctctagattagtctccgatccatgattgatgtctagggtctatgcccatccatccgaccatcccctgttctctgaaattcagaatgcgagaattttttatatttaaaacgcaagcctctatatttgatatgcaactagtaaacctttcgcaatttgacaacaactaatatgcaaaagatagcaatgtgccctgatcctcgattccccgcgaaaaattccaccatagaagatagagataaggaaacttgtacccctgcagggatgtaaacgtggatgagaatgggaaagcattcctagtatctccgcgggaactcgttaaacttacatcatgatgatgtttttaatgtaatatttaatgataaaaacaaataattatcttgtcaaatgatcacttgttgtacaaatgtgttcattttgatgtacacataatgttttttacatatgacaatgtgtataagtgataatgttttgtattaataacaaagaaactatgtcctgattataatttaagcaggacggggatccctaatggagatttatccccgcggagaatggggatggggaagaaatgctgcacgcaagagttcgtggggatccccatgggaaactttgttcatcgcggtaacggcaatggtgagctaaaacctgatggggaattccccgttgtcatccctaagctaggtcttatgcgcaagcgtgcaagcgagtttcttggtctgttagatcatgatccaactgtagacatatctgtgttttgttaggggttttctataaatttacacaagctagtgttcgaagggtttaaatgttaaacgtgatatatgtctggatcatgatttcgcttccatgattgcacataaggctagattgcatattagttgttgcctcagagattaaccttgcacatatgaattgttccaatttaagagactataaagaatctctctttttgtactttcaaatatctattagggcatgcaaaaagacaaaaatacccttgcctcttaacaagtggtctagatgcccacccgaccccttggtccctaggtgtccatgcactttttcttctcgacatttctctgtcttgcacaatctccttcctcgaagttctctaaaactaaatttttgtacatatctaacatattcggtcaaaatcaatgcaaacaaagtgtaaattatagttaattttttgcataggcaatagaaccaacaagacaatttagtatataggttcacatagacagtacaaccatttaggctcacaaaggttcacatagagacaagaaccattcagcctatttaagactacagaatcacatatacaaaagaagtatcttgatagctaggaatctagaacaatataaaagtcttatagctaaaaggatcaagacgcctaagagagtggtgaattagatttctctaaatcttcttttacaaattaaaacatataatcaagaccactagtcaactgtttatcaactctcaagtacatcactaggaaaacactcttcctcactcttaaatggttccttcagtagttaaaataggtcagagggccactggagcccccgcgttgtccttcgcttaggcgacacgggtggcccccaaaccctagcgtcgccgccccctaaccctccctccctcgccgtcgctggtggagtctaccggaggtcagtgtgggccccaaggatggcgacagtgggacgtccttccttcgattggtctcatgtgctcaaatgtgagagggtttccgtgttgggtggattagtcatggtgcgacggtgggtgggcgcgtgcagtggcgttatctaggcaaacatggccccccacgtgggtgtggcgctatgcgcgcgggccacatggctcgaccacatcttggtgatccacgagctcggtcactgcctctaggacggctttagcgtggcttcctgctccaagtcatcgtgtgcgaactcgtcacctcgcactgtcaaaacggggaagaagatgctgccaaccaacaatttgtggagcttggaggccgagaggagtcggggcggcgacaactgcggtctggtcctacagtggtgctctgaagttgggtggatcggcggcggctgagagcacgtcagcttggggttgcggtggccagcgaatggtcctagtggcgcctgctatggtgcatgcgccggcgccttagttccaccgcatcgcggctgctgctgtcatgtctggtcagtgggggttcgacgccaggtgttgcgggcggcgagttgcaaggcactcacgtccgacgactactagcttcggtggtcacgtttgtcggggctaacggtgactgtcgacaacggctccggcatgcggcagtgtgtcgcacatagcatggtggtgcccgattctgtatgcccagtcggagggggtggcggcgaacgcagctttgcagctgatgcagtagtcggcgcgtcgatgcccctctagaagggtttgtgcggggtgttagggcaacgatgatggcggaggtagtttgctttgacctagagtcttagcctgatgttgtgctaggggacctcttgggcgaaagccttggcgacggtgacgccagtgagcgccgcttaccctattgaggatgtcacattctccagcactgtcttccatgggcaaaatcctaggccatcttggacatgcgacagtagcatccatgacgtcactcccttcctgaaggcatcactattgaaatttcatctcagccacaacgtcgccttttggttcatgctttcgcttctcgatgtccggtatgcggcatgaagtcgaagttgctacttcaggggatgcgacttggcaatgatgacatgaggcaaccctccttctttgtggattagattgcttcagaggttgggcttatgctgagagcgtgggatatctcgaggcttggcaacgacgacgcaccacgatcttcctccatctgtgacaatgtttggatgtagacgtcgtcgggttattctttggccatgtattgcctgtcttggggagtcggagctgctcgtcctttgtgttgatctcatcaacaatgactctggatgggctgtatgtgtgaggctgtcgttgtttgggttgcttgtgcaccatatgtaggttttgggcttagatttctttaaaattgagtcaaattctttttcttgacncattacgtttaaaaaaataggctagagatctagaatgaacgagatgggattatatttataaccataaccattcaaatagctattacaactctagacaaaatttgcattctgcggaccattagaagatcaagcgttggccattgactttggtccggtcagacacacccgtgataataacctcaatgtatcaaatatagccattagagttactacgtgaagtgtatggtctaacacccttctcggaccaatctaatgctcaccaaacctctctggtcactctcttgagaacatcgaattggggcccaatggccagatggtcaccctattcataaggtatggtgctcctgtagaaagaactctagctactacaattgcaccatttggtccaatgatccttgtcggaccagtccaacgcaagctataaccttttcgtctaattttgtagaccatcagacttatgaagatgttcaccaagtggtataatcatgcatccactagcattccacaccatacttacctcattagattcatttaggtcaagctactacttcttaccattttttatcatacggtcaaaggaaaaacaaaatcataaaactactctaagtgtctctcaacttcaatggatatttagaactagtccatacttgaccttatcacccatctttgggaattgaaatgacttccatacttacggtcaaaggaaaacaaaatcttaaactactctaagtgtctctcaacttcaattgataattagaacaagttcatacttgaccttatcatccatctttcggaatcgaaatgactcccattcttacggtcaaagaaaaaacaaaatcctaaactactctaagtgtctctcaacttgaattcatatttagaactagcccatacttgaccttatcatccatctttgggaatcaaaattacttccatacttaggggcatgaaaaccattgattccctaaagaatcaccattattgtaacataatttaatctgcatctgcagaacacgcgttagtcacagtaattgtgtgttgtcattaataattgaaaccactaaaggtctagattctttcgataatattgttgcagaataggatttcaataacattgtttctagaattatctacacatcgatcttgcttcccttccttggagcgagctttttttagacctagcctcttccttggagcggtcatactattactagccccatctccagttcaattgaaaccatagaaagatgaattggttcagtacgtgaactaagataagctcatacatgttaaaaaaggctgaaccattctacctttttatcactgctctagggcttgtagtgatgtgatttatctgtccaagttccaccactgttcatcacatctggctaaaaaaatttagggttcttttggattgtaggaaatatgtaggattttttaaggaatactattcatatggaacattttcatatccttgcatttggttcataggaattatgcacttcattttcataggaatctttttatatgtatgcaattttataggaattttagcatctaccgaaacatctttgtaaatttactatgcactaagtatgataaattctccctcatgagccactatgaatgcgtagtgcaaaaaaaggctagctgtttagttaataaaagacatgtcctattcttagattcctgtatttttttctatgacccatccaaacaaatgtttatacaaaaaatctatattcctaagttttgcaatcgctaccgtatgctattcctatgtttttctattcctatattatttttatattcgtgcagtttaaaagacccttatgcggaaggctcgtccagccagccaggtgcacagcgccacagcccgctgtcaatacccatacagatatgcaagcgtaatttggcgagtggccggcgggcgccgcatcagccatggcccatggctcctgggatgcccggccggtgggcattattggatcaagtgtcacggcgttgccatactatatgatgtatagataatacctaatggtgactcatcctctaggaatctattgatccctatccagcgctagggcacagctgccgaaatctattgcttgctgctgctgcttggattacgaaccatatctaatgacgatgccaccaccgccacgaaataaggttgcatgctacgaatattatccgttcatattcgaatttgatccgtctactagtaatatctgtttgtttccgatatgattatatttgaaaagaaccaagccaacaaccaggttcagcttcccttcattaaaacacaccaatgaaagacatgttaaacatgtcgcgttcctgcgccccagctgcacgaacgcttcacatttaacattccagattctggtggtggggttggtcaagtttatgttcgagcagcacctggatcaatttgtttgggataggtttccgtataataaaaacagaaaccacccatcgctgtggctcgtcccttcgttcgcggtcagggtcgccgcgctcccatgccaatccagctgtccccgaattccagttgatctccggtcacccggagttgatcaacaccaggaacaagtgcgtcccgatcccggtcccggcccggggaaggcgtacacgcgcaggtcgtcctgctcctgaattcctgatccactaaacattggtgagctccttttttttgtggtagagcactggcatatgcctataaaaggtcagctcctggccactctagaccgcacccacacagccagtacccagtagtgctccacttgctagtccactcccctctcagtcgaggcaatggccttcgcttccagtagcttccgcctcgctctgttcttggttctgctggcgtttgtcagcttggcacggcacgccacgggggaggccagcccgagcaggaggctcatggagctgtacaagccaccgcccagcgatctcctaaggtaccacgacggcgccgtgctgagcggcgacatccccgtctccgtcctctggtacggccgcttcacgcccgcgcagaaggccatcgtcaccgacttcctcctctccctctccgccgcgccgacgtcccctgcgccttccgtctcccagtggtggggcaccatcgaccggctctacctatcgaaggcggcggacgcggccgccgtcgggaagagcggcgcgcacggcggcggtggtggcaggaaaggcgctcgggtggtcctggccggccaggtctccgacgaagggtgctcgctggggaagagcctgacgctcgcccagctcccggcgctggcggccgcggcgcgccccgcgaagggcggcctcgcgctgctgctcacggcgcaggacgtgctggtggagggcttctgcatgagccggtgcggccaccacgggtcgtacggcgcgcggccccgcgtggcggcggcggcgtacgcgtgggtcgggaacccgggcacgcagtgccccggccagtgcgcgtggccgttccaccagccgccgtacgggccgcaggcgccgccgctggtgccgccgaacggggacgcgggcatggacggcgccatgatcagcgtggccagcatggtggccggcgcggtcaccaaccccttcggagacgggttctaccagggcgaccgcgccgcgccgcttgaggccgccacggcgtgcgcgggcgtctacggcaacggcgcgtaccccggctacgccggccagctgctcgtggacgcggccacgggtgccagctacaacgccaacggggcgcgcgggaggaagtacctgctccccgcgctgtacgatcccgacacggctgcctgcaccaccttggtttgagcaaacgcgcggcgccgtgttttggcatctgtcaccgtaggtgggcggggatacagtgaagtgataatgcgcttgtgttaggcgcatgtatatatataataattagatggatacccgtgcgttacaatataaacatataataccatgatacaaaaaaaaaaaaaaaatgttgtgccgctaatcaaaatttagcaatctctagaacttgtggtagtcatactacaacaacaaaattaagcccatgaaacaaatatagtagacgagctctatataagaaatattttgatacatctctgatgaccactcaattttaaaagcaacttgtaaatattgtaaagaaggttgagctaaaaaccagcaaactggaatgctacctacagtacatttcaacaggcttaataaatcactaccctggttgaacaagcctaattttggccacttctaataaacaaccatatatacaattgtgtgcactctccaataattttcacgaggtatatattctgacctcgttcgataatcttatccaaatgccaacaaggtgggtgaatgaggagcacaagggctatggacattcagagcaaagcacacaggatacatgcaccctgagcatcatagcaatccaattgtggttcctacttttttatgcaccatacctagaaatagaagacatgcaccttatcagcaaccaatggcagtatatattataataaaagaactctaaaagtctcatcagctgaaatactttatgaactatatgtaaactgggagatggagggaatgatgggagtgacaaatactttgatccaacttaaaaattgcagcagtaataaatatgctcaaaaccttcttaaatactccagcataaaaaatatcacttggtgctccaccatttcaagcaataaggctctctccaacaaggtcatgtaaaaggtcatgttcgatatatttaactcaccgagctcgcccctacacctccagcaaagtcttctatcacatcctttaaaatttggcggcctcttctcatcctctaaatgtagcggctccttctacaattgtaaaattaattgtcttgcaatttggcaatggctttgtctgttcaatattcaatgccatttcaatggta

SEQ ID NO: 2857 - DNA, 2006 bp, Zea mays
  misc_feature (107)..(107): n is a, c, g, or t
aagcaacagtggtagcgctgagaacagtgctccgctagatgtgagagctgtggcaagccctctaaacactgtgcttgtactgttgaattaattgttagtagaataanaattgataatagatgaaaaataggtgtagtaaatgatattttatagttgtagtggggtataagagaagtatttagagggaaccgctgcgagagattgaaaagcaggggatgaaatattaataatgtgacaaaaaaattgatataggggaaactttaggagaaaccagtgtagatagcctaagaaaatagttggttgctgcttgcatgcacgcaaggtgggtggctgcaatcggcgtcgccctcgggtccaaacgcatccagatgtctcccaccgagtcagcacgagagatagcagctccaagggaaggcttcacgaaactaccgtcacacgaggatctcgggcctataaattgtcgaccccgccgcgccgcccggggcacaaacaacgctcatactcatagtcataaaccactcctgcactctcactcgattcacctctaccagcaactcgccacttcctccctgagaaattaaactgagaaatggcaccgcctcacagtcacagaagcttccgcggctggcagaacgcgagccacgtcgcgcttgtgcttgtgctggtgtccgtgctgttcctgagcaaggcacgtccctccgcgggcgccaggagcctgctggagctgtacaagccgccggccagcgcgctcctcacgtaccacaacggcgccgtgctgcagggccgcatcccggtgaccatcctctggtacggccgcttcgcgccggcgcagaaggccgtggtcaccgacttcctccagtcgctcaccaccaccgcctcgccgccgtccccgtccgtgtcgcagtggtggggcaccatcgaccagctgtacctgtccaaggcgcggagcggcggcggcagcgacgacggcagcgcgcaggtggcgctcgtggggcaggccgccgacgaagggtgctcgctggggaagcgcctcgcgctgtcccagctcccgcagctggcggcgcgggccgggccggcggcgaagggcggggtcgcgctggtgctcaccgcgcaggacgtggccgtggacgggttctgcacgagccgctgcggcctgcacggctccgacgccggggccggggccgcctacgtctgggtcggcaacgccgaaacgcagtgccccgggcagtgcgcgtggccgttccaccagccgctgtacgggccccaggcgccggcgctcgtgccgccgagcggcgacgtcggcatggatggcatggtggtcaacatcgccagcatggtcgccggcgcggtcaccaacccgttccgcgacgggttctaccagggcgacaaggacgcgccgctagaggccgccaccgcctgcacgggggtctacggcagcggcgcctaccccggtttcgcaggcaacctggcggtggacggcaccacgggggcgagctacaatgccaatggtgccaacgggaggaagtacctgcttcccgctctgttcgaccctgcaacctctacgtgttcgactttggtttaacgcccaaggaaacagtcctgtcaactgtgtagtaacgctgtgtatatagtatgagtttgataaggagtgtactgtggttagtgttgatatctgcatcataatacaatataaaaaaacatatatgtgtggtgcatgagggagcaatctgccctgaaaaaacactttccaaatcatgcgtctaaatattagcgacccttttggttcctaagtcaaaaatagcgtcgttgtaaggcaggccgctacctgtagcagattgtaaccttagcgtaactatatctcgagtagtgtagcagatcgagtctctcgagtgtggatagcttaaatttctgcctacctgaccagatcaaacaccctctgatcgcctcccgagcttttctgagatcgcacaatctactagtgtgcttaagcaaatgatatttgtttg

SEQ ID NO: 2858 - DNA, 2257 bp, Zea mays
cattgggtacctcgaggccgccccggactcataaaccactcctgcactttcactctatcatcacctaccaggctactagcataacaagtcgccaatccctcccccgagagagtcagaaatggcatcacctcatagttgctttcgcggctggcagagcacgagccacgtcgcacttgcgctggtgtccgtgctgatcctgagctcggcacgtctctccgcgggcggcaggagcctgctggagctgtacaagccgccggccagcgcgatcctgacgtaccacaacggcgccgtgctgcagggccgcatcccggtgtccataatctggtacggccgcttcacgccagcgcagaaggccgtggtcaccgacttcctcgggtccctcaccaccgccgccgcctcgccgctggcaccgtccccgtccgtgtcgcagtggtggagcaccatcgaccagctgtacctctccaaggcgcggggcaggggcagcggcggcggcggcggcggcgcgcgggtggcgctcgtcggccaggccaccgacgaagggtgctcgctggggaagcgcctgacgctggcccagctcccgcagctggcggcgcgggccgggccgaggaagggcgggatcgcgctggtgctcaccgcgcaggacgtgggcgtggacgggttctgcacgagccgctgcggcctgcacggctccgacgcccgggcccccgggaccgcgtacgtctgggtcggcaactccgccacgcagtgccccgggcagtgcgcgtggccgttccaccggcctctgtacggtccccagacgccggcgctcgtgccgccgagcggcgacgtcggcgcggacggcatggtgatcaacatcgccagcatggtcgccggcgcggtgaccaacccgttccgcgacgggttctaccagggcgacaaggacgcgccgctggaggccgccactgcctgcacaggggtctacggcagcggcgcctaccccggtttcgcaggtaacctggcggtggaccccgcgacgggggcgagctacaatgccaatggcgcgaatgggaggaagtacctgcttccggctctgttcgaccctgctacctctacgtgttcgactttggtgtagtaaacaatcctgtcgggattgtgtagcaacactgtgtatatagtatagtatgaggattaaggagtgtactgtgctaagtgttgataactggatcataacacgacataaaaaatagatatgtaccgtccacttttgaagaacttaattacttgttggaccgggggattgcaggcagaaatgatgtaaaaaaacaccagcccatcctagtcaaaaagaactgggcgcgtgaatgcatacacagaattcaattctagccagcgacatcttgtctatcagtcatccttgtgctttcaggttctcaaaaccgttaaaataaattacacactagctagatctagagtacgcaaaccacatgaacccaagaacacagcaaaaacgtcacacttaccggtgaatcgttgaagaacgattagtcgtgcttacatgaggaacgaagaagaacggctagtttttagacacgctaaccaagaaaccatcacacctgtcatcgggggacgacaccgtggatgcaagggttgaagggtatcgccgagttagttgccctaaatcgtccagcatacctagagcaccaatcaaacgataagcaaaggcatatgatcagatgaaggcaaaagagatgtaaaaaaaagagatattggatacctcaatcgccatcctctcatctgtataatataaaaaggggtgattatttcctagcacgaaagaagtccatatgttttggactgaagactcccagatccatgaccagaacacatacattttgcagttttttttaaaaaaataaaggaacgaagtttgaaccattcctagatttcgtcgtcacgtgcacgtgctcattgcgagctttcatacatgacagagtgtcgtctggagaagggtcaactgccagcaagtacagctaggtgactggagggacgtactccctccggtttcacattagttgtcgtttaggacaacgacacggtttccaaaatataactttgaccaatgtttttttgttaaaatacaaataaactcttaatacatttatatttttataaaagtactttttatgacaaattgatgcatataaatattaggttccaaaactaaataacaaaatagttatttgtagtcaaattttataagtttgactcgaactttatc

SEQ ID NO: 2859 - DNA, 1494 bp, Zea mays
cagggagaaaccagggtagatagcctaagaaaatagttggttgctgcttgcatgcacccaagtgggggggctgcaatcggcgtcgccctcgggtccaaacgcatccagatgtctcccaccgagtcagcacgagagatagcagctccaagggaaggcttcacgaaactaccgtcacacgaggatctcgggcctataaattgtcgacctcgtcgctcttcccgccgcgacaacaacgctcatactcatagtcataaaccactcctgcactctcactcgattcacctctaccagcaactcgccacttcctccctgagaaattaaactgagaaatggcaccgcctcacagtcacagaagcttccgcggctggcagaacgcgagccacgtcgcgcttgtgcttgtgctggtgtccgtgctgttcctgagcaaggcacgtccctccgcgggcgccaggagcctgctggagctgtacaagccgccggccagcgcgctcctcacgtaccacaacggcgccgtgctgcagggccgcatcccggtgaccatcctctggtacggccgcttcgcgccggcgcagaaggccgtggtcaccgacttcctccagtcgctcaccaccaccgcctcgccgccgtccccgtccgtgtcgcagtggtggggcaccatcgaccagctgtacctgtccaaggcgcggagcggcggcggcggcagcgcgcaggtggcgctcgtgggccaggccgccgacgaagggtgctcgctggggaagcgcctcgcgctgtcccagctcccgcagctggcggcgcgggccgggccggcggcgaagggcggcgtcgcgctggtgctcaccgcgcaggacgtggccgtggacgggttctgcacgagccgctgcggcctgcacggctccgacgccggggccggggccgcctacgtctgggtcggcaacgccgaaacgcagtgccccgggcagtgcgcgtggccgttccaccagccgctgtacgggccccaggcgccggcgctcgtgccgccgagcggcgacgtcggcatggatggcatggtggtcaacatcgccagcatggtcgccggcgcggtcaccaacccgttccgcgacgggttctaccagggcgacaaggacgcgccgctagaggccgccaccgcctgcacgggggtctacggcagcggcgcctaccccggtttcgcaggcaacctggcggtggacggcaccacgggggcgagctacaatgccaatggtgccaacgggaggaagtacctgcttcccgctctgttcgaccctgcaacctctacgtgttcgactttggtttaacgcccaaggaaacagtcctgtcaactgtgtagtaacgctgtgtatatagtatgagtttgataaggagtgtactgtggttagtgttgatatctgcatcataatacaatataaaaaaaacatatgtgtgtggtgcatgagggagcaatctggcctgaaaaaaactttaaaatcatgcgtctaa

SEQ ID NO: 2860 - DNA, 825 bp, Zea mays
gcggcggcggcagcgacgacggcagcgcgccaggtggcgctcgtggggcaggcccgccgaacgaaagggtgcctcgcttggggaaagcgccctcgcgcttgtcccaagcttcccgcagctggcggcgcgggccggcccggcggcgaagggccggggtcgcgctggtgctcaccgcgcaagaacgtggcccgtggacgggttctgcacgaagccgctgcggcctgcacggctccgacgccggggccggggccgcctacgtctgggtcggcaacgccgaaacgcagtgccccgggcagtgcgcgtggccgttccaccagccgctgtacgggccccaggcgccggcgctcgtgccgccgagcggcgacgtcggcatggatggcatggtggtcaacatcgccagcatggtcgccggcgcggtcaccaacccgttccgcgacgggttctaccagggcgacaaggacgcgccgctagaggccgccaccgcctgcacgggggtctacggcagcggcgcctaccccggtttcgcaggcaacctggcggtggacggcaccacgggggcgagctacaatgccaatggtgccaacgggaggaagtacctgcttcccgctctgttcgaccctgcaacctctacgtgttcgactttggtttaacgcccaaggaaacagtcctgtcaactgtgtagtaacgctgtgtatatagtatgagtttgataaggagtgtactgtggttagtgttgatatctgcatcataatccaatataaaaaaacataaaaaaaaaaaaaaaagggccgccgctcgcgatctagaactagtcctagatcgcga

SEQ ID NO: 2861 - DNA, 797 bp, Zea mays
cattgggacctcgagccggcgggatcactcctgcactttcactctatcatcacctaggagtaccaggctactagcataacaagtcgccaatccctccgcgagagagagtcagaaatggcatcacctcatagctgctttcgcggctggcagagcacgagccacgtggcagttgcgctggtgtccgtgctgatcctgagctcggcacgtctctccgcgggcggcaggagcctgctggagctgtacaagccgccggccagcgcgctcctgacgtaccacaacggcgccgtgctgcagggccgcatcccggtgtccataatctggtacggccgcttcacgccagcgcagaaggccgtggtcaccgacttcctcgggtccctcaccaccgccgccgcctcgccgctggcaccgtcgccgtccgtgtcgcagtggtggagcaccatcgaccagctgtacctctccaaggcgcggggcagcggcagcggcggcggcgcggcgggtggcgctcgtcggccaggccaccgacgaagggtgctcgctggggaagcgcctgacgctggcccagctcccgcagctggcggcgcgggccgggccgaggaagggcgggatcgcgctggtgctcaccgcgcaggacgtgggcgtggacgggttctgcacgagccgctgcggcctgcacggctccgacgcccgggccgggaccgcgtacgtctgggtcggcaactccgccacgcagtgccccgggcagtgcgcgtggccgttccaccggcctctgtacggtccccagacgccggcgctcgtgc

SEQ ID NO: 2862 - DNA, 2906 bp, Zea mays
ctcctgctacgtaaaacataactacaatcaataattaaaatttcaataagcagaattatcaaaaactacatctaaattattatataatctagattatataaaacggaaacaaacctggcagcgcagtcgatagccttctatgcggcaatcatgcccgtgggtcccacgtaatgggtcccgccacgtgcaccaatcgtggcccggcggcgcgcggccccgactttccccattcatcgagtctacgctcttcgtctttctccggtccgaattccccaatcggactctcctcttcttgccggatctccccaccccattccaccccgcccatgggtgcccccacccctcgccgctgacctgtgggtacactgccccctgctcccccgccccgctcccgctcgcccacgcgaaccctaggcagctaggctttgctgctagaagagctccagcgaccgacgaggagaggagaataaagctcaaatcttggatgcgcccgaaccgatggcgacacctgccgcagagaagccggaagatgtagagatccgtgaggtttgggcggacaacctcgagacagagttcgccgtgatccgcgacatcgtcgacgactatccgtatgtggctatggacactgagtttccgggcgttgtgtgtcgtccgctcggcacttacaagtcggcggccgagttcaactacgccactcttaaagctaacgtggacatgctgaagcttattcagctcgggctcaccttgtccgacgagcatggtgggctgccggcgctaggcccagacggtcgtccctgcgtctggcagttcaactttcgaggatttgaccctcggactgatgtggctgcagcggactccatcgatcttctacgccgtagtggtattgacttctctcgccatgctgctgatggagtcgactctcgctgctttgctgaactgctcatgtcctccggcgtagtattgaattcagatgtgcattgggtgacttttcatagcggctacgactttggctacctgctcaagctactcactggcacaaatctccctgatacgctgccaggattcttcgatctcatcaagatttactttcctgttatctacgatataaaacacttgatgaggttctccaatagcctccatggagggctgaacaagcttgctgagctgcttgatgttgcaagggttggaatctgccaccaggcagggtctgattcgcttctgacagcactgtctttcaagaagcttaaagaggcatacttcaacggattaactgagaaatatgctggtgtgttgtatgggcttggctttgagggtgtagagaccacctctgctcactgagtaatggataattaaataaaagatgaactatttatgaaaaaaaaaaaaaaaatttggtgtctttgtctgacaaaaaaaaaaaaaatgcgctggtgaaggtattattttccctctcagttttgatttcccctgcaagttaccttcagctaagctgttctatgatctagattgtggcttgatggaatgtgctgttgaagtttctttgaggcctgtattgatacactgatcaccaagtcaccaactgaagactcaaacattatcgaactctgtaatgctatggtaatcaagtactctacaacaagtcatcaactgctgtgctaaatgttatttggtagcaaaaagaacacttaacttgccctttgatatgtgaaactgaaacccctcagttcttgttttacatggtttctggtgctaccccttgaatagttgatgattttaggcactattctgatttctataccaacctataaaagcaagacaatatgctggacttctgattgtaatatgttatagtgtctatgtagttttgtagttccttaaactcaagcaacatatgccattatcagttttgcaaaattttgggagttcaacaggaagaaatctgataaacaagttcatatcacgaaagaggacttaactgatcagtatgaagagaagcacaacttgcataatgtgataaggaaactccatgacctcacatgatattagatgctttgatcgcttataaaaattctgttctctgtttgtttcagtttggacttattgaatatgatctcttagttgccttgtgtttcattatgctgcagttcatcagttcacagcattctttctttttctgacgcatatcatcatactgatttgcatactgtggagtgtactgtaaaagtttgaatttcgttatggggacatgttcttactagatctcatggtttcatgccacattctgtttcaatgttaactattatgaatacatcttgtacagtgcacaaactgttaaaccatagcagcttgattatatgctgtcatagggaatcttgcttcaatggtattgtcatgatacaggcatgtgccagtgcatggttctctgtttatagttttgttggtattgccaatttcttaactttctattttgtatatagtcacctctttactgcagataacagatgaagaatcagttttcttttccatgtttggattcttcttttcatacttgccttattgttttagatggaagctctcttgttaataaattgaaagtcttacagcattagtcttggaatgtacatttcacttccttgcaccgaaatacctgtgctcatgattactgataaaaaattaatagttgaatattggagaaatctgtttgatctttgtttgtttgtttatttatttccttttttgttgccactgaaaatatgtcatcttcttctcaattgagattttccctgaagtcatatttagattgttgagagaatttgtgctatctaattttacgctgtgaatttgatggaatgcattggtttaacttgatactagttacttggatcaatccaacagggggatcctct

SEQ ID NO: 2863 - DNA, 3467 bp, Zea mays
agctctattcaaagagcgctctaccagtacaactacaaccacactaaaacccaaacaaaacaaacaaaaaaaggaagcaggtgctgccgatatatcgatcgatcgatcatggcggcggccgtggccaagatcagcatggagtggctccaagaccctctgagctgggtgttcctgggcacggtgtgcttggtggtcctgcagcagctgcgacgtcggcggggcaaagcgccgctgccgcccgggcctcagccgctgccgatcgtgggcaacatggggatgatggaccagctgacgcaccgcgggctggcggcgctggcggagacgtacggcgggctgctgcacctccggctggggcggctgcacgcgttcgcggtgtcgacgcccgagtacgcgcgcgaggtgctgcaggcgcaggacggcgcgttctcgaaccggccggcgaccgcggcgatcgcgtacctgacgtacgaccgcgcggacatggcgttcgcgcactacgggcccttctggcggcagatgcgcaagctgtgcgtgatgaagctgttcagccggcggcgcgccgagacgtgggcggccgtgcgcgacgagtgcgcggcgctggtccgggccgtggccgtgggcggcgggagcgggggcgaggccgtgaacctgggcgagctcatcttcagcctgacgaagaacgtgacgttccgcgcggcgttcggcacccgcgacggcgagggccaggaggagttcatcgccatcctgcaggagttctccaagctgttcggcgccttcaacgtgggcgacttcctaccgtggctgggctggatggacctgcagggcatcaaccggcgcctgcgcgccgcccgctccgcgctggaccggttcatcgacaagatcatcgacgagcacgtgaggcgcgggaagagccccgacgacgccgacgccgacatggtcgacgacatgctcgcgttcttcgtcgaggccacgcccggcaaggcgacgggcgccgccgccgctgctgacggcggcgacgacctgcacaacaccctccggctcacgcgcgacaacatcaaggccatcatcatggtacgtacgttacgtatacacacacgtcgtgctgtgcaccatccctcgatctgacctgctgtcagtcacgctaatcacgccaaaaccgtccgttccgagttccgacgccgggaggactgggtgccggccggggttcgggcctcgggagcactgaatcaaaacgcttggctgaagaaacccgtaaacaaaaatacttactatatatatacctaaaatgtgtgacgacgtgtgatgtttgacaaccaaccaatcaggagtgctttgcgtctctgcatgctggtgacaggtgtttgtcgtgttcctgcatgcacgcagcacatgtggatctcttcgcccgccacggagctagattaagtcagggccacgtgtgcgtaactcgatctccagtagtgcatttttttcttcggtttggagttctcttctaccccggccggcttctacgttgacaagctccaaccggccggcccggccggcttccagaaaagcagtacgtgaacgtgacgttcggtaggtgtacttgttatttgtttgtgtcgtcctccttggtgtctggagatcgagtcgattagccagacagaccagacgtagccgcgcacggtcggcttgcttgtgcatggtgagacacgttttctcttttttgttcatacatgcatgtagtactgtgcgcatttaatttgtggccatgcttatgagtcgtctcacactagtactgtacgcatttttaatttgtgcgttggtggattttttttctccccatatatcacgacacgacgcacaaacatttgtctatagtccaactttgcgcgtgacgtaagtcggtcggtcgtcgtacaaagtttggacggccggataccctgcatcgatcgttctccaccctatatacggagctgaaagtaggtaaacgtgatgaaagcatccgagtttgatcgagctagccaaccattggagaccatgcatgtcacttttcggtgcatttttttcgtctaagatagctctgtccaccttggtgcctcggtgcgtgcatgtcaccttccaaagtatataaaaaaaacacatgcatcacccattttctgcagtatatatataaccgcgctagctgccgtaaatatcttgcacaattaaaccgtcatgatttcgcttgtaattaataatctagcattctagcttccgtcatgggcacaactagctagcatgtgcatatatgactgatatgatcatgtgtggcgtggtgtaattaatattcactaaaaacatcataaataaagggtaatatgtacctcaccatcgcgtcgttatgtattttgctgttcttttatgagcagtcaaagctgtaaactaataatgatgatgtatggacgccgcatgcaggacgtgatgttcggcgggacggagacggtggcgtcggcgatcgagtgggccatggcggagatgatgcacagccccgacgacctgcgccgggtgcagcaggagctcgccgacgtcgtgggcctcgaccgcaacgtgagcgagtcggacctggacaggctccccttcctcaggtgcgtcatcaaggagacgctccggctgcacccgcccatcccgctgctcctccacgagaccgccgacgactgcgtcgtggccgggtactccgtgcccaggggctcccgcgtcatggtcaacgtctgggccatcggccgccaccgcgcctcgtggaaggacgccgacgcgttccgcccgtcgcggttcgcgccgcccgagggggaggccgcggggctcgacttcaagggcgggtgcttcgagttcctgccgttcgggtcgggccgccggtcctgccccgggatggcgctcggcctgtacgcgctggagctcgccgtcgcccagctcgcgcacgccttcaactggtcgctgcccgacggaatgaagccctcggagatggacatggccgacatcttcggccttaccgcgccgcgcgccacgcggctctacgccgtgcctacgccccggctcaactgccccctgtactgacgccgtgcacgtggcgcgcggggactgccattctacgcatgcatgcgtttggactttggtgttcatccctggggtggggccgccgtgggggaagttaggagtttggtggctttctagctctgtcttcttgttttctgtttattataaattttcccaacccttccatgcctgatcgatgtgcggtaataattgttagaaaatgtgacattttgtatgtaatcaatctatggggtgcaattgttatctcgtcaaaggacacaccactcgacttgcaccccttcatgtatatatatacatacacgaacatcccctgcaataaagaaatcgctgtcactttctttcgaactcctttccactgttttacaatatgttatcaaccatgtgctcgcgag

SEQ ID NO: 2864 - DNA, 2504 bp, Zea mays
ctaaaaaacgggcttcgtgccgggctcgcgggcttcgtgcttattggacatctatagtctacatcgtccacagtcgtctgctccacctgctccttcctggaaccttctcctcctccacagtccctgcagaagatccgtttcccagtctgttttcttgaaggaacagctccgaccaatcaaattcaaagatctcttgttttaagcacggcgtcccatccatgtctcccgtcaccagtgcagtgagcgactaggactagtgtggtacgctgtgcgcacgcagtcgccggcataaagatccagcttctttttttaccgcctcccgtcccggggacccgaccatggccgccgagccggcggatgtcggcgactccgagcccgagcccttctccccgtcggacttcctcaaccttggtcccccaacgcctcgcctcgacagccccgccctgcagctgcacgacgacgatgacgacctcgtgctcctcttcatctcgcgcatgctcatggaagaggagacggacggcttcttcgagcagtaccacccggaccaccccgcgctgctccaggcccagcagcccttcgccgacatcctcgctggcgccgccgccgccgacggcagccgagggacctctgtagctggctcccctgcattcgccgccaacgctatctggccctacgatccagtccagctctcccagctgcttctttctaggacctacccggccgacacggcggcataccccagcgccgccgccgactcgatggcgtcctctgccgggtccggtgctggcacggtaaacatggacatgctcaacctggcgttcctcaagggcatggaggaggccagcaagttcttgccggccaccagcaacaaccatgaccaccggcgccaagcgacggaaacatgcgacaagcgggtggacgaatcgtcgccgttgctccaacagagtgcaagcaaaggccgcaagaaccacaggcacgctccttattggggtgaggatgaggaggccgagacaggcaggaggagctgcaaggtgatggcggtcgaaacagaggaaagcgagatggtggaggagttcgtccagagcggatacgactcgctgcacgagcagatgatggccatgaccctcagcacggccggcagcaggaaagggaaggggaaagggaaagggagcgccaacgaggccgtggacctgcgcaccttgctgatccactgcgcgcaggccgtggccgccggcaaccgccccagcgccgcggacctgctgggcaagatcagggcgcgctcctcgccgaggggagacgccacgcagaggctagcgcactgcttcgccggggggctggaggcgcggctcgcgggcactgggacccagcagctcacggcggcgacgaagcgcgcctccgccgtggagatcctcagggcctaccagctctacctggcggcctgcagcttcacagcgatggcgtacaagttctccaacctggccatctgcaaggccgtcggcggcggcgggaggaagaaggtgcacatcgtggactacggcgaccactactacgggctccagtggccgtcgttgctgggctactggggtagcctggaggctgggccgcccgaggtgaggatcaccgccatcgacttccccgagcccgggttccggccggatgctcggctccaggcgaccgggcggcggctcacatgcttcgctcggcggcatggcgtccccttgaggttccacggcatcgcggccaggtgggacgcggtttcggtggacgagctgagcatcgagcgcgacgaggtgctcgtcgtgaacggcctgttcagtctcggtaggatgcaggagcaggagcaggacgacgtggatagggatagccggccgagccctagggacactgtcctcggtaacgtccggaagatgcggcccgacgtgttcgtcctgtgcgtggagaacagctcgtacggcgcgcccttgttcgtgacgcggttccgggaggcgctcttctactactcggcgctgttcgacatgatggacgcggtggcggcgcgggacgacgacgaccgcgtgctggtggagcagcacctgtttgggcagcgcgccttgaacgccatcgcgtgcgagggctcggacagggtggagcggccggagacgtaccggcagtggcaggtgcggaacgaacgggcagggctgaggcagctcccgttggatcctgatgcggttcgggccatcagaaggaaggtgaaggacaagtaccacagggacttgttcatcgatgaggatcagcagtggctcctgcaagggtggaagggacgagtactctacgccatgtctgcgtgggctgcaaaatgatacgtacactagtttaacaaagttcaaagaaaacaccattaatatctatggctcatgttcaaaaaacgtttgattccgagaattgtaatctttcttcttcttttttatgaagggacgtagaaagagtatataattaattttatggattacttgtttgactgtcct

SEQ ID NO: 2865 - DNA, 2222 bp, Zea mays
cattgggtacctcgaggccggccgggaacccgccaaaaaggagggaggggatcaccgggacccgggcccgcggcccgcagccagagccgccgccgttccgtatccgtcccgtctccgccgcggcggcgctgacgctaggggttgccgcgcccagcgcggagatgcagcaacgtgcgcgggatggcgagcagcaccgcctgctcgacctcgcagtcgagtccggcttcgaccgcgacctcgccgccagctgcctcgcccgcctcctcgaggtctacggggaggatggtctggatatggttactgtcgacaactgtggcaatgatttccttgcatcactggctgatgccacacaacctactgatgactgggacgatctcaaagggattgagaccgaggcatgtggcaacttgaatgatatgatgatgaagaatgtacctgactgcaatggaggagttgctatagacagccgttatacatccagagagccaaattcgtcctctcaacgtgctccgaatcatcttgaagctttcaaatttgcctctgatgattcagattttgaaatggacaaccttcctgacaagtcttgtagtatgcaaaggcagacacaatcaagaaactctggaatgcagacccgaagctcagcaaaatccacagtgactagggaaaccagcagatatgacccaacgactcccacttcaaatagagagatgcctccagctgcatttcatcaaaggagagaacttctgagctacgagcaactttgttgcctcgatgatgtcaattttgccaatgctgtcatctttggcaacaaaagctttaggcccctgcagtacgaagcttgcagggctgcaatggataaccaagactgtttcgtacttatgccaactggtggtgggaagagtttgtgttatcagctccctgcaacattgcacccaggtgtcactgttgtcgtaagtccgctgctgtcgctgatccaggatcagattgtggcattaacttacaggtttgcagtaccagcagcattcttaaattcccagcaaacttctgctcaggcatctgcagtaatccaggagctaagatgtgggaaaccagccttcaaacttctgtatgttactcctgaaagaattgtcacgaactattcatttatggagaccctaagaggcttagatcagaggggactgctagcaagatttgtgattgatgaagcacattgtgtaagtcaatggggacacgatttccgtccagattaccgtggtctaggttgcctcaagcagaacttccctagggtcccgatcatggctttaaccgcaacagcaaccgaatctgttcgtaaggacgtcctcggtgccttgaggatccccaacgctgtggtactgaagaggagcttcgacagactgaacctcaactacgaggtaatcggcaagacgaaaactttccagaagcagctgggcgatctcctgaaagagcgcttcatgaacgagtctggtatcgtgtactgtctctcgaagaacgagtgtgcagacactgccaagtttttgagggagaaatacaagatcaaatgcgcgcactaccacgctagcctggcagctcgtcagcgaaccagtgtccaggagaaatggcacagcggggaggttaaggtcatctgcgctaccatagccttcggcatggggatcgacaaacctgacgtgcgttttgttatccacaacacattgtccaagtcaatagaaagctactaccaggagtccgggagggcagggcgagatgagcttccggcacactgtatcgtcttgtaccagaagaaagacttcagccgtatcgtgtgcatgttgaggaacggtgagaacttcaggagcgagagcttcagggttgcgatggagcaagctaagaagatgcaggcatactgcgagctcaagaccgagtgccggagacaggcacttctgcagcacttcggcgaacagtacgacaggcgaaggtgccgagacgggcctagcccctgcgacaactgcctcaagacatagtttagggtaataaactatggcgataagaatgccatgacgcttggttatgctctgaacttgtgaggtgtgtgttccacagtacattcgtctgtgtatatgtagcatccatagctcaaacaagtggccgcaactgcactgtgtgtaacgatggtctttgttttcagtggattgtgaggttcatgctttaaaaaaaaaaaaaaaaaa

SEQ ID NO: 2866 - DNA, 1593 bp, Zea mays
  misc_feature (225)..(225): n is a, c, g, or t
ctcatgagccaccgcccctgattctcatttatcttcaacgtcatctaccttatctcctttattcaattttctggtaaattctctcacgtctcctactcctcatcaatatgcaagtgtttcttttctttatttatcttgagcccgagtgatccatggaaaattccatcacatgattttatgtggcttctaagcactctcgtctcatgctccatccacataaacggncacacattttcctgctcgattcttccctgacagtctccaggagccgtatgtcttcatccttccctgctccctcatgttggcccacgccgcttagctcccggaagccttctcctatgcgtctcttctctttgaaatatctcacgtcgtggatgctctgattcttcttgaatcttatccttccaccgccggaccgcccctgactcctttttatgcgcgccggctgctctccctccgcttgctgcgcccatggccgagcggctcccatggcgagctcgccgggatgcccctgctccagcttcctccctgctcggccagaccatcggcctccctctgcttggagctcgtcgccatggtcgttgccttttccctgctcgcgtcctgtgcgcgtcctttagcccttgctcctctggctcggcgcccatctccatggctccctgcgtgtccattcgtcacgctctcctgctccctgttccccttgcgtcccctggatccttctctgcgcccgtgtcaccgtccgccgtcgatcccctcgcgcaggccatgagctgtctgttcgccatagtcgagccgttctcagttgctcgccgccgaagctcccctgatagctgcgtcctgctcgcctttgcgtcgcgcgcatagcgttatgttattcttgcgcgcgcgaagctctttgctcgtcaacgccccagcccggatttcgctttgtcgcccagctcggctctacatctcccatggctgtctgctctagctcgccgtgtccttcgtaaatattttcgcctagctgcacggacctcaccgttgtcttggtcgtcgatgccacgcaactatccacacgtggttgtcttcacggacaccgcttcacactatcactctgtcttcaccatccgtagtgtcatcgtcgggatgtcctagctgcaacaccagcgccctcgatcgtacccaaagctctatattggatttgtcagcgtgctactcgtccgctggttcctcgactttatcgatctcgtcgtcgttcgtgcatccccaagaaatcccaaacgtcgagtgaagacgaagctagccgagtggtattccccaagcgctcgacatattgcctggatcggaaaatcactaccaatctcgcggattcgtgtcagctatggaaacagtacgtgaattaaccacgtgatgcgaaagacaagccaagtcgaccccaagcacgggctaatccgcaagatgaagctgatggaccaacttgaagatggttaaatcaatcaagtgctcgatcgagggatactcgtcaagtggtcgtcgcctaacaacactaacctagtgttacccagtgtaatacccaaaaatgtattcaaagaaagtagagttgatctcctc

SEQ ID NO: 2867 - DNA, 2009 bp, Zea mays
ctcgtccaccgtgaaatcgcgtacgagaatccataattgagcctcgattcactggtaaatcatccgtgaccgtggaaccagatgttcagtccgcaggtaatttttccagatctttgaatcaattcaaccacagtctataatagtttggccaatatcgttttggcacgttctgtttgcatctcatttagacttaaattccagaactcaattatctgtgttctctcgtaaagacaaagtgggaaactagaaaattgtttttctcaaatatctccaccgtataggccatccacatccagtgcatgtgttcagctccctggagatttttattctccacgcgtctgcacttccttgcgatcctctccacgtctggacgtctggtgcatggatccctcgccatcagccttatcccacggctgatttttttgtcttcacaacagattttctttcctcagcctcatcctcacgtctctctctgttagatttttttcaagtcgtgttcatcttctacagccgccgcccctggatttctacaaatccaccaccgagcgttccactctcctcctgagctcctccagccagctcgccctcccaactcctgccgcactgagctcattgcacgctcctgtgcccctgcctcgtctagctccagcgctcggtgtccctcagcccagctgtgtctacgtgctgctcgctccgagctccctgtgccatggcgtcagccgcagttcaccgcgctcggcctcccgtcttgccgcgagtcccggctcgaatctccatggccgcaggcctctggtgccgcgcgcgtgcccttgtcatggtcctgcgcgtcctgcgtcttcttccccgagctcggccgccgagctctctgcgcgcgactctgctcttctgggtgcgcgcctgggtccctgctgagctcggcgtctatctctctatagctctagtttttccccagcacgctttcttccctgctcggccatgggagccgcgccgtcgaccctgcctgaatcccctcggccacgtcttccttcttgctccttgcgcgagccgcaaccctctgaccagtcccagccgaactccctccagtccaaccgctgctcctggctcgcccgtccgtggcggcacttcgtctatagccgctgtccgccgtcgagttcctgtacccgcgcctctggttcgccactgctctctgcgcgcgcgctctgctcggcctctatggcgctcgacgtttagattttctgcgtgcagcttcctcaaatcaccgtgtgcctagctcgctccagctcgccggtcgagtttctccctcgcgttcagacccggccgttaacgcccagtcatgtgttctttttccccagctcggatctcatcagccaccgttctctaacccgtgtctcggtcggcatcgtggagttttggttgattggctcgccgttgacctcgtcggtgtcgtcgaacactcaatctcgttgaaccccgaatcccggacgttaggcaaaaataagcgaggtccgtgtgcatcgctcatcaagtgctcgacacaaagagctgaatcagaatccttgccgtgttcgcggatagcgcgtcagatttagaatggtaagtcgattcaaaatttctgttagcttaattattgaagtagttcgatgaatgtgatgtgcttattttcgtgattttgaagcagtcgtgtcgcggtaggattaaatatatgtgaaatacgataaagttagtaatgcgaaagatagattaagtattttatctggctagctagtaagttcagatgacgttgccgtgccgatttagttgcttaaataaattaatgctttgctagtagacattctaattagcatagtgagttagaaagttataaatgatttctatcagtagtcttgagcttaattatcttagaaacgtgaacctagttttcgttaattgtttggtatagactatagcttagaaaaaatatagaacttatacttagggtgttgttacctgatatatgaattaaattcgtg

SEQ ID NO: 2868 - DNA, 2259 bp, Zea mays
gaccggccactcgtctgacgctacgctgcctactatctatctacctctaccctccctcatcacttgttccactacgaccggccacctagctcgccgcgcgcgcaagcctgcgccaccacccactctactagcttagtctcccctcgtgcagcgcgacgacagccagcaatggccgccgcccagtgaggcagggtcgcagtgacggcacgagacgcacacccacgggcgctggcggcatgccgggcgacgcctacgacctcctgtgcgccgaggacgacgccgccggcagcgccctgctgtgcaccaccgacgacgacgacgggtgctgctccgctgtcgaggaggactcggcggcggcggcggcctccatcgccgagctcatcggcggcgaggcccagtactcgcccaggccggactaccccgacaggctccgctccaggtccatcgacccggccgcccgcgccgagtcggtcgcatggattctcaaggtgcaagaatactatgggtttcttccattgacagcctacctcgccgtcaactacatggaccggttcctctctctccaccgtttgccgcaggaggacgggtgggcgatgcagctgctggccgtgacctgcctctccctcgctgccaagatggaggagaccctcgtgccctccctcctggacctgcaggttgagggcaccagcagatacgactgcttcgagcctgggacggtcggccggatggagctcctcgtcctgatggcgctcaactggcggctccgctcggttactcccttcaccttcgtcgacttcttcgcgtgcaaggtcgacccaggagggaggcacaccaggtgcctcattgcccgggccacgcaagtcattctggctgcgatgcatgacgtcgagttcttggaccactgcccgtcatcaatggcggcagcggccgtgctctgcgccatcggtgagacgccgtcactggagtcggtcagccctggggctgccgtcagctggtgcatcggccttgcagaggaagggatcagcagctgctacagactgatgcagcggctggtgataggcaacgtccggacaagggtcgccagcacgacgaccatggcagcagtgaacctgtgctgctcggatgaggcgctgtcctcgcattcctccgccacctcctcgccacccccggccaagaggaggaagaggtcgccgacggccacgtgaaaactgaagaacgcaagtagataggattatttatacgcttttggggggcagattaacagggtttgatcgatttctttgcagtttgtttgtcgttttttcttctttgtgattctttctcctttttcccccttttgccatttatttgttctgttcttttgggttggatctctactcctcggtggggggattctgcctgcctgctcgaccggcccagtcatcatggcggcctctggcctctgcaccgccagccagtatgtgaaggcgacgagactcgagagagagaaagaaagacagctactacgtataacagacacatctgtgtttctctgtgcaacactctgtggggcttcttcaaccccgacgcagagctgcagagagggaccattgattggtgagcgagggcagccatggcggcagatggagatggagagggaggggggaagaggcaatgagttgcggtggatggatgatgattggtagggttaaatgaggtggtcaaagggccgggcggtcagtgctcctgccaagatgcagccctgcctgcaaagtttctgttcatattcatgagggcaaaaattgtttgtttccgagtggtttgtttgtattttgttgatgccgctgaggcgagggcgtcagagagagagaaagaggggcatgctttgctttgctgtgatgggagtcacatggatatgccctactgtggtggtgctctggagggaaatatttgtccatctccagagctaacagtgtccaagcatggggcttttgggggcccttgctgattgtttgtatctcttttttcttgcttgtgtatcaatgaagattttgccatttgaattggcctgagaagagagtacaagctgaagagagagtttctgtgttctgcctgctgctggattatatgtttgtacctcttccttcttgtttatgtatcaataaagattttgccatttgaattggcctgagaagagagtaaaaaagagataattggtgtttttacctgctgctggattatactgcatggtttagcactgtgttactgctctgttattct
